United States Patent 10,767,156 (POLYNUCLEOTIDES ENCODING BREX SYSTEM POLYPEPTIDES AND METHODS OF USING SAME) - sequence listing, part 6

SEQ ID NO: 2409 - DNA, 4209 bp, Halophilic archaeon
atgactgacgattcactctctcaacggaaggcgcaactggacaaagccgaacgcgaacatctcgaggacgtcgtcgaagagctccgcgagcgcgtcgaggacaacgtccgatatcaactcacgcagaaaggccttgacgacgagccggagggtccggatacgctggacgaggacatcgagcagcttgtcgaagcaatcgaactcgaaggcgtcgacggccacacgtgggacgaggcgttcgagcagtacgtcacgggcgtgggctatacgattgtcaatcgcctggccgcactgcgctgcatggaggttcgaggcttcatcgacgaggaggtcaccgttttcaaggagaatggcctgactcctgctgccgagacgctggtccacgaggagttcctgctggaggacgaagcgattctggaggcctaccacaacgcctgcgacgatctcgccgaggagatcgagatcctgttcgaccgttcatccgcatacagtttgatcgaccccgacgacgacaccttcgaagaactctgcgggatgctcgattccgtcaaggacgaggtgtggcgggccgatgacgtcctcgggtgggtgtatgagtattacaatcgcccggtcgtcgaggcgttggacgccaagaatacccttgaaccggaggacgtcggaccggcaaaccagttctacacgccccactgggtcgttcggatgctcgcggacaactccctcgggaagctctatcttgaagcgaccgaccaagaggaggccatcccggagcccgaagctctctcccccgaagagcgaaaagaccggttggtcacgccggcggacgcccccactgttccggaactctgtacgtatctcattccggacgaagatcctggcgatgccccgaacttcgaccacccacgggaactgcgtgttatcgaccctgcctgtggtagtgggcacttcctgctgtacgccttcgacattctggagcgtatctggtgggaggaaacggacctcgaccgcgctgagatccccgcaaaggtgctagagcacaacctctacggcgtcgacatcgacctgcgctcctgccaactctcggcgttcaatctgtatctgaaggcccgaacacgggctgaggaggaagatggcgacttcgaaattccgaacgttggaatcgtctgcgctgacgcccgtgtcgccgaggttgaggaggctaccgaggtgctagacgatatcaccggcgaggggagcgatctgctggaagcgctggacgatgtgatcgaaacgttccagcacaccgaggcgctcgggagtctgctggacgtaagtgggacattggaagaagcattcgactccagcaagacgcaagcggagctcagtgactacaacgggggcgctcaccagtcgttacattcatttctgaaagcactccgtcgggcagtggaagaccagacaagcgattcatttggtgaacagaacctccgaagcttcctccatctgctggtcctgctgactcaggagtacgatgtttcactaatgaatccgccatatggctcaggtggaaggatgccgaatggcgtccaaaactatgtttcagacacctacaactacaaggaagaatattacatcaacttctttgaggcctgtgaccgtcgaaccaagactaatggtcgaacgggaatgctcgtcccacgctcgtttatgttcctcaagacatttgaggatttcagagaagactttatcggcggccaaggtgcgtttgatttcctcgccgagtacggtatcgatattctcgacaacgcaactgttcggaccgcgggtacagttgtgcgatctggtgtctctggcaatagtgaagggacattccttaggttagaggatgttgaaaaaggggagaaagaagctgcattcctgaaccactcctttggcaattctgaaaaggaggatgtcgagagattatacacccgtgatgtctctgaattcggacttatccctggaaagccgctctcatactgggttccacaaagtcttcggaagatttacgattctgattccgtcctcgacgaggacaacgctgggttaccgaaccggaatgggatcggggatatcaaacagggccttgcaacggcagatgatggtcggttcttgaggaatttctgggaggttaatagtccagatatttgggtaccgtttgcaaaggggggcgtcgactcttggttgctcccgagagttgtcaagacgttatactggggctcgaacggatcagagatcgaccgattcactaattcgtatcctcgtaataccgattattatttttcagacggagttacatttaaccgagttaagacaagcggtcgacgattcggctatcttcaagagggttcaatctttgccgacaagggccctactatatttacctcagttaacccttggagactaatatcttacacaaatagccgactattcacctaccttatgctggcacaaacaactgaaaggatgtgggaggtgggtcaggtttcgaagacgccttggcgtactgaattactgggtattgaggcgcttgaggacttgtcgaaggaggcatgcggactcctgatatccaagcggagatttgattttatttcgccatattacaccaatcctgttcttttggacatcgttggtgttgaagatgatctccagtcatacaatcaccctcaccgcaagcttcaacaagagcttgatcgaggcctctactctgagaatctcagtcttgaggcatcattatcggaattagggacagctgcctcagtccatctcgaacaaattgaagcgagtctacaggactgcgccgatcgaattgatgaggcggtattcaattgtttcgatatttctgaagatcagcgtgagactgtcctccaagagatagctctccgaacaaatgaggatcctcgtgaacgggaagagtacgacccgaaatcaatcacggaacccggagacaagttcccggaaatggtcaaggaccttctcctccacctttcccttcacgcagtcagtagtacagatgacggtattattcccatctcacggattgaaggcgaagacgacctcctcacagagatcgagtctgagttcgagcgggtctggggcgaatacgccgacgctcgcctcgccgaagttgataacgtactcggaagccagagtgctggcgaggaagcataccccaatcttcgaacgtggctcgtggaggatctcttcgactatcacgtctcgaaattcgaccggacacccatcttatggcggttcaccaccgaacgcctcgtttcagatccgagtggagaaggtttcgcctgcctgattgactatcatcgactggatgctgggttgttcgatcgcctccagaaccactacctagaaccacgtaagaacttcctcagcgaacagcggactgcagcaaaccggcggcgcaacgatgattccctgcctacgagtgagcaggcagaggctgccgagcagtacgaccgttatgaaagtggccttgagcagatagaggtactcgaagaacggcttgtagaattggtgcagccctctctcagagattgggatagagaaagccaaaacatggctgaagaagcggctggtcgtgtcgccaagttccgccgtcgaacaaaagaacatctcgaagtcatcgacgaactcgctgcgatggaagatgtcgacatgggcgaactgttcaccgataacttctacgagaaagtcgaaaaccagcgtgaggaatggattaccgcgcttgaagaccttgaaaaggcgttcaacgcttatgcggccgaggcagaccagcccgtggaagcgtacctgtacgacctatttgactactacacggacgatctcctcgggagttcgcactttgcgagtaacggcattctctatatgacctactacttcgatgacttcaagcaggccgatcaggctcggcttgacgacgccggtatctcacggcgacagcggctgatctcccagcttgcgagcaacctagatgagtatattgaactcggcgagtcgatttctgatgactgcaaggaaatttcgtcgaaaatctcgtccgactggactgaccgcgcactctcggagatcacgaccgctggctaccagccaaatcataagcatggggtcgaaatcaacatcacaccgctttcggatgccgaggtcgttccgaaaatcgtcgataatgaggtgctctga

SEQ ID NO: 2410 - DNA, 2502 bp, Natrinema pellirubrum
atggcaagcgattctctctcccaacggaaggcccaactggacaaggaagagcgtgaacacctcgaagatgtcgtcactgagatgcgggagcgcgtcgaggacaacgtcgaattccagctcacgcagaaaggtctcgacgacgagcccgaggatgtcgactcgctggacgaggatacccagcaactcgtagaggcgatcgaactcgaagccgtcgacggcgaaacgtggtctgaagccttcgatcagtacgtcacgggcgtgggctacaccatcgtcaatcgcctggccgcactgcgctgcatggaagtacggggattcatcgacgaggaggtcaccgtcttcaaggacaacggcctgacacccgccgccgaaacgctcgttcacgaggaattcttgctggaggatgaggccatcctcgaggcctaccacaacgcctgcgatgacttcgccgaggagatcgagatcctcttcgaccgctcgtctccctatagcctgatcgaccccgacgacgacacactcgaagaactctgtgcgaagctcgattcagttcccgacgaggtctggcgggccgacgatgtcctcggctgggtctacgaatactacaacgtgaagctgctcgatgagctgcgccgaaagggcgatcgcgaaggcctcgaacctgaagacgtaccgccggcaaatcaattttacacgcctcactgggtcgtccggatgctcaccgacaactcgcttgggaagctctatctcgaacacaccggcgagttacaggacatcgtcgagactcaggagaaattctcccctgacgagcggaagaatcgggcactctctcccgacgagtcgaccgatatcgctgacttctgtacctatctcgtcccttcagaagaggacgaggagccaaccgacttcgatcaccctgaagagcttcgagttatcgatcccgcctgtgggagtggccacttcttactatacgccttcgacgtattggagcggatctggcgcgctgagaccgacttggctaacgaggaaatcccgcggaaggtcctccaacacaacctttacggggtcgatctagacatgcgtgcctgccagcttgcagcattcaatctttacctgaagggccgaactcgagccgaggccgagggtgccgatggtttcgaaatgccggaggtcgggattgtgtgtgccgacgcgaaaattgcggacgtgtccggagttcaagatgtgtttgaggaggtcgcagacagtcgtgccggtgttgaagatacattagagaaaattctagatgctttcgaagaagttcatgggctcggaagcctccttgacgtccgtgggacactcggagagttattcacagatgaaagtggcggacagcaattggctctaactgatgactttaccgctacacacacattaagcaatttcttacacgctctacgtgatgcggtctcagagcatcgggatgaggattcattccttgcacaggatctcaagagcttcattcgtctcctcgacattctctcccaagattatgatgttgcgcttatgaatccaccgtacggtgcgcagggacgaatgccggatttagttcaaaattacgtggaaagcaggtatgagtacgggccagagttttacatcaatttcttcgaagtctgtgattctctaacgacagaggggggacgaataggtatgctcataccacggtcatttatgttcaaacgaagtttccatgaattcagagaggactttatcggggaacgcggcggatttgactttctagcggaatttggcctgggaatattggataatgctactgttcgaaccgtcggcgccgtcgttcgttcgggggcttcacaaaccggtaccggcactttcattcggttacatgatgcagattcccggcagaaagaagaagtattcaccaacgaggtactggctaatactgagtcagaaatcaaacgggtgtataacgtccctcttgctgacttcggaaagattccgaagaccccgctttcatattataccccagatattcttcgggcacttcacgaaaatgatctgaaattagacgctggagccgcaagtattgagggagacagcgtttgtgatgtcaagaccggtttgcaaacaggcgataatgatcggttcattcgaacccactgggaggttcctgactttgatgattttgtcgcctttacaaaaggtggatctgaagcttgggttctcccacagacaagccttgcactctactggggcgacgatggtatggagattaaacggcaggagagctcggtggtgaggaatgagcaatattatttcgatgaggggttgacttggacatacattaaagaagggggtcggaggttcggatatttcccctctgggggaatctttgaccagaaaggaccgatgacctttcctaatgaggatttatctgcgtggacattgcttgccgtgctgaattccgaactcttccacggactgtttttatcgagcgtgtcatag

SEQ ID NO: 2411 - DNA, 1743 bp, Natrinema pellirubrum
atgacacgctatttatcgcttactcctgatcgggaatggaatcctggcgatgttgggagaattccgtgggataaacgtttgcaaaagcaagatgaactggcagccattgctagagaacaatataaattagttctagaagagcgagttacagatcctgtaagtccttactacgggggtgcactgcttcttccacccgaggtgcgcgaagacttcttctatgaccatccacacacgaatgtggctgacgaactccctagcattgagcaaggggaactcgaggcaagccagtccttctcggatactattgaacaggcgatagaggccagagaaaaccgccatgctcatcttaaggagttacaagaaagagccaacgaaatcgtctatgatagcctagatatttcttctgacacacgaaaatccatcgctacagagattaaacttcggggcaacagttctgagtcttcaacgtcaacacaggatccaggagaagtactccgttctgaagttgaatcgctcgttcaccacgtcgcaatgatggttattgacgatgctgaagatggaatcgttcctctagaatccctagaaaacaaacccagtatctacgaacaagttctgtctcgctttgagaaagtatacggtgatcatactgatgaacggatggccgaaatagatgagattctcgggagccgatctagtgaccatgacgcgtatccgaatctgaaaaaattcttgtcagatgggcttttcgaggtgcatattaatcagatggaaaagacgccgatcctgtggcgcctcacaacggatcggctggtttctgattcggatcaggaaggctttggatgttatattgattatcggagtatggactccaatatctttgatcgacttcagaagaagtatttagaggcacagaaagccgatctccgtgaacggcggaatacagcagatcgtagacgtagtgacgaagcattaccgacttcggaacaagcagcagcaacagaggaatacgaacggtgtatgagtagtctctcacaaattgagctatttgaagagactctccaaaatctggccagcagttccccccgtgattggacagagagtgaccaaaaattagcaaaagatcttcttcctaaagtaaatcgtttctatgagcagacccagatgttcctccagacatatgataaacttattgaattaaacgatgaagactggctcgaagatacgtttagccaatctttcatagaaaccattgagaacaataagcaaatgtggctatcctcactcgatgatcttcgtactgcttgcgaagcatatagtactggaaatcatgaaccgattccagcacatttgtacgacctgttcatacacttcgaagatgaattagtcgggtcagtttggccaacaagtacgggcgtcctcgcgatgggatattatcctcagcgagaagcagaaaagtacctcaatgagaatggtgagccgaaagaaaccctatctgatgaaaccgcaatcctcctcgcaagaatagctgctcagttcgatgaatatgaatcgttagccgacgaaatagaatctcactgccagagcctaagtaaccggatttctagcagttggaaacaacgggcactctcagaaataactacgagaggttatcagccaatacataaacacggtgtgagaatcaatattaccccacttgcagaggccgaaatcgttcctaaaatagttaatgagcaggtgatttga

SEQ ID NO: 2412 - DNA, 4278 bp, Planctomyces limnophilus
atgacgatgactcccgacgccaagacgaaactctccaaaaccattcgcgccctgcgcgaacgcctgctcaccgagctgaatgaagcggttgaccgcgagtacaaatttacgctcaaaaatcctaagctcgacaccaaaacgaagatcaaacggcaacggctggaggactggctcgccgagcaggtccgcacgcaaacaggcaaagtcaaacggacgaaagaggtctttcgttccgacgcggaaaagcaggccgcctatacgctgctcaaccggctcgtcctcctgcggatcctggaagccgtcgggttgcggaagcccaaagttgttaccgggggctggaacagccaggggtacaaggactttcgcgaactcgcccaggcactggtccagtccgatgatggcgaaggctaccccttcctgctgcagctcatctttgaagacctcgccatcgacctccccggattatacggctccgccggtgtcgccgatctcattccggttccgtcgcccacgattcgggctgtcgttgaagccctcgatgatgaggcactggagacttgctggactgacgacatgacgctcggctgggtctaccagtactggaacgaccccgagcgggaagcgctggatgccaaaatcaacggcggcggcaaaattgagccacacgagattgcctcaaaaacgcagatgttcaccgaacgctacatggtcgactggctgctgcagaacagcctggggccgatgtggctcgccatgtgtcagaagcatggctggactcccggggttgtcgccgatgggacgctcgaccggctcgaacaacgccgctcggagtggcgcgcgaaacgcgacgccggcgaagtcgcgctcaccgacctcatgccactcgaaaccgacgccgagcggcgctgggcgtattatgttccccagccgattccggaagatgcggtcgatcatgctcccccgtccctccgtgacgtgaagattctcgacccggccgtcgggtccgggcactttctcgtcgttgcgtttgacctgctgtttgccctctacaaagaagaagcgaagcatcgcggacaacaggcgggggagcagtggaccgatcaggcgattgtcgaacgcattctcgaacacaacctgcatgggatcgatctcgatccgcgggcggtgcagattgcggcggcggcgctgtggttgaaggcgcagctcgtcgctccgtcggcccagatcaagcagctcaatctggtggcttccaacctggggatctcgcggctggcggacaacgatccctcgctggtggaactgcggcgggcgatcgaggcggagactggcattccgggcaagctgacgatgcagattgttgacgcactcaagggggccgatcatctggggagtctgcttaagattgatcaggcgattactgaagccatgcattcctttgagaaatcactcgggatgaaggacaaagtcgatcgggtcctgtttggtccggaactcggttctgagatcgtcattcaatcgggcggcgtcgaccgcgcggccacggaagccggcatcctctccgccctcgaaaacttcctcagccggcataccagcagcgaggaactggggctgcggctggcgggggagcaactggcggcgggagtgcggtttgtgcggctggtgaaggagggagcgtacgatctggtcgtcgcaaatccgccgtatcagggaacgtccaagatggcggacgtgaagtacgtcgccacgcactacaagctggccaaggcggacctgttcgcggcgttcctgctgcggggcctgcaactggtccgcgagcacggcgtttcggcgatgctgacaatgcggaactggatgttcatcaagcagtattccgacctgcggcagcacttgcttcagacgtatgacttgcgggcactgggagacttcgaccggggcgcgtttgaagaaatcctcgatgaagtcgtggcagtcgcggcggcctgcttcgcgcgggcaccgcaccgtagtgagagcgtggctcagtgcccgacgccgcgtgaggatcggtcgcgggataacgaacggacaaaacgaaagcgggcggcgacgctctgccaagtcggccgccacacgttcgaccccgccgccctgaaagtcgtccccgaatggcccctcgtctactggtgggatagggcattcttaaaagcatacagcgaagttggcacggtgggagccaatagccccgcacggaagggcgtttgcacttcgaataatggatggtttatccgccggccatgggaaatctcggtaaacagaatccgccatcctcgaagtgtggacccgacttgccattgggcaccctatgtaatgggggctgctggtaaagcttggatcgaaccagtctcgtttgctctcgaatggtcacgccatggactcatggtcaaagtgttgaacgactatatctattcaagctattcgaggaccatacagaatcagcatttgtactttcggaaaggcgtcgcgtttacaactattggctcagcattcacaggacgctcttttcgagttccgtcaatctttgacacgacaggatgcagtgtcttcggggcagacatcgcgaatacgacggccttgttcaattcatcgaaggcgcgatcagtattgaccagcttaaaccccacgattcactttacaaatggagatgtcaatcgcttaccgctatttccgatcgagaatgctgacgacgtcttcagtcttgtcgagacagcattcacgaaccacgaatctcaccgcgagccgtccgtcgagttcaaacggccggggccgtcgccgtggcggcaggctcaggagtgggcgcagctggcggtggatcggcccgagggagcgccgctgccggagtatattgaggaactcgatcccgagccgccgaccgatcatctcagcttcgccctcggcgtcgccctcggccgcttcggtgcaggcggcgaaggaattcttgatccgaccaaagacgacctctccaaagcactgccagcgggcatcctgttcctcgacggggctttgggcgatgacgaccgccgcgactctctcggtcatcacgccgcccagatcattcacgacaactggagcgaatacggaccgcagatcgacaagcggcgttcgctgcgggactggctccgcgaaaagttcttccccgatgttcacaaggggatgtacgagaaccgcccgattcactggccgctttcgtctggcaagaaaacattcgtcgcctgggtgacaatccaccgctggaacgaccagacgctacgggtgctgctggccgatcatctggaaccggccctgaaacggctcgacggcgaaatcaccgacctcaccgccgcccgtaacagtgccgacaggaaacaggcccgcggggccgaagaccgctacgccgacgtgaaagcctggcgcgacgaactggcggagttcattcaccacgtccaggaatgcgccgaacggggccccgagcctcccgatgcgaagaagccggaacgggaagtcgacgcccgttacattcccgacctcgacgacggcgtgatgatcaacagcgcggccctgtggccgctgctcgatccgcagtggaaagaccctaagaagtggtggaaggaactggtcgctgcccaagggaaaaaggactacgactggtcgcatctcgccatgcggtactggccgacccgtgtggatgaaaagtgtcaaaaagacccgagtctcggcgtcgcccacggctgtttctggaagtatcaccccgcgcgagcctgggcctgggaactgcgtctgcaggacgaaatcggcccggagtttgagatcaaggaagcctcctatcgaggtgacggcggcgactctgaacaccgtatcaattacctgcacaaggagccgaccgaagctctggcagcgattgaaaaggaagtcctgcgtcgcaaacggaagcagaagcaaccgcagtcggaactgacaattctggaacccatattgtggtccatcgttccggacgagtgctgggaactggagttgaggctgaccgaaaaacagcaggtcgagtttcgcttgctcgctcccgatgaacctgagtgccgtgccaggtttgagcaggctcatccggatcgagtgaagtcccgctgcgccctggtgagcaagttgagtccgccagatctgtacgtggatctggaagacgaggatgaagcggcgagtgccgacgccgaagatctcgatacggaggatgccgacgcgattgatgccaacacaggggaggtggaggcatga

SEQ ID NO: 2413 - DNA, 3975 bp, Anaeromyxobacter dehalogenans
atgcccacgctgacccccgacgcgaagcagctcctctcccgcaccgtccgcgagctgcgggcgaggctgctgcgcgacctgaacgatgaggcagagcggcggtaccggctgtcgatcccgccggagaaggcgaagctcccggaggacctgcgccggaagcgcgagcggctcgacgcctggctcgacgagcgcgcccggaccgcgaaccccaagaacaagagggagatggagtccgcccgcgcgcgattcctcggcgacgccgtgaaggaggcggctgcgacgctgctgaaccgcctcgtgctcctccggcacctcgaggcgctcggcctgcaaaagccggtgttcgtgaccggcggctggaactcgaaggggtaccgcgagctgcgcgagttcgcaccggcgctgctcggggacgagaccgaggggtacgcggcgatgctgcggctcgtgttcgacgagctcgctctcgagctgccgggcctcttcggcgacgtgggcctcactcggctgttcgccgtcccgcctgcgacgctccgcgaggtggtggagcggctcgacgaccccgggctcgagccggcctggacggacgacacgacgctcggctgggtataccagtactggaacgatccggagcgcgaggcgctcgatgcaaagctgaacgccggcgggaaaattgagccgcacgagatcgcgtcgaagacgcagatgtttacggagcggtacatggtcgagtggctgctccacaacagcctcggcctgacgtggctctgcatctgcaataggaacggctggaccgcggatgccgaagccgtgctttccgtgctcgatgcccggcgtgcggagtggcggaagaagcgtgaggccggcgaggtcgcacacgacgccctgatgcccatcgagggcgagctcgaggagcactggaagtactacgtaccgcaaccgatcccggacgaagcggtggcgagcgcaccggcatcgatccgcgcgctcaagctgctcgaccccgcctgcggatcgggccatttcctcgtgatcgccttcgacctgctcgcggggatgtaccgcgaggaggcccggcaccggggcgaggtatggagcgaccgggaaatcgcggaggcgatcctcgagaacaaccttcacgggatcgacatcgatccgcgagcggttcaaatcgccgcagcggcggtgatgctgaaggcgaagcggcaagcgaaggacgcgcggccgaagcgggtgaacctggtcgcgccggtgcttcggctcgggaacctgcctgacgacgatccggcgctcatgcggctgcgccgcgaggtcagggcggaaactgggattcccgaggagctgaccagccggatcgtgaaggcgctcgcgggagtcgatcacctcggttcgctgctcaaggtggacgcaacggtcgatgaagcgattgcagacagcgagcgcatcttgagaccaggagcgcagctcgaactgggcggagatgcaggaaagacgctggagcgtagcccgaatgaagtccgggctgcgttgcacgagaagctggagcagttcttaaggcagcattcgggagaagaagatctcggactgcggctggatggggagcagctcgcagcaggaatacggtttacccgcgcagcgagagaggcgagctacgatgtcgtcgttaccaacccgccgtaccaggggacggcccgtatctctggtgcagaatactatgttcgagagtatccgcgcgccgttgccgatttgtatgcggctttcatggagagagcgcttgtcctcgcgcgtccgcacgggatagctgcgttggtcacgatgcgtggatggatgtatctggcccagttcgaggagttgagagccgcgttgctggattcgtgcgacatccgctcactagccgacatcggtacgggcgcgtttggttcgcgctcaatggacgatgtgatctcgtccgcgatggtggtcgtccgccgggggaggcccgatggtaaggctatcgctcttcaagcggccccgctggccgacgccagccgtgattccggcaaaccgttgcggcgggccgcggcgttgctgtgcgggcaaggaagatacgagttcgaggccgggtggttcgaagctgttgaaggtaggccgatcatctactggtgggataagggcttcctcgcgcgataccgggccgcgaagaagctcggggaagtggctccggggcgcaacgggatgtctacgcaggacaacgttcgattcctgcgcaagtggtgggaggtgaggacggaagatgtcgccgtaacgcgcccgctgttacgtcggaacggttttgggctcgcgagatgggcgccatatgtgaagggcgcagcgggccgccaatggttcgagccaatgaccgacgtcgtggattgggaaaggttcgggcttgctccgaaggtgttttgcgaacacctctacgggagttactcgcgcactatcaagaacgagccgctctacttccgtcggggcattgctttcactgtgattgggtcctcgttcggggcaagggcgcatcgcgcggagagcgtattcgggcacatgggggcgtcggtgttcccggacgacatcccgggtgtgctctgccttatgaatgcttccgtatcgaagtacgtcctttcgtcgctgaaccccgggttgcattttctcgtgagtgacgtgaatcgcttgccagtgtttgaggttccggactctgcgaagatctacgccgttgtggaacacgtgtttattgaccatgagagcggacgtgaagcgtcttccgagttccgacgcccccagccctctgaatgggagtacgctcagtcttgggcgcagagggcagtggatcgaggtcctcttgaagcgttgccaccctattcaccagaacccgtgccggccgctggcatcgatcatctgtcttacgcagtgggtgtagcgctgggtcggttcggttctaaaggcgagggggtactaaccgaatcgcgtgggagcgcgcttccgctaggaatgttgttcatctccgcggcgttgggtgacgggtctctcgcgcacgccgcatgtgcctcgctacgcaacgcgtgggtggaacaccaggccggcgactgcgccgatctctgtacttggctccgcaccggcttcttcaagcaccacaagtcggtctacgagaaccgccccatctacctcccgctctcttcggcgaagaagagcttcgttgcctgggtgagcattcatcgttgggacgcgcagacgctctcgaacctcctcgcggagcacctccaccccgagaagcgccggctggagggcgagctcgaggacctccggcacgcgcgcgcgaagggagagaagagcgggaagggcaaagccgagaagcgctttgcggatgtgtcgaagctcctcgaggagctgaccgcgttcatcgatctcgtgacggaatgcgcggagcgtggcccgccgccgacgtcgcccgacgagccgctgcgcgagcgggatgcgcgctacgagatggacctcgacgacggcgtcatggtgaacagtgccgcgctgtggccgctcctcgagccgcagtggaaggacccgaagaagtggtggaaggaactcgccaccgcgaacggccgcaaggattacgactgggcacacctcgcgaagcgctacttcccggagcgggtggagaagaagtgcgtcgaggatccctcgctcgccgtcgcacacggctgcttctggcgcctccaccccgctaaggcgtacgcctgggagcttcgcctccaggacgagattcggcaggagttcaccatcgacgagcccgggtccgaaaaggcgcgcgcggcgttcctaaagtcgcacgcggacgaggccaaggcgatccggctcaaggagcaggagcgccgcgagcgaaagtcgcggaagagtgatcccgaggagaacctgtcgctctcgctagagtcgtccgaggtcgaggcggaagccgaggaggtcgagtga

SEQ ID NO: 2414 - DNA, 4494 bp, Haliangium ochraceum
gtgaccatgacgcccgaggccaagcgccagctctcgaccgccatccgcggcctgcgcgcccgtctgctcgacgacctgcacgacgccaccgagtcggcctatcgcatgggcgtgcgcgcccaggacgccggcctgcgcgaggccccgcgcgcgcgccgccgccgcctcgagacctggatccgcgatcaactccgcgcccagcccaacgccgccgacgccgacgccgacgccgcgcccagcaagaccagcaagaccagcaagaacgccaagaagaccaaggccgccaagaccgccgccaagagcgccgcccccgcgcgcgacaaagacgccatccgccgcgacgccgagcagcaggccgcctacaccctgctcaaccgcctggtcgtgctgcgcctgctcgaggccgccggcctgcgcaaacccgccgtgctcaccggcggctggagcagccccggctactcggccttccgcgacctcgcgcccgccctggtgcggcgcctgcacgaagtcgacgcccacgagcaggacgagagcgagggcttcaccttcctgctcggcctcatcttcgacgacctcgcccacgacctgcccggcatctacggccccgccggcgtcgccgagctcatccccatcccggccgccaccctgcgccacatcatcgagaccctcgacgaccccgcgctcgcctcgtgctggcacgacgacatgacgctgggctgggtctaccagtactggaacgaccccgcgcgcgaggccctcgacgccaagctcaacgccggcggcaaggtcgagccccacgagatcgccagcaagacccagatgttcaccgagcgctacatggtcgactggctgctgcaaaacagcctcgggcccatgtggctggccatgtgccagaagcgcggctggacgcccgcgtgccaggccgatggcaccctcgacgcgctcgagcagcgccgcagccagtggcgcgcccagcgcgaggccggcgaggtcgagcccaccgcgctcatgccgctccacggcgagctcgagcagcgctgggcctattacgtgccccagcccattcccgaccacgcggtcgaacacgcccccggcagcgtgcgcgagctgcagatcctcgaccccgccgtgggctccggccacttcctcgtggtcgccttcgacctgctctttgccttgtatcaggaggaggccgggcaccgcggcgagcacgggcacgagcgctggcgcgatgacgccatcgcctgcagcatcctcgagaacaacctgcacggcatcgacatcgacccgcgcgccgtgcagatcgcggccgccgcgctgtggctcaaggccaagaagcgcagccccgaggccgagcccgcgtgcatgaacctggtcgccgccgacctgcgcctggccgcgctgcccgagcacgaccgcggcctgagcctgctgcgccgcgaggtcgagcgcgagaccggcatgccggccgcgctcaccgaccgcatcatcgaggccctgcgcggcgccgaccacctcggcagcctgctgcagatcgaccgcgcggtcgacgaagccatccgcgaacacgagaccgagctgggccggctgcaacccgaacagggcgagttctggaaggagctgggcccggagcggcgcgccaagatctcgaacgaagaggcgcgcgccggcattgtggcgcgcctggagcgctttctcgagcagcgcggcggccaggaggacctgggcctgcgcctgcgcggcgaccagctcgcgcgcggcatccgctttctgcgcatgatcgagcccggacgctaccacctcgtggtcggcaatcccccgtaccagggcacctcgaagatggccgacaccgcgtacgtgcaagcccactacccgcgcggcaaggccgacctgtacgcggcctttctcgagcgcggcctgcagctcgtgcgcgcgggcgggacctcggcgctgctgaccatgcgcaactggatgttcatcaagcagtactcggatctgcgccagtggctgctgaagagctacgatttgcgcgcgctgggcgatctggcgatcggcgcctttgatgaggtccccaatgatgtgctcagcgtggtgatcagcgtgtttcgccgggtcgagccgcagccggaagcgagcgtagcccagcagcccacgccgccggatgaccgctcgtacgatcggcaacgcacgctgcgcaagcgcgccgccaccctgtgccacgtcggccgccacgccttcgacccggccgccctgcaggtcgtccccgagtggcccttggtctactggtggtccgagaagtcgctacgcgaatatcagattggaccactgattggtgaggtggccccagctacatttggcgctaccacgggcaataacgtcaggttccttcgattcgcttttgaagtacctcttctgatggttgacccacctgagtggaaaactgcttgggttccgttcatcggaggcgcgaaagggcgagcctgggtcgaagagttgcgtgaggcgatgcattggaatgcgctcgggttggagtacagagtgttttgcgagcgcagtttgggagccaacttccggagtccaagtctccaatttaaacggggggtggctttcgcgatgatcggtgatagcttcagcgctcgagtccatcgttacgctagcattttcggcgatatgggatcatcgatatttcccgattataatgccactgcggtatgcgcgatgaactcagcgagatcgcgcaatgttttaagttctttgaatccaagccttcatttcggcgtcggcgacgtcaaccgcctgccgctcttccctgttgccaacgctgacgaaatctacgccacgatcgagcgcgccttcaccgaacacgagtcccaccgcgagccctcggtggagttcaagacgcccggcccctcgccctggcggcacgcccaggactgggcccaggccgcggtcgatcgcgccgagggcgcgccgctgccgccctaccaggccgagcccgaccccgagcccgccagcgcgcacctcagcttcgcgctcggcgtcgccctgggccgctttggtgcccacggcgagggcatcctcgacccggccacggccgacctgagccacgccctgccggccggcgtgctgttcctcgacggcacgctcgacagcagcgagcagggcgacggcctcggacacccgtcctgccaagacctgcaccgggtgtggcgcgagcgcggcggcgacatcgaccccgcgttcgatctccgcagctacctgcgcgtgcgcttcttcgacgacgtgcaccgccagatgtacgaaaaccggcccatccactggcccctgtcgagcgagaaaaagaccttcgtcgcctgggtcaacatccaccgctgggacgcccagaccctgcgcgcgctgctggccgagcacctgcaccccacccagacccggctcgaaggccagctcaccgacctgcgcgcggcccgcgacggcgccgacaagagcgccgcgcgcgcggccgagaagcgctacgccaagctcgtgggctggcgcgacgagctggccgccttcgtcgccgcgctcacccagtgcgccgagcacggcccgccgccgagcgacggcaaatgcccgccgcgccaggtcgacgcccgctacgcgcccgatctcgacgacggcgtgatgatcaacagcgccgcgctgtggccgctgctggcgccgcagtggaaagacccggccaagtggtggaaggagctggccacggccaagggcaaaaaggactacgactggtcgcacctggccatgcgctactttcccgaccgcgtggaccaaaaatgccaggccgacccctcgctgggcgtggcccacggctgcttctggcgctaccacccggcccgcgcctgggcctgggagctgcgcttgcaagacgagctcgagcccgcgttccagatcgtcgagccgccctacgcgccgcccggcctggccggcgacgacgccagcaccggcgaccccggtcacgaggcgcaccgcgccgcctacctgcgcgagcacgccgaagaggccctgcaagcggtcgaaaaagaggccctgcgccgccgcggccgcggccaggacgccgccgccatcgccgagctggcgctgcgcgagcccggcctgtggagccggcatccggccctgtgctgggcgctcgaagacaccctcatcgccaagcagtctgcgccgtttcgcctgcgcgcgcccgacgaagccaaggcccgcgccgcctacctggccgcgcatccccaggccgccaaagcgcgcgcgcgcctgctcgacgagctgcaacccagccagaccgccctggccatcgccgacagcgacgccggcaaaacggccggcaagaaagcaggcaaaacggcaggcaaaacggcaggcaaaacgcccggaaccaagacaggcaagaaggccgggaaaaagcccgcgggcaagaaagccggcaagaaagccggcaagaaagccgccggagacgcctcgtga

SEQ ID NO: 2415 - DNA, 4455 bp, Haliangium ochraceum
gtgaccatgacgcccgaggccaagcgccagctctcgaccgccatccgcggcctgcgcgcccgtctgctcgacgacctgcacgacgccaccgagtcggcctatcgcatgggcgtgcgcgcccaggacgccggcctgcgcgaggccccgcgcgcgcgccgccgccgcctcgagacctggatccgcgaacaactcagcgcccagcccaacgccgccgacgccgacgccgcgcccagcaagaccagcaagaccagcaagaacgccaagaagaccaaggccgccaagaccgccgccaagagcgccgcccccgcgcgcgacaaagacgacatccgccgcgacgccgagcagcaggccgcctacaccctgctcaaccgcctggtcgtgctgcgcctgctcgaggccgccggcctgcgcaaacccgccgtgctcaccggcggctggagcagccccggctactcggccttccgcgacctcgcgcccgccctggtgcggcgcctgcacgaagtcgacgcccacgagcaggacgagagcgagggcttcaccttcctgctcggcctcatcttcgacgacctcgcccacgacctgcccggcatctacggccccgccggcgtcgccgagctcatccccatcccggccgccaccctgcgccacatcatcgagaccctcgacgaccccgcgctcgcctcgtgctggcacgacgacatgacgctcggctgggtctaccagtactggaacgaccccgcgcgcgaggccctcgacgccaagctcaacgccggcggcaaggtcgagccgcacgagatcgccagcaagacccagatgttcaccgagcgctacatggtcgactggctgctgcaaaacagcctcgggcccatgtggctggccatgtgccagaagcgcggctggacgcccgcgtgccaggccgatggcaccctcgacgcgctcgagcagcgccgcagccagtggcgcgcccagcgcgaggccggcgaggtcgagcccaccgcgctcatgccgctccacggcgagctcgagcagcgctgggcctattacgtgccccagcccattcccgaccacgcggtcgaacacgcccccggcagcgtgcgcgagctgcagatcctcgaccccgccgtgggctccggccacttcctcgtggtcgccttcgacctgctctttgccttgtatcaggaggaggccgggcaccgcggcgagcacgggcacgagcgctggcgcgatgacgccatcgcctgcagcatcctcgagaacaacctgcacggcatcgacatcgacccgcgcgccgtgcagatcgcggccgccgcgctgtggctcaaggccaagaagcgcagccccgaggccgagcccgcgcgcatgaacctggtcgccgccgacctgcgcctggccgcgctgcccgagcacgaccgcggcctgagcctgctgcgccgcgaggtcgagcgcgagaccggcatgccggccgcgctcaccgaccgcatcatcgaggccctgcgcggcgccgaccacctcggcagcctgctgcagatcgaccgcgcggtggacgaagccatccgcgaacacgaacacgccctgggccggctcagccccagccaggggcacctgttcgagggccacgggcccgcgcagcggaccttgatctcgagcgagcaggcacgcgccggcatcgtcgccaggctggagcgctttctcgagcagcgcggcggccaggaggacctgggcctgcgcctgcgcggcgaccagctcgcgcgcggcatccgctttctgcgcatgatcgagcccggacgctaccacctcgtggtcggcaatcccccgtacttggggaccgggaagctccgcgatagcgaagaattcaagcgctcctatcccgatgcgcccatggattacttcgctggattcttcctccgcggggtcgagtttctgcgtcctggtggggcgtgcgcgttcatcgcgctcagtaactggatgtttctgcggacatacgaaacatttcgcaagcgaatgctcgaaaaccatctgggtgtgttggcagagctgggaaaagcggccttttcgaccggcggcacattgatttcgactgccatggcaatgttccggcgtttgccgcctggcgaagcaaagtcactagggtttcgcaccttcgaggactacgaagtcaggcgggatgaagcgcagcctgtgcgtacagaatgcgcattgctgtgccacgtcggccgccacgccttcgacccggccgccctgaaggtcgtccccgagtggcccctggtctactggtggaacgataaaacattacacgagtatcgtagttctccgttgcttggagagcttgcccccgcaacttttggcgccacgactggcaataatgttcgctttacccgattcgtgttcgaaatctcctcacagtcaagcgacgctactatgctcgatgttggctgggttcctttcatcaatggtgccaaaggacgagtttggtttgaagaattgcgcgaggcgatgcattggcaaaacgcaggtttgacctatagggtcttctgcgagaccagtacgggggcgaattttcgaagtccccaccttcagtttcgtcgcggagtcgcattctcgatggttggctctgagtttaccgcccgtgttcaccgctatcggagtatcttcggtaataaagggtcatctgtattcccggacgatcttgtgggggcggtttgtgcgatgaactctacgcgcgcacgcgagattctccagtccctcaatcccggcatcggcttcgaagtcggcgacgtgaatcgcttgccgctgttcccgatcgccaacgctgacgaaatctacgccacgatcgagcgcgccttcaccgagcacgagtcccaccgcgagccctcggtcgaattcaaagctcccggcccctcgccctggcggcacgcccaggactgggcccaggccgcggtcgatcgcgccgagggcgcgccgctgccgccctaccaggccgagcacgaccccgagcccgccagcgcgcacctcagcttcgcgctcggcgtcgccctgggccgctttggtgcccacggcgagggcatcctcgacccggccacggccgacctgagccacgcgctgccggccggcgtgctgttcctcgacggcacgctcgacagcagcgagcagggcgacggcctcggacacccgtcctgccaagacctgcaccgggtgtggcgcgagcgcggcgccgacatcgacccggcgtccgatctccgcagctacctgcgcaccggcttcttcgacgtgcaccgccagatgtacgaaaaccggcccatccactggcccctgtcgagcgagaaaaagaccttcgtcgcctgggtcaacatccaccgctgggacgcccagaccctgcgcgcgctgctggccgagcacctgcaccccacccagacccggctcgaaggccagctcaccgacctgcgcgcggcccgcgacggcgccgacaagagcgccgcgcgcgcggccgagaagcgctacgccaagctcgtgggctggcgcgacgagctggccgccttcgtcgccgcgctcacccagtgcgccgagcacggcccgccgccgagcgacggcaaatgcccgccgcgccaggtcgacgcccgctacgcgcccgatctcgacgacggcgtgatgatcaacagcgccgcgctgtggccgctgctggcgccgcagtggaaagacccggccaagtggtggaaggagctggccaccgccaagggcaaaaaagactacgactggtcgcacctggccatgcgctactttcccgaccgcgtggaccaaaaatgccaggccgacccctcgctgggcgtggcccacggctgcttctggcgctaccacccggcccgcgcctgggcctgggagctgcgcttgcaagacgagctcgagcccggctttcgcatcgtcgagccgccctacgcgccgcccggcctggccggcgacgacgccagcaccggcgaccccggtcacgaggcccaccgcgccgcgtacctgcgcgagcacggcgaagaggccgtccaagcggtcgaaaaagaggccctgcgccgccgcggccgcggccaagacgccgccgccatcgccgagctggcgctgtgcgagcccggcctgtggagccggcatcccgccctgtgctgggcgctcgaagacaccctcatcgccaagcaaggcgcgccctttcgcctgcgcgcgcccgacgaagccgaggcccgcgccgcctacctggccgcgcatccccaggccgccaaagcgcgcgcgcgcctgctcgacgaattgcagccgacccagaccgccctgaacatcgcggccggcgacgccggcaagaaggcaggcaagaaggcaggcaagaaggccggcaagaaggccggcaagaaggcagggaaaaagcccgcgggcaagaaagcgggcaagaaagccggcacgcccgccgccggagacgcctcgtga

SEQ ID NO: 2416 - DNA, 3696 bp, Burkholderia thailandensis
atgatcgatcgcgcaaaactgctggcggaccttaagctccaggttcgagccttggaggctgacctccggcaacgctttgttagcaacgctagtgaatacaaatcgcggctcaccgccgaatggcaagccgcgcgtgacgccgggcgcacatcagaggacgtggccatttgggctgaagcgcaattcacgcaatcggcggtggcgtgggtgcttgcttgtgtgttcgtgcgcttctgcgaagacaatgatctgctcgacgccccgttgatttcgggcaccgacggtcggggacaatccgccgtgtcacggcaggaggccttttacctgcaaagtcctaccgcatccgacaacgattaccttcgtgaggtattcgccgtggcagggcgtctgcccgggctgtcggacgtcctcaaagttcaaagcagcctgctgcttgcgccggtgtcggccgacatgggcaagcagctggtgcgcttctttcgtgccacaaacgcggacagtggctcgttggtgcatgattttgccgacccagagtggaacacgcgctttttgggcgacctttaccaggacttgtctgaggctgctcgcgaacgctatgcgctgctgcagacgccagaattcgtcgagtcgttcatcctcgatcgcacccttaccccggcgctcgacgtctataccctggaagaagtcgatctgatcgaccctacttgtggttccgggcacttcttgctcggcgcattcgagcgcttagctccgcgctggctgcgcaagcggccagaaaatgtcaatctagccctccaggaggcgctgggacgcattgcgggcattgacctcaacccttacgcagtggcgattgcgcgtttccgcctgctgatcgctgcactaaagatggcgagcgtcaaaaaattacggctcgctccggactttcatttgcacgtcgaaacgggtgatagtctgctgcacggcttcgaccagcgggactacgcgggggcacaggtttctctcgcattggacaccccgcaggagaacttggccgcggtcgctgaccacttgtatcggcacgccttcgcggctgaggacctgacggccacgaatcggattctggcccgaaaatacgcggcggttgtcggcaatccaccttacattgcagtcaaggatcgcgctgtctcggccctgtatcgagagcgattctccagctgccacggaaagtacgccctcgttgcgccattttgcgagcgattctgggcattggccaagccgctcgataacgctcaacgtgcagggtacgtgggattaattgtcggcaacgccttcatgaaacgtgaattcggaaaaaagcttgtcgaagaattcttcccttcagtggatctcacgcacgtaatcgatactgctggcgcgtacatcccgggacatggaactcccacagtcatcctcgcggggcgcaaccgccttccagcgagcccggtcattcgcgctgcgatggggattgaaggggagccaagcaaacctgacgacccttcgcaaggaatcgtttggagggcgattgttgaccagatcgaccagcgtgattcagagtccaaatggatcagcgtctcggatattgataggagcacacttgcgaagcatccctggagtatgggaggcggaggcgcatcgagcctgaaagaagctattgaagacagcgcggaaaaaattctggctgatttcgctgattcgattggtattacgtcttttactctagaggataacgcatatattcacgactcgcagacgtttcggcgtcaaggagttgaagttcaattgcttcgcgacatggttgtcggggacgaagtgcgggattggttcaatgattgcgaatcgactgcactatttccctacgacgctaactattcgccaataaggcttgccgcatttcgcaaggctttcgcttttctctggccgtatcggacgtgcctttcaaatagtaagatgttcggtgggcaaacaaaggtagaagcaggcctgaattggtttgagtatggtcgactgacagcagggaaactggtcactccgctatcaatcacgttcgcgttcgtcgcgacgcacaaccattttgttcttgatcggggcggaaagatattcaatcgcagctctccggtaattaagcttccggcgggcactggagaggacgaacacttagggctggttggtctgctaaattcatctacggcttgcttttggctgaaacagatgtttcacaacaaaggcagcacggtagatcagcatggagctcgtcagcgcacaagtgcgtttgaagatttttacgaatacacgggtaccggagttggaaaatttcccgtgcccaatgtgaggccagttcaaattgcacggcagatcagtgatctagccatcgaatgctctcgacatctccctgctgcactgattgcgaggggggcgattagccggaaggaactcgatgcatcgcgcgcggaatcagcgcgtatccggtcgaagatgattgcttggcaggaagagcttgactggaagacctactcactttttgacgtgaccgacgaggagctttgtttcgataaagatccgccggaggtcaaactcggggaacgcgcgtttgaaattgcgctggctcaggactgtactgcaggaatagccgcgacgacttggttcgataggcaccgctcgcaaccaatcacgtcggtgcccacgcattggccatctgactatcgagcattagtggaaaaacggattgcagctatccgtaagtcgcgcgacctggcattgatcgagcgtccagagtgcaagcgtcgttgggtgtctgatgaatgggatgcgctggaaaaggctgccctcgaacaatggttgttgaaccgtttggaagctgcggacctgtggccgcacgatgcactccctgcacccaaactgcgttcggtccgcgagcttgtcgatgctttatctggtgacgaagaattccggcgagctttggacctctatgcaggcagcggcagcgacgctcacgtaaccgttgtcgcactggtgcagcaggccagcgtaccttttttggatgcgctgcgttacagcgagagcggtttgcggaagcgcgcggtgtggcgtaacacatggctgatgcaacggcgcgaggatgcgctcgatgcggaggtggctcgccaactgactgatgagccgatcgaggcgattaaggaggagcaggcaaaacgtaaagccgcggaagtgggcgttgttcctgtcccaccgaaatacaagcaagtggattaccgcgaaggtgtgtattggaagttgcgcggtgcccttgatgtgcccaaggagcgttttgtttgttttccgggcttggagcgtagcaacgacgccggaagcccgatgctgctgtgggctggctacgatgccaaggcccgcgctttagccctgacaggctacctgtatgagatgcttcaacgtgaaggcgctgatgtggcgcgtttgacgcctgcgttggcggggctagacgagctactcccatgggtgcatcaatggcatccggaggccgatgacgacctgggcatgagcactggcgactacttgcagggcctgctcgatgcgcagttggcgcagcacgggctgacgctgagcgcactgcgcgcttggcaacccgaagctccggttcgccgcaaacgcggcaagcggggccagcacgtagcacaagcctaa

SEQ ID NO: 2417 - DNA, 3609 bp, Candidatus Accumulibacter
gtgatcaacgccgccgccctcctgcgcgacctcaagcgcctgaccacgacgatcgaatccgacctccgcgagcggctggccgcgacgccggacctcgatgcctcgttggacaacgaatggcaggccgcccgcaacgccgggcgaatggctgcgacgctgcacgacttcaaggaagaagccatcacccaggccgccgtgcattggttgctgatgggcgtgttcatccgtttcctggaagacaacagcctgatcgatcgcccctggttgagtgccgccagcccggcccagcgggcgctggcgcaggaccggcacgaaagctacttccgcgcccatccgggcgacagcgacctcgaatacctgctcgccgcctaccgcgacgtcggccggctgcccggcctggggccgctgttcgacgagcggcacaatccgctgttccgcctggccgtctccggcgacggcgcgatggccatcgttggcttctggcagaagatcgacccggacaccggcacgctgctccatgacttcagcgaccccgagtggagcacgcgctttctcggcgacctctaccaggatctttccgaagcggcgcagaagaagtttgcgctgctgcaaacgccggaattcgtcgaggaattcatcctcgaccgcacgctgaacccggccatcgccgagttcggttaccgcgaagtgcggctgatcgacccgacctgcggttccgggcacttcctgctcggcggtttcgcccgcctgctcgaatgctggcagaagaacgaacccggccgcaacgcgcgcgatgccgtgcagcaggcgctgaacggcatttacggcgtcgacctcaacccgtttgccgtcgccatcgcccgcttccgtctgttgattgccgcgctcaaggcctgcgctgaaaccagtctcgccgaagcgccgaacttcaggttcaacctcgccgccggcgacagtctgctgcatggcccgcgccttggccacggccaactcgcactcggcggcgaggccgaaaacctcggccgtggcgcgctcgcccacgccttcgccagcgaagacctgcctgatctcaaccgcatcctcggccagcgttaccacgccgtcgttggcaatccgccctacatcaccgtcaaggacgcggcgctgaatgctgcttaccgggcgcgctacctcacctgccacatgaagtattcgcttggcgtgcccttcaccgagcgcttcttagaactcgccattcccggtagcgagcgcgagccggccggctacgtcggcctgatcactaccaacagcttcatgaagcgcgagttcggcaagaagctgatcgaggacttcctgccgcgcatcgacctcagccacgtcatcgacacctcgggcgcctacattcccggccacggcacgccaacggtcatcctcttcggtcgcaaccgggcgccgctgacgtcggtggtgcgcaccgtcatgggcatcaagggcgaaccctcgaccccggacgacccggcgctgggactggtctggcgggcgatcgtcgagcaggtcgatgtcgccggcagtgaatcggcatttgtgtcggtggccgataccccacgttcgacctttgcaaagcatccgtggagcatcggcggcggtggcgcggcggatttgaaggagatgcttgagtcgggtagtgaacgcactttgggcgatgttgcgaatgttggtgtgggtgttgttacgctcgaagacgacgcctatcagattccaagcgatcttgtaggccgcagatcttttccaaaggaattcgttcgtggattcgtcgtgggtgacattgttcgagactggttcttcaacacgcattcggttgccgtgtttccccatgtggacaaatcattccaagcatctcttgcgccggagatttatcgttggctttggccgttgaagactggtttgtccaaccgaatatggttcaagaaaacacaattgcagcgtggttacgaatggtttgcctatggccatatctcagcggaaaaattcaatactccactcaccatcaccttcgccttctacgcaactcacaaccattttgttcttgaccgaggtggcagggttttcaatagaacagcgccagttatcaagctgcgggcggcggcgagcgagggggagcatctgggcttgcttggtttactcaattcgtcggtagcatgtttttggttgaagcaagtcgctcaaaaccgaggaagtaccgtcgatggcaagggggcacgacaaagaactgaccctttcgaggatttctatgagatcggtgcggggatagcagctaaactccctctcgtaacgctagattgttatgaccttactcgtcgactcgatgatctctctcagcatttggatgacaatagccccgctgccattgtttccgccacacggacgagagcggcacttgtcgccgcaagatgcgagagcgtttctctgcgacggcaaatgatcgcgacccaggaagaactggactggcgctgctatcaactttacagcctgacgcagaccgaactcacccacccgcagccgccagacattgccctcggcgagcgcgcctttgaaatcgtcctcgcccggcgcatcgccgccggccaagccgaaaccacctggtttgcccgccatggctcaacaccgatcaccgaactgcccgcccactggccggccgattaccgctgcatcgtcgaagcccgcatcgcgctgatagaatccgacaaagtcatcggcctgatcgaacgccccgagtacaagcgccgctgggcgtcgaccgcgtgggcagaacaggagcagaccgccctcaagggctggctgctcgaccgcctggaatcgtctctgaaagacgctgcggccgacaccccgagcctgaccagcaccaacaagctggccgatccgttacggtccgacaccgatttcatgcaggttgccgaactgtatgccggccgctccgattttgacgtggcgctactggtggcaaacctcgtggccggcgaagcagtgcccgtgctgcccgttctgcgctacagcgaagccggcctgcgcaagcgcgccgaatgggagcgcacctgggacttgcagcgccgggaagatgcggtcgacgccgagacaagcgacgaatcggaacgccggcggcgcaagaccgccgagatcggcgacattccggtgccgcccaagtacaagtcgagcgatttccagaagaccgactactggcgcctgcgcggcgggctcgatgtaccgaaggaacgtttcgtcagcttcccgcactgcagccgcgacgccgacggcagcctgctgatcgcctgggccggcctcaacccgctgcaactcggcaccgccatcgccacctgctatctcgacatgaaggacaacgagggctggcatgccgagcggctgaagcccttgctggccggcatcgccgaactggcgccctggatcaaacagtggcacaacgaccccgatgccgaacacggcacccgcatgggcgactatctggatggcttcgtcgatgaagaagcccgcgacctcggcttgacccgcgaggccgtagtgggctggcggccgccggcgactaccgttcgtcgcggtcgacggccggcgatttga

SEQ ID NO: 2418 - DNA, 3999 bp, Corallococcus coralloides
atgaaagcgaacgaccgagcccgattgaccaccgctctccgcgaccacgtcgcgaagatcgccgccgacctgcgcgcgaagatgcgcgcgcccggcgctgcgcgcgtggccgctgagcagctccacaaggacgagcgcgttgccgaggacttcgaggtttggacggacctcctctcgcgtcgcgcggcggtgctctgggtgctcaagagcgtctatgtgcgtgtgctcgaagaccgggggctccttgcgccgggacggctgctcgatcccgaggcacagcagctgttcgagaagctcgcgccgaacctcggcgagacggccttcctgcgctggatctacaaggaccttgcaagcacgcgcggcggcatgccggagctgtttagcccccaacccgccgaggtggcactgccttcggacgagctgtcacgcgcgctgatcggcttctggcgccaccgagacgccgacacgggcgcggtgtggagcttcgtcgaggaacgcttcgagggcgagctgatgggcgacctgtaccaggagctcgatccggtcgtgaaagaccgcttcgcgctctgccagacgcccgacttcgtacgcgcattcatcctcgaccgcacgctgacgccggccatcgagaccttcggtgctgacgacgttcgcctgctcgaccccgcatgcggctcgggccacttcctcatcgacggcttgaagaggctcgtcgcagcgaccgccgagaagcacaatgattggtcgaaggagaatgtggtcgcgcacgcgctcgatcgcgtcgtgggcatcgacctaaacgactacgcctgcgcgctcgcccgtacgcgcctgatcatgacggccgccgagctcgcgggcgtgaccaagcttgccgacgccgcgcgcttccgcccgcacgtgtactgggcagatgggcttgagcaagtcgagaaagaggagcagaaactctcgacgcagttcgacttgttcacgaaggtcgaagagaagccgcgcgccacgctcacgcggtccgacgtgcgcgctgcgcttaagaaggtcttcgcgaagaagttccaagcggtagtggcgaacccgccatacatccttgagcgcgatgaggctcgcaaggagtaccaccgcgagctgatcggcaagaaccgtcgctacgtatcggcgaccggcaagtactcgctcggtgcgcccttcacggagcgctgttttcagctcgcggacaaggacggcttcgtcggaatcatcacgagcaacaacttcacgaaacgcgactttggcaaggcgctgatcgaaagggtcctcgccaacctggacctgacactcgttgtcgatgctgcgcaagcgtacattccattccactcgacccctaccgttttgctgttcggtcgacaccgaaagccggtcggcgatgcggtgcgcgctgtgctcggcaaacgtggtgagagtggaactccatgtgacccagcgcatggcgaggtctggacgagcatcgctacgaactggcccagcgttggcttcgacaacgactacatcagtgttgccgacgttcctcgaaccatgctgaacgttcacccctggagtctgggcggcggtggtgcctccgagctcaagcagaggattgagagcgcagcggagtcgaccctcgggaggctgtccgagagcattggcatcacgtgcttcaccctcgaagacgaggccttcattgcatccgaggaagtactcgttcgtcacggcattcccgccgaccagcgccgaccgatggtggagggcgatctcattcgggattgggccgtcgcgccgaccgacgtcgcggttttcccctacgacgacaccctgaatgtcttggcatcggtcgatggctcaaaacttgaggcgtggctactcccgtacaagacgcgtctctccaacaacaagatgttcggggggcggacgaaggtcgaggacggtttgaaatggtacgagtacggccgcttcactgcttcgaagctccgcacgccgctctctatcgtttgtgcgtgtgtcgcaacccataatcacttcgtcctcgataggggcggcaggaacttcaagcagagcgtcctcgtcatcaagttgccctcggaggctaccgagggcactcacctggctcttctggggatccttaactcgtcgaccgcctgcttctggatgaagcaggtcttctacccgaagggctcgaagacgcacgacgtcgacagcgcgggcacgctccctgagaacaaccgcttcgacttcgcggccaccggcatgaacgcgttcccggtaccgcacggactcgccgcgagtagcgcgggaaccatcgccgctacgatcaacgctctcgccaccgagcgctcagaccacctaccgcatagcgtggtccgtcgccccggcgttctcgtatcctccaccgcgttgagagctgctctgagggaagcagagcagcgggagatgagcgcgttccttcgaatggtgttctggcaagaagaactcgactgggagatctatcgtctgctcgggctgacaccgcagggcagtaccaacctcttggcggaatgcgacgtccagcccgactcaagaccgtttgcttgggctgaaggcatgctgccgagcgggctctcgccgaaggtcgccgaggagtacgtgcgccgtcgaaaactccttgagtccgagcgcttcctgggtctccttgagagcccggtgagcaagcgcttgtggaggggcacacagggcgtgttcggtcgctatgatcgcacctacctcgacaagacaagaacggcactcagcgcgtggttcgccgggcgagttgaggcggtcgcacgcgatcgaagtcgccacttctcgctcgagcatctagtcgccgccctccaagacgacgacgacgctctggctgtgtgcgaggttctgacggaccggcgcgacttcaatctctcgcagcttgtcgctcaagtattgcaggcagagtctgtcccgagccatccgttgcacacgtacaagcccgcagggctcgtgaagcggcaagcgtgggaacgcacatggcttgaccaagcgcgagtcgacgccggggagaagacgtcgccggaggtacctccgaactacgcgaacaccgacttcctgaagcccgaatactggcaactgcgtggcaagctcgacgtcccgaaagagcgcttcattgcattcaccgaggtgcccggccgctccggcgtcgagaccctctacggctgggcgggctggaccgcgcagcagcgcgtgaaggccatccttgccatcgacgaagaactcgaagacgactcggtgccgctcgccgaccgcatcggcctgctcgacagcgcgtggcgcctgctctctgacgtggctcgcgaagacgcccctgctgccacgcgcctcaaggccgagctgcaagcgctcgtcggcatcgagggcccgagcaccacgctcattggagactggaagaagcgcttcccgccgcccagcacccgcgccgccgggccgcggaggacctcgacgaaggaggtcgaggacgacgactcgttcgacgacctgcctgcgatcatccccgacgtctccagtcctgacgacgctgcgctcttcatctgggcggtgctccacgcttcaggaggatcggcaacccgcacggatctcgcgcgtgcattcgcgctgcgagcccgccccaatctgttgaagcgtctcgcaccggcgcccctgaagcgcgcggttacccattgggggactaccgtgggctcgcgttcggtgaaggcaggcctgcttgcctcgacgctcgccgcgttggcagagcggaacggtgtcgtgttggggacgaacagcgaggcgcgcgtgactgtcagcacaagtccgcacacgccctccgaggaacagatcgatccgtggttccgctttgaggccgaccttgcggtgaaagttctgcgggcacaacccgtggatgacttcagctcgatcgacaagtcgctctcggctgctgaccgcaaactcctggagacagctgcatga

SEQ ID NO: 2419 - DNA, 3603 bp, Corynebacterium variabile
atgcagaacgagagatccgacaacatggccaggaacacaaccagtaactcagaagcatcattgacagcagccctgcaaccggtcatccgcaacctggtaaaggacatgcgctcccgactgaccgaagatgctgcccttcaccagacctgggtcaccgagcatgcccgggcacaggccgccgaccgcatcggcgcctccttcgaggagtggagtgaggagcagctccagcaggccgcagccggctgggtactcaccaccgtgttcctccgattcatcgaggacaacgacctcttcggtacccgccaggttttcctcaccggatacgacgctgaccggcgttccctgggccgcgactacgaagcagcgctgtaccaggcccactccgactactcctaccgtgcatatctcacccactgcttcgagcagctcgccgatgtccccgcgacgaaggatctggtcggtccccatgctgcgatccacatcatcgatccgtccgacgatgctgcccgtgggatcatcgagttcttccgtgccctcgacgccgatgagaacacccgctggacattcaacgaccctgagcggtccacccggttcctcggcgacctgtaccaggatctgtccgagtatgcacagaagaagtgggcactcaagcagacacccaacttcgtcgaggagttcatcctcgaccgcacgctaacccctgctctggaggagcggccactcgagggtttcaaactcatcgacccgacgtgtgggtccggtcacttcctcctcggcgctttccaccgcctagtcaccgagtgggagaagcacgcccccgccatgcccgcaccagagcgggcaaagaaggcgatgcagtcaatccacggtgtggacatcaaccccttcgccgtggcaatctcccagttccgcctaactgttgcctacatgcaggcagccaaagacacccggctgactgagagggagagcaagcccgggttcacggtcctggccggtgattcactgcttttcggtcctgacgccgtgggccagggtgcgttgaacctgcaggcgcagaacttcgtgtactccaccgagaacgcggacgcactcgatgaaatcctaactccgggcacctatgacgtggtggtaggcaacccgccttatatcgaagtgaaagatccgatcctcaagaaacaatacaagtcgaggtattccagatacatcaaggggcagtacaatctaacgattcctttcatggtactattttacaatcttgcaactaatggttccgcgaatatccccgcaggatggactgggcaaataacaggaaattcattctttctgaaaccattcggagtttcactcgttgaaaatttcttcacagaagtcgacgttcgagaaataatcgataccgcaggggcgcatattcccggccatggaacccccacggtaattatcatcggaagaaattcagctccttctcgccgaaaaatcgtcggagtgataggattagaaggcgagccaacaacccctgccgacagttccaagggtttggtatggacgtcaattgtcaataatattgacgaatccgggtatgaagattcttacatttcagtgcaagagctgagtagagattttgtctcatctcacccatggaacctccacggaacgacgatctcgcagacggccgaatggatccaagaaaaatcaaaaaagaccgtgggggaaataactgacgccgtcggaagaaccacacacacaggacttgatccagcctattttattccgaaaaatcggtcgcttactaaattttccgaaacggtagaggttgctaccggatcaaacattagagattacttaataattaactgcaatgtgacattatttccgtatgacagcatcggaaattccataactccccatttcgaggaacaaaaacactattggacatacaggtcccgactacaaaaaaggacagactttggcaagactgtcgaacagagagggctacgatggtttgaccataccatgttcttccctgatcgctatcagagaaagctctgtctcccattcccgtttgttgccacccacaatcatttttcactcaatagagataacagggttttcaatcaaaagggcccggcgatcattatgcctaatgaggcatccgaggaggatcacctgcgcctgctcggggtgctgaactcctcgaccgcatgcttctggctcaaacagaacagccacggcaaggggatcggcggagtgaaccaggagtcccgccacgagctcttcgacgagttctacgagttcaccggcaccacgctcaagaagttccccctccccgacctcgagggcagtgacgtcaccgagcggggccgtcgtctcgacgcccttgcccaggaactcgcgacctacgagcccgccgcggtcttcaccaacggcacccccaaccaggagaccattgacgaggccgaggcgaactacgtccgcgtccggcgtctcatgatcgccgagcaggaggaactcgactgggccgtctacttcctgtacggcctcaccgacaccgacatgtccctgcccgcaggatccgtctccggcatcgagctgggtagccgtcccttcgagatcgccctggcccgtcgcgtcgacgccggggagaccaccaccgcgtggttcgaacggcaccactccaccccggtcaccgagatccccgactcctggcccgaggcccagcgtgtggcagcgagagcgcgcctggacctcatggcgtccgacaagtccatcaagctgctcgaagcccccgagtacaagcgccgctggtccgacgacctgtggacagacaaagtccacaccgcgctcggtgactggctgctcacccgactggagaccccggaactgtggcgccgggccgacggcatgccgcagccccgtaccatccgtgaactcgccgcccaggtcgaaaccgacccggatctcgccgacgtgctgtccgtactgccactgtggtccacccgtcggggagccaccgtggaaaagatgctcgacgacctcctcaagggcgaagccgtgccctacgtcgcgtccctgcggtacaggaaccgtgggttcgccaagcgtgctgagtgggaggccacctgggacgcccagcggcgcgaagacgccggtgagatcaccgccgaggcagtccccgtcccgccgaactactccagtgcagacatggtgccgacggcgtggaagcaccgcggcaagctcgacgtgccgaaggaacggttcatttcctatcccggggcgtccccggagggtgattccacgctgctgctgggttgggcggggtggaatgacctggacaaggggctggcgatcttctcgaccttcgccgaccgtgcggatgaggatgcggataccgagaccctcgccgggatcctcgccggtctggtggaggccctgccgtggatcaggcagtggcacaatgacctggatccgcagttcaacctgaagatgggcgactaccttgaggcacagctggccgaggcagcccggtccctgtccatccccgtcgaggacatccccgcccacgcaccgaagcccgccacccgcggtcgcaagaagacgtcgaagtaa

SEQ ID NO: 2420 - DNA, 3720 bp, Frankia sp.
gtgatcgaggcgagacgcctgttggccgatctccagcggcaggtccgcggcctggaggcggacctgcgcgcgcgggcccggtcggaccgggacgtcgacgatcggctgcacaagcggtaccaggaggcgaagaccggctgtcgcaccggcgtcggctacgagacgtggctcgaccagcagctcacccaggtggcggtcggttgggtgctggcctgcgtgttcacccgattctgcgaggacaacacgctgctgggacgtccgatgctggccggcccggtccgccccgagcaggaggccgacgagacaggcgaggccagggaacgggtcgacggggtggccgaggcccgggaatggcagactttctacttccaggcggaggaccacaagaatgactccgacctggactacctgcgggcggcggtcgcccggctggaggcgtacgacgcaacccgggatctggtcaaccggcacaacccgctgcacctggtggacatctcaccggacgcggcgaccggcctgctggagttctggcggcggatcgacccggaaaccggcgctctcgtccacgacttctccgatccggcgtcctccacccgcttcctcggcgatctgtaccaggatctttccgaacaggcgcgtaaggactacgcgctgctccagacccccgagttcgtcgaggagttcatcctcggccggacccttgccccggcgatcgacgagttcggcctcgccgaggttcggatgatcgacccggcctgcggctccgggcacttcctgctcggcgccttcgacctcctgctcgaccggtggcagaagcaggaacatgggattgacgtcaaggtccacgtggagcgcgtactcggccaggtccacggtgtcgacatcaacccgttcgcggcggcgatcgcccggttccgcctcgtcatcgccgcactggccgtctgcgggatcacccggctcgtcgacgcccccgtctggcgcatccgcatcgccatcggtgactccctgctgtggggcaccgaggatcagcaggacgaactcgacggcgtcgccacccacgccctgacgggttccaccggtgagggtgagttcacctacgagtacgaggacgctcgcgagctgaaggagatcctggaagcccgctaccacgcggttgtcggcaacccgccgtacatcacggtcaaggaccgggcccccagcaacgcctatcgggtgcgctggagcgcatgccatcgccagtacgcgctcagcgtgccgttcgcgcagcggttcttccgactcgcggtcaacggcggcttcaccggccagatcaccgcgaactccttcatgaagcgcgagttcggcaagaaactcatcgaggagttcttcccgagcgtcgacctcaccctgctcgtcgacaccagcggcgcctacatccccggccacggaaccccgaccgtcctcatcttcggccgccaccgccgcccctccctgaccacggtgcagactgtccttgggatccggggcgagcccagcgcaccggccgacccggccaaaggcctcgtgtggacacgaatagtagagaacttcgcgaatgctgaccacacggatgcgtatatcagcaccctcggaatcaagcggatagatcttgcgaggcatccctggtcactcgctggcggtggagcggctcagttgcaagctcagatagacacaaccagcgcgcgtctacataatctcggagttgacatcggacgcaccgtccagctcggcgaagatgacgcttggatacttgcccatagttctccggcggtgaccaggtttcaggacaacatggtcccccatgttttcggcgagctagtacgtgactacacgatcgaacaacctcccattgcaattaatccgtatgccgacataaccaaaggaatcccccttttaaaagatcaggaagttgtacaaaatctcctctggccaaaccgaacaatcctgtctgctcgcacaatattcggtagaagtcttgccgaaaacgatcgaccatggtatgcatatttagaaatatatgcaaaccgactgcacaccccgctggcgatcgcctttccgttcgtctcgacccacaaccacttcacactcgaccgaggcggcaagatattcaatcgtaccgcaaccgttctcaagctgcccgagggagccacggaggagaaacatctgcggctggtcggggtgctgaactcgtcggcggcgtgcttctggctcaagcaggtgagccacgacaaaggaatccgtggccagggaggaggcttcaccagtgacgactgggaacacttctacgagttcaccgggaccaagctgaaggagtttccgctgccggacggggcgccactggtgttggcgacgcggctggacgggttggctcaggagctccagcgggtcgcgccggccgcggtggccagggacgctgttccgacccgggaggcactcgtgcacgcgcgggcggagtgggagcggatccgggcggagatgatctcggcgcaggaggagctggactgggaggtctacggtctctacgggctgctcggcgacgacgcggacgggttgatcggttcgagtgtgacgaagccgccgctggcgcttggcgaacgggcgttcgagatcgtgctggcgcggcagcacgatgccggcgagaccgagacggaatggttcacccggcaccgctcgacgccgatcatccagctgcccgcgcactggccgcaggactaccgggccctcgtcgagcggcggctggcgaagatcgacgatgatccgtaccttcacctcatcgagcggccggaatgcaagcggcgctgggcgagccggccgtgggcggagatggaggccgaggcgttgcgcgcctggctgctcgaccggctggaggcccgcgaactgtggcaccgaccggaaccgaccccgcgcaccgtcgcccagctcgccgacgagctgcggaccgacgccgagttcaccgccgtcgccaggctctacgcccgcgacaccgctcttggtgacgtggtcgccgatctcgtgcgcgacgagcatgtaccgttcctcgccgcctggcggtacaccgacatggggctgcgggtccgggcgcagtgggaacgcacctgggatctccagcgggagcaggatgccgaggacgagcggatccgggccgaggaggagcggcgtaaggagtccgacgagccgctgccaccggccccaccgcgtaaaatcatcgacatcaaggtgccgccgaagtacaaacagaccgacttccgcgagacgtcctactggcgcagccgcgggaagctggacgtgcccaaggagcggttcatctcgtacccggatgcttcccgggacgggaccctgctgctgggctgggccggctgggatcatctccagcaggcgcaggcgctggccacctatatcgccgatcggcgcgaggtcgacgcctgggacgccgagaaaaccaagccgttgctcgccgggctgctggaactcctgccgtgggtcgcgcaatggcattcggaactggacccggagttcggtattcggcccgcggacgcctacaccggcttcctcgacgagcaggtgcgccagctcgggctgacccgtgacgatctcaccggctggctccccgcggccaggaagacgagaaccacggtgaagaagccggcgaagaagccggcgaataagcccgccacgactccggcgaaggcggcccggtcatga

SEQ ID NO: 2421 - DNA, 3594 bp, Frankia sp.
atgatcgaccgggtggcgctgctgaaggacgcccagcggcaggtgaaggaccttgagaaggatctacgcgctcaggtcgacgaggtggccgaggtcgggacgcggcttcgggctgagtacgaccgtgcgttcaaggtcggccggacggcagcgacgtggtcggcgtggctcggcgagagggtcacccaggcggcggtcgcttgggttctgggaacggtcttcgtccggttttgcgaggacaacggcctgatcggcgacccgttcctcgccggcccaacgacagcacgcctgacactggccgaggagcggaccgaggacttctaccggcgccaacccgagaagacggcgcgcgactggctgcggaagtccttcgatgagatagcgaaggtcccggtcggcgcgggcctgttcgaccagcggcacaacgcgctgttccagatcccacccacccacgacgcggccaagaacctcctcgccttctggcggcggcgcaccgaggccggcaccctggtccacgacttcaccgacgacgcctgggacacccgcttcctcggcgacctctaccaggacctctccgaggacgtccgcaagaagtacgccctgctccagaccccggagttcgtcgaggagttcatcctcgacctgaccctgacaccagccatcgacgagttcggatacgacgtcgtcaaactaattgacccgacgtgcggctcgggccacttcctgctgggcgcgttccgccggctgctcgccgagtgggagaagaactctcccgaccgggacgtcttcgaacgggtccagctggcgctggacgcggtccacggcgtggacatcaacccgtacgcggcggccatcgccaagttccgactgactatcgaggcgctgcgtgtcgccggcttgacaacacttgacgcggcggccggctacacgttcccgctacacgtggctgtgggtgactcgttgctgaagaaccgccagctcgacctcttcggcgaggagcgagacgaactcgccgagttcgcctacgccaccgaggatctcgccgatcacctcggtatccttgaggaaggccgctaccacgcggtcgttggaaatcctccatatttcaccgtcagagacaagaagctaaacgcactgtaccgcgatctctatagctcctgcgctggacgttacaccctctcagtaccctttgcgcaacgctttttcgagctggcacggcaatcggacggagatggagtcggcgctggacgcgtcggccagattacagcaaattctttcatgaggcgcgaattcggcaagaagttgatcgagaacttcttcgctcgcgtcgttgagctaacgcaccttattgatacgtccggagcatatattccaggtccgggcgtaacaacagttattcttgcgggtcgccgcaatcagcggaagcgcataaaaaccgttcggatgattctcagcgtacgcggagagccatcaattcccgacgatccaagtcagggagccgtctggcgggcgattgtcaatagcgtggacggcagcagcaatgactgggttgccaccgccgacgttgaccgcgacgtactatcgagccacccttggacgctttccgtcggcgacgtcggtgcgatcatggacagacttggcgccgaggggcaccggaaactcaaggatgaaatccttggcgacattggatttgccggcttttctggcgttgacgaggcatattacctgcccgctagctggcacgcgaggttccgcacccctcaagcacttgttcggcctgtcgtgacgggtgaagacgtccgcgactggcgcacatcgcccaccctgtatgcgattacaccatacacttctgacggcagcctcattccaatcgcctcgtcgtccgactgggtgcgccatctatggaagtataaacaaattgttggacgactgactgacttctctggaaggaccaggctcgacctcggtacgccgtggtgggcatggtatcgctgggtggcggcacgcaatagcgcgccagatataattgcctgtccaaagattgcgagtctgaaccacgcctcctacgggcacgacggctacacctataaccagcatgttccagtaatagtacttccaggcagctcgggagctgacgcacgactttctcttgtcggtatactcaatagctcgacggcctgcttctggctgaagcaggtatctcacaatttgggaagtaccgctgacgcgaccggtgccagacgaacggccaccccgtgggaaaatttctacgaggtgacaggtgctaaccttgagaatcttccgctatcagctcaatgccctctcccgttggctcgcgagctagatcgcctcgcgcgaaacctgacgatggtgttcccgcaggcagttgccgcagcaggtccacctgcccgcccattgttgcgtacggcccgtaatgaatgggagtcgacgcgggcacggatgatcgcgttgcaggaggagctggactggcaggtctaccggcagtacgggctgctcgctgacgaactgacgctgccgatggccgatgtccccgagatcaagctgggggagcgggcgttcgagatcgtgctggcgcggaagatcgcggccggcgaggagacgcccgagtggttcacccggcacggttccacccagattttcgaaccgcccgcgcactggcccgctgaataccggactctggtggagaaacggatcgctgtcatcgaggcggacaagaacatcgggctgatcgagcggcctgagtacaagcgccgttgggcgaccgagggctgggacaagctgcaggacgctgcgctcagggagtggctcctcgaccggctggaggcccgcgagctgtggttcgccgacgtcgacggcatggttcagccgcgcctctggaccaccggccgcctggccgacgagttggccgccgaggctgacttcgtcgctgtcgccgagatctacaagcccggcgagaacctgtccaaggtcgtcgacgacctggtcgagaacgagcacgtcccgttcctggcatccctgcggtacaaggactcgggcctggagaaacgcgccgactgggagtcggtctgggagcagcaacgcgccgaagacaccacacccacccccgaagccgcgaagaagatccgcgacagcattccgctcccgccgaagtacgcccaggccgacttccgcaaggcaagctactggaaggcccgcggcaagttggacgtccccaaagaacggtttatctcctaccagccggccagccctgacaacgacccgacgctgctggtcggctgggccggctgggaccaccgcgagcaggcccaggcgctggcgacgctgatcgtcgagcgtcaggacaacgacggctggggcgccgcacggctcaccccgctgctcgccggcctgcgtgaggtgatgccctgggtccgtcagtggcacaacgaggtcgacccgctctacgacggctccccggccgaggtctatgacgccttcctcgccgacgcgatgggccgccacaacctcaccgccgacgccctggccgactggcgtccgcaggcggccgcccggggccggagggccacgaagtga

SEQ ID NO: 2422 - DNA, 3849 bp, Haliangium ochraceum
atggaacgcacccgctacgaagagctgcaaaaagccctgcaaaagcaggagaaggccatcgccaaggcgtccatcgcctggggccgcaaggccggcaaggagcgggtgacccgcctgcacgccgaggccgagaccggcggcagcttcgacgacttcctcaaggtcgcggccggccgctcggccgtgcgcttcttgctgcgcaccgtctacgtgcgcgtgctcgaggacctgggcatcctcgaggagccgcgcatccgcggcctgcgcagctacgaggccttccgcgcgctcgcgccctcgctcggctaccgcgcctacttcgcgtggatcttccgcgacctggccgtggacttcccggccctgttcgagcccgcgcccgacgagctgcccatgcccggagaggagctgtgccgcgcgctctgggacctgtggcacgaccaagacggcgagggcggcctgcgctacgcgtggaccggcggcgacttcgacagccgctttctcggcgacctgtaccaggacctcgacgccgacgtgcgcaagcgctacgccctgctgcagaccccggacttcgtcgaggagtacatcctcgaccacaccatgaccccggcgctcgaggagtttgcgcccgaggccctgcgcgacgccggcgaggcctttcgcgtgctcgaccccacctgcggcagcggccacttcctggtcggcgccttccaccgcatggccgacttctgggaggcgcgcggcatggggcgctgggccgcggccgagcaggcgctggatagcgtgtggggctgcgatatcaacccctacgccgtggatgtggcccgctttcgcctgctgctcgaggtggtgcagcgcaccggcgagaaggacctcggacggctgtcccagctcaagctgcacctgcgcgccatggactcgctgatcccgtgggaggggccgcccaagggccagaccggcgagctgttcccgggcgccgaccgcctgagcaagtacggcacggccgaggagcgcgccctgaacgccgcgttcctgcagcgcgatttccacgcggtggtgggcaatccgccgtatgtggtgcccaaggatccagccaagcgcgatgattatcgggtgttctggccgaactcggccgcgggtaagtatgggttgtcggcgccgttcatcgagcggctgtttactttggcttgtgagggtggctggacggggcagatcacgggcaatgcgtttaccaagcgcgagtttggcgccgcggtcgtcgagaagtttttgccgaccgtcgatcttacggatattatcgataccagcggcgcgtatatccctggtcacggtacgccgacgctgattttgtttggccggaaccgcgagccagtcgaatcagtagtccgctgtgtaggcggcaaattaggggagcctgttcggcctgaagttcccagccaagggcattattggtcagcgatcaaatacgcgccgaaatcggtttcagatgaaagcccgtatttgacggtgtcaagttacgcgcgggtctggttgaagaaacacccttggaatcttaaggggggtggtgcttcagaactccagcggcggattaggggaaaagcgagctttgagctgaaagataagtcaaagaggcttggcctgatgacgaagccggttttggatgatgtgtatattccggctccattatggctgttacggcttgagcctagaggtggggtgatattggccgaaggggagctcattcgggactggggagttggtctgggagcctgcgccgtgtcgcccaatgttccttcgagtccttacaacgtagacgtgagcttggcggagacaggccctcggcgattcgcgcacttttggcggtttcgtggcttgctctggaataggcgctcgcgtgcaacacggttcgctcctctcaggacaatagttggagcccaattctacgaatttcccttctattaccctcagacgctggagggaccgcaggtttgtcatgcatctgtagctactcataatcattttgtgtttgatagaggtgggaggctttttaagcagacggcgccgtgtgtgcagttgcctggtgatagtgacggtgcagattatttgtcgctcaccgcactgcttaatagtagcactctgggattctggatgcggcaggtattctatcctaagggcggagacaaacagggggatggagggcgtgtgtggagcgagccttggacggatagactcgcttacgactccaccaagctcaagcgcgcgcccatcgtcaccgaggatcgcgcggagcgcgtggccctggccgagcagctcgacgcgctggcccaggagcgcgccgctcagctcccggcggcggttctcggacgctccgactggaaccccgacgagctggccgcggcgctggccggcgctcacgacgaataccgcgcgctcactgcccgcatggtcgcgctgcaagaggagctcgactggctcacctaccagtcctacgagcttctgccgcgcgataccgcagcctggaacccggtggcgcccgccgacgccgagcccctggcgcccggtcaccggcccttcgagatcgcgctggcgcggcacaacgccacctgcgcgcccgaggagcgcagcgagtggttctcgcgccacggccacgacgaggtcaccgacatcccggcccactacagcgcggccacgcgcgcgcgcatccaggcccggctggcgctcatcgccgacaacgccgacatgcgcctgctcgagcagccgcagttcaagcgccgctggcagatgccggcgtgggacaaagaggtagcggccgcgtgcgagtcgtggctgctcgaccgcctcgaagacctgttcgcgccgccgcttgccgaccaggcgtccgacgacgccgccgctgccgcgcccgagcccggcccgccgccgccgctggccgatccgcggccctacaccctcgaggagatcacggccgcgtggcagcgcgagccgcgcgtgcaggccgtggccgacgtctacgcgggcggccgccacaccgtgctgtcgctgctggccgagcgtctgctcgacgagcacggcctgcccgaccatccgtaccgcatctacaccgacgagggcctgcgcaagctgcgccagtggcaggaggtgtggcgcctgcaggaccgcgaggacgcgggcgagaaggtcaagattcccaagccgcccgagttcgccaagggcgacttccagagcgagcgctacttcaagctgcgcggcaagctcaacgtgccgcgcgagcgctttttggtgttcgccgagctgctgcccgcgcgctacggctggaacggctggcgcgacctgaagcgcgccctggctcaggtcgagtcctacaccgcggtcgagcagcacccgaccgcgccgctgccgcggccgtccaccgacgacccgcgccgctgcggcgccaccctgggcctgtgggagagcctgcccgacgtcaagcgctgggtcagcgcggccgaggagggcgggctgcgcgccctggcggaagaagtctgccagcgcagcgcgtgcccctgcgaggtggtgcaggcgtggcaggcgtggcagtccggcaccctcgagatcacggccgcggacgacgagcgcgatcccgacgaggtcacgctcgacgaccgcatcctggtgatgaagcgcttcggcatgggcggcgtgctgtcgatcaacgacctgcaaggctggtggaaccgcggcccggccgagctcgatcgcatcctcgacacgctggtcgccaccggcgagctgacgctcaaaggcaaaggcaaccgccggcgctacaccccgggcgcgcccaaagggcagcccaaatccccccaggcctag

SEQ ID NO: 2423 - DNA, 3522 bp, Microlunatus phosphovorus
gtgatcaacgccgcagccctggtcgccgacctgaagaagcaggtgctcgtcctggaggacgacatccgcgggcgactcgagcagctgccggtgatcaaggcggactggcaggcccgacaccgccgccaggtcgacgccgaccgcaccgccagtgcttggacctcctggcgggacgaccagatcacccaggccgcggtggcttgggtgctgactacggtgttcgtccggttctgcgaggacaacggcctgctctccccggtctggatcgccggtccgccaactcgccggcaggaggcactggacgcccaactcgcctacttccgggagcacccagacgacagcgaccgggagtggttggaccaggcgaccgctcatctggccaagcgaccggcaacggctgggttggtcgacgagcactccgggctctggctggtgtcaccatcgggtcaggcgtgctcggacctgatcgccttctggcggcagcgcaccgaggacggcgccctgctgtacgacttcacagacgagcagttgaccacccggttccttggtgatctgtaccaggatctgtccgatcatgcgaagaagacctacgccctgctgcagacgccggagttcgtggaggagttcatcctcgaccagaccatggacccggctcttgccgagcgcccgctcgaaggcttccgactgatcgacccgacctgcggctccggccacttcctgcttggcgccttccgacggctgctcgatcggtgggacaaggcggcgcccgggatggagctgcaagcccgcgtgaacctggccctcaagtcggtttacggcgtagacctcaacccgttcgcagtggccattgcccgcttccgactcacggtcgaagccttgcgagcctgcggtctcaggtccctggagcacgccccgcacttcgactaccacgtctacaccggcgactcgctactctttggagctagcgattctccgttaccgttcgacggtgcggatcctgatctgctggcgagtcaagtttcctactcaacagaagacgcgtacgaattaagaagcgtcctagcacccagtagatatgatgcggtcgttggtaatcccccatacataccggtaaaggatccagtgctcaagcgagagtacaaacggaggtacttgagctgtaaggcaaactacgcgttgacggtcccttttgttgagcgcttcttccaacttgcagtcgctcgcacagataatcgaccgtcgggctgggtgggcatgatcgcctccaactctttcatgaagcgagagttcggagacaggttggttgaggagtatctaccaagagtccgcctcgtgcgcgttatcgataccgaaggcgcatggattcctggacacaacgccgatggcacgccaactgtaaccatcgttggtcggaacgagccccaggatggtcgagttattcgggttcttacgggaaaaggactgcgcgagaccagggctacggctcgtgttggaggcagcgcgcactggctgcgaattgtggagcgcgtggaggagcctggatatgaggatgactggataaccgtaggcgaccgcgacccctcagagctttcgaggcacccatggatacttgctggcggcgcggttcccaagcttatgtccaaactggaaacgggtccccgccgacttcgcgacgttacaagggacgtagggtttatggccgtgacccgcgaggacgatgcttacctccgtggcgggcatgttctacaacgactcgggatcggcgaaggatctcgccgtaggttctgcgcagggggagatctgcgcgattggcgggccataggcgggatggatgctatctgtccatatggcagcgatggaaagccggcgattgacgatcaagccaggaaggctctttggccactaaaggcgagcctgatgaatcgtcgagcccagagtggttaccaggtagatattggcttgcattggtgggaatattcgcagatgaacgagcgtcgcctgttatcgcaaagggtgattgcctatgctgaagtagcgacgcacaatcatttcgtcatccgttccgatgactccgtttatggtaggactgctccttgcattgcactgccagactcgatgaccgacgaggaagttcaaggcctctgcggcttcttgaattcttcattggcatgcttttggttgcgtcaaaggtgcaaacccaagggcggggcggccggcgatgtctggaggcgcacataccagttcaacgtcagcaacgtggccgagattccgattccggaggaccttccctatagtctggccagaaggattcaggaacttgtgcttgaaactcgtgaccttgatccgctgatgacgagcccgctaaaactccggagtgacgctagcaacaaatacagttcaagtctggcgcacatgatctcattgcaagaggagctggactggtacgtatatggcgtcgtgggagtcttccaatcggcctcgatgcagatgtggtgcgagtttccacccaaaattctgcccggccagagggccttcgaaatcgcattggctcggggcgtatccaaggctggcgaaattcctacgtggtttgcggaacatggcatagttccacatactgagttgccatctggctggtctccgagctatcgcgcattggtcgagcgaaggattgaaatgctcggcagcgacgacctgctcggccttctcgagcgtcccgaatataagcggcgttggtcaacatgggacgactggaactctcgatatgaccaatcgcttagagattggattctttctgaacttgagtcacgccgattttggttttcggaaggctcgcatccgcgaccaatctcaatcgctcagctcgcagatatggtgtcgcgggaagaattgctcgtgcgtgcaatatgtatgctggagcgccgcccagatgtgtcgatcgtgccgttcttgtccaacttgctgacaggagaagctgtcccctttttggcggcttatcggatgacagagggcggtcttcgaaagagtgattcttggcgcgagattgtcaacagtcaaatggaggacggagacgaatttcctcgcccagcggctttgccgcggccgttcgaggagcaggacttcaggtcaagcatctggtggcaggctcgcggcaagctggacgtgccgaaggagcggttcatcctctaccccgacgctggccgcagtaccgattccaccctgttgttgggctgggcgggttgggaccatgccgagcaggcgctggccctcgccatgatcatcgccgagcgcgaggaggaaggctggaccgatgagcgcctgattccgttggtcgctggcctggcggagctgcagccgtgggtggagcagtggcatgccgaggtcgatcccacctacggtgtcagcctggccgcgttctgccgcgagcagctggccgagcggtctcgccaggtcgggcggtcgccggagcagctggccgactggcgaccgaagccagccacccgaggaaggagggcacgcacgtga

SEQ ID NO: 2424 - DNA, 3525 bp, Micromonospora aurantiaca
atgattccgctgaaggcgctgcagacccaggtcaccgccctcaccgacgacctgcgtgggcaggtcgccgcggactccgagctggagtcgtcgctgcgcaaggaacacgcccgggcgaccgaggcccggcgtacggggggaacgttcgagacctggctggacgacgtcgtagaccaggcggcggtggcctgggtgctcggctgcgtgttcgtccgcttctgcgaggacaacgaactggtcgatccgctctggatcggcggcccggagccggtcgcgccggttggccgggccatgcagcaccgccagcagcacctgattgacaacccccggcacaacgaccgggaatggctgcgcgaggcgttcacctacctgcgtgggctgcgcgccaccggcaagatcttcgacgagcacaacccggtgtggcggttcgacatctccggcgcggcggcggagaagctgtcggagttcttccggcgagggccgggtctggtgtcgctgcgcgtcgacgacctgaacacccgcttcctcggcgacctctaccaggacctgtcgacgcacgccaagaagacgtacgccctgttgcagacgccggacttcgtcgaggagttcatcctcgaccgcacgttcgagccggcggtacgcgaattcggcctgccggagacttcggtcatcgacccgacctgcgggtcggggcacttcctgctgggcgcgttcggccagctggtgcgcaagtggcgggagcgcgagcccgccaccgacatccgggtgctggtggagcgggcgctcggccaggtgaccggcgtggacataaacccgttcgcggtggcgatcgcccggttccggctgctgatcgccgcgatgagggaatgcggcctgacgtcgctggaacgcacgccgtcgtggccggtcagggtggcgacgggcgactcccttttgcagtggggacgcaagtcgcgacaccagggcgacctgatcgcgatgttggaggggcagaacgccttcgcgtacgcggctgaggacgccgacgtgctcgccgactacctgcgcgagggccagtacacggtggtggtcggtaatccgccgtacatcacggtcgcagacaaggcccgcaaccagctctaccgggatatctatcccgacgtctgccaccgccaatatgcgctgaccgtgccgttcgcgaagcgcttcttcgacctggcgaggcagtcagacgagcacggcgagggagcgggccatgtcggccagatcaccggcaacgccttcatgaagcgcgagttcggtaagaagttgatcgaggattacttcgcgcatcaagtcgagttgactgccattgtagatacgtcgggcgcgtatattccaggtcatggcactcccactgcaatcttagtgggacggtcgagattccgccgccgcgcgccgaacattcgcataatccgtgggatcaggggagagcctgagcggccaggcgatgctgcaaacggagcagtctggactgcaatcaaaaagcaattcgacctgccgggttctgattctgagtggatcagcgtacaggacactcctcgcagcgagatggcttgttttccttggagcctttctgggggtggggcggttgaactccgggatttgatcgagcagagaagtgtcccgcttgggtcagcggttgattccatcggccgaaccacccataccggtcaagatgaggccttttatctaaattcagccgcagttgcgactagaggtatgagtagtgcggttgttccggtagtcgcgggcgaagatgttcgagatttccagctccatctcgacgccgtagcaatgttcccctatggcactgacggggtgcctcgggaaacctcaatttcggagtcccgattttactggataactcgcgtttggctgcgttcaagaatcgatttcggtcgcacagtggagcagcgcggattgagatggtttgaccacagcatgttcttcgcaaagcgatttcgtgtcccgcgctcaatcgcgtttccctttgtcgccacccataaccacttcgtcctcgacaggggcggcaaggtgttcaacaggacggcgccggctataaagctggcggagagggctactgaatacgatcaccttcggctgcttggggtgttgaacagttccaccgcctgcttctggctcaagcaggtcagctacccgaagggtggtgacccgatcgggggcgacggagcaagggtgagcgccgagccttggtctgaccgctacgagttcaccgggacgaagctccaagagtttccgctgccaagggcgtacccggtggagcgggcgcggctgctcgactcgctggcgcagcggctcgccggcctgaccccggcggcggtcgcggagtccgcggtgccgacccgggagcggctggcgacggcgcacgccgactacgacgagacgcgggcgcggatgatcgccttgcaggaggagttggactgggaggtctaccggctctacgggctgcgcgacgacgacctgacctttgtcgagccgccgcgactcgcgttgggggagcgggcgttcgagatcgtgctggcgcgccggatggcggccggtgaggtggagacgcagtggttcgcccggcacgggtcgacaccgctcacggagctgccggcgcactggccggacgactaccgggcgttggtgcagcggcggatcgaggtgatcgagtcggaccggaacatcgcgctgatcgaacggccggagtgcaagcggcggtgggccaccgagggctgggacgccatgcaggccaaggcgctgcgtgactggctgctcgaccggctggaggcgcccgaactgtggggcgaccggccgataccgcagtcggtggcgcagctcgcagaccgggtacgccacgacgacgacttccgcgcggtgctggagttgtgggccggccgcgacgactacgacctgacgaagacgctggcgaaactaatcgccgacgaacacgtccccttcctgcccgcctaccgctacaagccgtccggcttacgcaagcgggcgcagtgggagcggacctgggcgcagcagcggctggaggacgcgggcgaagacgtggacatcaaggtgccgccgaagtacacgtcggcggacttcgccaagccgtcgtactggagggcgcgcggcaagctcgacgtgccgaaggagcgcttcatctcgtatccgaaggcgggtcgcgacggtgacggtacggaactgctcggctgggcggggtgggaccacctcgcgcaggcacaggcgctggcgaccgtctatctggatcgcaagctgcaggctgcgtggtcggcggaacgactgctgccgttgctggcgggcatcgcggagctggagccgtggctgcaccagtggcacaccgacgagcgtcccgacttccccggagtcccggcccagttcttcaccgacctcatcgacaccgaactgtcccagcttggggctgaccgaccagatctcctcgcgctgcgagggcttggtggccatgccgacaaccgcggcgagtag

SEQ ID NO: 2425 - DNA, 3570 bp, Mycobacterium gilvum
atgggctgggctgcaacggaactggtgaccgcgctaaaacgtcaagtgttggcgttggagaccgatctgcgggcgcgggtcgacggcgatgacgagcacgcccggcagaaggatgtgctcgatgcgtggcggcgctactacgacgcggcgttcgccgcgcagcgcactgcggcgagctggcaggagtggcgcaacgaccgggtgacgcaggcggcggtggcctgggtgctgctgacggtgttcgcccgctactgcgaggacaatgcgctgctctcgccgcgctggatcggcggcgccgatgccgatcaccgtgcccaggcactcgacgcccgccgcgcctacttccagcagcatcccgagcacaccgaccgggagtggctgagccagatcatcggccacttcggcaagttcaccgcgacggccggtctggtggaccggttctcgccgctgcacctggtggcgccctccggtgacgcggcgcgcgccctgctggagttctggtggcaacaggacggtgacgggcaaccgctctacgggttcgccggggtggacacccgattcttgggcgacgcataccaggatctgtccgagcacgccaagaagacgtatgcgctgttgcagaccccggagttcgtcgaggagttcatcctcgatcagaccatggaacccgcgctggccgaccggccgctgcaggggttcaccgtcattgacccgacctgtggctcagggcatttcctgctcggcgccttcgctaggctgcatcagcggtggcagcgggaagctccggcactcggtgcgcgggaactggtcgccaaggcactcgacggcatctacggcgtggacatcaacccgttcgccgtggcgatcgcccgcttccgcctgctcgtcgccgcgctgcacgcggccggggacagcagcatcgaacagaacatcggctacaccccacatctggcggctggcgacagcctgctgtggggcgccaatcagcaactgctgcccgaagatctgttggccggcccggcgattcgcgccgacgccaccgaggacgccgacgcgctcaggagcatcctgcagcgcgaacacgatgtcgtagtgggcaatccgccatacatcaccccgaaggacgcggcgctgaacgcgacgtatcggaagctgtacagcacgacgcatcggcagtacgcgctcacggttcccttcatggagttgttgttccggctcgcacacggatcggccggaacacggcccgccgggtggatcggccagatcacgtccaactcattcttgaagcgagagttcggctccaagctcatcgaagagttcctgccgaccgtcgacctacgcgaggtgatcgacacctcgggtgcgtacatacccggacacggaacgcccactgtgatcatcgtgggacgaaagcagcgaccatcctcggacacggttcgcgcggtcttgagtgtgcgaggcgagccgggccggccagacaatcccgcgaaaggtctggtgtggtcgacgattgtggaccacattgatgagccaggatttgaagacgcctacatcaacgtcagcgacctcccacgccagacgttctccagtcatccgtggagcctctcgggcggcggcgccgtacaacttcagcagcaggtcgacaagcagacagcgaagctcggcgagcgaatccttgtggtggggcgcactacacataccggtagcgacgatgccttctacttgccggacgcagcctcagagagactgcgtctgacgaatgatgtcgttccagtagtccttggggaaggcgtgcgcgattacaccgtcgtcccccacctcgacaccgtgtttccgtacgactcggacggggtaccgtcatccctcagcgacagcgcactccgatacctctggccaaatcgttcagtgctcagccagcggatcgatttccagcagacactcgaagaacgtgggttgcgctggatagatcattcgatgttcttccctcagaggttcagaagcccactctccatcgccttccctttcgtgtccacgcacaaccacttcgcactggatcgcggcgggaaggtgttcaaacaaacggcgcctgcaatcaagctgccagcgggcgcgtcggttgaggatcatctgcggctgctgggtgtgctgaactcgtcggtggcctgcttctggctgaagcagaacagccacaacaaaggcgaaggcggcggcgcgagggttgaagccggctatgcggctcgcggcgaggcgtggcgggagagctacgagttcacgggaacgaccctcaaagactttccgctacctgccaacacaccaatggaacgcgccaaactgctcgacgggctcgcgcacgaactgcaagagcgatcgcccgccgaactcgcgaagcgtgaaactcccaccgccgctacgctcgaagattcacgtgcagagttagatcgtttgcgggccttgatgatcgcgaatcaggaggaactcgattgggagtattaccgcacctacggcttgatcgaagtcgacctcacctacaccggtgaggtgccgggtgttgcgctgggtgagcgcgccttcgagattgcgctggcccgtcggatgaaggacggggtggaaacgacctggtttgtccacccactgcaaatctcctcccccatcaccgagatccccgaccacctccccaccgcgtaccgcgacctgctgcaacgtcgcctcgatgccatcgaaaccaacccgcacatccgtctgctcgaaaagcccgagtacaagcgacgctgggcatctgagccgtgggacaagcaggtcgaatcggcactgcgggactggctgctggatcgggtggaggatcgcgcactgtggttcgaccgggacgggcggccgacgccgcagtcggtggcgcagctcgccgacgttctggatcgtgacgcggacttccgctcggtgctgcggctgtgggtcggtgacccgaacgcaaccaccggtgcctcgctggcgaaactgcttgccgacgaagcggttcctttcctggccgcctaccggtacaagccctccggtctggacaaacgggcggcctgggaggacacctgggcgctgcaacgccgcgaggatgccggcgagaagctgggctcccccatcccggtaccgccgaagtacaagcccgccgacttcgtgaaggtttcctactggtcgcaccgcggcaagctcgacgtccccaaggaacgcttcatctcctaccccgccgccgggcgggacaccgacgccaccgaactgctcggctgggccggctgggaccacgcccaacaggcactcgccctggcgtcgctgatcagcgcacgcatcgacgagggctgggacaccgcccggctcgtgccgctactggccggtctcaacgagctcgcgccgtgggtgcggcagtggcacaacgagatcgacccggagtacggcgaatcggtggccgacaccatcgacgccgagttgacctcacgcctgaatgagcatcacctcaccgtgaccgacctgaccagttggcggccagtgcagtcggcccgccgcggccgaagggcagcccgcacatga

SEQ ID NO: 2426 - DNA, 3630 bp, Nocardia cyriacigeorgica
atgatcgaccgcgccgcactgctcgccgacctgaagaagcaggtggtcgcggtcgagaccgacctcgagaagcagctggacgtgctgcccgaggtcaaagcacgcctgcacgacgaatgggcccaagcccgcaaactcaaccgcaccgccgccaccgagtcctcgtggcttggcgagcgcgtcacgcaggtcgccgtcgcgtgggtcctcggcaccgtcttcgtccgcttctgcgaagacaaccacctcatcgccgacccctacctcaccggccccacggacgaccgtcgcgaactcgcccacgcccgctacgacgcctacgtcgagaccgatcccgacccgacctaccgaggctggctcgagaacgccttcgccgaactcggcgccgggcaagccggaaaactcctcttcgaccccaaccacaacgccctctaccagatccccgtctctcacgacggcgcccgcgaactcatcgaattctggcgcacccgtgacgaacacggcgtcctcgtccacaacttcaccgaccctcttgacgaagacggcatcaacggctgggacacccgcttcctcggcgacctctatcaagatctctccgaggacatccgcaagaactacgcgctactccagaccccggagttcgtcgaggagttcatcctcgaccgcaccctcgagcccgcgatccgcgaattcggttacgaaaccatccaactcatcgatccgacctgcggatcgggacacttcgttctcggtgcgttccggcggctgactcagcggtgggccgatgaacaaccgacgaaggatcggcatgaacgcgtccacgcagcgttgaactcggtgcacggggtcgacatcaacccgttcgctatcgccattgcccgcttccgtctgttggtagccgccatggctgccgccaacgtgcgcacgctggccgaggccgcgcgatacgagtggccgatcaaactggcggtcggtgactcgctgatcaaggcacggcagctagagctcaccttcgacggcgaccaccgggacccgctggccgaattctcctacgctaccgaggacgtccacgactacccgggaattctcgaaccaggtcggtaccacgtcgtcgtgggaaacccgccctacatcaccgttaaagacaagaacctcaacgagctgtaccgcggcctctacaagtcttgctccgggtcgtacgcactatccgttccattcgcggagcggttcttcgaactcgcaagacttggccaacacgacgggcacggattcggtcgagtcgggcagatcaccgcaaattcctttatgaagcgcgagttcggcaccaagctgattgaggagtactttgctcaaaccgtagaactcaccgaggtcatcgatacttccggagcgtatataccaggccacggcacaccgacagtaatcctgattggcacgcgacgttccggcaacagccgcagcacgaccgttcgaacggtacgaagcgtacagggtgaaccacgggctcccgagcgtcctgagaatggacgggtctggagtgcaattgtcgagcaaatcgacaatcccggaagcgtcagccagtgggtttcagtcgatgatcttgagcgaacccgctacttcaacaagcagccatggatcctcctcgacggcggtcttgagatggtcgagcgtctgcatgaatccgcaaaagacaagcttcgatctgtcaccaccgaaataggaacaggcgccatcacgcgtgaagatagcgcgtacatgttgggcaacggttgcttgagacgcaagggaatcgaacccgactaccgacgcgcaatcgtcgagggcactgaggtccgggattactccatcgctgaggccaccgcgtcgttgtggccatattctgaatccaccctcaaagcgcaagcctcagaacgggtcacgcgggctttgtggccacatcgagttattcttcgcaatcgggtagctttcggtaaatcccaggtcgcacgcggacttacgtggttcgaatactcgatgtttttcaccgagaggtacaggaaaccactcggcattcccttcgccttcgtggcgacgcacaaccatttcgtgctggaccggggcgggaaggtgttcaagcagtccgcgccggtgatcaagttgccggagggggcgagcgaggaggagcatctgcggctggtcgggctgctcaacagctccaccgcctgcttctggctcaagatggtgagccacgacaagggtaacggtggcattggcggtggcatcgccagtgagtcatgggagaagttcttcgagttcaccggcaccaagctgcaggatttccccctcccgggcaggtacccggggtccctcggcgaagccttggactcgctcgcggaacagctggcggagacgcaacctgcgaccatcacatcgaacgccacgccgaccgcggaaactcttcgaaacggcaagcgccgctgggagtccatcaggcggaagatgatcgcacttcaggaagaactcgattggcaggtctacgggctctacagcctgctgcgggatgacctgacagcagtcaaggacgagattccggaaataaccttcggagaacgcgcatttgagatcgtattggcgcgtaaagcggcgcgtggcgaagcatctggtgagtggttcgctaggcacgccgcgcagcctgttacgagccttcctaaccactggcccgacacgtaccagaaaatcgtccgtcgacgtatcgaagtcatagagtccaatcgcgctatcgggatgatcgaacggccggagtataagcgtcgctgggccacggacggctgggaggccttacaagaaaaggcgttgcgcgcatggctgctcgatcgcatggagtcatacgatctgtggttcggcgacaccggccaaccccaagtactcacgttgtccaggctcaccgaccgtctcgccgctgacgaagacttcgtctccgtcgctgccctgtactccccccgcactgatttggcgcaggtcgtggcagacctgatcaccgacgagcacgtccccttcctggccgccctgcgctacaagccctccggcttgaagaagcgcgcggattgggaacacgtctgggacatgcagcgccaagaagacgcgatgcccgacggccacaacaagaacaaattccgcgactccatcccggtcccacccaagtacacttcggcggacttcctgcgcacttccttctggcaggcgcgcggcaagctcgacgtgcccaaggaacgcttcatctcctacggctccgccaacgtcgccacccctgaactctacggttgggcgggctgggaccatcgcgagcaggccatggcgatcgccatctacctcgccgaacacaatctctccaccgaagagatcactccgttcctggcaggtctgctcgagctccagccttggctggaccagtggcataacgaggtcgacccgaattttggcatcgcgccctcgaccttcctcgcgggtgaccgccgagaccggcaagacgaacacggcctcaccgacgacgatctccgcaactggcggccgcagcccgcgacccgaggccgccgcgccaccaccaaacgcaccacgaagaagaagtccgcaacggcggagggggacaactga

SEQ ID NO: 2427 - DNA, 3702 bp, Polaromonas naphthalenivorans
atgatcaacgccccccagcttctgaccgacctcaagcgccgcctcgcgctgctcgaaagcgacctgcgcgagcgcatccacacgctgcccgacctcaaggccagcctgcaagccgaatggcaagtcgcccgcgatgccaaccgcacggccgaaacgctggagagctggagcgaccaggtcatcacccaggccggcgtgcattggctgctgagctgcgtgttcctgcgcttcattgaagacaacaccctggtcgagcgcccctggatcggcggcacgccgggcagcggacgcctggtcctggcgcgtgaccggcatgaaacctactttcgcgccagcccgctggagagcgaccgcgattacctgctggcctgcttcacggaggccggcacgctgcccggcctgcacaccttttttgacgccgcgcacaacccggtgtttcgcctcggcatcagcggcgacgcggccatgagcctgcgccagttctggcagcagcaagaccccaacaccggcgcgctgctgcacgacttcaccgacgccagctggaacacccgctttctgggcgacctgtaccaggatttgtccgaagccacccgcaagcgctacgccctgctgcaaacgcccgagttcgtcgaggaattcatcctggaccgcaccttgaccccggccatccgcgagtttggctaccgcgaggtgcgcatgatcgatccgacctgcggctcgggccacttcttgctgggcggctttcagcgcatggtgggtgaatggtcccgcgccgcgcccgcccacaaccggcgcgacgtggcgcaaaaggcgctcgacgccgtggccggcgtggatttgaatccgtttgcggtggcgatttctcgctttcggctgctgctggccgcgctgcaggccagcgacgtgcatcgtttgagcgacgcgccggatttcacgatccatgtcgccattggcgacagcctgctgcacgggcagcgttttggcctgtcggggcaatcgggcatccagtccgacgacctgttcgacgtggccgaaagccacgccgacagcggcctggcccacgcctacgccagcgaagatttaaaactggtgcagcgcatcctgggccgccagtaccacgcggtggtgggcaacccgccttacatcgttgtcagggacgcggcgctgaacgccgcttaccgcagccagtacgccagttgccatcggcaatattcgctgggcgtgccgttcaccgaacgtttttttgagctggccgtgaccgggcgtcctgccttactccctctccctcagggagaggaccggggtgagggcggccccggttcggccggctttgtcggcctgatcaccgccaactccttcatgaagcgtgagttcggcagcaagctgatagagcaggtgctgcctcggctggacctgacgcatgtggtggacacctcgggcgcctacattcccggccacggcacgccgacggtgatcctgtttggccgccatcagacgccgaaacccgacaacccgattcgcaccgtcatgggcatcaagggcgaacccagcgcgccgaacgacccggcgcacgggctggtgtggtcggctatcttgtcgcagattgaccgcgccgggtcagaaagcgagtttgttagcgtggccgatatggagcgcaagggcttggccaaacatccgtggagcattggcggtggcggtgtggctgatgtaaaagagcagattgaagcaaacaccgtcccattgtcatcaatcacgactgatctcggatttgtctgcatcacgaaagctgacgatgtttttgtgcttccactggaggcggcaattcggaaagggtgcgagcctgcggtactgaaagcttttgcagtaggtgaagatgttcgcgactggacagttaacagcgaaaacatttgtctgtttccctacagcgataaggctgaacttcgacctgcgagcgatcttgcgaatgcattgcgctttatttggcgatgccgaacatcccttctcgaccgaaagatttttggtggtgaaacctatcgcgaaacgggaaaggcttggtattcatacggacagatacctgcagagcgtttcaagatcaggactgcgattactttcgccttcgtcgccacctacaaccatttcgtccttgaccgaggcggcaaggtgttcaaccgcacggcgccggtcatcaagctgcccgccggggcaagcgaggactcgcatttgggcttgctcgggttgctcaattcgtcaaccgcaggtttcttcttgaagcaggtgtgtttcaacaagggtaatggtgggattggtggaggaatatcggacgagcattgggagttgcgttacgagtacaacgcgtcacagcttgttgattttccagtcgtagaaaatcgccccctcgacctcgccacccacctcgaccatctggccaaccagcttgccgcctcacaacccgccgcgctgctggccgccgcccacgcgggcaccgaagcgctccccacccgcgccagcctggacgccgcccgcgtccatgccactgaactgcgccgccagatgattgccggtcaggaagaactggactggcgctgctaccgcctttacggcctgctgccagccagcagccaagccgccgatgtcgagcacgccgcgccgcccgaagtcgcgctgggcgagcgcgcttttgaaatcgtgctggcccgccgcgtggctgccggcacggaaaccaccacttggttcgagcgtcacggctcgacacccgtcaccgacattcccggccactggcctgaggattaccgccaggtggtgcagcgccgcatcgacctcattgccagcgaccgcaacatcgccctgatcgagcgccccgagtacaagcgccgctggaactcgcccaagtggaacgatctggagcaagccgccctgcgcgactggctgctggcccggctcgaactgccccgttactggcccgccagcgccgatcagccgccccagctcacctcgaccagccgcctggccgacgctgcccggatggacgccgacttcatgcagatggccacgctctacgcaggccacgccgatttcgacatcggccagctcgtcgcccagctggtcgccagcgaagccgcgcctttcctgcccgtgcagcgctacaccgaagcaggcctgcgcaagcgcgcccagtgggaagccacctgggccttgcagcggcgcgaggatgcgggggaagacttgacggcgagcgtcggcgccattccggttccgcccaagttcaaaagcactgattttctgaaaaccgatgtctggcgcctgcgcggcggcctggacgtgcccaaggagcgctgggtcagctaccccggctgcgaacgcggcgccgacggcagcctgatcattgcctgggccggctgggaccacctgcagcaagccaccgccctggccggtttttacctagacatgaaagacagcgaaggctggccccccgagcgcctgcaacccctgctggccggcctgctggagctggtgccctggctggcgcagtggcacaacgaagtcgatccggtctatggcgagcgcatgggcgactattaccagggttttgtggccgaagaagcccgtgcccagggcttcacgctcgatgacttgcgggcctggacgcctgccgccacggtcaaagcgcgtggacggcgcaaagccacggccgccagcgaatga

SEQ ID NO: 2428 - DNA, 4950 bp, Polaromonas naphthalenivorans
gtgaaaaaacctaaagtaatttccgtcaaccaaatgtccttatttggcgacgttattgaaattgaggagccgccagcgtctgtagcggtcctcaaaccggttgcaaaagccgtagaaacgctgactaagcgccgggagatgtttgttctggaaagcaaatacttcgctcagctgaccgggcctgcagccaaggtgaaagccaacctggcagccgtcaaaatggccatgcaaggtggcaaaaaatcgcttgaagaaaaagcggtcatcgtagcctacagcggctggggtggcatttctgccatgtttgccgataacggcgatttcgaggcccagcggcttgagtttctggaaatggtcggtgaaaaatcgtatgcacaggcccgcgacagcgtgctgacggcttactacaccgagccagaagtaatccaggccatgtggggacttgtccaaaagatgggtttcaagggcggaaaagtcttggagccctcggcgggaacaggaaacttcattggtgccatgcctgttgccctgcgggaagcttcgaccatcaccatggtcgagcctgacagcgttagcgcaacgatctgcaaggcgctctatgcggactctgatacgttggttcacacctgcggaatggagatcgcaccgctgcgcagcgaaagctttgatgtggtcatcggcaatgtgccttttgggaactaccgggttcatgactcgaagtttgattgcatgaagctggtaatccacgactacgcgattgcaaagtcactggacctcgtgcgtgccggcggcattgtggccgtgatcacctcaacgggaacgatggacaagccgaaaagcaattttcgcgagtacatcgctgaacgcgctgatctggtgaccgctattcgtttgccatcgggtgcattcacgcgcctgggtgagacggatgtggcgactgacattcttgtgcttcgtaaaaaaccaaaagttgctgactctcatgtgggtcacgacttcaaggtggctgaagtgatcaagttgcacgagttcggcaacatgaatgagcgcagttatgacacgatcaatgcgttctattcacagaaccagcgccagctcctcggaatgcccaaggccagcacaaaccagtttggtgcttgcctcaagttcgtgccggagttggcctggggtgaacaactgaaaaccatgtgcagcgatgcgacgttggacggttggtacacgcacgaggaacgcaaagaaattcgtgagaatttcgtggccgacatgagcggcttgaaaaccatggtggccagcggctttttctttgacgatcagggtcagctgtattacatgaccaaccaaaacgctgaaagccaggcccatttgcctgagccgaagcgtcggcggattgaaggaatgacgcatattcgaaattgcgtcgtggaactgctggagttggattcggtgggtgcgaacagcacctatgaacgcgccaaactcaaccgcttgtatgacgcattcgttgtgaagtacgactacctgatgaagccgtataaccggcgcctgttcagcctggacagccatgcgccgcttttgtggtcgcttgagcgctacgatgacgaaaatgaaaaggccgtgaaaacggatattttcagcaagtcaaccgtaagcgctgcggtgctgtctgatacggctgaatcgctgtccgatgcgattgccctgtcttacaaccgcttcgcgcggctggacctggcattcatggccaaggccttgtcgctcggtgaggacgaggtggtgcaaaagctgcttgacgctaaccgggtcttttttgatccagaaagcagagagtatgtggactccgaggtctatctgagcggcaaggtgctcgaaaagctacttgtcgcccgtgcggctgcagaaggcgacgaacgttacatgctcaatgttgctgcccttgaagcggtggtgccggcaacggtgccgctgagcaaggtcagcatccagttgggtgtgccatggatcgggcaagaggatgtgcaggcctttgtcgatgaaatcgtgaccctggatgccgaaaaggtccaagactacaacgacattaaagctgtgacagttacgcaagtgattggcatggcagtatggtcggtgacgatggggaatcgatttcaaaaggaaaccaggtatagcggtgattggggaacagcgcataggccatttgatgacctgctgagcgacttgctcaatcagcgcagcaccacggtttacatggaaattgaagtcgagccgggcaagacaaagcgcatcgttaacaaggacgagacgctggcggcacgcgacaaagccgagaagatccaggcagcatttacctcatgggtctatgcagacccggagcgtgtccaacggctggagttcacctacaacagcaaattcaacgggacactcaaccgtgaattcgatggcgcgcacttggtggtgccggggctgagttcggctgtcaagctgcgctcggaccaactggacggcatttgggccggtttgatcggcggcaacaagctttacgcttatgccgtgggtggcggcaagacgctgattaccatttgccttgcgcagatgatgaagcgtctgggttttgccaagaagccgaccatcgtggtgcccaaccacatgcttgaagagtttgcgggacagtatgcgagggctttccctcgtgcacgaatcctggcggccagtaaagaagacctggagggcgacaagcgccgggtactgatgatgagattggcaatggaggattgggattgcatcatcatcacgcacggttcgttcggaaaaattgcactctctaaacaagttgtacaggatttcgcagacgaggccggtgaaaaaatcgatgccatgatctcaggctcggatgatcggaacgtggtgcgcgaggccgttcggcaaaagaagactgtcattgcgaaagtgatggcgctggctgaaaagggcaagaaagacgatggggttttgacttttgaccaactgggcattgatcagttgctggtcgatgaagccgaccttttcaagaatttgtggtttcaaacaaagaaaacacgggttcccggactgagcagcgcttgtagtggtcgcgctttggatttatttctgaagtcgcgcatcattttcgagcgccgcaaggacggatttggtctagtttttgccacagcaacgccgatcgccaacacgattggcgaaatgttcatcatgcagacctacttgcagcctgaccgcctcaaagagttgggaatcgatgggttcgatgcatgggcggctaactttgcccgtgaagtgacttccatcgaggtgacgcccgatggaggtggctaccggatgcacacacgtttttcccaattcgtgaacgtgccagagttgatgctgattttcaaagaagtcgcattgattcgaaccaaggctatgctggcgcttccagagccaaaagtcgctggtgggcgtcattgcattgttgccgcgcgtgcatctgaagctcaaaaggcctatgtgcaaaaactcgtggacagggctgcggctatccgtgaaggaaaagtcaagccgcatgaagacaacatgctgtgcgtgacaggtgacggccgcagggccgccctggatatgcgctgtgtggatggcttggaaatggaccacgcaggcagtaagttgaatgcctgtattgaaaatgtctatcgacattgggctgaaggccgcgagaaaaagcttacccagcttgtattttgcgacttgagcactccgaaggcacatggcttttcggtctataccgacatgcgtgaaaagttagttttaatgggcgtgccggttgaagaaatcgcgttcgctcaggactacaagacgacagcgcaaaagggtgagcttcaccgcaaggttcgctcaggccgtatccgtatcctgcagggctctacagagctgatggggttcggtaccaatgtgcaggatcgactggtggcagagcaccatctggacgcgccatggcgtccgcgtgacgttgagcagcgggacggccgcatcatcagacagggcaacctgaatgaagaggtgttcatctaccgctacgtcacggaatcgacgtttgatgcctacatgtggcaaacgctcgaacgcaaggccggcttcatcgcccaagtgatggagggaaaaacagaaatgcgtagtgttgaagatgtgaccagccaggcgttgagctttgctgaagtcaaggcaattgcctcgggtaaccccttggtgatcgagaaggcgggtgtcgatgcggaagtgtcgaaaatcctctcactcaaagctgcttggcgctcggaccgcgaaatcgtgctctcacgactcgcgaactgtgtgcaaagcatcgactacagcaaaaagcggattcaggcgtttgaaggcgaccttggatcgattgggaacgcaagcgaagttacgctgggtggaatggtgcatagtgcgtcagataagactgggaagtctgtgatggcgcacctggcatcgataaaggctagcgtaacgaccaaggagcatcagtggaggtcgtttgacgccctgctggccgttggcaacatgagcatcgggttggaactgcatggaaaaattggcagcgcaagttacaagttctttgcaaagggatcctctggcgtgagctttgagttcacgcttccctacggtgcgaaagacatcgaaatctttttgaggtctaaacaccttgaaacggatttgatggacaagctaagttggttcagaacccggctcattgcggacgaggctgagttgatcaacctgaaacgtggcgctgaaaaaccattcgagtacgctgaaaggctcgaagcagcgctgaacaagcaagaagagatcgacaagtcgttggacctgagggctgacgatgtttcgacgctgttcatggaagaagaaaagcaagaagaggccgaaatggcttcataa

SEQ ID NO: 2429 - DNA, 3630 bp, Saccharomonospora viridis
gtgcgtggggctgacctgggtgagctggtgaaggacctgcgcaggcaggtcaccgtgctcgaagacgatctgcgggcgcgggcccaggaggtgccggagttccacaccccgctgcgcgccgagtacgacgaggcgtacaagcgggagcgcacggcggcgacgtgggagtcgtggcttgatcagcgggtgacgcaggtggctgcggcgtgggtgttgggcacggtgttcgtgcggttctgtgaggacaacgggctgatccagtggccgttcatcgcggggccgggggagcggttggttgacgcggaggagcggcacgaggcgtatttccgcgagcacccgcaggacaacgaccgtgattggatcgtcgcggccttcaatcacctgtcggaggcgcacccgacggcggcggggctgttcgacgcgcggttcaacccgctgtgggagatcacgccgtcgttcgaggcggccaccgagctgttgcagttctggcggcggcgcggcgacgacggtgagatccgctacgacttcaccgaccccgaatgggacacacgcttcctcggtgacctgtatcaggatttgtccgaacacgcacgcaagacgtatgcgctgctgcagacgccggagttcgtggaggagttcatcctcgacctcaccctcgaaccggccgtcgaggagttcggcctggcagacctgcgcacgatcgacccggcgtgcgggtcggggcacttcctgcttggccttttccgccggattctgaccaagtggcgggaggtcgagccgggcacggatcagtgggagctgatccagcgcacactcgcctcggtgcacggctgcgacaagaacccgttcgctgtttccatcgcccggttccggatgctcgtggcggtgctgcgcgaggcgaacgcgatgcggctggaccaggccccgcagttcccgatcaacatcgcggtgggcgactcgctcatgcacggccgtggcgcgcccggcatccagggcgagctgttcgcgctggacgagccgcacacctacaccaccgaggacgtcaacgagtacgtgcgctcctgcgacctgcttggtaagggctcgtaccacgtggtggtgggcaacccgccgtacatcacggtcaaggacaagcaggagaacaagaactaccgcgaccggtatgacgcgtgttcgggaacgtatgcgttgtcggtgccgttcgcgcagcggctgttccagctcgcgattcgtagggacggatctgagcgcgacgcggggtacgtcggccagatcaccgcgaactcgttcatgaagcgtgagttcgggaagaaactgattgagcaattcttcaaaacggtcaacctgacacacgtcatcgacacgtcgggtgcgtacatcccagggcacggcacgccgacggtgattctggtggggcggaaccacagctaccggcaggatgagccggtccgggctgtgttgggtgtgcgtggggagccgagccaacctgaagatccgtcgaaggggctggtgtggtcggccatcgtcgagcaactgtgcgaacctggcagtgaatcagagtgggttgctgttgatgatctcgaaagagctcgattttctgtcttcccgtggtcgttaagcggcgggggtgctgctccgcttttcgaggacattgatcagcatccggttaaactcggtgaccgagtgaaaagtataggtcgcactacggctaccggggcagacgatgtttttctgttacccgagcgaaaagtggcggagaggctggggttctctgaaagtgtgcgaacactaattgttggtgattctgttcgtgactttcgcgtctcaggggctgtgtacgtttacagtccttatagcgatttttctaatgagtccgttgttgatgcggacagctcgttggttacgcatctcctttggccgttccggcatgtactgagtcggcgcgtaatttttggtaaaggcctccaggagtcagggagtccctggtatgttcacttggagaactacccaagtaagttgaaggtgcgttgcggaatcgggttcgcctttgttgcgacacataatcattttgttctggatcgccaaggttttctatttaatcgtactgcgccggtgatcaagttgccggaggaggctggtgaggacgagcatctggagttgcttggggtgctcaactcgtccacggcctgcttctggctcaagcaggtgtgccacaacaagggcaatggtgcggacagcaagggggcgcgtacgacggctgtaccgtgggaggacttctacgagttcaccggcaccaagcttcaggagttccccctgcctgccgtactgccgttggacctcggccgggcactggattcgctggcccaggacctcgccgcgcacgagccgtcggccgtcgccgaggcaagcacgccgactcgcgcgcggcttgacgccgctcgcgctgagcacacgcggattcgggggcggatgatcgcgcttcaggaggaactcgactggaccgtctaccactcctacggcctgctcgacgacgccgaacgtgcccggctcaccgcgcccgacctcgacaccgtgccggaaatccggctcggcgagcgggcgttcgagatcgtgctcgcccgcaagatggccgccggagaagcggagacggcgtggttcgagcggcacgggtccacgcccgtcaccgagatccccgcgcactggcccgactggtaccggcaaatcgtccaagcgcgcatcgacgtcatcgaaaagcgccgcgacatcggcctcatcgagcggcccgagtgcaagcggcggtgggcctccgagacgtgggagcgcaaggaagccgacgcgctgcgcacgtggctgctcgaccggtgtgagcggcgagacctctggttcgggctgcgtgacgggttctcccagccccgcacgctcaccgtcaaccagctcgccgatcagttccgtgacgacgccgacatgcacgccgtcgccgccctctacgccagcgaccacctcggcaaacccgacctgccgctcgcgcgcgtactcgaaacgatcatcgccgaccagcacgtcccctacctcgccgccctgcgctacaaggacagcggcctgcgcaaacgcgcccagtgggagcaggtgtgggagaagcagcgggaagaagaccgcacgggccagcggctcgacatccccgtgcctccgaaatacacgtccgccgacttccgcaaaaccagctactggacccaccgcggcaaactcgacgtccccaaggagaggttcatctcctaccccgacgcctcacccgacgccgaccccagcctgctgctcggctgggccggctgggaccacaaagaccaagcccaagccctggtcaacctcatcaacgaccgcaccgccgacgccgggtgggaaaccgaacggctcaccccgctcctcgccggcctggccgaagtgatgccctgggtgcggcaatggcacggcgaatacgacgaggaatgggaaggcgtccccgccgacgaataccaagccttcctcgacgaacaacgcaccaaacaccagctcaccgaagacgacctcaaaaactggcgacccgcccccacccgtcggggccgccgcggcacagcgaaggaaacccagcagtga

SEQ ID NO: 2430 - DNA, 3657 bp, Saccharopolyspora erythraea
gtgaaggagacgacatcggtgaacgacgaggcgacggcacgcggtatcgaccaggcggcgctggtgaaggacctgcgcgctcgggtgtccacgctggaggacgatctgcgagcccgcgcggctgaggtcaaggagttcgacgccgcactacgcgaggagtacgaggcggcccgggaggccgaacgcactgcggcgacttacgagtcctggctcgacgagcgcgttacgcaggtcgcggcggcttgggtgctgggcacggtgttcgtacggttctgcgaagacaacggcctcatcccggacccgttccttgcggggtggggcgagcggctcgccgaggcggaggagcggcacgaggcgtatttccgggagcgtccgcaggacaacgaccgggactggattatcgccgcgttcgacactctcgcagccgcgcacccgaccgccaagggcctgttcgatcggaaccacaatccgttgtgggagatcacaccgtcgttcgaggccgcgagcgacctgatccggttctggcggcggcgcggcgacaacggccatgtgcaccacgacttcaccgaccccgaactcgatacccggttcctcggggacctgtaccagaacctgtcggagaacgcccgcaagacctatgcgctgctgcagaccccggagttcgtcgaggagttcgtcctcgacctgaccctgacgcccgcgatcgaggagttcgggctcgacggcctacgcacgatcgaccctgcgtgcgggtcggggcacttcttgctgggcatcttcgatcggctgctgacgcggtggcgcgcgaaggagccgggcactgactcctggacgctgatccgtcgatccctcgaatccgtccacggctgtgacaagaacccgttcgcggtgtcaatcgcgcggtttcggctgctggtagcggcactgcgagcagctggagacgcgaggttggacggggcggcggagttcccgatcaacgtggcagtgggggactcgctgatccacggacgcggtgcgccgcggccggaggacgagttgttcgcggcggaggaagcgcacacctacgcaaccgaggacgtcaacgagcacgtgcgtgactacgacctgctaggtcgggcgtcgtaccacgtcgtggtcgggaacccgccgtacatcacggtgaaggacaagcaggagaacgcgaactaccgcacgctgtacccggacgtgtgctccggcaagtacgcactgtcggtgccgttcgccaagcgcctgttccagctcgcggtgttcacgagcggtgacgatcgccgggccgggttcgtggggcagatcaccgcgaactcgttcatgaaacgcgagttcggaaagaagctcatccaggactacttcgcacagaagatccacctgacacacgtcattgatacgtccggcgcgtacatcccggggcatgggacaccgaccgtgattctcgtgggacgcaaccactttccgcgcatgggcgagtcgatccgggcggtgctgggggttcggggtgaaccgggcgaaccggagattccagccgagggcttggtctggtcggcgatcctcgaccagatcggcaaacccggaaccgaatcggagtgggtgtctgtccaggacggcgagcgcactagttactcccggttcccgtggagtctttccggcggtggcgcgaccgatgttttcgccatggtagaagaggccccgaagcgtttgaaatcgttgttggaacgaccgatcggattcgcgagtttccctgggcaggacgaggtctttttcttttcggattcgtggttccgccggaaccgggtcgaagacgagatggctcgaccgctcgtggtcggcgaggtggtacgcgactgggacgaaaagtgcgaccagactgctctcgtcccgtacggctgggatcagaaaccgatcgaattcaatccggcgagcccatgggggcgtcatctatgggccatgcgcagggtgctttactcgaccaccgggttctccggtgaaacacgggatgaactagatgtcccctggtggacgtggtatcgctggatacctgaacgttatgcgactccgctatcgatcccgttcgcttttgtcgctactcatagccactttgtgctggatcggggtgggaaggtcttcaatcgttctgctccggtgatcaagttgccggagggggcgagtgaggacgagcacctggagttgttgggggtgctgaactcgtccacggcctgtttctggctcaagcaggtgagtcaggacaaagggaatcgtggtggtgagcggtcgaccgggcgctacgcgtgggagagttacttcgagtttacgggcaccaagctccaggactatccgctcccgcaggatcttccgctcgaactcggccgcacgttgggctctctcgctcggcgaatgtccgaaaaggatgcttcggtgttcgcgtccggggctgctccgactcggctcgaactcaacgcatcgcgtgcggaacacgaccgcatccgctcccgcatgatcgcccttcaggaagagcttgactggttcgtctaccactcgtacggcctgctcggcgatgccgaacgcgagcggttgaccgtgcgggttctcgatgcggttcccgaagttcgattgggcgagcgggctttcgagatcgccatggcgccgcgcgccgctgaggatgaggcgatcgagcaatggttcatccgccacgattcgaccccgatcaccgagattccgaccgactggcccgactggtatcgcgagatcgtgcagaaccggatcgatgtgatcgagaagcgccgcgacatcgcgttgatcgagcgtccggagtgcaagcgccgctggtcgagcgagccgtgggagaagaaggaagccgaggcgctccgcacgtggctgctcgaccggtgcgagcggcgggatctgtggttccaggtgcgcgacgggttcgagcagccccgcacgaggactgtccatcagctcgcggacgcgttccgcaccgacgaggacctgcacgcggtcgcccggctgtacgcgaccgaccacctgggcaaaccggacctcaacctctcgcaggtgctggagcggatcgtcgcagaccagcacgtgccctatctggctgcccatcgctacaaggactccggcttacgcaaacgagcccagtgggaacaagtctgggaactccagcgcgaggaagaccgcaccgggacgcgcatggacatcccggtcccgccgaaatacacctccgcagatttccgcaagacgagctactggtcgcagcgcgggaaactcgacgtcccgaaggagcggttcatctcctaccccgacgccgcgcccggctccgatacgtcgctgctgctcggctgggcagggtgggaccacaaggaccaggcgcaggcgttggtcaatatcgtcaacgaccggggcgagaaggagggctggggtgccgaggaactgacgccggttctggcgggcctggccgaggtgatgccgtgggtgcgtcagtggcacggcgagtacgacgaggaatggggcggggtgccggcaaacgagtaccaggcattcctggatgaacaacgcggcaagcaccacctcactgaggacgatctgaaggcgtggcggccgacgggccgtcgcggcggcgcgaagggtgaacgccagtga

SEQ ID NO: 2431 - DNA, 3936 bp, Saccharothrix espanaensis
gtggggtggttccggcacccggcccatcccgctcccctaccctggctccttgtgacaacgccctctctcgatcgctccacgctgctggccgacctgcaaaagcaggtgctgatcctggagaacgacctccgcgagcaggtcgaccgcgagcccgaggtcatggccgatctcacggcgaggcacgaggccgcgctgacgtcggcgacgctgggcacgttcatcggtgagcaggtcacccaggcggccgtggcgtgggtgctcggcaccgtgttcgtgcggtggagcgaagacaacaaactcatccgtccgatgctgtcgggctcgggtgaccgcctggccgaggcggaagacgcgcagggcgcgttcttccggcagcagccgcacgccacggatgcggactgggtcgagcagaccttcgactcactgcgccgcagcgacgcgggcgaggcgttgttcgaccgcaagcacaacccggcgtacctgatcccgatgtcgcacgacggcgcgaaggcgttgatcggcttctggcgtacgcgcaggccggacggctcgctggtgcacgagttccgtgacgacacgtgggacacacgtttcctcggcgacctgtaccaggacatgtcacaggctgcgaaggacaagttcgcactgctccagacgccggacttcgtggaggagttcatcctcgactacacgctgacgccggccctggacgagttcgggctggacggcttccggttgatcgacccgacgtgcggctcgggccacttcctgctcggcgcgttcgagcggttggcgagcgcgtggcgcgaacgggacctcaacctgagtgacaccgagatcgcccgtaaggcgctggactcggtgcacggcgtggacatcaacccgtacgcggtggccatcgcccggttccggttgacgttggccgcgtggtggttggcgggggtgcggacgatcgagcaggcggcgggtcagcgctgggcggtcacggtcgccatcggcgattcgttgctggcgaaaaagagcgacacgttggccgggctcgaccagttcgtgggaatccagatggagtctgaggacgtcgaggactacccgacgttgctggacgagggttcgtaccacgtggtcgtcggcaacccgccgtacatcacggtgagcgacgcgaagctgaacgccgagtaccgccggtactacacggcgtgccaccggcaattccagttgaccgtgccgttcgcgcaacgcttctttgacctggcacgcagggcgggcacggaccgccgggagtcgggctacgtcggccagatcacgtcgaacggcttcatgaagcgcgagttcggcaccaagctgatcaaggaattcttcccgacaattgaactgacccacgtgatcgacacgtcaggcgccttcatccctggccacggaacgccaacggtgatcctcgtcggccgccgccgctccccggaccgaagccagccggtgcgtgccgtactcggcatccgaggcgagcccggccaaccgaccgatccggcgaacggcatcgtgtggacggcaatcaccagccagatcgaccgagtgggcagcgagtcagactgggttagcgtcaccgacttcccccgcgaacgcctattccagcacccctggtctctcagcggcggcggggcggacacgttgacgacagacattgagagaacttcacaacgaaaacttaatcaacattgtgaacttatcggattcttggcaataacgcgggaagacgatgcatacgtacttgactccgcagcagcccgtcggctctcactcgggaacaccgtacaaacatttgctatcggagcagaactgcgagactgggaccactcacccgaattcgatgcagttttcccctacacagcagacgcccgatcaacccgcctcacccaagcgtcagaaaaacacctgtggccaaaccgagtactcctctttcgtaggcgagcactttccggataccacatcgaccggggcatcgactggttcgcgtattccgattttcaccccacgcgctggcgttccacttttctaattagctttgcttttgtcgctacacacaatcacttcgtactcaatcggggcggcaaggtcttcaagcagtccgcaccggtgatcaagctgccagccgaaacgacagaggatgatcacctccaactcctcggggcgctgaactcctccgctgggtgtttctggatgaagcaggtatgtcacgataagggaagccagtccggaaccggcgggttcatgcacgatgcctgggaaccgttttacgagttcaccggcaccaaactggagcagttcccccttcctgctgacctgccgctagcccgtgcgcgccgtctcgacacgctcgcacagcaactcagcgacagcaccccgcaagccgtcgccaaagccggaatccccacccgcgacctcctctcccgcgcccacgacgactacaccaccttccgcgcccggatgatcgccgagcaggaagaactcgactgggacgtctaccggcgctacggcctgctctccgacgccgaagccgccagcgtcgtcatcccagatccctccaccgtccccgccctcaacctgggcgaacgggccttcgaaatcgtcctggcccgcacggtcgccgccggtgaaaccgacacccagtggttcgcccgccacaactccaccccgatcaccgaactccccacccactggcccgacgactaccgccgcgtggtcgaggcccgtatcgacctcatctacaagcgccgcgacatcgccctcatcgaacgccccgagtgcaagcgccgctggtccgtcgaaccctgggacaagcaacaggaacgcgccctgcgcgagtggctgcaagaccgcctcgaatcccgccacctctggtacgccgaggacgccaacggcgcggaacagccgaccatgcgttcagtctccgaactgaccgacctgctccgccccgacaccgcgttcaccgacgtcgcccgcatctgggccgccgacgcgctcggcaaccaggacgtcgacctctccgagatcgtcgccgccctcgtggacgacgagcacgtcccgttcctccccgtcctgcgctacaagcccgccggcctccgcaagcgcgccgactgggagcacgtctgggacctccagcgccaagaggacgacatcgccgccgaactcggcaaggacgtcaccgacccagtcgtccgcaaggaagtcgagacccgactcggcacgatcccggtaccgcccaagtacggctccggcgatttcctccgcaactcctactggcggcaccggggcaagctcgacgtccccaaggaacgcttcgtctcctaccccggtgcgacccgcgacggtgacggcagcctcctgctcggctgggcgggctgggaccaccgcgagcaggcgcacgcgctcgcggtgctgatcagccaccgccacaccgaggaaggctggcccgccgaccgcctcaccccgctgctcgccggcctgcacgaggtgctgccgtgggtgaagcagtggcacagcgacgtggaccccgtctttggcgaatccccttacgtgatctacgagggcttcctcgaaaaccagctcggcgagtccggcatcgcccgcaacgacctgccgacctggcggcccgcgaccaagatggacgtctcgccgctcccccgccgtggcacccgccgccctgccgccgctaaggagcccaagcagcccaaggtggacagggcgttcaccgccgagcagttcgccgttgtgttggacttcgccgcgaacggcccgctgacgacatcccagaccaccgaggtcaccgggctgccgtccgcgcaggcccgcgagctgctcaagcaactcgtggagcgcggtgacctgatccagaccggtcaacgtcggggtactcgatacgagttgccgtccgctcgataa

SEQ ID NO: 2432 - DNA, 3654 bp, Singulisphaera acidiphila
atggtctatattaagacactgctccccgaactcaggggggtcgtcaaggatctggccgaagacctgcttgtccgatcgatgaccgatgccgagagcgacgccgggctgagggaagcgcatcggaagatcaaggaaagtgggcgcacggctcagtctttcgaagagtggcgtgacgactatctcgatcaggtcgccgtggcttgggtgctcgcctgcgtcttcgtccgttttatggaggacaacgacctcatcaacgagcgttggattgccggtgagggggagcacggcaagatggctgaaggggagcacgaactcttcttcaggagtcatcctcacgacaccgatcgggaatatctccaccatgtgttcgtggaggtgcgtaagatcccggcagcggccgaactcttcgctgaggggaagacaccgctgtgggccctggcaccgagcggcgatgcggcgaaacggttgcttgagttcttccaggaagttgatgcggaggtgggcggcttgaaacgctcgttcgccaccgaaaagtgggacactcaacccatcgtcgacgtgtacgagaagttgtctccgcaggcccggttcctcggagatctgtatcaagacctctcggagcatgctcgcaagaagttcgcccttttacaaacgccggtcttcgtcgaagagttcatcctcgaccggacgctgacgtttgccctcgacgagttcggtctagatggcttgcggatgatcgatccagcctgcggatcggggcatttccttctaggagcattcgatcgtctatttcacgagtggatgaagccggagcatggagtcaataacaaggtcgtcgccgcccaaaatgccctcgacggtgtttggggggtggacatcaatccgttcgccgtcgctatcacccgattccgattgctcgtggcggtcgtgaacgcttgcggaatcaagaagctgaatcagcagaattattcttggaagctccatctcgccactggcgacagcctgctttggggcagcaagccaagcttcaacggcgagcgagtaccaatcaaacggcaaggaaattttttcgaggaagtagatcggatctatgccatcgaagaactcgccgcccttgatgaagtcctgggacaaggatatcacgtcgtcgttggcaatccgccgtacataacggtgaaggacaaggcgcagagcgaaaaatatcgagaattgtacagcgcctgtcaccggcaatactcgcttggggtgcctttcactcaacggttctgggagctggcgattcgcaagggggagcgaatcaatcaggacagtgagacagtgagttctggaccgggttacgttggaatgatcaccgccaattcgttcatgaagcgggaatttggcaagaaactgatagaagagtttttccccagggtcgacctgacgcacgtactcgacacttccggggcgcacatccccggtcatggcacgccaactgtaatcctgtacggacgcagtcgtaagcctgttagcgatacggtgcgagccgtgctgggcatcaagggagagccaactactcccgacgatccatcccaagggctggtttggcattcgatcctcagccagatcgaccgggcgggtgccgaggacgaatttacctcgacgacggaggtgccaagaaagacttttgcctctcatccttggagtatcggtggaggcggggcggctgacctaaaggagattcttgaactctcaggttcaatactagcggatgccgtggatctcattggcttaatgttcatgacacgtgcagatgatatttatttcgctgacagggcatccctgattcgggcaggtgtgaacgttactaacatcgccagcgatgtggaaggtgacgccatccgtgactggaccatctcgaccatcgaatcagtgctgtacccctacgatgatcaattgcggccggtgagagagcaaagcgactctggtgttataaaatttctttggccctgccgtgtaactttgtggacacgtcgtgaaccaaacggagaccatcgccaaattggtctcacttggtacgaatggagtagattccagaaagagcgattgcgcacgccacgtacaatcgctttttcaaaaattgccactcacaaccatttcgtattagacagggaacgccagctcttcaactgctcggctccgatcatcaagctccccgccgacgcaaccgaggacgaccacctcgccctgctcggcctgctcaacagctccacggcgtgcttctggatgaagcaggtgatgtcgggcaagcacaaaggggatggcggagaagctcatgccgatcccgcatatcaacggtttgagtttaccggaacgcagctcctgaacttccccatcccggaacaacgcccccttgatctctcccggctattcgatggcctgggccagaagtacaacgtttcgctccccaatgcgatcgtgcaacgcggcatacccactcaggccggtctggaggagggccgggcgacggcggcttgtgttcggggccggatgatcgccctgcaggaagaactcgactgggagtgctaccggctctacgacctgctcagcgacgacctccgatacatcggcaacgacctacccgaaatccggctgggagagcgggccttcgagatcatcatggcccggcggatggccgaaggcaagttgcagacgacgtggtttgtgcggcacggctcgacgccaatcaccgagatcccggcgcattggcccaccgcctaccgcacgctcgtcgagcgacgtatccgggtcatcgacacgatcaaggaaatcgaactgattgagcggcccgagtacaaacgccgctggaataccgagccttgggaggaacaggagcggcgggccttgaagggctggctcctcgaccggctggagtcgccccgttactggccgaacgtggagctgcaatccacggcccaactcgccgaccgggccagcggcgatcctgagttcctgccggtggcggcgctctaccgtggccgccccgacttcgacgtgaccgccctggtggccgaactggtcgaagccgaggccgtctcgttcttgcctgtcctacggtacaagccctcaggacttcgcaagcgtgaggtctgggaacgcacctgggctctccagcggaagcaggacgccgggggagacgtgggtgacatccctgtcccgcccaagtacaccactccggacttcctgaagaacgactattggcgactccggggcaagctcgacgtgcccaaggagcgatggatcagctacccgcacctccagaccgagagcgaccccagcctggttgtcggctgggccggctgggaccacctccagcaggcaacctccctcgtcgcctactacgacgcccgcaagcgggaaggctgggacaacatgcgtctgtcccccctcctggccggcctcgatcaactcctgccttggattcaccagtggcatcctgagatcgaccccgagttcggcgacacggcgggccagtcgtaccagaccctgctggagaacgactcccacgaactcggcctgaccctggacgacatccgcaactggcagcctcccgagaaggcccggaaggcccactcgcctcgcaagaagaagtccttggcggaggatgccgaatga

SEQ ID NO: 2433 - DNA, 3594 bp, Sorangium cellulosum
atggcaggcaagcgcaagaagggagcggacgagagcctcacgacggcgctcgcgcggctcctcgagaagaccctcctcccggacctcacggcccgggcgaagaccccggcggtggccgcggtgctcgccgagcagcacgcccgcgagaaggccgagtcgcgcaccgccgacccgctggccgagtggacgccgcgctggctcgagcagatcggcgtggcctgggtgctctcctgcgtgttcctccggacgctagaggaccgcggcttggtccgccaccggcgcatcgcgggcgagggcgccgccgatgccgagcaactgttcttcgagctcgccccgtcgctcaccgcccgcgactacctgctcaccgccttccgcgaggtcgcccgccaccccagcgccgaggatctcctcggcccgacccggaacccggcgttccgactctcaccgtcgaacgaaggcgcccgtgcgctgctcgatttcttccgccagccggacaagactggtggcggcctgtgctggcgcttcgaggggagcgacacgcggtttctcggagatctgtaccaggatctatcgcccagcgttcgcgagcgctacgcgcttctgcagacgccggacttcgtcggagcgtttatcctcgatttgaccctcgatccagcgatcgcgaccttcggtcttgaggaaacgcaccttattgacgcgacgtgcgggtcgggacacttcctgctcgatgctttcgaacgcatctgcgaacaccggatgcgtacggcgccagggatcgatgttagggaacatgcagcggcggcactggggcaggtccatggggtggacatcaacccctatgctgtggcgattgcgaagtttcgattgatgctggcatatatggcgaaggcggagctcgggaccttggcggaggtgccgcagcggctgccgatcgaggtggttgtggccgattcgctgcttcatggcgtggtggggacgacgcggcggtttgccgagctggaagggcagagagcagaggcgtgggggcagccgatgttcgagctcgaggaccaggatgcgtcggatcgggtgttcgggcggaagtaccaggcggtggtggggaatccgccgtacatcgtgccgagggatgatggtccacgcgacgaataccggaaacactaccgctcttgccatcgaggatactcgctgtccgcgcccttcacggagcgtttgtttcagctcgcggagggtggtggttatgtcggattgatcaacgcaaacagcttcatgaagcgcgagttcggcaagaagctcatcgaagaggtgctcgctcacctcgatttgacgcgcatcattgatacctctggtgcctatgtccctggccatggaactccgaccgtaattttgtttggccggaatcaaaggccggtggctacaaccatccgtgctgtattgggaaaacgcggggaacccaacacgcccgaactaccggagcaaggcgtcgtctggcgctcgatcgctacgcgcaacgacgatacaggcttcgagaacgagttcatctcggtagtcgacgccaaccgggcgaaattcgctcagcacccatggacgctgggcggtggtggcgcagcagatgtcaaggtcttgatcgaggcacgcggcacaagtcgtctcggtgagttggtcgacagcattggccggtcaacgcacacgggtgaggactcgttctttttcatgctcccgagcgcagccgagcgtgccggtgtggcgcgcgatggcttcgttccccttgtgaagggggagcaggttcgagactggggcatcgccgaagatgaggcgactcttttcccctacgacatcaagactgccgagccgcgccctcccataggtcgagccgcgccaatctactggccatatcgaacgatactgcgaaaccgccaggactatggtgaaaaaatcgagcagcggtcccagggcgggcgacgtcttcagtggtttgagcattcgatgttctttcccgagagataccgcaaccctctctcgatcaccttcgccttcgtcgccacccacaaccacttcgtcctcgaccggggcggaaaagtgttcaaccgcacggcccccatcatcaagctgccggaaggggccacggaggaagaccacctcgcgctgctcgggtacctgaatagctcgaccgcgtgcttctggatgaagcaggtgtttcacgataaaggatcaggaacggacacgggtaagtggcaatcagaacctgcgaagatcgcctatgaatttactggaacaggcttgcttccgttgccgattccgtccattccgcagcccaagcctctcgcggagcttgcgtcagctatcgagctagtagcgcggaaacggtccgagcttctgggcgagctaattaatggactcaccgaagaccagtcacggcatgatttccaggggcgcatagcgaaggccgccgatttagacgggcagttgcttgctcatggagtatacctccaggaatggatggattggctcgtctatggatcgctgggtctggcacctgtcagtctcgttgctcgatttgaaaccgattcgaacgtccggactggagttcctcttggggggcgaccgtttgagctgctcttggcacgcaatggacaagctatcggaattgatgggcaacctctcttgacccagttgccaccgtcttgctcgccagagaccgccgcactctgggaggacctcatcagtacgatagcggcgagcccggagctcagtgtcctcgaaacccccgactataagaggcgctggtgcatcactcccaaagacatgggaggtcgtgtcctcacgttcgaggaccgcatgcgcgaccgacttcagtcctggctggccgacaggatcgaggccatattccgcgaaggtcaagcgcggttttcgctacgtcaactgcttgagcgcctgagcctcgacgtatctttcggagtcgcagcgcagcactggtccggcgcaacggatctggatgctgtcatcgcagctttcgtcgcggccgatgcagtcccctacctcgccgccctccgctacacccccgaaggcctcgaaacccgcgccgcctgggagcacacctgggccctccagcgccgcgaggacgccggcgagaagctctccgcgcccatccccgtcccgccgaaatacgacgccaaggacttccgcgaccccaactacttccgcatccgcggcaagctcgacgtcccgaaggagcgcttcatctcctatcccggcgccgagaaggacgacgacccgagcccgctcttcggctgggccgggtggaaccacctcgagcgtgccaccgccctcgccggcctctaccaggagcgcaagaccgaggacggctggggcgccgatcgcctcacccccctcctcgcgggcctcctcgagctcgtcccctggctcaagcagtggcacaacgagatgaacgaggagttcggcgagcgcctcggcgactactacgagcgctacgtcgacaccgaggcccgcgccctcggcctctccctcgacgccctccgcgcctggcgccccgaggccaggggacgcaagggcaaggcgaagcgagccgcgccgtga

SEQ ID NO: 2434 - DNA, 3633 bp, Streptomyces coelicolor
gtgatcgaccgcaaggctctgttgaacgacctgaagcagcaggtcaaagcggtcgaggccgacctcggcaagcaggtgaaggcgctcgatgaggtcggcgcccggctgcgggccgagtacgatcaggcgcgcaagctcggacgcacggcggcgacgtggaactcgtggctggacgagcgggtcacgcaggtcgcggtggcgtgggtgctggggactgtgttcgtgcggttctgcgaggacaaccggctgatccccgagccgtacgtgacggggccggacaattaccggcgtgacttggcggagactcgatatgacgtgtacgtcgaggcggacgatgatccgacctaccgcggatggttgcggcgagccttcgctgagttgggcgatgggcaggccggccgcttgctgttcgatagcgaccacaatccgttgtaccagatcccgctttcacatgacggtgcgcgggagctggtcgagttctggcggcagcgtgatgaggagggcgctctcgtccacgacttcactgacccgctgagtgcggacggtacggaggggtggggcacgcggttcttgggggatctgtaccaggacctgagcgaggctgcgcggaagacgtatgcgctactccagacgccggagttcgtggaggagttcatcctcgatcggacgatgaaccccgcggtgcgggagttcgggtacgaagaactgaagatgatcgaccctacgtgtggttcggggcactttgtgctgggggcatttcgacggttggtgcggctggggggggagaatcagccgggcaaggatgtacaccagcgggtgcgggctgcgttggactcggtgcacggtgtagacatcaacccattcgcagtggccattgctcggttccggttgctcgttgccgcgatggcagcgagtggtgtgcggacgctggacgaggcctcgaaatacgagtggccagttcatttggcggtaggggattcactgatcaagtctggctctcagcagggtagcctgttcggcgaaagcgacgatgacctcaccgatgagctggccgagttcaagtacgctacggaggatgtgggcgagcacccagagatgttgaggccggggcgttaccacgtcgtggtggggaatccgccgtacatcacggtcaaggacaagagtcttaacgccctgtatcgagagttgtatccggcttgtgcggggaaatacgcactgtcggttcctttcgctcagcggttcttcgagctggccaagcgcgaggatgccgagggaagtggctatggcatggtcggacaaatcactgccaactccttcatgaagcgtgagtttgggaccaagctcatcgaggggtacttcggccacgcggtagagctgaccgaagttattgacacctccggtgcctacattccggggcatggcacaccgacggtcattcttgtgggcacgcgacggggcggggatggacggtcgccggttattcggactgtccgtagtgtgcagggcgagcctgtggcgccggagaacgccgaggaaggcctggtgtggcgggcaatcgttgagcagatcgacaagcctggttcagtgagccagtgggtgtccgtggacgacctggatcgcgagaagtatttcagtaagcagccgtgggtccttgccgatggtggccaggagatgttggagcagatcaacgcggccagtcacgcgatcctgaagcgtgatctgcaccggatcgggttctacgggatcatgggggcggacgacgccatgagcgccgttccgcgcacgttcaggaggaacaacgccgagtctgagtacgtccgacgccttgtcgtgggagatgaggtacgtgacttccgaatcgcggatggggacgacgcctttcacccgtacggcagccaacgcgacctggttggtccagatgcctttcctaacctggctgcttggctgtggccgtaccggaccgaattgggaggccgcgccacgttttcgggcggaacgtacttcgcggatggtcggccttggtgggagtggcaccagcttcccaaggatgtgggagcacatgcgtggtcgctgaactttgcatttgtggcgactcataaccatgtggttcttgaccgcagtggatgtgcgttcaccaggacagcaccggttatcaagttgcgggagggagcgagcgaggaggagcatctgcggttgctcgggttgctcaacagctccacagcggggttctggctcaagatggtgagctatccgaagggcggcgacccggttggtgatgaaggtgctcgggtcagtgtgcacccttggtccgacaggtacgagttcaccggaaccaagctccaagaattcccacttccttccgagtatccgaccggcctcggcaccgctctcgatgccctggcccagcggcttgccgcggccagcccggcggctgtggctgctgaggctgtccccattgctggcctacttcgcgaagcaaggactcgctgggaagcgatccgttcccgcatgattgcccttcaagaggagatggattggcaggtctactctctctacaaactccactccgaagaccttcgcgtctcggaagaccccgacgacaccaatatccccgaactgaccctcggtgggcgtgccttcgaaatcgtcctcgcgcgccgcgtagccgcaggcgaggccagcgatgagtggttcaagcggcacaactccacccccatcacggagatccctgctcactggcctgccccctaccgtgaaatcgtccagaagcgcatcgacgccatcgagtcgaaccgtgccatcggcatggtcgagcgccccgagtacaagcgccgctgggccaccgaaggctgggacgcgctccaggagaaggccctgcgctcctggctgctcgaccgtatggagaaccgtgacctctggtgtgacgagaacggccagcccaccatcctcaccctggcccgcctcaccgacgccctctcccgtgacgaggacttcgcctccgttgccaagctctacgcgccccgcaaggaactcgcgaaggtcgtcgccgagctgatcaccgacgagcacgtgccgttcctctccgccctgcgctacaagccctccgggctgaagaagcgcgccgactgggaggaggtgtgggacctccagcgcaaggaggacgccgcaccggacgagccggccaagcggaagatccgggactccatccccgtaccgccgaagtacacctcggccgacttcctccgcccgtcctactggaaggcgcgcggcaagctggacgtgcccaaggagcggttcgtctcctacgggcagaccaacgccgccacccccgagctgtacgggtgggccggctgggaccacagggagcaggcgcaggccctggcgacgtacttcaccaacaccgcgttgtccaccaaggagatcacaccgttcctcgctggcctgctggaactccagccgtggttgtctcagtggcacaatgagttcgacatgctctacagcggctccccggcggacttcttcgcgggttaccgccagcagaagcagggcgagcacgggctcactgacgacgacctccgtggctggcgtcctccggccgcgacccgacgtcgtcgcgcagcagcgaagcagtag

SEQ ID NO: 2435 - DNA, 3642 bp, Streptomyces griseus
gtgatcgaccgcaaggctctgttgaacgacctgaagcagcaggtcaaggcggccgagacggacctgtcccagcaggtgaaggccgtggcggaggtgggtgcgcggctgcgcgccgagtacgaccgagcccggaagctgggccgtacggcggcgacgtggaactcctggctcgacgagcgcgtcacgcaggtcgcggtggcatgggtgctgggcacggtgttcgtccgcttctgcgaggacaaccgtctgatcccggagccgtacctgacggccccggaggacgaccgccgcgacctggcgctcgcccgcttcgaggactacgtgtccacatcggacgacccgacgtaccggggctggctggagacggcgttcgaggaactgggcgcgggccaggcgggccggctgctcttcgacaagaagcacaacccgctgttccagatccctctctcccacgacagtgcccgcgacctggtcgacttctggcgggcgagggacgaggagggcgtgctcgtgcacgacttcacggacccgcttgaggaggacggcgacggcacgaagggctgggacacccgcttcctgggcgacctgtaccaggatctgagcgaggcggcccggaagacgtacgcgctgctccagacgccggagttcgtggaggagttcatcctcgaccggacgatgactccggcggtgcgggagttcgggtacgagggcttgaagatgatcgacccgacgtgcggatcggggcacttcgtgctgggtgcgttccggcgactggtacggctatgggcggacgggcagccggggcgcgatgtgcatgagcgggtggcggctgcgctggactcggtgcacggggtggacctgaacccgttcgcggtggccatcgcgcggttccggctgttggtggcggctatggcggctagcggagtgcggacgctgggggacgccgcggggtatgagtggccgattcacttggcggtgggggactcgctgatcaagcaccggcacaagcaggggaacctgtttgacgggctagaggaggagggtgcggacgagctggcggagttcaagtacgagacggaggacgtccacgagcatcctgagatcctgcggcaggggcgataccacgtggtggtggggaacccgccttacatcactgtcaaagacaagaggctcaatgagctgtaccggggactctacgacgcttgcgccggaaagtacgccctctctgttccattcgcccagagatttttcgagctggcgctgattgggcatgccgagagcggacgcgggtacggaatggtcgggcaaatcaccgcaaactccttcatgaaacgggagttcggaactaggctaatcgagactcactttgcacacgagattgaactgacagaagtaattgactgctcgggagcttacattcccggacacggtacaccaaccgtgattctagtcggcaggcaccgctcgggcagtcaacgctcagacactatcctcacggcaagaagcatccagggagaaccaggtacaccgaacaacgctgaagaaggtaaagtctggtcggctatcaccaatcagatcgaagatcccggctcggtgagccaatggatttcagtcgaccatctcaaccgaaaacattacttcggaaaacagccttggattctgactgatggcggactagaactcaatcaacaaatcgaaaagactagcacagaaaaactacgaagtgccctatctcgcgatattggcttcgcgagcttccccggccaggacgacgcattcattcatccgccagaaacgctccgccgttacggcatcggagacaatgtagcgaaaccgttgatcgttggcgaagtggttcgcgactggagcacacatagcttcgagagcgcaatcgcaccgtacgactcttcgctttctcctctaccgtacgacgagagcagtccatgggggcgcctcctttggacggcgcgacgctacctgcgatcaacaaccgacttcgatggacgcactcagcacgacctaggaaagccctggtgggcatggtatcgctgggtccccgagcgatacaggaccccgctctcgattacgtttgcattcgtttcgcgacagaatcacttcgtattggacaggggagggaacgtattcaagcagtccgctccagtgatcaccctgcgtgaggggtcgagcgaagaagatcacttgcaactaattggacctctgaatagctccaccgcctgcttttggctcaaaatggtaagtcaagccaagggcggcatggacaataacagtgggggtggaaaccgctgggttcctgagtcctggatggtccactacgagttcactggaaccaagattcaggaatttcccttgcccgccatcagacccacagcccttgctgcgactttggattcgctcgcgagccagctcgcttccgaaagctccagcgctaccatccgggaaactacacccactgcgtccgccctccgcgagttgagggggaaatggcattccgtccgcgctcgtatgatttcgctgcaggaggaactggactggcaggtctactcactttacggtttgcaccctgaggatctcactggctcagaagaccccgactcctcttgtgttcccccactgactctcggtgagcgcgccttcgagatcgtgcttgcccgtcgcgtcgccgcaggcgaagccagcaacgagtggttcaaacgccacaactcagtcccaatcaccgagattcccagacattggcccgatacttatcgcgagctcgttcaaaagcgcatcgacgctatcgagtcaagccgagccattggaatggtagaacggcccgattacaaacgccgctgggccaccgaaggatgggacgcactacaacagaaggccctccactcttggctgctagatcggatcgagaatcgacgccactggtttactgagaacggcacgcctgctctcgtctccctcgctcagctaaccgacgctctctcccgcgatgaggacttcgtctccgtcgccaagatctacgagccgcacaaggaactccacaccgtcgttgctgagctgatgacgggcgagcatgtgccgttcctcgccgccctgcgctacaagccctccgggctcaagaagcgcgcggactgggaacacgtgtggaatctccagcggcaggaggacgcggccccggatgagctggccaagcggaagatccgggacaccatccccgtgccgccgaagtacacctccgccgacttcctgcggccctccttctggaaagcacgcggcaagctcgacgtgcccaaggagcggttcatctcgtacgggcagagcaacgcggccacgcccgagctgtacggctgggccggctgggatcaccgtgagcaggcctacgcgctcgacgcgtacatcgcgtcccacgaggcattgaccgcagaggaactcaccccgttcctcgcgggtctgctcgaactccagccctggctcgaccagtggcacaacgagttcgacgccaccttcagctcctcccccgccacctacttccggggtgaccggcagatggtccagggcgagaacgggctcaccgacgacgacctgcgcgcctggcgaccggtcgctgtcaaacggggcgccaagcggaagtag

SEQ ID NO: 2436 - DNA, 3966 bp, Thermobifida fusca
gtgaccgccgtgtcttctccacctgcatcgtcgacggtttttgccgccccgcgcggctactcgtcggtgcgcgtagcgggctcgctgctcaccgctgccctcataggccggatcggttccggcgacccgcagttgccagggcttcgctccgaagactacggccttgccccggggcggcggctaggcgagtttgcgagccgccactgggaggagctgctcggcgtctaccgggagttccagcaacaactcacccaggccagctctggcgagtcgcgggcagcgctcactcgggaacgctggctgctgccgctgttcgatgcgctcggtttcggtcggctccacccccagcgcgaagggttgacggtggccgggcgcacgtttccggtcagccatctggggcgcaatgtgcctatccaccttgtggcgtgggggcgcgacctcgaccggcggtccaacggggaacgtgccccccagtcgatgctccaggacttcttgaactcgagcgacgagcatgtgtgggggatgctcagcaacgggcagaagctccgcctgctgcgtgacgccgcatcactctcagaggccgcgttcatcgagttcgacttggagtcgatgttcgacggcgccctgtacgccgactttgtgctgctgttcgcgctcgcccattcttcccggtttgaggcacggacctccgacaagccggggaacagtgcggagcagccgagcgtggcgaactgttggattgaacgctggcgggttgagggcgaccgtgcgggaatccggttccgcgcgaagctccgcgacgggttgaaagcggcgctagaggaactgggcacggggtttctggaaggcaacgcggagctgagggagaagctgcgccgcggggacgtgtcccgccgggaattccgtgacgagctgctccggctggcctaccagttgctgttcttgtttgtggccgaagacaagggtgcgctgctcgccccggatgcggaccaggctgcccaggaccggtaccgcacctatttttctacgcagcggctgcgccgtatcgctgtgcagcgggtaggcgaccgccacgacgacctgtggcggacactgctgatcgtgctcaacgcgctcggctcggatgagggctgcccggagctggcgctccctgccttaggaggcttgtttgtcccggccaacgcggtggaaggggacggctcgcacccggggctgttgcggggccgggacgtcactttgtccaaccggcgtctgctggccgcggtgcgtcacctcacccgggtcgaagacgagggcgggtgctggcagcaggtcgactaccagcatcttgacgccgaagagttgggtttggtgtacgagtcgctgctgaacttggtgccctacaccgaccctgctgtccgggttttcgagttgcggagcgctgccgggaacgaccggaagacgaccggctcctattacacaccgtcttctctggtggagacgctgttggacagcacactcgacccggttatcgaggagcacgccaagcgtggggtcccagacgacctgttgaagatcacggtgtgcgatccggcgtgcggctccgggcatttcctggttgctgcggcccgtcgtatcgcccgcgcctacgcggtcttggaagccggggacgaggagcctactccggacgctattagccgggcgatgccgaaggtggtgcgccactgcatctacggggtggacctcaacccgctggctgtggagctgaccaaagtgtcgctgtggcttgcgtctgtggagccggggaagccgctggcgttcctcgacgaccacatcaaagtgggcaacgcactgttcggagccacgccgagactgctcgaggccgggatcccggacggggctttcacagcgttgaaaggtgacgaccggaaggtcgcggcggggctgcgagcccggaaccggcgggaggtgcgggccctccaccgggagaggggaagagaggttcgcgggcaagcccaggaggtgcgggtttttgacgcgcccctagacaagcagcggtgcaagcgtgccgctgacgcgtggtgtgccgcgtttgtgtggccgcaacgtcccggcgctcccgacggggtgacgacggccactcttctccgcatcagccaggggcaggctctgccgccagaccagcaggagatgatcgaccggctggcccggaagtaccggttcttccattggcatgtggagtttcccgaggtttttcgcgggtgcgacggggatccagcggaggacttcaacccggtgaccggttggcggggcgggttcacgtgtgtgctcggcaatccgccgtgggagcgggtgaagctccaagagagggagtttttcgaatcccggcattcagaagtcgctggagcggcgaacaaagctcaacgcaaggcgctgatcagcgagttggcggggagcgaagaaggcgcgcacttgctgcgcgagttccaggaggctaagcacacgtcggaagggctcagcctcttcctgcgtgagtcagggaagtatccgctgaacgggcgcggcgacgtcaacacgtattccgtgttcaccgagcaggggaaggacctgctgcatcctcacggcaggctcggtgtcattgttccgacgggcatcatcactgacgccacgactcagcatttcttcaaagatgtcgtgggacgccaggtgctggcctctgtgttcgatttcgagaaccggagaaggctgtttcctgacgttgacagccgcctcaagttctctttggtgacgttgaccggccacgcggacactgtcgagcacgcaaggttcgctttcttcctgcacagcgctgctgaactgaacgagccggacaaagtgttcacgttgagcacgaaggagatcctgaaactcaacccgaacaccgggacctgccccgtgttccgttcccgccgtgacgcggagatcacactgcagatctacgacagggctcctgtcctcgtcacccacggcgaagaagcggagaatccgtggggtgtgtcgttcacgagaatgttcgacatgtcgaacgacgcccagcttttccgaagctatgcggagctcgcttctgacggctggcggctggaaggcaacattttcgtccgcggggaggagcagatgctccccttgtacgaggcgaaaatgctgcaccactacgaccacaggtgggcgacgtacggaaaaaccggcagatcggcccgggacatcccgctggaggagaagaacaacccccacgggttcgctcttccccggtactgggttccccggcaggaagtcgagaagcgggtagggcgggagaacggctggctgatcggcttccgaaagatctccaacgtgaccaacgagcggacgctggtttctttcgcttttccgctgcgcgccctggcagattcaggaaacatcctcctcaccgacaaggaagagaagtcttcgctctacgcgaacatcacttcatttattctcgactacacgctgcgccagaagctcgggggaacaaacctcaacttcttccagtttgaacagctccccgtcatcagtccggaggatttcagcaggaaagcagcgtgggatttcgggttcaccgtgcatgaatggttgaccccccgtgtcctggagctcagctacaccacctgggacatggagttgttcgcgcgtgacctcggggacttcggagcgcctttcgtttgggacgaggaacgcaggtttctcctccgctgcgagatcgacgccgctttcttccacctgtacgggatcgcgcgcgacgacgtttcctacatcatggaaatgttccctcttgtgaagcggaaggacctcaagcagcacggtttttaccgcacgaaggacacgatcctcgaggtttacgacgcgatggcgaaggccatcgaggccgatgatccttatcagacggttctcgacccgccgccgggcaaaggatcccgccactgcacgtga

SEQ ID NO: 2437 - DNA, 3588 bp, Thermobispora bispora
gtgactgttgtccccgctgcgctgctcaaggaccttcagcggcaggtgacgctcgtcgccgaggacctgcggcggcaggccgagcgggtgcccgagctcggcgcgcgtctggaggggatgtaccgagccgcgaatgaggtcggccggacaggcgagacctggaacgcctggctcactgcgcagagcgagcaggcggcgtcgtcgtgggtggtcgcctgcacgttcatccggttctgcgaggacaacgacctcaccgcgcaccgctggatcgcctcccgcgatgcgaacggtaacgcgaccaccgaggcggccgacgccgaggccgcctggatccggcgcaacccccggctgaccgcccgcgagtggctccgcgaggcgttcacctggttgcgcgcgacccgggccgggcaggcgctcttcccggacacggacttcgtctggtggtgggacatctccgccgacatggccgatgcgctgatcgccgcgttccggcggcgtgacgccgacggtgtgcggctggcccacgacttccacagccccgagctcgacacccggttcctcggcgacctctaccaggacctctccgagcatgtgcgcaagcgctacgcgttgctgcagacccccgagttcatcggggacttcatcctcgaccggacgctcacccccgcgatcgacgacttcgggctggacgggctcaagctgatcgacccggcctgcggctcgggtcacttcctcctcggggcgttcgaccggctgctccaggcctgggccgcgcaggccccggggatggatgagcgggtccgggtgcagaaggtgctcgacagcatccacggcgtcgacatcaacccgaccgcgaccgcgatcacgaagttccggctcatggtggcggcgctccaggcgtgcggggtcacccggctcgacgaccccggcatccccgcgctgcggctcaacgtcgccaccggcgactcgctgctgtatgccagcaagttcggcggccggcagaccgaactccaggtgcaggacggctcactcgtcgcgcaccggtacgactgggaggacatcgaccggtacccgggaatcctcgcgcacggccgctaccacgtggtcgtcggcaacccgccgtacatcacggtcaaggacaaggcgctcaacctggcgtaccgcgatcggtatcccacctgccatatgaagtacgcgctgtccgtgccgttcgcggagctgttcttccggctcgcggtatgggataccgagcggcccggttacgtcggccagatcaccgcgaactccttcatgaagcgggagttcggcaagaagctgatcgaggagttcttcgcggcgaaggtcgaactgacccacgtcatcgacacctcaggcgcgtacatcccaggccatggaacgcccacggtgatcctgatcggcaagaaccgcgatcggaatcgcctcggcacgattcgcgctgtgcttgggatccgcggtgagccatctcagcctgaggatccacgactgggcttggtgtggagatcgattagtggtcatatcgatcagcctggtacggaaaccgaatatgtatccgttgccgatttaccgcgcgaatggttcaccgcgcatccatggacgctgggcggtgggggcagtgctcagctgcagacgcttattgagtcgatggcgcaggtgaagctaggcgagctagtcgaatctataggaattacctgtttcacgctggaagatgatgtctacgtttttccggaacggtgtctcgatcggcgtatgattcctaaagattttcggcgtcccatggtgcttggtgatggccttcgtgattggggtattagtgtaaatggctctatttctgtatttccttatgactttaattttcttcctgtggaagttgaaaatgaaagagtgctttatctgcatttttggccctatagaacaaatcttagtaaaaatatcatgttcggggggaggacgaaggtggcggctggactccgatggagtgaatttggtcgcctaacagtgaacaagctacggacgcccctctcaattacatttgcgtttgtggcgacgcacaaccacttcgtgcttgatcggggtgggaaggtcttcaagcagtccgcgccggtgatcaaattgccccgcgagaaaacggaagacgaacacctacgccttcttggtctactcaactcttccactgcctgtttttggcttaagcaggtaagttatccgaagggcggtgacccgatcggcgatgagggcgcgcgggtcagccttgaggggtggtcagatcgatacgagttcactggcaccaaactgcaggatttcccgatccccgaaggtgcaccactggagcgagcgcgtcggctggacgccctggcgcaggagcttgccacggtgatgcctcagcacgtctgcgcgcggggtgtgccctcccgtgaggcgctcgccgaggcccggcggcgctaccacgagatccgcgcggagatgatcgcggtccaggaggagctcgactgggaggtctacaagctctacggcatcctcgacgaggacctcacttacgacggcgacgacctgcccggcctggccctcgggcagcgggcgttcgagatcgtcctcgggcgcaaggtgctcgacggcgaggtcgagacgcagtggttcgcccggcacggctccaccccgatccgcgacatccctgccgagtggccgcaagcctaccgcgagctggtgcagcggcggatcgagatgatcgagaacaagccgctcatcggcctggtcgagcgccccgagtacaagcggcgctgggccgccgagccgtacgagaagatgcaggccgaggcgctgcgcacctggctgctcgatcggctggaggaccggcgcctgtggttcgacgaagcggaacacccccgggcgctgagcgcggcccagctcgccgacctggtgcgcacggacgccgacttccgccaggtgctcgacctctacctgggccgccccgactacgacatcaccgccgaggtggccgcgctgctcaaggacgagcacgtgccgtacctcgccgcctaccgctacaccgagagcggcctgcgcaagcgccaggactgggagcacgtgtgggccctgcagcgccgggaggacgcgggggagaaggtcgagattccggtgccgcccaagtacggcccgaaggacttcgccgcccagagctactggcggcaccgcggcaagctcgacgtgcccaaggaacgtttcatcggctacccgggggccgagcgcgacggtgaccccacccccgtgtacggctgggccggctgggaccacctgcagcaggcgaaggccctggccagcctcatcatcgagcgcggctaccccacgggcgatccgcgggtgaccccgctgctcgccgggatcgccgagctcgagccgtggctgcaccagtggcacaaccagtacgacgccgtctacggcgagcccccggccggcttcttcacccggtggctggagaccaagctcaccgagcacggcctgacccgtgaggcgctcgccgcgtggcgccccgagaccaagcagcgcggccggcgcgcgaggaagggagcctga

SEQ ID NO: 2438 - DNA, 1683 bp, Hahella chejuensis
atggctgacgcaggtcttagatggtatgactatatgcaacataccgcatccgcttaccaaacatcgctctctataacttttgcattcgtggcgacccacaaccattttgtgttagaccggggtggcaatgtattcaatcgaactgctccagttataaagctaccgactttggctacagaaactgatcatttcgggctgctagcattgctaaatagctcaactgcgtgcttttgggggcgtcagacgttttttgggcgtggcgggttttctgatggtaagtggcaagagcgaatggagtgggacggtacaaagttaaaggcctttcctgttgttgaagatacgagcaagcaagcaaccctatttgcaaagcaaatcgatagtttaacaaaacgtctagagagttgtagtccatcatcaatactcaaccaagcagaagatcaactctatgaagcactatcaaaggcaaaagaaacagaatataaaatattgagagaaatgattgctctgcaagaagagttggattggtttgtttactatctatacggattaacaaaagcacccttgtgttgtgagggagaacttccagaaattgatttgggtcagcgagcattcgaaatagttttggcaagaaaaataaatgcaggcgagttaaagactgtttggttcgagcaccattgtagtaaacctaataccgaaattcctagcgaatggccggaaaaatatcgcgatatagtgaacgcgcgcatcaatgagataaaagaaaatgagtcaattaaattaattgataacaaagatcataagcggcgatgggcaagggactcttgggacgacagattaaagctagctgcaaaagattggttattggattgcattcagaaattgatggaattccataagctttcaacctgcgctcaattagctgacaaagttcgagaacataaaaaagcaaggcaggtggccgcaatatataccagaggggaagactttgattttcaaactctagtcagtgatttggtagcttcagataatgttcctcaaactgcggccgaccgaatcaagcctgcagctatggaaaaatatcgtgcttggcaggaaacctgggaaaagcagcggctagaagacgcgattgatgctgaattcggagtggacaggcctttgtctgaagtggattccgccgacgaaagcaaccgtgccaaatacgaagaagctaaacgcaaagctgaagctaaaaaagccgagattattggcgatattcctcttccgccccaatacaaacaaagcgacttccgaaaagccagctactggccattacgcggtaagctcgacgtacccaaagaacgattcttctctctgccaggctgtgaaaaagacggcgataacacgttagtgattggctgggcaggtttaaaccatttgcagcgcgctcaagccattgccgcttggtacgaagaccgcaaagaaaacgatgggtgggaagcggaacgtttaatgccgatgttggtagcgatagacgaattaattccctggctaaaacaatggcacaacgacatagaccccgaatacggtgaacgtatgggtgacttttatgaaagttatttgttggaagagctgcgccgttgggagttaacgcgtgaagaattgttggattggcgaccgccgacaaccacaagaagacgaagataa

SEQ ID NO: 2439 - DNA, 3723 bp, Actinomyces sp.
atgaacacctcagtgttggagtccctggcggccgcctcgcgcgagcgcctcatcgagatgtccgtggctgcgatcgagcgcaagatggccgatccgcttctgagcgacgccgaccgcgtgcgcctgacccaggctgtcgacaagcatgccgaggccggtggtaaccgggtgctgggtgctgcgaaggtggttgcctactcctggtttaaccgcctgacagccctgcgctacatggacgcgatgggtctctcaggtgactacggagtcgtcaccccggccgagggtgcggggacgggtgtacccgagtgcgtgcagcgcgcccgcgggggtgacttcgaccgacacatcggagaggatgcgcgagcgcggatagtgcagctgctgttcgataatcaggaccttgatgcatacgttctgctgctccgcgagtacttcacctcgtggcacctggtcatgccgggcgtattccccgaggcggaagactggacgaacctggttccgccaacggacctcctgtcggctggtgagtctgtgcgtgccgatatcgttgcggcgatcaaccccaacgattctggacgcatggacgttgaggtaatcggctggctctatcagttctacatttcagctcgtaagcaggaaatcaacgagtcgaaggccaagatcgacaaggacacgttggctcccgtcacgcagctctttaccccgcactgggtggtgcgctacctggtggagaatacgctggggaagcagtggctgcgtgcccacccggactccgcgctccgggagaaattcgagtacctggtgacccctgccgaaggacaggaggatgagggcctggcaatctccaaccccgaggacttccgcgtcatcgacccggcctgcggctctgggcacatgctcacctatgccttcgacgtcctgtgggagatgtacgctgaggccggatacccgaccaggcagatcgctcgcctgatcctggagaagaacctgcatggtgcggacgtggatgggcgcgcggcgcagctcgcttccttcgccttgacgatgaaggccgtcgagcataatcctggtttcttggggcgtatcgagcgccagagtcagcgagatggcgagacctcgtggcaggggcccagaatcgttcacgttgagtctatggaactcgatgagctgagccccgcagagatcgcggatgcctccgacgatggagtgtccctcggcatgtctcagctgatcgaacagctgcgctatgccgacgcctacggatcgctgatccgtgtgcccgagggtgcgtctactctgttccgcgagatcgcgcgccgcattgaagcgggggagaagcagcaggtgctgggcggcgcggacagtgaggagtggctgcgcgccgccgacatgtgcgagatccttgaggacggacgctacacgaccctgattgcgaacccgccttatctcagcatgaagaaggcgaaagatccactcaagcggttcgcgaacaaacactacaagcgtagttccacagacctgtgcacgatgtttatcgagcgtgctgcttccctcgctcaacgtcgtggtgcgatcggtatgatcacgatgcacgcgtggatgttcctggactcgtatcgagaactgcgcccgtggatgttgtcgaccatgagtatcgactcgatggctcaccttggtacgcgtgccttcgactcgattgggggagaggtcgtccagacgaccgcttttacgattacgaatgcaactagcgatgtcgaccgtgtcggcgtctatttgcggctagtagacggtcgaaacgaagctgaaaaagaccttgttctccgaacggtagcgtgtgaacagaagcatgacattcgctttgaagtctcacccgcaacttttgcagtgattcccggaaggcccatagtgtactgggctagtcgccaaatgcttaacgcttttgaagcgggcgtcccgttgggagaggtggcgcccgcgaagcaagggctcgcgaccgctgataacgagcgattcctacgtcagtggttcgaggtaagcgccgaccgctcttacatgcaggcccgcgatcgtgcggatgcccaggccagtggtgcacgctggttcccacacaacaagggcggcgagttccgcaagtggtggggcaaccaggactacgttatcaactggcaggacgatggccgtgaactttgggatttcagaccacgctcggtcatccgaaatcccgattgttacttccgtccctgtgtttcgtgggcgcgtgtgtcctcaggtgatccgtcattccgattgtttgattcatcttctacatttaacgacaaaggtgccgctgtatttttgagctcgcatcagcaaacatatgagatgcttggctatttgaattcgagtacaacgttaaagcttgaatctacaatcgctccaaccgtcatgttcgaggttggccaggtgaagaatctcccctggatcaagcccgagtcctttgattcggcgggagtcgagcggttgatcgagattttccgcgccgactgggacgcccgtgagacctcgtgggacttcgcccggcctccctacctgcgcggcgggtactcgctgctccaggatgcctttgacgactggtaccgccgcagctgtgagactgccgatgaagcgcgacgcctggagacggaaaataaccgctactgggccgaggtctacggcctcgcggacgaggtggagatcaacgttccactctcgcgagtctccctcacctataacccgcggttcgccttcgcccccacgaagggtgcgcccgagcgcagcgaggaggaataccgctggctgcactaccaatgcagcgcgcgcgaactcatctcctgggccatcggcgtcacgatgggccgctacagcgtcgacgtgcccggcctcgtactggccgaccaggcctcgtcgcttgacgacttccgcgcccgcgtcgccgaggcgcgcctcgaacccgacgatgacggcatcattcccgtcaccggcggcgccttcgacgacgatgcctcgcgccgcgtcagggccgtgctgcgcgttgtcttcggtgccgctgatctgggtgacaacatcgagttcctcactcgctgcctggccgtgaagcctggcagctcgagcgcggagttcgtgccgccggcgatcccggccgaccccgagcgggcccttgaggactacatggcgaagtccttcgccgccgaccaccagaaggactacagcggccgccccgtgtactggtctcttgagtctccgaagggcacgttccgggcgctcatctacctgcaccgctacacgcctgacacggttggccaggtgctcaccaagtacgcggctcccttcgtcgatcgactcaaggccgaatcggaggccgtcgggcgtgagcgtgacgccgtgatgggcgacgacaggaaggccgatcgcgagcgcgcccgcatcgacaagaggcgtgcggagatcgacgcgacgatcgcggaggttcagggattcatcgactcggtcctgcagcctctcgctcagcgccgcatccacttggacttggacgacggcgtgcgcatcaaccgcctcaaactcgcttacggctggcgctcggatctggctgacctgccccagcccgcgatcggcgttgccacggcggcagtcaagaaggagatcgagaaggatctcaagtgggcccacaaggaggtcgcaaagaacaacgcatggtggagtgagtaa

SEQ ID NO: 2440 - DNA, 3573 bp, Vibrio cholerae
atgaatactgcaaaactaaaaaaatatgcccctcaagcaagacgtgagtttatcaccgctgtttcaaaacaatttaatcagctaggtatatacagcgacaaacagatatcagaggtaaaacaagaaggttcagtattactaattgaaggtaaaacttttgagcctagcgtaaaaactgccagagagcgattggtcaaaaaggttcaggcaatgggctataaccagctcgtggaacaggtagcttatacttggttcaaccgcctatgtgctattcgctatatggaaatccatgactatctaggccacggttttcgtgttttgtcgcacccagacaaccctaaaggctttgaaattatcgaccatgcccaagacgctgcggatgaactcggattagatagagctcacattgttgaactcaagcttgcgggcaacaaagacgaagagctgtatcgtgaactgctgttaggccagtgccataagcttcatgaggcaatgcctttcttatttgacgcattggacgatgaaactgagtttcttctaccagacaacctaacacgtaccgactcaattctgcgtggattggtagacagcattcctgaagaggactggcaacaggtagaagtgattggttggctttaccagttttacatttctgaaaagaaagatcaggtaatgggtaaggtggtcaagagtgaagacatccctgccgccacccagctatttacacccaactggattgtaaagtacctggtacaaaactcagtcggtcgccaatggctgcaaacctacccagactctgccattaaaacgcagatggaatactacattgagcctgctgaacaatctgacgaagttaaccaacagctaaaggctgttacgccagaatctattgaacctgaaaccatcaaagtacttgacccagcttgtggttcaggccacatattgattgaagcctataacgtgctaaaagccatctacgaagagcgtggtttccgctctcgtgacattccaaagatgattctggagaacaacctctacggcctagacatagatgatcgtgcagcgcagttatctggctttgcgctgatgatgatggctagagatgacgataagcgtatttttacccgtaacgtgcgactcaatgtactgtcattgcaggaaagtaaccatattgatctaccgaccttatggaaagcactcaacctatcgggaagttggcaaagcggcacgtcccagggcttgttctcagatgaagagcaagatttaaactcgttcaatgcagacaaccgctaccaactgctgaagcgaacattggcaagatttactcaagccaagacctttggttctttgattgatgttccaagcgatgaccatgaacagctaaaagagctcctgagcacgctagtagagctacaagagtcaggcgactcaatgcagaagcctgcggcgaaggaattgattgaaattgttcaccaagctttgattttgtcaactcgttacgatgcagtgattgctaatcctccatacatgggccgtaaaggtatgccacaagcactaaaagggtatatctcggaattctatcccgaatgtatttgggatatatattcggcttttattatgaaatctagaaaaatggtcttatcgtctggaagactggcgatgattactatgcatagctggatgtttttatctgcatttgaggaactacgtaaaaatattttaagtaaagatactatattatctatgttgcatttgggaactcgagcttttaaagaaattggtggcgaagttgttcaaacttgtgccttcgtaattgagagagagaattcaaacgcagttccttgctcattttatgatttacaaggttatgataatagcgatgaaaaggaaaacgcattcctcgttggggatgctcctttatacaatggattgaaaaatattgattttaaactattgccgtcagcaagcatttgttattgggctacaaaagatcttttatctctgttttccgaatatcctcgtatcggcattaaaacaattaacaaaagtctaaatcttactggtgataacaacaggtttttacgatttttctgggagatagattcagaagaaataggtaaagatagaaagtggatcttttacgctaaaggcggtgcttacaagaaatggtatggaaactttgactatgtaattaactggtctcaagatgctgtgagcttctatcgtagtgataggactgcgaggataattccagaaaatttgtggtggaaagagggtgttacgtggacaaaagtaactacttcagcccctggttttcgcctgttaccaaaggaagcaaattatgacgttggggggtcttcaatattatttgatgatattgaacaagtacatagatgtatgggctttttaaatacaccactagctacttatttaataaggttactaaacacttctgtcaatatccaggttggagacatagaagaccttcctgatttatcgtcgaaggttaatcctaaggatgtgtctcgcgctattgagttgtctaagaccgagtggaacatgtgggaaagctcatttgaattttcaggtgtgaaatttgaaggcaagtctttttatgaaagtttcaaattgtttcatgaagaaacaacgagaatcataaatgaacttcatacactagagaatattatctctgctaatgttactaaagatcttaatgtatcaatagaattaagagatgttgatcttgaaagcattagtttagagtcaaactgttctttgttggagttacaaagcaagtgggctgctcagcttatctcatatgtcattggttgtattatggggcgctattcaataatcaatgaagggattatgtttgcttcaaaaaaacaaaatcacttttttgaaaaagtaaacgaaggagcattcagtaacttttttcccgatgatgatggaataattcctttaactgatcaagagtggttcaaagacgacgctacaaatcgttttcgtgagtttgttcaggttgtttcgggtgaggcgcacctacaagaaaatcttgattttgtcgctgaatcactttgtttaaatgccattaaacccaagaaatcagaattagcgttggaggcgatccgccgttacttatcgactcagttctataaagatcacctgaagacttacaaaaaacgccctatttattggctgtttagctcaggcaaacaaaaggcttttgagtgcttggtttacctgcaccgttataacgagggcacgctttcgcgtatgcgtaccgagtatgtcaccccgttactaggcaaatacgatgcttatgcagagcagcttgagaagcagattgaaacggcagactcgaccattgaagcgaaccgcttcaagaaagagttggatgctttaatcaagaaacaggttgagctacgagagtttgatgacaagctaaaacactacgccgatatgcgtatttcactggatcttgatgatggtgtgaaagtgaattacggcaagtttggtgatctgttggctgatgttaaggccattaccggttcggccccggaggttaactaa

SEQ ID NO: 2441 - DNA, 3699 bp, Vibrio harveyi
atgaataccaacaaactcaaaacttatgctccgaaagcccgtttggcttttatggatgcagtaaaaaaacgagctgccgtactcggcatttacgaaaataaaatcagtgaagccacgatacaaggaactgatacccttattgaagggcgtatctttacacgcaagcaaggtcaacagcgtcaacagttagtgaaacgcatcgaagcgcttggtggtggtaaagatggctacaaccaatttattaacgaaatggcgtttacctggtttaaccgttttacagccattcgtttcatggaagtgaatggctatcttgaccatggcttccgtatgctgagtaaagaagagggttcagagtttggcaaaggctttgaaatcttagctcatgccgctgatgtggcagaggatttgggattaaataaatccgacatcgtacaaatgctattagctggcgacaaagaagaagagctgtatcgtgaattattgctcgctcaatgccaccagctcagcaaaatcatgccatttatgttcgaaaaactggatgacgctactgagttgctactaccagataacctgactaaaaccgactcaattctcaaagaactggttaatgacgtacctgaagataactggcgcgaaatcgaagtcatcggttggctgtaccagttctacatttccgagcacaaagatgcggttataggtaaagttgtaaaaaaagaagatattccagctgcgacacagctttttactccaaattggatcgtaaagtatttagttcaaaactcacttggtcgccagtggttagccacctaccctgactctgagctgaaagataaaatggaatactacatcactcctgccgagcaaagtgatgaagtaatagaacaactaaaagcgatcacgcctaccagcatcgatccagagcaaattaaagtcctcgatcctgcttgtggtagtggtcatattttggtggaagtgtacgaggttcttcgtgaaatctacctggagcgtggctaccgcttacgcgaaattcctgagttaatccttactaagaatatctatggcttagatatcgacgaccgcgccgcgcaaatggccgctttcgctgtactaatgaaggctcgcgaagatgatcgtcgtatatttagccgcgttgaagataaccacattaaacttaatattcacgcaatccaatcaacagaacatattaatatcaacaaactctggtcagatcttgatcttgatgacaacaaacaagcaggctctatggatgatctatttgcagagccgcaactcggcatcagtgaagcatccgaagaaaacaaggtttaccttgatttactgcgccacttaaaagaacagttcattgatgctaaaaacttaggttcattggttgaggttgatagccaaaaccttgaacctctgactgcattgcaagaaaaacttgcaggaaaagcacaaggtaatgagccaacgaccagagaagcagcacaagcactattgcctattgtggaacaagccattgtattagccactaaatatgatgtagccgttgcaaacccaccatacatgggttcaaaaggtatgaatgctgcgttgaaaaactttgcaaagaaatcctacccgaactcaaaatccgatctttttgctattttcatggaacgtgtatttagcttcttaaaagaggatggttataacgcacaagtcaatatgcaatcttggatgttcttgtcaagtttcgaaaaagtgagggattctttactagacacaaaaacgataataactatggcgcaccttggggctagggcttttgggcagatttctggcgaagtagtccaaacaacggcgtgggtcattaagaaagaccacctaaatgggtatcaaccttcttttttacgcctagtagagggtaatgaggaggaaaagcgtactgcattattggaaaagaaaaatctctactccaaaattaaacaaaatgaatttagccagatacctggtagtccgattgcgtactgggtaaatgcgttaacaagagcgacctttacaagtaatagaagatttggggatatagccacaacaagaaaaggtctagtaacagcccgtaatgatgtatacgttcgatcatggagcgaagttaacttctctaaattggggctagagtgtacaaaccgcgaagacgctcaaagctctaattgtaaatggtttccatatatcaaagggggggagtttagaaagtggtacggtaacaaatgggaagtcgttaactgggaaaatgatggctatgcgcttcaaaatacaactcacccaacagaaaatcgaatttgggcaactaacttcaatttagagtatatattcgctcctaatatcaactggtcagatattactggaggaggctttgccgcacggtattcctttggtggggaaatttttgatgccacgggattatcatgcttccctcctgaagctgacagattagaagtactaggttacttaaattcttccatagcaggggacttactaaaactgttgaacccgacactacactttcaagcgggaaatattgcctctcttccttatcttccacatggtaatcgtgaaagcctaaaggagtatgtatctgaactagtagacattgcgaagttagattgggacgagtttgaagtgtcttgggattttctaggtaaccctttaatcaaagccaataaaaattcattgattatggctactgaatctgttttttcaaaatattctttgcttacgcagagaactatatcattggaaaacaatgtaaacgaaattgttcacgaactgttcggttttcagaactcaaccgaaaagacagaagtcaaagaaaaaataacgttgaaaacaaatccattccatcgattcaatgtaaatcacttacaagctcacaagtctagcgtgattgcggagcttttaagctattctattggagcaatgatgggtcgctactctctagatcgcgagggcttagtctatgcacattctggaaacaatggcttcaaagaacttgtagccgaaggcgcatacaacactttccctgctgatgacgatggaatcattccattggcagccgaagaatggttattcgatgatgatgcaactagccgcttccgtgatttcgtaaaaacggtctggggtgaagagcacctgcaagaaaacctcgattttgttgccgaaagcttatgcttagatgcgattaaaccgaagaagaacgaaagctcgatggagacgattcgtcgttacttctcgactcagttctacaaagatcatttgaaaacttacaagaagcgtcctatttattggctgtttagctctggcaaagaaaaggcatttgaatgcttggtgtacttacatcgttacaatgaaagtacgcttgcccgtatgcgtactgagtatgtcaccccattgatgagtaagctagaaactcagcactcggtcttaacggaaagccgcacaaacgcgagtaccacagagcagcgacgtattgataaagagttgaaatcaatcgagaagaaacagtccgaacttcgtgccttcgatgaagagttgaagcacttagcagaaatgaagatttctatagacctagatgacggagtaaaagttaactacggtaagttcggtaacctactcgcagatgtcaaagcgattcatggtaaaaatccagaagaaataaaatag

SEQ ID NO: 2442 - DNA, 3465 bp, Lachnospiraceae bacterium
atggataagaatgcgattaaaaaatttgctgtctgggcaagaacagaactgatcgcccgtgtttccctgaaaggtgtggaatacggtatcactgaggacaaaattgaggatgccaatgcggacagcgttggcggcaaagtcctcactgccgatgaaaagaagcagcgtcaggctttgattgctgagattaacgataaaggatataagcaggtcatggaggaggttgcttacacttggttcaaccgcttctctgctctgcgattcatggaagtaaacggctatcttccttctcatgtgcgtgtgttcacggacgaggaaaacagctttaagccgcagattataaccgaagctattcatctcgatttggatggattggatgtggaaaaggtctatgagctgaaagacgcagaaaagaccgaagaattgtataaatatctgctgatcgtgcagtgtaacgccctgaataagattctgccgggaatgttccagagactctcggactacaccgagcttcttttgccagacaatctgctccgtgaaggtagtgtcattcagcagatgatcgagctgataccagaagacgactggaaggatgctgtccagatcatcggctggctgtatcagtattataacagtgagaaaaaagatgatgttttcgcagcactgaaaaagaatgtgaaaatcacaaaagagaacatccctgcagcaactcagcttttcacaccggactggattgttcgctacatggtagaaaacagccttggtcgtttatggctggagggacacccggatgttaagagtcagcttctgccgacagaggaagaacagtctgcctattctaccggaaaccgtgacccggaagataccaaatggcactactatctggaagagaccgagcaggagccggaagtgcaggtacagctggctgaaatccgtaaggaatacgccgcgctgacaccggatcagctgaaagtcattgacccatgctccggttccggtcatatccttgcgtatatgtttgatgtcctgatgaagatttatgaatcctatggctatactacccgtgaagcagtggcaagcattgtggagaataatctttacggattggatattgatgaccgtgcggcacagctggcttactttgcggtaatgatgaaagcccgtcagtatgaccgccgcttcttcagccgtggaattcagccccatgtatatgctattgcagagagtaactatgtagataaattcgctgtggactatttctgtaacggcgatatgaagctcacagccgctatggataccattatcagcgaactgcatgatgcaaaggaatatggctcgattctgaccgtaacaccgcaggattggtctgctctgtatgaccgttttgcggaaatcaaggaggatattcatatctctcgtggagcggcactgagaggattactgccattggtgcagacggcggaaacactggcacagaaatacgatactgttgtgacgaacccgccgtatatgggatcagcagggatgaattccaaactgtatgatttcgtgaaagaagaatatcctgatgtgaaatcagatatgagtactgtatgcatgagaaagaccatttccatgtgtaacgagcatggatatatggcgatgattaacattcctgtgtggatgtttatttccagctatggaaaacttcgtaccgaaattataacccggaattctcttgtacagatgctacactttgggagaggagtatttggttcagattttggaacgacagcttttgttattgggaagcgatttgtccccaattattgtggaacatacagaaaactatttatgaaacaaggagctgttgattcggttgaaacaaaagaattgtggttccatgaaggcaaaggtgctttttccgctaagcaatcctcttatctgcgcataccaggaaatccgattgcatactgggtgagcgaaaggtttattagcaattttgcggaaagattggttcaagatacacatttttcgggtggtagaaataagacccatggaaacgaacaatatacacgaatgtggtgggaaatcgccgacagagaaaagtggcaactatatgtgaaaggtggcgattttagacgatggtatggaaatcaggaggttgttgttgattggtctactggagctaaagaatcttacgcatctcatggaggcttatacaatcaggactatgcaaataagcctggtatatgctggactctaatcacttcagctaaaacagctttcagatataagataccagaagcgcactatgattcaggcgcaccaacgatttttaacgataaattttctcttgatttgaccttgctcggttttttgaactcaaatatagcaacagagtatcttcagttgttgaatcctaccatcaatatgggcaatacttatgtgttatcgcttccatatatagatgttggtataaggaaagcagaaattgataccttggtcaaaaaaaatatcgatgcagcaaaagacgactgggattcttttgaaaattcgatgcaatttaggtctcatccgcttgttagatttatggaaacagacggtaaaattgcaacagcatataatttgtggagtatgcatgcagcgtgtgcatttaatgaaatgaagcaagtagagaaccgcttaaacgaactctatgcggaagtgtatgggttgtctgacgaaataagtacagaagttccagatagagatatatccataagaaagggtgacttgcaacgtgacatcaaaagcctgatttcctatgccgttggatgtatgtttggtcgctattctcttgatgtagatggacttgcgtatgcaggaggcgaatgggatgccagtaagtatgcttcttttgctgctgataaggataacattatcccgatttgcgacgatgaatacttcgaggatgatattgttggtttgtttgtggaatttgtgaaaactgtttacggtgaagatacattggatgaaaacctgagattcattgccgatgcactgggcggcaaaggtcaaccgaaagatgtaattaggaattatttcctgaatgatttttataaagatcattgcaagatttatcagaaacgcccgatctactggctgcttgacagtggcaagaagaacggctttaaggctctgatttatatgcaccgctatcagccagacaccattgcccgtatccgtaccgattatgtgcatgaacagcaggctcgttatcgcactgccattgctgatctggaacagcggattgccaatgcttccaccggcgagcgtgtgaagctgaacaaaaagctgaccactttgcaggcacaggaaaccgaaatcagagcctacgaggaaaagattcatcatcttgctgatcagatgatttcgattgacctggacgatggtgtgaagaagaattatgcaattttccaggatgttttggctaaaataaagtaa

SEQ ID NO: 2443 - DNA, 3666 bp, Escherichia coli
atgaataccaataacattaaaaaatatgccccacaggcccgtaacgatttccgcgatgcggtgattcagaagctaacgacgcttgggatcgctgcagataaaaaaggcaatttgcagattgccgaggccgaaaccattggcgagaccgtgcgttacggtcagtttgattatccgttatcgacccttccccgccgcgaacggctggtaaaacgcgcccgtgagcagggttttgaggtgctggttgagcactgcgcctacacctggtttaaccgcttatgtgcgatacgctatatggagctgcacggttatcttgagcacggcttccgtatgttgtcccatccggagacgccgaccgcgtttgaggtgctggatcatgtgccggaagtggcagaagccctgctgccggaaagtaaagcgcagctggttgagatgaagctttccggtaatcaggatgaagctctgtaccgcgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcagaaaagaaagatgctgtgattggcaaagtggtgaagagcgaagatattcctgccgccacccagctgtttacgccgaactggattgtgcagtatctggtacagaactccgttggccgccagtggttgcagacctacccggactcgccgctgaaagacaaaatggagtactacatcgagcctgcggaacaaacgccggaagtgcaggcacagctggcggcgattaccccggccagcattgaacccgaaagtattaaagtgctcgacccggcctgcggctccggtcatattttgattgaagcctataatgtactgaaaaatatctacgaagagcgtggttatcgcgggcgtgatattccacaactgattctggaaaataatatttttggtcttgatatcgacgaccgagcggcacagctttccggctttgcattattaatgatggcacgtcaggatgaccgcagaatatttacccgcgatgtacgtctgaatattctctctttacaggaaagcctgcatctggatatcgccaagctctggcagcagctcaatttccaccagcaggtacaaaccggtagtatgggggatatgtttgctgaaaatatcacgttagcccaaaccgacagcgcagaatatcagctgctgatgcgcacgttgaaacgctttgtgaatgcaaaaacgctgggatcgctgattcaggtgccgcaggaagaagaagcggaactgaaagtatttctggacgcgctgtatcgcctggaacaggaaggcgatttccagcaaaaagcggcggcgaaagcgtttattccgtttattcagcaggcgtggattttagcgcagcgatatgatgcagtggtggcgaatcctccgtatatgggcagtaagggaatgaatggtgagctgaaagagtttgccaaaaataatttcccagatagtaagtctgatttgtttgctatgtttatagagcgtggtttcctttggttgaaaaatgctggtttcaactcaatggtaacaatgcaatcctggatgttcctttccagttttgaaaacatgcgtgaaaatatcctcactaattatacaatcgaaactatggtgcatatgggcaatggagttatgaaaattgccttcggaactaatgccactgtatttagaaacaaccacatttcgacttaccaaggttcattctcttatgtcgaaaacggtaatataaatcaagaaggcaatccaaaacaattcccggtaataaatgagcgtttaaaaacggccactacaaatgattttaagaaaatccctggttctcctatagcttactggatcagtcattctcttttaaatgttttcgagacttcaaaaccaatttcagaatattttgatactcgtcttgggatgtctacagctaacaatgatgagttcttgcgtttctggcatgaggtttctatacaaaatattggttttggttgcaaagatagagaagaagcatcgaactcattaaaaaaatggttcccttatgccaaaggtggtagctatagaaagtggtacggcaatcatgattacgttgttaattgggagaatgatggagaaaaaataagaaattttggaattgaaaatggtaaagttcgatcacataattacaatctagattttatatttagaaagggtattacttggtctgatgttacgtcaggtagtaatgcttttagagttttaccgcaaggctttctgtttgatggtagaggatcctctggcttttgtgaagataaccttcgcccaacaattttatgcttactaaactccaaactaagctataatataatcaatatcatcaatcctaccattgctattaatgttggagaaatcgctaagattccattacataacaatctaatgaataataaaaataatattgaaaatctaactttagagattattgaccttcacaaaaaagattgggatgaaaaagaaaattcttggaatttttacagaaacgcattgatagataaaaaaagtaacaatttaaaagaggctttacttagaaaatatgctaatgatacaattgaaatcaaccgctgtcattcaattgaatcggaattaaatcaccaaattaacattacttatgatctagagagttatgttaaccaaacagtggatttagctcaaataaccttatttaagaatatggcttatattttttctgatactgcaaacaaagaatcgctgtatgttactatactgatatcagaactaatatcatattccatcggctgccaaatgggccgctactccctcgatcgcgaaggccttgtctacgcccatgaaggtaacaaaggtttctccgaactcgtcgccgaaggtgcctacaaaaccttcccagctgacagcgacggcatcctgccgctgatggatgacgagtggtttgaggacgacgtcacctctcgcgtcaaagagtttgtccgcaccgtctggggcgaagagcacctgcaggaaaacctcgaatttatcgccgaaagtctatgtttatacgcgatcaagccgaaaaaaggcgaatctgcgcttgagaccattcgtcgctatctttccacccagttctggaaagatcatctgaagatgtataaaaagcgtccaatctactggctgttcagctccggtaaagagaaagccttcgagtgcctggtgtatctgcatcgctataacgacgccacgctgtcgaggatgcgtaccgaatatgttgtaccgctgctggcgcgttatcaggccaatatcgatcgcctgaacgatcaacttgatgaggcttctggcggtgaagccacacggctgaaacgcgaacgcgacagcctgatcaaaaaattcagcgaactgcgtagctatgacgaccgcctgcgtcactatgctgatatgagaatcagtattgatctcgacgatggcgttaaggttaactacggcaagtttggcgatctgctggcagatgtcaaagccatcaccggcaatgccccagaggtgatctaa

SEQ ID NO: 2444 - DNA, 1923 bp, Coprobacillus sp.
atggcaaagaaaaatggctatcaggcaatgattacccagcacgcatggatgttcctgtcaagctttgaaaaactgcgtgggaaattgctgcataccgatattgtcaatatggcgcatcttggtgcaagagcttttgaagaaatcggcggcgaagtggtacagaccacctcgtttgttatccgtaaaagccatattgcgaactataatggtgagtattgccgcctgattgagccgactacacagcaaggaaaagaggatatgttccttagctgtgaaaatcgttatgccgctgatcagtccaatttttccaaaattccgggaagtccggtggcgtattgggtgagtgagagcatcttagctgcttatgagcaaggtggtttaatcggtgactctgccgatgtcaaaattggcatgggtacaggcaagaatgagatttttgtgcgtgaatggtgggaggtgttttataccaagattgacttctccctcaaaacgataaatgaccttgccgagagcaatgggcgttacttcccctacaacaagggtggcgagttcagactgtggtttggaaaccttcaggaagttctatggttcgatgccgaaggacgccgttatatgaataccatgagcggtcaccgagaaaacggtgcacacgatttttattgtaaagaagggcttacttggtcatttatcagttcatctaagtttggcattcgatacttgccgacagggtgtttctttgatgttgctggctcaaccttgttttcaagagttgataacgcttatacgctcggttttcttgcatcctgtgtctgctttgatattctcggcattcttaatccaactctgaattatcaggcaggaaacattaaaagccttccacttctggttgatagggaagatgaggttgacgagtgcgtatatcagaatattcaaatatctaaagatgactgggattcttacgagaattcatgggattttcagcgtcacccacttgtcagtggacagtgttcagtggatagtgagcagtgttctgaccactgtacactgatatctgaccactataaagagtgggaacaacaatgtgaccaacgctttagccagctgaaagccaacgaagaagaactcaaccgtatcttcatcgacatttacggcttacaggacgagctgaccccagaggttgaggataaggatgtcacggttcgcaaggctgaccttggcagagatattcgttctttcatttcctatgcggttggctgtatgtttggtcgttactctctggatgtggacgggcttgcctacgcaggcggcgaatgggacactggcaagtatgcttctttcgctgcggataaggataacattatcccgatttgtgacgatgaatactttgaagatgatattgtcggtttgttcgtgaagttcgtgaaaaccgtctatggagcagatacgctggacgaaaacctgaaattcattgcggatgctctcggtggcaagggtcagccgaaggacgtgattcggaattacttcctgagtgacttctactccgaccattgcaagatttatcagaaacgcccgatctactggctgtttgacagcggcaaaaagaacggctttaaggcgctgatctatatgcaccgctatcagccggacacaattgcccgcattcgtaccgactatgtgcatgagcagcaggctcgttaccgcactgctattgccgatctggaacagcgcatttccaatgcctctaccggcgagcgtgtgaagctgaacaaaaagctgaccaccttgcaggcacagaataccgaaatcagaacctacgaggaaaagattcatcaccttgccgaccagatgatttccattgacctggacgatggcgtgaaggcgaattatgctattttccaggatgttttggcaaaagtaaagtga

SEQ ID NO: 2445 - DNA, 3633 bp, Enterococcus faecium
atggataagaaagcgataaagaatttcgcggtcaatgcccgtagaaaattaattgatgaagtaatgactaaagcaaaacgtttaggaattgatgaatcaaaaattgaagatgtgaagaaaattgatagcaatttacaagaaatcgaaaaatcaggaataagaattcaaggaaaagaaatagcgcaaagaaacaaattgattgcagaactaaaacaacgtgcttctgtcacttcttattcagaagcttttcaagagttaatcgaagaggttgcttatacgtggtttaaccgattgattgccattcggtttatggaggtaaatgattatttacctgacacgtatcgtgtattatctagtgaaataagtgggaaaattgagccagatattattacagatatttatgatgccgatatctttgaagaattatctagtaatgaacagcaacaagtcagaacttggaaaacagataattcagcagaagcaatggacaagctgtatcaattgatttttataaaaatctgtaatcaattgaatgattacttacctgagctatttgaagaagtagaagattatacagaacttttgtttacagcttcttatattaaaaaagatggtgtaatcgctgatcttttaagtattccagaggatgatttctatgttcaagctggtggacaggtagagattattgggtggttgtatcagtactataatagtgagccacataatcaagtggtgaatatttataaagggattgtcaaaaaacaagatattccggcagcaactcaactatttaccacagattgggtcgttcgttatatggttgacaatagtttaggaaagtattggttagatcattatcccaatagtgaattaagaaataagttgaaatacttaattccagataaatatgcttttgaacaagcaacatctgtaagtaatttaaaaccagaagaactaaaaattatcgataacgcaatggggtctgggcatattttagtttacgccttcgatgtattgatggaaatttatcttacgttaggatattctgagcgtgatgctgcacgtgcaatcgttgaatacaatttatatggtcttgaaatcgataaaagagcgtatcaattgtcttattttgcaattatgatgaaagggcgtcaatacgatcgtctttttttgaaaaaaagtctatcgccgaatttaagagagtttattgattctcctaaagtgacagacgagtatcaagagcgtattagtgaattgaacaatgataagtatagtgaacgctggaatgaatacaaagagttaatttttgatcaatttgaaaatgggaaagaacttggatcaatcattaagttagtcgataaaaataatcaggcaataactaaagaatacttaggaaaagtaagagagtatatatcaaaattcaacgaatttacgaatatggatattctttatgggatgaaggaaatacaagaaaaatacttgcacattcttgacgtggctgaaatgctagttgataaatatgtagcggtagtcactaatccgccttatcttaataaaatggataagaaattaaaaaaatatgtaaatgataactattctgatgtcaaaaaagatctattttctgtgtttattaaattgaatagccaaatgctgattgataatggatatgcttcctttatgacgccatttgtttggatgttcatttctagctatgaaaagttacgctcatttttaattaatgaaagaaacatttctagtttgattcaaatggagtattcagcttttgaagaagcaaccgttccaatttgtacgtttacgataaaaaattcaaatgaacaagatggaagctatataaaattatcagattttaaaggtggaatggaagttcaaaaaattaaaacgttagaagcaattcatcagcatggtgaatgcgattatttttatagtactaatcaagacaacttcaaaaaaatcccaggaatgccgattgcttactgggcaagcgataacgtaatcactgattttgctcaaggaaaattaactaacgatgttgcagatgcaaaacaagggttggcaaccggaaataacaataaatttttgcggtattggtttgaagtagaatttaacaaaataaagtttgatgctaaaacattagaggacgctaaaaagtctagaaaaaaatggtttcctacaactaaaggtggtcgttttagaaaatggtatggaaacaatgaatacgtggttaactgggagaatgatggagatgaaataaaaaattatgttaatgaaaatgggaagttaaaatctagaccacaaaatcttaattactattttaaaaagggaattacttggtcgacactttcatctggacaagtatcttttagattgcagaatcaggcaatttttgaaactaaaggatctgttctgttctcaaaggatataactgactttgaagaaatatttggctatgtaaactctaaattagttaatcactttttaacttttatttctcccaccttggattaccatgaaggaccaatgggaaaactaccttttcttaaagttacatctgagagaaaattaaaaaaaataagagaaaaagtggatgaaaatatcgatatagctagaaaagactataatgctcttgaaacgtcatacgagtttagaagaaacattttgttaagttatatgtttaaaaaagatctctcagaggcatttaactgtctaagtaggcagttggttaatcaatttaatactctaaaatcgaatgaagaggaactgaacgacatattcattaatcattattctcttgaaaaagaattaacaaaagaggttcaagatgaatatatctctgcaaggttacctgataaggcgagggaaattaaggattttatttcttattcaataggttgtatcttcggtcgttactccctagacgaagatggtctcatcttcgctggcggcgaatgggatccttcccgctatcaaaaatttaaacctgatactgataatgttttactcatcaccgatgatgagtatttcaaggatagccaaattgacattgtcaatcgtttcattgatttcgttgagattacttttggtaaagaaacccttgaagaaaatctccagtttatcgctgacactttaggtggcaaagggacaagtcgagaaattattcgtcgttacttcgtacaagatttttacaaagaccatttaaaaacatactccaatcgaccaatttattggcaattggactcaggaaaacaaaatggctttaaagcgttaatgtacttgcatcgctatacaccagatcaattaggaaaagtacgtactgaatacctacacgaactacaaaaagcgtatgacaatcgaatcgaattgcgtcagcaacaaatttcaacaagtgataacccaaaagaaagaaatgcaatgacaaaagaaattgtaaagattcagaagcaattaaaagaagttcgtgagtatgacgagaagttgggtcacttagcattaaaacgaattgaattagacttagatgatggtgtaattgtcaattatgataagttgcagcgtgatcctaaaaccggcgagaaattccaaatttttgcaaaaggggtcaaagaaccaaaaaaatag

SEQ ID NO: 2446 - DNA, 3741 bp, Vibrio cholerae; identical to SEQ ID NO: 2398

SEQ ID NO: 2447 - DNA, 3618 bp, Escherichia coli
atgaatactaataacattaaaaaatatgccccacaggcccgtaacgatttccgcgatgcggtgattcagaagctaacgacgcttgggatcgctgcagataaaaaaggcaatttgcagattgccgaggccgaaaccattggcgagaccgtgcgttacggtcagtttgattacccgttatcgacccttccccgccgcgaacggctggtaaaacgcgcccgtgagcagggttttgaggtgctggttgagcactgcgcctacacctggtttaaccgcttatgtgcaattcgctatatggagctacacggttatcttgagcacggcttccgtatgttgtcccacccggagacgccgaccgcgtttgaggtgctggatcatgtgccggaagtggcagaagccctgctgccggaaaataaggcgcagctggttgaaatgaagctttccggtaatcaggacgaagccctgtaccgcgaactgctgctggggcagtgccacgccctgcaccacgtgatgccgttcctgtttgaagcggtagatgacgaagcggaactgctgttgccggataacctgacccgtaccgactctattctgcgtgggctggttgataatattcctgaagaagactgggagcaggtagaggttatcggctggctgtatcagttctatatttcggaaaagaaagatgctgtgattggcaaagtggtgaagagcgaagatattcctgccgccacccagctgtttacgccaaactggattgtgcagtatctggtacagaactccgttggccgccagtggttgcagacctacccggactcgccgctgaaagacaaaatggagtactacattgagcctgcggagcaaacgccggaagtgcaggcacagctggcggcgattaccccagccagcattgaacccgaaagtattaaagtgctcgacccggcctgcggttccggtcatattttgattgaagcctataatgtgctgaaaaatatctacgaagagcgtggttatcgcgggcgtgatattccacaactgattctggaaaataatatttttggtcttgatatcgacgaccgcgcagcccaactttccggttttgcattattaatgatggcgcgtcaggatgaccgcagaatatttacccgcgatgtacgtctgaatattgtctctttgcaggaaagcctgcatctggatatcgccaaactctggcagcaactgaatttccaccagcaggtacaaaccggcagtatgggggatatgtttgctgaaaataccgcgttaacccaaactaacagcgcagaatatcagctgctgatgcgcacgttgaaacgctttgtgaatgcaaaaacgctgggatcgctgattcaggtgccgcaggaagaagaagcggaactgaaagtatttctggacgcgctgtatcgcctggaacaggaaggcgatttccagcagaagtcggcggcgaaagcgtttattccgtttattcagcaggcgtggattctggcacagcgatatgatgcggtggtggcgaatccgccgtatatgggaagcaaataccaatcattaagtgtaaaaaaacatcttaaagataattttactggttatgataaggatttattttcagcctttatagtcagaaacttagaactttcaaaacaaggggctcaacttggattcatgacgccatttgtctggatgtttatcactacgtacgaagaattaagaaaaaaactgatagagcaagaaattattacatcgcttgtgcagcttgaatattcaggctttgacggtgcaactgtgccaatttgcacattcacattacagaaaggtcatattaaccattttactggtagctatatccgcctctctgattttcgtggtgcatcaaaccaaggtcccaaaactcttgaagcgatacaacaccataattgtggatggttttatgaagcgcagccagacaattttaaaaaaataccaggaacaccaatagcctattggctaggccagaatataaatattttcgataatgacaaaatagctaattcatggttctctggtggtagaattaaaactcacaatggtgataaatatataagatatatatgggaaactagtcgtctttcgagtaaatggaaaaaactaatcaaaggtggagattacaaaaaacattttggcaatgaaatctttctggtagattggtccgtaaatgctataaaattttatgaaaaaaacggtggcatttatccatcaaaatttagagataaagctggtatttgttggtctaaaatcacatcgggccaagctagctttagagtcaaaagtgaagatgtagaatacgattctgcatcacctgtaatatttaacgataaatttaacagtgatctttatacgcttgctctcttgaatacaaaagtttttaatgttctacttaaagcattgaaccctactattaatacccaagttaatgatgtcatgtcattaccattcatcaaaatggaagcagctgttcaagaaaaaatcgaaactaatgaacagctgctgataaatatagcgatgcacgattggaattcgcaagaaatttcttttgattttatggttaattctttagtcagcgaatcgagagcatcatctgaagtagcatcaagctatgctatagcaagaaaaaagtggcaagatgcttttaataaaacgaaagagttggaagaagaaaataaccatttagtcattacaagtagcaactttaatgggataaatgaagaattaattgattcagaaataactttagtcagcaacccatactacaagtacggtgattcaacgactaataatgaaactcgtttgttatcggattcaatagcagatgtattaagttattccatcggctgcatgatgggtcgctactccctcgatcgcgaaggcctcgtctacgcccatgaaggcaacaaaggctttgccgaacttgccgctgaaggtgcgtacaaaaccttcccggcagacaatgacggcatcctgccgctgatggatgacgagtggtttgaggacgacgtcacctctcgcgtcaaagagtttgtccgcaccgtctggggcgaagagcacctgcaggaaaacctcgaatttatcgccgaaagtctctgtttatacgcgatcaagccgaaaaaaggcgaatctgcgctggagaccattcgtcgctatctttccacacagttctggaaagatcatatgaagatgtataaaaagcgcccaatctactggctattcagctccggtaaagagaaagccttcgagtgcctggtgtatctgcatcgctataacgacgccacgctgtcgagaatgcgtaccgaatatgtggtgccgctgctggcacgttatcaggccaatatcgatcgcctgaacgatcaacttgatgaagcttctggcggtgaagccacacgcctgaaacgcgaacgcgacagcctgatcaaaaaatttagcgaactgcgtagctatgacgaccgcctgcgtcactatgctgatatgagaatcagtattgatctcgacgatggcgttaaggttaactacggcaagtttggcgatctgctggcagatgtcaaagccatcaccggcaatgccccagaggcgatctaa

SEQ ID NO: 2448 - DNA, 3720 bp, Lachnospiraceae oral
atgaacaaatcggccatcaaaaactttgctatttgggcaagaaataagcttataacagatatcagctaccgtgcagggctgatgggaataacaactgaagggatagcggaggcactgccacagtctatgggcggtacagagttttatgatataggaactgaaaacccatattcaatcagcggagatgctataaagcagagaaaaaaactggtagaggtcattcgagagaaagaagcagataccgactatgctacagcttataaatacatcatggaagaggttgcctatacatggttcaaccgcttgattgccatacgctttatggaggtaaatgaatacctgcctactcatattcgtgtgctctcctcggatagcggaaagcttgaaccggatattgtgacaaatccttttgatacggagctgcaatttacagaagaagaaaaagaaaagatagtacaattaaaaacagacaacaggcttgatgaacttttttgtatgctatttataaagcagtgcaatgcattaaatgagaatttacctgcactttttgaaaagacaaatgattatacggaattgcttttaaatatttcagttatagacagggaaggtgtggtctataagctggttcatgatatacctgaggatgattttaatatagaaaaaggcggtcaggtggagattataggttggctgtatcagtactataatacagagcctaaagcacaagtttttgccagaccttcaggaacaaagataaggaaagaggatgtccctgcggcaacacagctttttacacctgactggatcgtcagatatatggtggaaaacagtctgggacgactatgggtggaaggacatccaaatgatgaactgaaggcaaattggaagtattatctggaggaggctaagcaggagcctgaagtagaagaaaaactgactgaaatcagaagagagtatgcaaagttaaatcctgaggatataaaacttatagatccctgtatgggcagcggccatattctggtatatgcctttgatgtgctgatgcagatatatgaaagtgcaggctatggtcagcgtgatgctgcaagaagcatcttagaaaacaatatctatggtctggatatagatgacagagcatttcagctggcatattttgcagtaatgatgaaggcaagacagtacaatcgcaggatattaaacggtgagcataagccaaatctattttctataaaagagagcaatggaatcaacagaaatcatctaaaatacttcggtatgaacttaagtgaagatgatacagagaaagcggtatctcagataaatgctctacttgatacctttatagatgccaaggaatatggttctatacttacagtggaagaatatgagtgggggcttttggagagctttgtagctgatagtgagcctacagggcagatcagcatggaaacagtggggatagaggctactaaggaaaatctattacagataatagagcaggggaaggtactggaggaaaagtaccatgtggtagttactaatccgccgtatatggcaatcagtaattcaaataacaaattaaatgggtatgtaaatagaaagtatattggtggtaaaacagatatgttttctgtctttattgaaagatgcttacagtttactataagaaattactatacttctatgattactatgcaatcttggttatttctaacaagctttgaaaagatacgcaataaaatattagataatgaaatagctagcttagcacatttaggagctcgtagttttgatgaaattagcggtgaaattgtacaaacagtagtatttactattaaaaaaataagtttagaaggtagatacaaaggattatattctagattagtgtctggaaatagtgagaaagaaaaagaatgtttgtttttatatcagaataatttgtatataagtaaaggagagaattttaggaagattccacaaaggttgattgcgtattgggtgagagagaatacaataaagtgttttgattatccagctcttgatgagatttttattactagagagggtatggcaacagcagataatgagcgtttcttgagattatggtcagaagtgaggtttgattcaataactttagattgtgcaacatcaaagcaagcagctgaaaaagatgttaagtggattccgtataacaaaggtggaaaagaacgtgattggtatggaaataatgaatatattgttgattggagtcatgatggatatacaattaagaataatatagatatagaaactggaagagttagatctcacaactataatggagaatttgggtttaaagaaggtataacatggtcagctataagctcaggtgatttatcagtaagatactgtccagaggggtttttatttgactctaaaggagcaaaggggtttgtaaagaaaagtaatgaagatcttatatggattcttggattgcttaatagtaaagtcagtatgcagtttcttcagtttatatcacctacattagattttaaagttggggatattgtttcattaccatttatatcagataaagaaagacaaagtgatatattagtcctagttaaagaacttgtatcttattcaaaaaccgactgggattcctacgaaacctcttgggattttgcatttcatccacttgtaaaaaatgacatttgtaatgttgccataactgcggatccaagaactatttccgattcctaccattcctgggtatctgaatgtgaacaacgcttcttgggactcaaagccaatgaagaagaacttaaccgcatttttatagatatatacggtttacaggatgaacttacccctgaagtatcagataaggatgtgactgttcatagagtatatgacagtaaggaagatgtgccggagtctatgaagggttcggcttatatcagaacaaagcgtgatgagatagtttcccttctttcctatgccattggctgtatgttcggtcgctactctttggacagcgaaggtcttgcctatgcaggtggtgagtgggatgaaactaagtatattacgttcatgcctgatactgacaatataattccgcttactgatgaggagtatctggaagatgatataattacacgactttgcacttggctaaaagtagtttatggtgaagatactctggaagaaaaccttgattttattgcgaaggcacttggtaataaaggaaatacatctcgtgagattattagaaattattttttaaacgatttctttaaggatcattgtcagacatattcagtcacaggttcaggtaagagacctatctactggctctttgaaagcggaaagcagaacggatttaaggcacttatctatctacatagatataatgcagatactgtaggaaatcttcgtatagactatttgcacagaatgcaaagaatctatgagagtgaaatcggtcgcatgcaggatactatagatcacagcagcaatgcccgtgaggtggcggcggcaaccaagcgtagagaaaaacttcaaaagcagttaaaagaatgccgtgagtatgatgaaaagattgcccatctggcacttagccgtatagaacttgatcttgatgacggagtaaaagtaaactatagaaaacttcagaccgcagcagacggcaagttttatgaggtactggcagattcaaagaatataatgagtaaaaaatag

SEQ ID NO: 2449 - DNA, 3645 bp, Salmonella enterica
atgaataccaataacatcaaaaaatacgctccacaggcccgtaaccagttccgcgatgcggtgatccagaagctaaccacgctggggatttccgctgataaaaaaggcaatctgcaaattgcggatgccgagctcgtcggcgaaaccgtgcgctatggtcagttcgactaccccaaatccaccctcacccgccgcgatcgtctggtaaaacgcgcccgcgagcagggctttgacgtgctggttgagcactgtgcctacacctggttcaaccgcctgtgcgccattcgttatatggaaatccacggttatcttgaccacggcttccgtatgctctcgcacccggagaacccaaccggctttgaagtgctggaccacgtaccggaagtcgcggaagcattactgccagagaaaaaagcgcagctggtcgagatgaagctttccggcaaccaggacgaagccatctaccgtgaactgctgctggcccagtgccacgccctgcaccgtgcgatgccgttcctgtttgaagcggtcgatgatgaagctgaactgctgctgccggataacctgacccgcaccgactccattctacgcggcctggtggatggtattccggaagaagactggcaagaagttgaggttatcggctggctatatcagttctatatctctgagaaaaaagacgcagttatcggtaaggtggtgaagagcgaagatattcctgccgccacccagctgtttaccccaaactggattgtgcagtatctggtgcagaactccgtcggccgccagtggttgcagacctacccggactccccgctgaaaggcaaaatggactactacattgagccagccgagcagacgccagaagtgcaggcgcagctggccgccattacgcctgccagcattgaaccagaaagcattaaggtgctcgacccagcctgcggctccgggcatattttgattgaagcctataacgtgctgaaaaatatctacgaagagcgcggctatcgcgcccgtgatattccacagctgattctggaaaataatatttttggtctcgacatcgatgaccgtgccgcacagctttccggttttgccttattaatgatggctcgacaggatgaccgccggatattcacccgcgacgtgcgtctgaatattgtctccctgcaggagagcctgcatctggatattgctaagctgtggcagcagctcaacttccaccagcagagccagaccggcagcataggggatatgtttgccgaaaataccgtagtgccccataccgacagcgtggaatatcagctgctgatgcgcacgctgaagcgctttgtaaacgccaaaacgctgggctcgctgattcaggtgccgcaggaagaagaagcggaagtgaaggcgtttctcgatgcgctgtatcgcctggagcaggaaggggatttccagcaaaaggccgcagcgaaagcgtttattccctatattcagcaggcgtggatactggcgcagcggtatgatgcggtggtggcgaacccaccgtatatgggtaatgggggaatgaatagtgatttgaaaacatttgctaagacttacttccctgacagcaaatcagatctctttgcgatgtttatgcaacatgcattttctttacttaaagaaaatgggtttaatgcgcaaattaatatgcagtcatggatgtttttatcaagctacgaagcacttcgtggctggttattaaataacaaaacatttattacaatggctcatctcggtgcacgtgcatttgggcaaatctctggtgaaatagtacaaaccaccgcttgggtaatttgtaatcgtcatgagaaaaattaccgtcctgattttttcagacttactgacggcaatgaaaaacagaaacaaagcaatcttataaacaggaaatttcattttcataatatcatacaagaaaatttcaaaaaaataccaagcagccctatatcctattgggttactgaaaaaataacgaataactttcaattaggcacgcctctatataaaatatctgaagcgcgccgaggcttagcatcaggtaataatgagaaattcattagagaatggactgaagttaataaaaattcaatatcaattttaaatatagaaaatgcaaattgcaaatggtttatccataacaaggggggggaagcaaaaagatggtatggaaacaacagccttattattaattgggagaacaatggtcacgctataaaaaatcaagaagcaaaaaccagtggagacagaggttggcgtgctacaagtgaagaattctatggaaaggatggtattacttgggggggattaacaaatgcgttcttgacttttagatggtcagattatggcgcattgttcgacacaaacaaagggccaatgatgtttcctcaagaaaatgcctattatctattagggttcctaaattcaccattggcaatagaatattgcaaattacttaatccgacgatctcatttcaaaatgcagatattaacagaatcccctttttcttaccatcacatgatacaaataataaaatacaagaaaaggtattggaatgtatcgatatagcaaaaaatgattggtttaactatgaattcaattggggatttaaagaaaaccctttgctcagagtacgctcatccatacaattggctttcgactcatataaagaaaaatccaatgaatacattttaaaaacaaaagacatccaacttgagataaataaacatttttgtgagttaggtgggctagatttaaatgattataataatgatattcatcttctttgtaatgagagctaccggtataatgaatctgacaataaagaaagccgtttcaaatcagacacgttaagtgaactattatcctacatcatcggctgcatgatgggccgctactccctcgatcgcgaaggcctggtctacgcccacgaaggcaataaaggctttgccgaactggtcgctgaaggtgcgtacaaaaccttccctgccgacaatgacggtatcctgccgctaatggatgacgagtggtttgacgacgacgtcacctctcgcgtcaaagagtttgttcgcaccgtctggggcgaagaacacttgcaggaaaatctcgaatttatcgccgaaagtctctgtttatacgcgatcaagccgaaaaaaggcgaatctgcgctggataccatccgccgctatctttccacccaattctggaaagatcatatgaagatgtataaaaagcgtccaatctactggctgttcagctccggtaaagagaaagcgtttgagtgcctggtctatctgcatcgctacaacgatgcgacgctggcgagaatgcgtacagaatatgtggtaccgctgctggcacgctaccaggccaatatcgatcgcctgaacgaacaggtcgatggagcctcaggcggcgaagccacccgtctgaaacgtgagcgtgatagcctgagcaaaaaattcaacgaactgcgcagcttcgacgatcgcctgcgccactatgctgatatgagaatcagtattgatctcgacgacggcgttaaggttaactacggtaagtttggcgatctgctggcggatgtgaaagccattaccggcaatgcaccggagattatttaa

SEQ ID NO: 2450 - DNA, 3681 bp, Pectobacterium wasabiae
atgaatacgtcaaacatcaaaaaatacgccccggtggcacgtaaacagttccgcgatgcggtcatgcaaaaactgaccacgctgggtattgaggccgataaaaaaggcaacctgcaaattgcgcaagcaaccgatcttggcgacagcgttcgttatggtcagttctcgctggataagtcactgacgtcacgccgtgaacgtctggtcaagcgtgcagaaaagcagggctacgacgtgctggtggagcacattgcttacacctggtttaaccgcttctgcgctattcgctatatggagctgcatggctatctagatcacggtttccgtatgctgtctcacccgacgctggaaggtggttttgaggttctggatcatgtgccggaagtggctgaagctctggggctggacaaagcgcgcccggtggagatgaagctagcgggcgatcgtgacgaagagctgtaccgtgaactattgcttgcacagtgccatacgctgcacggcgcgatgcctttcctgttcgaagcagtcaatgatgatatcgaactggttctgccggataacctgactcgtaccgactccattctgcgcgggctggtggacaccatccctgaagaggactgggaacaggtcgaagttatcggctggctgtatcagttctacatctcagagaaaaaagacgatgtgatcggcaaggtggtgaagagcgaagatattccagccgccactcagctgtttacgccaaattggattgtgcagtacctggtgcagaactcagtgggtagccagtggcttcaaacctacccggactccagtctgaaaggcaaaatgccgtattacattgagccagcggagcaaacaccagaagtacaggtgcagctggctgctatcacaccatcgagcattgagcctgaaagtattaaggtgttggacccggcctgcggttcaggccatatactgactgaagcctataacgtgctgaaggccatttacgaagagcgtggctaccgtacacgggatatcccgcagctgattctggaaaacaatattttcggcctggacatcgatgaccgtgccgcacagctctccggttttgcgatgctgatgctggcccgccaggatgatcgccgcattttgagtccaggccgtggcgttcgcctgaatattgtttccctgcaggaaagtaagctggatgtcgctgaactctggaccaagctgaatttccaccagcaagtgcagcgcggcagcatgggggatatgtttgctgaagggactgcactggccaataccggcagcgtggaatataagctgctgatgcgcacgctggcattgtttaccagcgcaaaaacattgggatcgctgattcaggttccacatgaagatgaagaggctctgaaagcgtttcttgatgggttatatcgcctagaagttgaaggggatattcagcagaaagaagctgcggcagagctgatcccctatatccagcaggcgtggattttggcgcagcgctatgacgcggtagtggcgaacccgccgtatatgggtgggaaaggaatgaacagtgaactgaaagagttcgctaagaaacaattcccggacagtaaatcggatttgtttgcgatgtttatgcagcatgcgttttctttgctcaaagagaacggttttaatgcgcaagtgaatatgcagtcgtggatgttcctgtcgagccatgaagcgcttcgtgggtggttgctggataataaaacctttattacgatggcacatttaggggcccgggcatttgggcaaatctcgggagaagtggttcagacgactgcgtgggtaattaataacaaccatacaaaatcttatcagcctgtatttttacgtttgattgatggtagtgaagagcaaaaaaaaacagagtttcttgaaaagaaaaaacgttttaacaatatattacaagacgattttaaacaaatccccggttcgccaatcgcatactggatagacaaggaaactctggggtcttttcttcttcacaagaaacttggggacgcaatagccttaaaagctggtatgtccaccggggataatactatttttcagcgttattggttcgaggtttcattaaataaaactacaattaaaaaaaacaaatcaatgcagcacactgtaactgccatagataaatgggttccttgtagcagcggtggcgaatatcgaaagtggtatggtattaatgagttagttgttaactggttaaatgatggtcatcatatcaggaattataggtttgaaaacggcaaagtccgttcagctgtgaggaatgatgaatattattttagggagggcgtaacatggtcaaaaataagtcaagggaatttttgtgtcagatatcgacctgaagggtttgtcttcgatgatacggggcgctgtgggttttctaacgataaaaatgagcttctatatgctgcggggctgatgtgtactccggttgcaaatcactatctatcaatacttgcccctacattgagttttaccagtggggaattgtcctcaatacctttccctacgtatgaagtacaaataaccgaactggtaagaaaagccattgatatatcaaggcatgactgggattctaaagagatatcatgggattttaaatctttatcgcttactgaaaataataaaagtgcaagattaagacttattttcaatgaaaaaatattgtcggatgctaaggtggttgaacttcttctctccatcgaaaatgatattaatgatatttttattgaaaaggttggattgaaaaaatcattaattgatagcgtatcaaaagataacatcaccctattttgcaatccgctgtatagatataaaaatgcttcaaatgatgaggataaatataataggtatttgacggagttagtagaagatattttaagttacatcatcggttgccaaatgggccgctactctctcgatcgcgaaggtttggtctacgctcacgaaggaaacaaaggttttgcagaactagtcgccgaagatgcttataaaaccttcccagctgatgaagacggtatcctgccgctcatggattacgactggttcgatgatgatgttgcctctcgcgttaaagagtttgtacgcaccatctggggagatgaacacctacagcaaaacctcgatttcatcgccgaaactctctgtttgtacgcaataaaaccgaaaaaaggcgagtcttcgctagatacaattcgtcgctatctttccacccagttctggaaagatcatatgaagatgtacaagaaacgtccgatttactggctgttcagctccggtaaagagaaagcgtttgagtgcctagtgtatctgcaccgttataatgaaggcacgctgtcgcgtatgcgtacagaatacgtggttccgctgctggcgcgctaccaaggcaatatcgatctgattaatgatcagcttaagaatgctgaatccggcgctgccaacactcgtctgaaaaaagagctaaatgggttgaccaaaaaattcaacgagctgcgtggctttgacgacagtttacggcactatgctgatagacgtatcactattgatctggatgacggcgttaaggttaactacggcaaatttggcgacctgctggcagatgtgaaagccattaccggtagcgcacctgaggagatttga

SEQ ID NO: 2451 - DNA, 738 bp, Escherichia coli
atgatgggccgctactctctcgatcgcgaaggccttgtctatgcccatgaaggtaacaaaggcttcgccgatctcgtcgccgaaggtgcctacaaaaccttcccagccgacagtgacggcatcctgccgctgatggatgacgattggtttgaggacgacgtcacctctcgcgtcaaagagtttgtccgcactgtctggggtgaagagcacctgcaggaaaacctcgaatttatcgccgaaagtctttgtttatacgcgatcaagccgaaaaaaggcgaatctgcgcttgagaccattcgtcgctatctttccacccagttctggaaagatcatctgaaaatgtacaaaaaacgcccgatttactggctattcagctccggcaaagagaaagcctttgagtgtctggtgtatctgcatcgctataacgacgccacactgccgagaatgcgtaccgaatatgtggtaccgctgctggcgcgttatcaggccaatatcgatcgcctgaacgatcaactcgatgaagcttctggcggtgaagccacacgcctgaaacgcgaacgcgacagcctgatcaaaaaattcagcgaactgcgtagttatgacgaccgcctgcgtcactatgctgatatgagaatcagtattgatctcgacgatggcgttaaggttaactacggcaagtttggcgatctgctggcagatgtcaaagccatcaccggcaatgccccagaggtgatctaa

SEQ ID NO: 2452 - DNA, 2745 bp, Escherichia coli
atgaataccaataacatcaaaaaatatgccccacaggcccgtaacgatttccgcgatgcggtgatccagaagctaacgacgcttgggatcgctgcagataaaaaaggcaatttgcagattgccgaggccgaaaccattggcgagaccgtgcgttacggtcagtttgattatccgttatcgacccttccccgccgcgaacggctggtaaaacgcgcccgtgagcagggttttgaggtactggttgagcactgcgcctacacctggtttaaccgcttatgtgcgatacgctatatggagctgcacggttatcttgatcacggcttccgtatgttatcccacccggaaaccccggccgcgtttgaggtgctggatcatgtgccggaagtggcagaagctctgctgccggaaagtaaggcgcaactggttgagatgaagctttccggtaatcaggatgaagctctgtaccgtgaactgctgctggggcagtgccacgccctgcaccacgcgatgccgttcctgtttgaagcggtagatgacgaagcggaactgctgctgccggataacctgacccgtactgactccattctgcgtgggctggttgatgatattccggaagaagactgggagcaggtagaggttatcggctggctgtatcagttctatatctcggaaaagaaagatgctgtgattggcaaagtggtgaagagcgaagatattcctgccgccacccagctgtttacgccgaactggattgtgcagtatctggtacagaactccgttggccgccagtggttgcagacctacccggactcgccgctgaaagacaaaatggagtactacattgagcctgcggagcaaacgccggaagtgcaggcgcagctggcggcgattaccccagccagcattgaacccgaaagtattaaagtgctcgacccggcctgcggctccggtcatattttgattgaagcctataatgtactgaaaaatatctacgaagagcgtggttatcgcggacgtgatattccacaactgattctggaaaataatatttttggtcttgatatcgacgaccgcgcagcccaactttccggttttgcattattaatgatggcgcgtcaggatgaccgcagaatatttacccgcgatgtacgtctgaatgttgtctctttgctagaaagcctgcatctggatatcgccaaactctggcagcaactcaatttccaccagcaggtacaaaccggcagtatgggggatatgtttgctgaaaataccgcgttaacccaaaccgacagcgcagaatatcagctgctgatgcgcacgttgaaacgctttgtgaatgcaaaaacgctgggctcactgattcaggtgccgcaggaagaagaagcggaactgaaggtatttctggacgcgctgtatcgcctggaacaggagggcgatttccagcagaaagcggcggcgaaagcgtttattccgtttattcagcaggcatggattctggcgcagcgatatgatgaggttgtgacgaatccgccgtatatgggtaatggtggaatgaatagcgaacttaaagcgtttgcaaaaaataatttcccggatagcaaatctgatttgtttgcaatgtttatggagcgtgcattttctttgcttaaaagcaatgcatataatgcgcaaataaacatgcagtcatggatgtttttatcaagctatgaaaaattaagagagaagcttcttaaattaaaaacatttcatactatggcccatcttggagcaaaagcattcagtcaaatatctggtgaagttgttcaaacaacagcctgggtggcattaaacgaacatatagatatgtttaaacccacgttcttcagaataattggaggttctgaacacgaaaaacaaaaaactcttatagaaaaaaaagatggtattatcttgcatagtcaaaataactttatgaaaataccgggagctccttttgtttattggaatgtagataaaataagtaagtactttgaaaatacaaaaactattggagatttatgtgatgcacgtaaaggtatggggacgggagacaatgcttcatttgtaagagcttggcatgaagtttcattaggaaatatcgggtttaattttgatagtcgagaaaatgcttcagcgtcgaatattaaatggttcccatacaacaatggtgggcgttatagaaaatggtatggtaacaatgaagatgttgttaactggtatcaagatggggttgaagtcaaagcaacggccacgatcaaaaacaatggtggtcattggtcaagatatcttgttagcttagatcgttttttctgccaaggtttaacttggtctgatatttcatcaggcaactttggtgctcgttattttgacaaaggatatcttttctcaagtgtaggtatgtgtgttttttctgaaacacatagcatatacaatctactaggtgtacttaacagttcaataactcaagagatattagatagtattagcccctcactacattatggcgtcggagaaataaaaaaaattccattaaaaataatcaataatgacgatgaaatcaaagaattagtccaaatttatgcaaatgactggggttcagttgagacttcatatgaatttttaacgctaccaattattgctaacaaatcagatgcacaatcaatcagaaataattattccagcttactggaaattcaacaaaaatatattggcaaagcgtttttttag

SEQ ID NO: 2453 - DNA, 3687 bp, Ruminococcaceae bacterium
atgaataaaggtgcaatacaaagatttgcaatctgggcgcggaacgagctgatcgctcaggtgtcgcagagagcttatcagtatggaatcacgaaggaaggctgcggcgaggcaaacgccgtgacggtgggcggacgcgcactgactggcgatgagcagaagcagcgcaaggagcttgtcgatcagatccgctcaaaaggctatacacaggttatggaagaggttgcctacacttggttcaaccgttttattgccctgcgctttatggaggtcaacaactatctgccctcccacattcgtgtcttttccgacagtaccggcgcgttcaagccggagattttaagtgatgtcctgcaccttgaccttccgggactgaaccgggagaaagttgcggagtatatcgaaagcaacgacaccgaaggtctctatcgctatctgctgctgacgcagtgcaacgcactgaacgaccctcttccccgtatgtttgagaaaatgggcggctataccgagcttctgctgccgaacaacattctgaaacaggacagcgttctcggtcacatggttgcggatattcccgaaaaggactggacggatcaggtgcagatcatcggctggctgtaccagtattacaactccgaactcaaggatgacacctttgctctgctcaagaagaatgtaaagatcaccaaggaacgcattccttctgcaacgcagctcttcaccccggactggattgtccgctatatggttgaaaacagcctcggcagaatctatgtagacaagcgcaagaacgagggcatctatgcggacggtcgcggcttggatgaaatgacttggcacgaagcggaatctgaacgcattgcaacagaaacgctgattgccgacaaaatgggttggaagtattacttgcccgaagcggaacagacgcaggaagtacgcaagcagcttgacgagattcagaacgagtacgccacgctggatgtcaaagacatcaaggtcatcgacccctgcatgggcagtggtcatattcttgtctatgcctttgatgtgctgatgcagatttatgaggcaagcgggtatagccagcgggacgctgcgcagagcattcttgaaaacaacctctacggtctcgatattgatgaccgtgcagcgcagcttgcctattttgctgtcatgatgaaggcacggcagtataaccgccgcgtattctcccgtggcattcaacctcatgtgtatgctatcgtcgagagcaatgggctggacagcagctccgttgaatacttcaccaacaacgatccgaagctcaagaaggactttggaactctgatggacgagctgcgagatgcaaaggaatatggttccattctgaacatttctcaggtggactttgccgccctctatgccagagtcgaggaagtgcgggctgacatcagtatgttccgcgagatcgtgttgaacagtattctgccgctgattcaggctgctgaggttatggcgcagaagtatgacgtggtggtcacgaatccgccgtatatggggataagtaacgcatcagaaaagctaaatcaatatgcgaaaaaggcttatcctatttcaaggtatgatttaagcactatctgcatggagaaaactctttccatgtgcaataagaccggaatgatggcaatgataaacattcctgtttggatgtctaagtcgagttttgaagacctcagatactcattgctgactaaacatacatttgtaaatatgctgcattgtggaagaggtatttttggatcggacttcggtacaactgcctttgttatcagaaaatcctttgaaaaaggatatgctgcaacgttccatcaactttttgatgaaatgggagcggttgattctgttgagcaaaaagaacggtggttttttgaaaggaaaggtctctacattgctgagcaaaagaaattcttgaacattgggagctatccgattgcttactcaacaagtaaacggcttttggagatccttgacactgaaaaacccctgagcgactttgcgtacccccgtaaaggactaactacgggagacaatgatacatttatccgcttgtggttcgaggtatctggtcagaaattcagcatgactggtaacgggcgcaaatggttcccgatgaccaaaggaggagacttccgacgctggtatggaaataacgactacgttgtaaattgggaaaacaatggatttgcattaaggaacttcaaggatgaagatggaaaacttcgatccgttttgcgaaatacacagttttacttacgagagtgtatttcgtggaacgatactactgcaaccggaaagattgcatttaggtatcagcccgaagggtatatttccaatgcgtccggaccgtgcgtattcgcagatcacgacttgttctatctgtttggacttctcaattctattgtgtcgcagaagctacttgaaattctggctccaaacatgaagtttgaagttggtcagatggcattggttccgattataaagaagcagtctaactatattgatgatttagtccgcaagacagtcgatatagtgacgtctgactgggattcgtttgaaacctcatgggatttcaaacttcacccattggttgaaaaccagcaatacgccgctacttatcatttcgatgagcaaaactctcctgctcatcatattagcgcagcctatcagatgtgggtagcaacaactgaacgaagattccagcaattaaaaactaacgaggaagaactcaaccgtatcttcattgacatctacggattgcagggagaacttacgcccgaagttgaggacaaggatgtcactgtgcgaaaggctgatcttggaagagatattcgttctctcatttcctacgccgtaggatgtatgttcgggcggtattcgctggataagcccggtctggtttttgccgggtacagcaagatcgagcaaaccacaaagacgcttgacggtgaggatcctgagcttgaaaagttcgcaaagcagaacgcggatggttctgtctcctatggctcctattatcacgaggtcaatcaggataactataagtccttctcgattgacacggacaatatcattcccatctgtgatgatgactatttcgacgatgacatcaccggacgttttgtgaagtgggtcgaaaccgtttacggaaaggaaacgctggaagaaaacctcaagtttatcgcagatgcgctcggcggcaagggaacaccccgcgaggtcatccgaagctacttcctgaatgacttctatgctgaccattgcagcacatactccgttactggttcgggcaagcgtccgatctactggctcttcgacagtggcaagaagaacggcttcaaggctctgatctatatgcaccgctatcagagcgaccttcttgcccggatgcgaaccgactatgttcacgagcagcaggagcgttatcgcacccagcttacccatctcgcggacgccatcgaacacgccggagctgcggagcgtgtgaagttgaccaagcagcagaagaagctccaagaacaggcacttgagattcagaagtacgaagagaaaattcatcatcttgccgatcagaacatccagatcgacctcgatgacggtgtgaagcacaactacgagctgtttgccgatgtgctggcgaagataaagtga

SEQ ID NO: 2454 - DNA, 3528 bp, Holophaga foetida
atggatcgctcaaaactaaaaacctacgcccctcaggcccgccgtgacttcatcgcggccatgaaggcccgtgctgcccttttgggcatcacagacaagggcatcgcgcccgccacgatccagggggattcggccatcatccaggggcaggcctttcctaaggtcgtggaggtcctgcggcagcggctggccttgcggatcgagggggagggtttcgagcaggtcatggaggccatggcctacacgtggttcaaccggtttgcggcgctgcgctacatggaactgcacggctatctggatcacgggtaccgcgtgctgagccacccggagggcaaggcgacgccggagatcctggagcaggcagagcatctggatctgccggggctcaagcgcgagcaggtggtggatctcaagctggagggcaaggaacaggaactctacaggctgctgctggtggcccagtgcaacgccctgcaccaggccatgcccttcctcttcgaggccatcgaggacgaaacggagctgctgctgccggataacctgctgcactccgattccctgatccgcaagctggtgagcaacctggatgcggaggattgcgaaagtgtggaagtcctgggctggctttaccagttctacatcgcggagaagaaggacacggtcatggcccgcaagagcgccgtgcccacggaggatatccccgccgtcacccagctcttcacgccgcattggatcgttcgctacctcgtggagaactccctgggtcggctctggctgctgaatcgccccggctcccggctccgggagcagatgccctattacatcgagcccgacccaaaagatgcccccgaaaccgacttcctcaagatcaccaagcccgaggagatccgcctgatggaccccgccgtgggcagcgggcacatgctcacctacgccttcgatctgctcttcctcatctatcaggaagaaggctacgcgcccaccacgatttccggcctcatcttgcggcacaacctccacggactggatctctgccctcgcgctgcccagcttgccgggttggccttggtcttcaaggcgcgggaaaagtcccgtcgcttcttccaggttggacaactcgtgcaaccaaatatcatcgagcttcgcgatgtgtgcttcgtggacaacgagttgcgcgactacatccaggctctcgggctgggcgatctcttcagccagcccatgctcaaactgctacaccagttcgaagaggcgaagaacttcggctcgctcatccagccctgcctggacgaagcgagcatcgccttcgtccgcagcgccattgaggcgaagggcatcggcggccagctattcctacgcgaaacgcacctcaaagtcctgcgcgtgcttgaacaagccgaggcgctgacgcagcggtatcacgtcgtcgtagccaatccaccgtatatgggatcaaagaatcaaacagccgcactcaagggttttttagaaacgaactttgagccttttaaggcagatcttttctcagcattctttattcgttcgagaacactcgcgttgtcggatggctttcttggcttcatgagcccgtttgtctggatgtttatcgcttcctacgaaaacctcaggcgtgaacttattgaacgggcctcaataacatcgttggttcaacttgaatactcaggtttcgaaggcgctactgtgcctatctgttgcttcaccctgaacaataggtacaagccaaaacacaaaggagcgtttatacgcctgtcaacctttcgtggtgctgaaaaccaagcaccgcggacacttgaagcgattcgcaataaagaatgtggatggttctattcgactgctactgaagagttccaaaaactgccaggatggccaattgcctattggcttacatctagaacaagggaatgctttgcgactaacgcgccgcttgaaagcatttgcaatatccgtgagggaatcaacactggggacaatactcgctttcttcgctattggagtgaagttgacttattgagaatcagcttcacgacacagccagcgggtgcggtcgagcagaaatgggttccgcacaagaaaggcggttattttcgaaggtggtatgggaacgcagaattcgttctgaactgggagggaaatggcgtggatatccactcctttcacaaccttcctctcagctttaatggcgctcctatgcgcgggaaagcgcacttctttaaggagtccttgtcctggagccgaatcagttccgggagcttcgccattcgatactacccagccggattctcatacgactcaactgcaccttcgattttcacttctccagaattcacggcttttgtccttggctttttgaatagtgaggttgtgacctgcctgctcgcggctttgagtccgactctcgatttccggctcacaaatattgggaacctccctctagctttgaagactggggattcggacagccgcgattccgttaacagggtggtctcagcatgcatggacctctcccgtgctgactgggacaacttcgagacctcctgggatttccgcgatcatcccttgctccgaccaggactgaagtcagcaacgctggaggcaagctggcagaattgggaaaggcatagcaccgccgccttccgccggatgcaggaactggagacggagaacaaccggctcttcatcgccgcctacggcctcgacggcgagttggagccagaggtgcccgaggaaaagatcaccctcgcccgcgccgatgtccggaaggatgttgccgccttcctctcctatgccctcggctgcatgatgggccgctacagcctggacaagccagggctgatctatgcccatgcgggcaacgtggatttcgacgccagccaattcgccaccttccctgccgacgaggatggcatcgtgccagtcacggagttcgcgtggttcccagatgatgccgcgacgcgcttcgaagccttcgtgaaaaccctctggcatgggtcgaccctagaggagaacctggcctgggtggcggaatccctggataccaagaaggacgaaacgccccgagagaccatccggcgctattacgccaccggcctctacaaggatcacctccagacctacaagaagcgccccatctactggctcttcagtagcggcaaggagcgcgccttccaggccctggtctacctgcaccgctaccacgagggcaccctggcccgcatgcgcaccgagtatgtgatccccctccagggccgcatcagtggccgcatcgagcagctccgggaagacctcccccgcgccacctccgccgcccacagcaagaaactccagaaggaactggacctcctgcgcaagcagcaggtggaactccacaccttcgacgaaaagctccgccaccaagccgatcgccgcatcaacctggatctcgatgacggcgtgaaggtgaactatggcaagtttggtgacctattggccgaggtgaaggcgatcacgggcgggaaggacgaggaatga

SEQ ID NO: 2455 - DNA, 3666 bp, Escherichia coli; identical to SEQ ID NO: 2443

SEQ ID NO: 2456 - DNA, 3651 bp, Oribacterium sp.
atgaataagactgccataaaaaactttgccatctgggcgagaaataaactgatcgcagatatcagttatcgtgccggccttatgggcattactgcagagggaattcagaaagcactaccacagtccactagaacaaccgagttttatgatattggtactgcagaaccttattccatcagtggcacggaagtgaaacagcgagagaaattggcggaattgattcgtaaaaaggaaaaagagacgaattataagactgcatataagtacgtgttagaggaggttgcctatacctggttcaaccgcctgattgctgtgcgctttatggaagtcaatgattatctgccgtcccatatccgtgtgctttcctccgattccggcaaaacagagccagatttggtgacaaatcccttcgacgcgggactgtcctttactcaagcggagcagcaggaaatcattcgcctgaagcaagaaaataagacggatgaagccttccgtctgctgtttatcaagcagtgcaatgctttaaatgaaatcttgcctgctttgtttgagaaaaccagtgattatactgagctcttgctgaacctttccgtggttgaccgggacagtgtgctttggcatctggttcacgatataccggaaacgtattttgatgtgaatcgcggcggtcaggtagagattatcggttggttataccagtattacaataccgagccgaaaaatgaggctttttccaagaaggggaagattagcaaggaagaagtgcccgcggttacgcagctctttacgcccgattggattgtccgctatatggtggagaatagcttaggccgtctttgggtagaggggcatccgaacgatgagctgaaagccgggtggaaatactatctggaagaagcggagcaggagtcggaggtacaggcgcagcttgctgaaattcggaaagagtatgccaagttaaatccggaggatatcaaagtaatagatccctgtatgggcagcgggcacatcttggtttatgcctttgatgtgctgatgcagatatatgagagcgcaggatatggacagcgcgacgctgccgaaagcatactggaaaacaatctctacggattggatattgatgaccgagcttttcagttagcgtactttgctatcatgatgaaagcacggcagtataaccgacggattctaaacagggaacataagccgaatgtgtactcgattcaagagagcaaagggatagaccgaaatcagctgaagttttttggtgcgggttttcgtgaaatagaaaagaagcgcgccatcgagcagatgaacggacttctggatacttttaaggatgccaaggagtatggctctattctgacagtagatcagtatgattgggagttgctggatcgctttgtttccaatattgaagtggttggtcagatgagtatggacaccgttggactggatgatactgcggaagaagtgaaacagttgattgcgcaaggcaaggtgctggcgcaaaaatatcatgtgacaattacgaatccgccgtatatgggaaataatggtatgtcagtaaagctaaccgattatttaaggaaagtatatcccaacagcaagtcagatttatattccgtatttatcgaatgttgtggctatacgacactaaagcatggattcagagctatgattacgcagcatggatggatgtttttatctagctttgaaaagctacgtttaagtgttgaaaatgcagacattatttgtatgtctcatcttggggcgcgggcgtttgacgagattagcggtgaagttgttcagacaacatccttcattacgcgtaacagtacatattctggatataaaggtacatatgtacggcttctcacatcgacatcagaatcaggaaaagaacagttattcctttcagggaatagtagattttactccggacgcgagtgctttgatatgattcccggggaacccattgcttattggtttagcgagcggttattacgtgtattcaaaaatcaagcgctatcggatgtagcaaaaccacgacagggattagcaacaggtgataatgacacttttctgagactctggacggaggtaaatattcggagaattggattcggatatcaaagtcgaagtgatgcgaagagatcaggcgctaagtggtttccctgcaataagggaggcagttatagaaaatggtatggaaataatgactatattgttaattgggagaatgacggtttcgaaataaggaataattatgataagaacggaaaacttaagtcaagacctcaaaatgtcgatttctattttagggaaggaataacttggtccacaatagcaagtggtaatttagctatgcgttatagcccagtggggcatatgtttgaaacaaaagggtcggtatgctttccaaataacaaatcacagttgctatacttacttggactaacgaatacgccaattgtttcaactatcctttccgtcctatctccaaccttagattttcatgaaggacctttaggaaaggtgcctgtcattattaatggcgattactttaaaagtgtatctgagcgagtaaatgagtgtattgaggtggccaaagcggactgggattcctttgaaacctcttgggattttgaatcgcatccgctgacaaagcaagtactaagtcatagccattggaatgccgaaagtgtaacggttgaatcgtgcttccgtgcctggtctgatgaatgcgataggagatttgaagagctcaaagcaaacgaagaagaactaaaccgcatcttcattgacatctacggcttacaggatgaattaaccccagaagtcgaagacaaggatgtaacggttcgtcgcgctgatttacagagggatatcaagtcccttctttcctatgccgtcggctgtatgtttggtcgttattccctcgacaccgccggtcttgcctatgccggaggcacatgggatgagcagaaatacgagaagttcaaaccggatggtgacaatgtgattccgattacagatgaggaatatttggaggatgacattgtatctcgcctttgtgaattcctaaaagtcgtttatggtgaagagaaactggaggataatcttgactttattgcgaaagctcttgggaataaaggtgactccagtcgagagatcatcaggaactacttcctaaatgatttcatcaaggatcattgtcagacttattctgtgactggctccggtaagcgcccaatctactggctctttgattccggaaaaaataacgggtttaaggcattaatctacttgcaccgatataatgctgacactatcggtaatctccgtatcgactatctgcatcgtatgcagcgtatctacgagagtgagatgagccgcatgcaggatataattgaccatagtactaatgcccgtgaagtagtgcaggcaacaaagcgtcgggaaaaactgactaagcagctaaaggaatgccgggaatacgatgagaaactggcgcacctcgcgctatctcgcattgaactggatctggatgacggtgtaaagaagaattaccgtaaaatacagaccgcaaatgacgaaaagttctacgaggttcttgcggattcaaagaatatcatgtcgaaggaatga

SEQ ID NO: 2457 - DNA, 804 bp, Escherichia coli
atggatataaataaaagacatcaatgtgaagttattacagatttaattagctacatcatcggttgcatgatgggccgttactccctcgatcgcgaaggccttgtctacgcccatgaaggcaacaaaggcttcgccgatctcgtcgccgaaggtgcctacaaaaccttcccagccgacagtgacggtatcctgccgctgatggatgacgagtggtttgaggacgacgtcgcctctcgcgtcaaagagtttgtccgcactgtctggggtgaagagcacctgcaggaaaacctcgaatttatcgccgaaagtctctgtttatacgcgatcaagccgaaaaaaggcgaatctgcgctggagaccattcgccgctatctttccacccagttctggaaagatcatatgaagatgtataaaaaacgcccaatctactggctattcagctccggtaaagagaaagccttcgagtgcctggtgtatctacatcgctataacgatgccacgctgtcgagaatgcgtaccgaatatgtggtgccgctgctggcgcgttatcaggccaatatcgatcgcctgaacgatcaacttgatgaggcgtctggcggtgaagccacccgcctgaaacgcgaacgcgacagcttgatcaaaaaattcagcgaactgcgcagctatgacgatcgcctgcgtcactatgctgatatgagaatcagtattgatctcgacgatggcgttaaggttaactacggcaagtttggcgatctgctggcagatgtcaaagccatcaccggcaatgccccagaggtgatctaa

SEQ ID NO: 2458 - DNA, 2517 bp, Escherichia coli
atgaataccaataacatcaaaaaatatgccccacaggcccgtaacgatttccgcgatgcggtgatccagaagctaacgacgcttgggatcgctgcagataaaaaaggcaatctgcagattgccgaggccgaaaccattggcgagaccgtgcgttacggtcagtttgattatccgttatcgacccttccccgccgcgaacggctggtaaaacgcgcccgtgagcagggttttgaggtgctggttgagcactgcgcctacacctggtttaaccgcttatgtgcaattcgctatatggagctacacggttatcttgagcacggcttccgtatgttgtcccacccggagacgccgaccgcgtttgaggtgctggatcatgtgccggaagtggcagaagccctgctgccggaaagtaaagcgcagctggttgagatgaagctttccggtaatcaggatgaagctctgtaccgcgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcggaaaagaaagatgccgtgattggcaaagtggtgaagagcgaagatattcctgccgccacccagctgtttacgccaaactggattgtgcagtatctggtgcagaactccgttggccgccagtggttgcagacctacccggactcgccgctgaaagacaaaatggagtactacatcgagcctgcggaacaaacgccggaagtgcaggcgcagctggcggcgattaccccagccagcattgaacccgaaagcattaaagtgctcgacccggcctgcggttccggtcatattttgattgaagcctataatgtgctgaaaaatatctacgaagagcgtggttatcgcgggcgtgatattccacaactgattctggaaaataatatttttggtcttgatatcgacgatcgggcagcacaactttccggttttgcattattaatgatggcgcgtcaggatgaccgcagaatatttacccgcgatgtacgtctgaatattgtctctttgcaggaaagtctgcatctggatatcgccaaactctggcagcagctcaatttccaccagcaggtacaaaccggcagtatgggggatatgtttgctgaaaataccgcgttaacccaaaccgacagcgcagaatatcagctgctaatgcgctcgttgaaacgctttgtgaatgcaaaaacgctgggctcactgattcaggtaccgcaggaagaagaagcggaactgaaggcgtttctcgatgcactgtatcaactggaacaggaaggcgatttccaacagaaagcggcagcgaaggcgtttattccgtttattcagcaggcgtggattctggcgcagcgatatgatgcggtggtggcgaatccgccgtatatggggggaaaatacttagctccggcggttaaaaatcatctgaaagaaaattattctggatatgataaagatctattttcagcctttattataagaaatttacaactttccaaaaatggtgcacaacttgggttcatgacgccatttgtctggatgtttatttcaagctatgaagaactacgtctccaactaattaataatgaaacaatcatttcattaatacagttagagtactcaggttttgatggtgccaccgttcctatttgtactttcacattgcaaaaaaatcatatttcaaatttttcaggtagttatattcgactttctgattttcgcggagcggcaaatcagggaccacgagcacttgaagcaataaataataaagattgttcttggcgctatcaaaccaatcaagaaagcttcaaaaaaatacctagcaatcctattgtatattggataaaaccccaaacctcaatcctttttacaaataaaaaaattggtgaactctatgaggttaaagaaggtcttggtacacgtgatgatgatatatttttgcgtagacactgggaagtatcaagaaaaaaaacaaaaactgacaagagtttaaaaaaatggataaaaacagataaaggaggttcttttcgaaaatggtttggaaatgatgaattcataatgaattgggaaaataatggttatgctattaaaaaccatcgaaatgcagatggtagtcttaaatcaagaccacaaaatacacaatatttttttaaagatgctatatcttggaataaaattgggtctggagaaacttcgtttcgtatacgtgatagcatcggtggtttcaacgatgctgctccatcaatatttggtgataacctaaccatattaattggactattatccagttctctctatcaatatttaattcaattacaaggaggtacgttaaatgtaaccactggaataataaaaacctaccattaa

SEQ ID NO: 2459 - DNA, 3516 bp, Acinetobacter johnsonii
atgaataccagtaatattaaaaaatacgcaccgcaagcacgtaatgattttatcgcagcgatgcgtaagcaggcggccaaatatggcatcaccgcagacaacattttaccggcagaacagaaaggcgacttgctgctgattggcgatcaggtttttccgctatccgtcatgaaaccacgtgacaagctgatcaaacgcattcaaaccagcagttttgagcaaaccattgattatatcgcttacagttggtttaaccgtctctgtgcgattcgctatatggaatgcaaaggcttactggatcatggccgtcgtgtactcagtagtgccgatggttgtgcaggcttgccacagattctggaagaatgtctggatattgacctaccaggtttagatgccagccgtgtggctgaactgaagctggatggcaataaagacgaagagctctatcgggaactgttactggctcagtgtcatgcgttgaatcaggtcatgccactcctgtttgaacaggtttctgatgaatctgagctactgttaccggataacctgaccaaaaccgactccttgattcgtgatttggtgagcagcattcctgaagaagactggtcggatgtacagattattggctggctgtatcagttctatatttctgaaaagaaagaccaggtgattggtaaagtcgtcaagagtgaagatattcctgccgcgacacaactcttcaccccaaactggattgtaaaatatctggtgcaaaacagtgtcggccgtttatggatgatggcacagcctgatagtacgcttgccagtgagtgggaatactatattcagccagcggaacagaccgatgaagtcaatgcccagttaaaacagctgattgatgtgcggattagtgaagatggcgatactttaaaccctgaaagcattacggtactcgatccagcctgtgggtcagggcacattctggtggaagcttatgattgtttgaaagctatttatttagaacgtggttaccgtagccgtgatattccacgtttgattctggaaaataacctgtacggcattgatattgatacccgtgctgcgcagctctctagctttgcactattaatgaaagcacgtgaggatgaccgccgtttatttagcaatccaccgaagctgaatattattgcgctacaagacagtcagccagaacgactggaagcattcggtcaggatttggcaaatactggtattgcacaggcagatttaaaagaattattagacctatttgaacatgcttcgacctttggttctttaattcaaatccctcaaacattcgctaaaaagctgcctgatttagaaagcaaactgaataccgctttagagtcaggggatatttttgcacagcagtcagcgcaggagctgttacctttagtacagcaagctaaattactcgctaagcaatatgatgccgtgattgcgaatccgccgtatatgggcggtaaaggcatgaatacagcactgaaagattttgctaaaaagaaattccctgacagcaagtcagacctatttgccatgtttattgagcgtggttttaactggtgtaaggacaatggctttaacagcatggtgaccatgcaaagctggatgttcctgtcctcttatgaagcgatgcgtgaaaaactattacaatatcgcacgattcaaacgatggctcatttaggggcgcgtgcatttccagaaatttctggtgaagtagtacaaacgactgcttttgtcatgcaaggcaagcatttagatggttttaagccagtattttttaggcttgttgatacagcacaagattctaaagaaattgaattaaaagcaggcttaaatcgatttgattcaactgttcaggatgattttaagaaaattccgggtagtcctattgcttattgggtgagtgaaaaggtaagggaaatttttgaaactagtccttcaatgggtgaagttgccgatgctcgccaaggccttgcaacagcggataacaatcgattcttacgtttttggcaagaagttaatattcagagagttggttttggtattgaaaatcgtgaaatagccataagatcaagaaaaaaatggtttccatataataaaggtggagattttcgtaaatggtatggcaatcaagaatatttagtaaattgggagaatgatggtttagaaattcgtgaaaatgtagatgaaaatggaaaacaacgttcacgaccacaaaatacagagttttattttagaccatcggtgagctggtcagatgtaacctcatcgactaatgcttttagatactttccacatggttttattcatgatgttaaaggtcagtccgcatttagtaattcagaggctgaaagatacaagttacttagtttgctaaattctaattttattaaatatttaatgccaatattaaatcctactatatcatttcaagttggtaattttaatcagttaccatatttaaacttgagtagtgatattagccgaaacattcaaattgcaaaattagactgggattcctacgaaacctcatgggactttactcaaaaccctatcattcgtactcagcagccaaatctagaacaagcctttcacacatggcaacagcaaaatgctgatgccgtggctgaaatgaaacgtcttgaagaagaaaacaacaagctatttattgatgcttatggtttacaggatgaactcacaccagatgtaccggatgaacaaatcaccctcacccgtgccaaccgtgaaaaagacagccagcgtttagtgtcttatgctattggttgcatgatggggcgttatagcttggacgaaccaggtttgatctatgcccatgcaggcaatcaagactttgatgccagtcgttatcaaacattcccagccgatgcagatggcattattccactgaccgaaatgcactggtttgaagatgacgcaacacatcgtatccaagagttcttaactgctgtttggggtaaagatacgctggatgccaatatgcagtggttggcagaaagcttggataaaaaagccagtgaaaccgctgaagacaccattcgccgttacctagccagtaagttctataaagaccatatgcagacctataaaaagcgtccaatctattggttattcagcagtggtaaacaaggggctttccaggcgttggtgtacttgcaccgctataacgaaagtaccttggcacgtatgcgtactgaatacgtcatgccgctgatttctaaaatggcggctatggttaattctttgcaaagtgaaatcgaaaacagtgattccgctgctgaaattaaacgtaaagagaaagaactacaaaatctgcataagcaacaggctgaactgagtagctttgaggaaaaactgcgccattatgccgatcagcgtatttcactggatctggatgatggggtgaaagtgaactatggcaagtttggggacttgttggctgaagtcaaagcgattacggggggcagtggggaataa

SEQ ID NO: 2460 - DNA, 2541 bp, Selenomonas sputigena
atgaataagaatgcgataaagaaatatgcggtatgggcaaggcgcgagctgatcgaccgtgtgtcgaagaaggcgatgcgctatggcattgcccctgaaatccctgctgaccccgaagcggacagcgttgaaggtcgccttctctccgataccgagaagaaagagcggcgtgcgctcatcgagaaagtggcagcgcacggctacgagcagacgatggaagaagcggcctacacttggttcaaccgcttcgccgcgcttcgcttcatggaggtcaacggctatctgccctcgcatgtgcgggtattcaccaacgatgccggagagttcaagccgcagattctcgccgaggcgatccatctggacttgccggggctggacaaggaaaaagtctatgccttgaaggaaggcaatgacgaggaggcgctctttcgctatcttatcatcgtgcagtgcaatgccctgaatgaaatcctgccgggaatgtttcagcgactggaggatttcacggaattgctgctgcccgacaatctgctccgcgaaggcagcgtgattgagcgtcttgtcaagcagggcgatgcgggaagcattcctgaggaggattggcgcgatcaggtgcagatcatcggctggctgtaccaatactacaacacggctttaaatgaattggtatatgacggcaatctttctaaagagaagattccaaaacatttgctccctgcggcaacaacaatttatacaccagattggattgttcgctacatggtggaaaattccctaggccgcttgtggctcgaaggacatccgaacgaaaacctgcaaggcgaatggaaatactatctgcctgaagccgagcaggaggagtctgtgcagaaacagcttgccgagatgcgcaaagaatctgccaaccgcaagccggaggacattcgctgcatcgacccctgcatgggcagcggacatatcctctgctacatgtttgacgtactggtgaagatctacgaggactatggatatacggctcgtgaagccgcagcatccatcgtgcaaaacaatctctatggcctagacatcgacgaccgtgcggcacagctttcctattttgccgtgatgatgaaggcgcggcagtatgaccgtcgctttttcagccgtgggattcagccgaatgtgatggcgatagaggagagcaacggacttgcgacttgggcggaaacggcaggggacagcctcgtttccgggcagctcacctttgaggacgatttcatccgtatggcggattatctgattgaaatattccaagatgccaaggaatatggctctattctgacggtgcaggcagatcgctatgatgcactcgtggactttatcgagaaaactgggcaggagacaggaaatctcctctttcgggcgtggatcgatgaagtcgaacgaaggattctaccgctgattcaacaggcaaaggtattctcgcaaaaatatgatgtgattgtgactaatcctccataccttggaagtacgcgttttagtttcaagcttaacgagtatgtgaagaaatatttcccaaatgagaaaagtgatttgagcatggttatgctcaaaaaatcgcttcaagaaactgccaaaacaaatggctatgtggcatttgttaccacggcatcttggatgagtttgtcgagttttgaaaaactgcgttcttatatgtataaagattgtgctattgacacgttagttgattgtggcacagagctttttgaaggaaaagtagggcataattctatagtttcatgggttgttcgcaaaacgaaattcaattataggatgactgctgtccgattggttgattattgttattcaagacgggatgaaaaagaggtggaattttttaataagaaaaactattttgttgccacacaggaaaacttttccaagattccgggcagcccagtggcttattgggtgagtgaggcaatgcttcgttgctttggagaaaaatgcataaaggattatggctttgctggcatcggtatgcgaactggtgacaacgaaagatttttaagattatggtatgaagtgtctgcaaacaattttagtattacaagcaaaggcgttataaaatggattccatataataagggaggaaattttcgcaaatggtatggtaataatgaatatgtagttaattgggagaatgatggagaagaaatcaaagataatacacggctaaattatcctgaactcggagataatttgggttggaaaataagtaatgaaaaatactattttaagcctggtataacttggacgggtgtaactatggcaaagtttagttgccgaatatatccaagtggatttatttttgattcaggtgccaatgggcttttcccttacaaaaagcaggatgaatcatatttggcaggttttcttaatacgaaaattgcaaatgacatattgcgaataataaaccctacaataaacacaggctctggaactgtaaagtctataccggtaatcaaaagcaagactcaacaaaaaaagttgatgaattaa

SEQ ID NO: 2461 - DNA, 3510 bp, Acinetobacter junii
atgaacaccagcaatattaaaaaatacgcaccgcaagcacgaaatgattttatcgcagcgatgcgcaagcaggcggccaaatatggcatcaccgcagacagcattttaccggcagaacagaaaggcgacttgttgctgattggcgatcaggtttttccgctatccgtcatgaaacctcgtgagaagctgatcaagcgcattcaaaccagcagttttgagcagacgattgattatatcgcttacagctggtttaaccgtctctgtgcgattcgctacatggaatgcaaaggcttactggatcatggtcgccgtgtactgagtagtgcagatggcaatgcaggcttgccacagattctggaagaatgtctggatattgacctaccgggtttaaatgctagtcgtgtggcagaactcaaactggatggcaataaagacgaagaactctatcgtgagctattactggtccaatgccatgcattgaatcaggtcatgccactcctgtttgagcaggtgtctgatgaatctgaactactattacctgacaatttgaccaagaccgattctttgattcgtgatctggtcagcagcattccagaagaagactggtcggatgtacagattattggctggctgtatcagttctatatttctgaaaagaaagatcaagtgattggtaaagtcgtcaagagtgaagacattcctgcagcgacccaactcttcaccccaaactggattgtaaaatacctggtacagaacagtgtcggtcgtttatggctgatggcacagcctgatagtacgcttgccagtgaatgggaatactatattcagccagcggaacagaccgatgaagtcaatgcacagttaaaacagctgattgatgtacggatcagtgaagatggcgatactttaaaccctgaaagcattacggtactcgatcctgcctgtggttcggggcatattttggtggaagcctatgactgcttaaaagcgatttatttagaacgtggttaccgtagccgtgatattccacgtttgattctggaaaataacctgtacggtattgatattgatacccgtgcagcacagttggccagttttgcgctattgatgaaagcacgtgaggatgaccgccgtttatttagcaatccaccaaagctgaatattatcgcgttgcaagatagtcagtcagaacgactgcaagcattcagtcaggatttggcaagtactggtattgcacagccagatttaaaagaactgctggacctatttgaacatgcttcaacttttggttctttgattcaaatccctcaaacattcgctaaaaagctgcctgatttagaaacaaagctcaatacagcattagcgtcaggggatatttttgcacagcagtcagcacaagagttattgcctttagtacaacaagctatattactggctaaacaatatgatgcagtaattgcaaacccgccgtatatgggcggtaagggcatgaatacagcacttaaagattttgcgaagaaaaaattccctgacagcaagtcagacctgtttgccatgtttattgagcgtggatttgtatggtgtaaggacaatggctttaacagcatggtcgctatgcaaagctggatgttcttatcctcttatgaggcgatgcgtgaaaagctgttacaagatcgcacgattcaaactatggcacatttaggtgcaagagcattccctgaaatctcaggagaggtggtacaagcgactgcatttgtgatgcaaggtaaacatctaaatgggttcaagcccgtattttttaggttagtggatacagagcaggatcaaaaagaaaatgaattaaaagcaggactaaatcgctttgattcaacgattcaagatgactttaagaaaattccaggtagtcctgtggcttattgggtgagtgaaaaggtaagagaaatttttatattaggaaaatatgtggatgatgttgcagaacctaaaagtggcctatcaactacagacaataatcaatttttaagattctggtttgaggtttcatatttaaaaattggatttggtattaccagcattattaatactcaagatagtgactatatgtggtttccatttgttaaagggggagattttagaaaatgggctggtaatgaggagtatgtggtaaattggaaaaataatggtcgtgatataagagaaaaaacaaaaggggcagctggaggtcgaatagtaagtccagaattttattttaaaacaggtgttacttggtctggaatatcaagtagccttccttcaatgagaaaaatgacgaattctatttttggaagcggagggaaagctttattttcgaatgaacatttagatgtatttttaggttttatgaattctaaaatagctataagccttttaaacatcataagtccaacgttaaattatgaagcagggcatattggtaaattgccagtagtgaaatttgattcaattcctataaataaagttatccagtctctggttgatatatctagatcggattgggactcctatgaaacttcatgggactttactcaaaacccaattatccgtacggggcagctaaacctcgaacaagcttttaacacctggcaacagcaaaatgctgacgccgtggctgagatgaaacgcttagaagaagaaaacaataagctatttattgatgcttatggtttacaggacgaactcacgccagatgtacccgatgaacaaatcaccctaacccgtgccgaccgtgaaaaagacagccagcgtttagtttcttatgcacttggctgcatgatgggacgttatagtctagatgaaccgggcttgatctatgcccatgcaggcaatcaagactttgatgcgagtcgttatcaaacattcccagccgatgctgacggtattattccactcaccgaaatgcactggtttgaagatgatgccacccatcgtatccaagagttcttaactgcagtgtggggtaaagatacactggatgccaatatgcagtggctcgctgaaagtttagataaaaaagccagtgaaactgctgaagacaccattcgccgttaccttgctagtaagttttataaagaccacatgcagacctataaaaagcgcccgatctactggttatttagcagtggtaagcaaggggctttccaggcattggtgtatttacaccgctataacgaaagtaccttggcgcgtatgcgtaccgaatatgtcatgccactgatttccaaaatgtccgctatggccaattctttggaaagtgaaatagaaaacagtgattctgctgctgaaattaaacgtatcgagaaaaaactgcaaaacttgcataaacaacaggctgaactcagtacctttgaggaaaaactgcgtcactatgccgatcagcgtattagcttagatctggatgatggggtgaaagtgaactatggcaagtttggggacttgttggctgaagtgaaagcagtgacgggggagaaatga

SEQ ID NO: 2462 - DNA, 3714 bp, Shewanella baltica
atgaatactgcgaaactaaaaaagtatgcccctcaagcaagacgtgagtttatcaccgctgtttcaaaacaattaaatcagctaggtatatacagcgacaaacagatatcagaggtaaaacaagaaggctcagtattacttattgaaggtaaagcctttgagcttagtgtaaaaattgccagagagcgattggtcaaaaaggttcaggttatgggctataaccaactcgtggaacaagtagcctatacctggttcaaccgtctgtgtgctattcgctatatggaaatccatgactacttaggtcacggtttccgcgttctttctcacccaaacaaccccaaaggtttcgagatcctcgatcatgcacaagatgctattgatgaactcagctctgaaaatcaaaagctagacagagctcgcattatcgagctaaagcttgcgggcaacaaagacgaagagctttatcgtgaactactgttaggtcagtgccataagttgcatgaagcgatgcctttcttattcgacgcattagacgacgaaacagagctactgctaccggataacctgactcgtacagactcaattctgcgtggattggtagatggaatccctgaagaggactggcaacaggtagaagttattggctggctttaccagttctatatttctgaaaagaaagatcaggtaatgggtaaggtagtcaagagtgaagacattcctgccgctacccagctatttacacccaactggattgtgaagtatctggtacaaaactcagtcggtcgtcaatggctgcaaacctacccagattctgccattaaaacgcagatggaatactacattgagcctgctcagcaatctgaggaagttaatcaacagctaaaagctattacgcccctttcttctaatggagaaggcattgaacctgaaaccattaaagtactcgatccggcttgtggttcgggccacatactgattgaagcctacaacgtgcttaaagctatctacgaggaacgtggtttccgctctcgtgacattccaaagatgattctggagaacaacctctacggcctagacattgatgatcgtgcagcacagttgtctggctttgcgctgatgatgatggccagagatgacgataagcgtatttttacccgcaacgtgcgactcaatgtgctgtcattgcaggaaagtaaccacattgacctgccgaccttatggaaagcactcaacctatcgggaagctggcaaagcggcacatcgcagggcttgttctcagacgaagaacaagatttaagctcgttcaatgcagacgactgcatggatgcaggaggtagggcgacgcaggatgccaaagccgacaaccgctatcaactgctgaaacgaacgttggcaagattttctcaagctaagacctttggttcattgattgatgtaccaagcgatgagcatgatcagttaaaagaattactgagcactcttgtcgagcttcaagaatcaggcgactcaatgcaaaagcctgcggctaagcaattgattgaggttattcatcaggctttggttctatcgattcgttacgatgctgttattgctaatcctccctatatgggagcaaaaggaatgaatgcggacttaaaggattttgcaaagaaaaatttccctaatagtaaatcagatctgtttgccatttttattgaacgaggatttagctggcttaaagaagcaggctttaattcaatggtaacaatgcaaagttggatgttcttatctagttatgaacagatgagagactccatactgtcccatgcgactattgaaaatatggttcatatggggaacggagtaatgaaaattgcatttggtacgaatgctactattttcagaaatacccattttaaaggttatcgcagctcattttcttacgttgataatgatgatattaatgaggatggtcatccgaaggaatttccagtaattaatggaagaataagagatgtggcatcggatgagtttaagaacatccccggtagtccaatagcatattgggttgataggtcagtagttgactgttttcgaaagaataaaacaatcggtgatgtttctgacgtgaagcaaggtttagcaactgctaatgatgatcgttttttgcgagcttggtttgaagtcgattgtagcaaaatatcatttccatcttctttcgaaccaaataaaaaatggtttgccttcaataaggggggtgattttaggaagtggtatggtaataactatttggtcgtaaattgggagaatgatggtgaggagattaaaggtttccgagagggaggtaaacaaaaatcaagacctcaaaatacatcttattacttcaaacaaggcgtaacctgggggcaaactagtagcggaaagtcttcattcaggtgggttgacaatggttatatatttgctcacataagctcaatgttatttagtagctctgatgacgaggggaagttgaaactagcttttctaaatagcacatctggtatatatcttttggagctattcagtcaatcaatgggggtcgaagtcggtcatataaaaagtcttccttatataccagtcggtgatggtgaaataatatcaaaaatcaataggctgatatcaattcataagtgtgattgggatagtcatgagacatcaatcggctttaacgatcataaattcgttgcttttaaaaacaagtgtttacgggaaattgctagctattacttagagtttgacctgaaaattgtcgatgagattcgtttggttgagactgaagtaaattcatttttttctcaagcgaccggtctttcaaacgttgttttaaatgatgttgacatatctgaggtcagtgtttctacgaaccctcactacctctatccaacagattctaatcggatagataggtatactagtgagtcacttgttcaactcataagctattcaattgggtgtatgatgggtcgttactctcttgatcgtgacggactaatctatgctcattccgtcaatgaagaatttgataagctagctgcagaaggtgcatatgtaacgtacccatctgacgaagacggtattgtcccattaaccgatcaagaatggtttaaagacgacgcaacaaaccgttttcgagagtttgttcaggtcgtatggggtgaagaacacctgcaggaaaaccttgattttgttgccgaatcattatgcctaaacgctataaagcctaagaaatctgaatccgcgttagagacgattcgacgttatttatcgactcagttctacaaagatcatctgaagacttacaaaaagagacctatttattggctgtttagctcgggcaaacaaaaggcctttgagtgccttgtttacctgcatcgttacaacgagggcacgctttctcgtatgcgtactgagtatgtcaccccgttactaggcaaatacgatgcttatgcagagcaacttgagaagcagattgaaacagcggactcgaccagtgaagcgaaccgttttaagaaagagttggacgccttaatcaagaaacaggtcgaactacgagagtttgatgacaagctaaaacactacgccgatatgcgtatttcactggatctcgatgatggtgtgaaagttaattacggcaagtttggtgatctgctggctgatgttaaggccattaccggttctgcctcggaggataactaa

SEQ ID NO: 2463 - DNA, 3741 bp, Vibrio cholerae; identical to SEQ ID NO: 2398

SEQ ID NO: 2464 - DNA, 1593 bp, Escherichia coli
ttgaagctatggtatgaaccatcattaagaaaaattaacttttccgcaaaagatcgtgccgacgcattaaattctcaggcaaaatggtttccttgccaaaaaggtgggagttatagaaaatggtttggtaatcatgagtatcttgtaaactgggaaaatgatggccgtgaacttcttgattttgcagcaagcctgtatggttctccaaccagaacaataaaaaatatccctttttattttagagaaggtgcaacttggtcgacaatttcgtctagtgatttttcaattagatatagcccaactggttttatatcagaaaccaaaggtgctgtttgttttgctgatgataaagatattttattatcgatcctaggattcggtaattctaaattagttaattattttttgaaatcattatcaccaacgcttgattaccacgaaggtccgataggtaaacttccttttaaaggaaagcttaaggctcaagttttagaaaatgttgtaaatttaatcgctatttcagaggaagactggaatactgaggaaacatcttgggggtttaaaaaacaccctatcacaaaattagacaacctgaattatttgcaggctagttttgaagcttttaaaaatgatgtacaagaaactataattagaacccaacagcttgaagagttcaataacaaggaaataattagagaatatggactagaatcagagctaaactataaagtttctttagaagaaataacattaacggtaaatcctgattataagtattctggaaccacggatgataaatcaaaaaggatgcagtcagacagtctttcctccctactatcctatgccatcggctgcatgatgggccgctactccctcgatcgcgaaggccttgtctacgcccatgaaggtaacaaaggcttcgccgatctcgtcgccgaaggtgcctacaaaaccttcccggccgacagtgacggtatcctgccgctgatggatgacgagtggtttgacgacgacgtcacctctcgcgtcaaagagtttgtccgcaccgtctggggcgaagagcacctgcaggaaaacctcgaatttatcgccgaaagtctctgtttatacgcgatcaagccaaaaaaaggcgaatctgcgctggagaccattcgccgctatctttccacccagttctggaaagatcatctgaaaatgtacaaaaagcgccctatctactggctgtttagctccggtaaagagaaagccttcgagtgcctggtgtatctgcatcgctataacgacgccacgctgtcgagaatgcgtaccgaatatgtggtgccgctgctggcgcgttatcaggccaatatcgatcgcctgaacgatcaacttgatgaggcttcaggcggtgaagctactcgcctgaaacgcgaacgcgatagcctgatcaaaaaattcagcgaactgcgcagctatgacgaccgcctgcgtcactatgctgatatgagaatcagtattgatctcgacgatggcgttaaggttaactacggcaagtttggcgatctgctggcagatgttaaagccatcaccggcaatgccccagaggtgatctaa

SEQ ID NO: 2465 - DNA, 1905 bp, Escherichia coli
atgaataccaataacatcaaaaaatatgccccacaggcccgtaacgatttccgcgatgcggtgatccagaagctaacgacgcttgggatcgctgcagataaaaaaggcaatctgcagattgccgaggccgaaaccattggcgagaccgtgcgttacggtcagtttgattacccgttatcgacccttccccgccgcgaacggctggtaaaacgcgcccgtgagctgggttttgaggtgctggttgagcactgcgcctacacctggtttaaccgcttatgtgcaattcgctatatggagctgcacggttatcttgatcacggcttccgtatgttgtctcacccggagacgccggccgcgtttgaggtgctggatcatgtgccggaagtggcagaagccctgctaccagaaagtaaggcgcagttggttgaaatgaagctttccggtaatcaggatgaagctctgtaccgtgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcggaaaagaaagatgctgtgattggcaaagtggtgaagagcgaagatattcctgccgccacccagctgtttacgccgaactggattgtgcagtatctggtacagaactccgttggtcgccagtggttgcaaacctaccccgactcgccgctgaaagacaaaatggagtactacattgagcctgcggaacaaacgccggaagtgcaggcgcagctggcggcgattaccccagccagcattgaacccgaaagcattaaagtgctcgacccggcctgcggttccggtcatattttgattgaagcctataatgtgctgaaaaatatctacgaagagcgtggttatcgcgggcgtgatattccacaactgattctggaaaataatatttttggtcttgatatcgacgaccgagcggcacagctttccggctttgcattattaatgatggcacgtcaggatgaccgcagaatatttacccgcgatgtacgtctgaatattgtctctttgcaggaaagcctgcatctggatatcgccaaactctggcagcagctcaatttccaccagcaggtgcaaaccggcagtatgggggatatgtttgctgaaaataccgcgttaacccaaactgacagcgcagaatatcagctgctgatgcgcacgttgaaacgctttgtgaatgcaaaaacgctgggctcactgattcaggtaccgcaggaagaagaagcggaactgaaggtatttctggacgcgctgtatcgcctggaacagaaaggcgacttccaacagaaagcggcagcgaaggcgtttattccgtttattcagcaagcgtggattctggcgcagcgatatgatgcggtggtggcaaatccgccgtatatgggcggcaaagggatgaatggcgagctgaaagagtttgccaaaaataatttcccggatagtaaagctgatttgtttgcaatgtttatgcagcatgcattttctttacttaaagaaaatgggtttaatgcacaagtcaatatgcaatcatggatgttcttgtcgagctacgaagcgcttcgcggttggttattaaataataaaacatttatcacaatggctcatttaggagctcgagcttttgggcaaatttcaggtgaggttgtacagacaactgtatgggtagttaataataaccatactgagttttaccgccccgtatttttccgcttaatcaatgggagtgaagaggaaaaaaaagtgcactaa

SEQ ID NO: 2466 - DNA, 3741 bp, Vibrio cholerae; identical to SEQ ID NO: 2398

SEQ ID NO: 2467 - DNA, 3474 bp, Alcanivorax pacificus
atggaaacatcaaaacttaaaaaattcgcccaattcgctcgccgcagcctcctcgaacaggttacagccaagctcaaactagtactcgccgacgagagtcccgcccggcgagaaaggccacaggcaattaaaaagctggaagaggcggtaaccgaccaaggcaaagagcaggttatcgaacgggtggcctacatctggttcaaccgcttctgcgccctgcgttttatggacgtgaatcgttacaaccgcattggcattgtttcccctgctgaggggcagttccagcccgagatcctagcggatgccaaaatgggccatatcgatgaagaaatggtgtcggaggcaacccgtcaaaagatcttcactctcctggatggcaaaacacccagtcaggatccgcagggggaggcctatcgcctgttggtcgtcgcggcctgtaactattggtacagtgcgatgccgttcctgttcgaacgcattgacgattacaccgagctactaatgccggatgatttgctgtcaggaaactctatcctggcctatacccgcgaagccatgacgccggatgcctgtgaggatgtcgaggtgatcggctggctgtatcagttttatatctccgagaagaaagaccaggtattcgccgatcttaagaaaaacaagaaagttactcccgagaatatcccagcggcgacccagctattcactcctcactggattgttcgttacttagtggaaaactcgctgggccgactctggatgctcaaccggccagactcaggcctgattgaacggatggattactacattaagccggaagatcctgaggcagatttcctccgcatcagtagccccgaagaaattaaggtttgcgatccagcctgtggctcaggccatatgctgacttatgccttcgatttgctgtatgccatttatgaggaggaaggctatgagtccgctgagattccggccaagattctgacccataacctttacggaattgagatcgacgaacgcgctggagaactggccgcatttgcgctgaccatgaaggcgcgagccagacaacgccgtttcttccgaaagcccgtgcagccgaatattgtcgttctggagaacgtgtcctttaccgaatccgagatgcaagatgtagctactctggtaggtaaagatctttttactgacgagctgcgcgagactttatgccggttcgaacaggcaaaaaatttcggttcactgatagtgccgaagctaactgatccatcccaaactctgagcgttcttgaggacggaggcctttgcgacgatatgctgctaaaagaagttcaagcgcgcctcgtcgccgttctccgaatggccgaagtgctctcgcccaaataccatgtggtggtagccaatccaccgtatatggggcgaaggagtgggatgaatgatgttctgaagaaattcatcaacgacttcttcattgaaggaaaagctgatctatacgcagcctttctgaaaagggcttccttgctcggcgttgagcgatcactgcatgggctcgtcaccatgcaaagctggatgtttctctcatcgtacaagggaatcagggaactattggttcgcaaccatacgatagattcagtgctgcatcttgggccgagggctttccctgaaatcggcggggaagtcgtgcaagttgcagctacatcgttctcaaagctacggaatcttgacaataaaccgatatttatccgtgcagtagatagaactgccgaggaaaagtcgcaggcgctaaaagataaacgcaactttttttctaaggtgagccagctagagttcttgggtatacctgattgcccgcttccatattggcttcctgagcaacttatcgccctatttggacgatcaaaaaaggtagaagactactcagatcagcgccagggccttgcaactggagatgatgaccgatttcttagaacatggccggaggtttccagtgctcgaactaactgggatgcggagaaatttcctgaccaagcctttccatggttcccattcattaaaggcggtagctttcggcgctggtatggaaataatgagcatgtcattaaatttgaccaggaaagttttactgcgttatcccagcagggaaactgcctgccaagcagatcatattatctaagggagtctgtcgtttggtcagatattgccggatcagcattcgctgcaagattcaaccctcaagggaaagtttttgctactggcgcactgagcgcttttccatcccaaacgcctatttcttcgctgcttggctacttcaattctaatatccacaaggaggttatgtacgctcttagtagcggaatgcattacagcgtgggctatgtcgataaatcgccataccttcacagtgatgtaccgcactcgcgcgttggcgagataactaaaatttgcgtcgctctctcaaaatctgactgggacgcctacgaaacatcttgggatttcacgagttctccactgcttacgttggatcaccgggccgagacgctggaggccagctataccctgctacgcaccaattggcaacgcatgacagaagagatgcagagattagaggaagaaaatagtcgcattttcatcgatgcctatggcctgcatgacgaactattccccgaggtgccgcttgaggaaatcacacttacttgcaaccccgcctaccgctatggggtaaaaggctctgaggaagaccgggaaacccgcctgtgtgctgacaccatggctgaactcatctcctacgctgtgggttgtatgttcggtcgctacgctctggacaagccgggcctgattctcgccaatcagggtgagactatcgcggactacctgaagcagatcccagagccgagcttcccggcggatgaggataatgtcatccccatgctcgacggtgactggttcaccgacgacatcaccgagcgtttccgcgaattcctgcgcatcgcctttggcgaagaacactatgaggaaaacctccgctttgtcgagcaggcgctgggcaaggacattcgcaagtatttcctaaaggacttctacaacgatcacgtgcgccgttacaacaaacggcccatctactggctgttctcctcaccaaagggctcattcaatgcgctgatctacatgcaccgctaccagccccacaccgtgggcacggtgctggagtacctgcgcgatttcaaagacgagaagctgcaagcccggaaaaaccatctggaagccgtcagcatcagtgctggagcttcccagggtgagaagaccaaggccctgaaagaaattgagaatatcaacaaaatccttgccgagctggatgactacgagcgggatgtgctttaccccctagccaccgagcagatggaaatcgatctcgatgacggggtgaaggccaattatccgaaattcggcgacgctttaaagaagattaccgggttaagccaatga

SEQ ID NO: 2468 - DNA, 3741 bp, Vibrio cholerae; identical to SEQ ID NO: 2398

SEQ ID NO: 2469 - DNA, 3741 bp, Vibrio cholerae; identical to SEQ ID NO: 2398

SEQ ID NO: 2470 - DNA, 3480 bp, Gamma proteobacterium
gtggatacgtctaagttaaaaaaattcgcacaagcggcgcgccaagagttacttgagcaggtcggcagtaaactcgcgtttgtcttaaagcccgaaagtcccgctcgccgtgaatatccggcggtagtgaatgagctcgaaaaggcgatgtcggctcatggtaaagcggcgctgatcgatcaagtggcctacacctggttcaaccgtttctgtgcactgcgattcatggatgtgaacggttacaaccgtgtgggtgtcgtctcaccggctgagggacaggtgcaaccagagatcctcgctgaagctaaatcaggtgtacttgatgatggtcagattaacgctcagacgatagagaaaatccgcggcctgctgaatggctcgattccaagcccagatgcacaaagcgaagcgtaccgtctactcatcgtgggttcatgtaatgcgctgtacgaccgtatgccttacctgtttgagcgtattcaggacttcactgagctactgatgcccgatgatctactttcggataactcgattctgacgaaaatgcgcgaggtgatgacgccagaatcctgcacggatgttgagatcattggttggctgtatcagttttacatttccgaaaagaaagacgaggtgtttgcaggtctcaagaagaaccagaagattaccgccgagaacattccggcggccactcagctgttcacgccccactggattgtgcgctatttggttgagaactctttgggccgcctctggatgctgaatcgccccaattccaagctcacagagcagatggaatattacatagcaccggaagaacctgagtcagatttcctaaagatcggcagtcctgaagagatcaaaatcgccgatcctgcagcaggctcaggccacatgcttacctacgcgtttgatctgctgtacgcgatctacgaagaggaaggctatgacccgaatgacattccgggactgattctgagcaacaacctgtacggtatcgagattgatgagcgcgcaggggcgttagcgtcttttgcgcttgagatgaaagccgcagcaaaactcggtcgtcggcgtttcttccgtatggatgcgaagcccaatgtttgtgtgcttgaagattttactttcacagactccgagatggatgatgtgatgtccatcgtgggtaaagatctttactcggcagacctgcgcgagacgctgactcagtttgagcaagctaaaaacttcggctctctcattgttccaaagctcaaggaccccgctgaaacactccgactgatcgagacaaaagacctcgcgggcgatatgtggttgaccgaagtacatgagcgtttggtcagagtactgcgcatggctgagtatctttcgccgaaataccatgtggtggtagccaacccaccatataagaagaaaggtgaccttaacggccagcttcagtcatttcttgtggagaagtttcccgattgtttttcggacctatatgcggcatttattgaccgcctgaataaactttgccgcaggcattgtctcttcgcaatgatcgctatggatagctggttatttggtgatgatttcacagaaatgcgcatacgcctgctctcaggagcgccttttaaacagttagcgcacctcggccctcgtgcctttgaccaaatcaaaggtgaggttgtacaggtcgcaagcttcgtatcacaaaggcatggcgatccaagtcaggtggctcaattcttcgacttaactgacggccagacttccgaagagaaggcgtctatgcttcgaaaacggcatggaaaacatctggctagagggactgatttttcatgtttgcctcgaaatgtggtcgcgtattttgtgtcagatcatactcggaatgcttacgcaaaaggcacacccctaaaggagattgcggaggccttcactggtttgcaaaccggtgacaatgatcgctttattcgatgctggcccgaagtcaacagtaattccattgcaaacaataatagttacgatgttataggatccgatgaccatccttgggtccggtatattaaaggtagtgattaccggaaatggtacggaaatggctttctcgttctgaattgggcgagaaatggacaagctgtaatcaaccatccaagtgctcgacctcagaatcgagaacactacttcaagcccggattagcctacaacaccattgccaaaaagttttcggctcgacgtgtttatggtggtgaggtattcgatcaaaagaattcaatgttcatagcggcaaatgatgtgagtctcgatgagtctttggcacttttgcactccaattcaattgttccgttgctccgcgtggttgccgctaaggactttggtcccggcagcatgaagcttttgccaatgccgtcagatggtattccattacctgcacgtgaaattacgttgcaatctgtgagactggctcgcgcagactgggacgcctacgaaacctcttgggatttcagcacgctcccgctgatctcgcacgatcatcgcggagagacgcttgcggagagatatgcaagcttgcgcacccattggcagtccatgaaggacgaaatgcagcggctggaggaagagaacaaccgcatcttcatcgaagtctatggcctccaagacgaactatcgcccgaagtcccaatcgaagaaatcaccctcacctgtaacccagcgtaccgttatggcatcaaaggcactaaagaagaacgtgaaacacgcctgaaagcggacactatggcagagttcttgtcatatgctgtgggttgtatgttcgggcgctactcattggatgagccgggtctgatcctagccaaccaaggtgaaaccctcgccgactatttagctcgtatacctgaaccggcgttcatgccggacgatgataacgtcattccactgatcgacttcgagggggactggtttgaggacgatatcagcgagcgctttaagcagttcctacgggtgacgtttggcgatcagcactatgccgagaacgtagcctttatcgaagatgcgttgggtaagagtatccaaaaatacttcgttaaagacttttataacgaccatgttcaacgttacaagaagcgcccaatctactggttgttctcaagtccgaaaggcacgttcaatgcgctgatctacatgcaccgctacacgtcgtcaacggcaagtgtcgtgctgaacgagtatctgcgtgagttccgcaccaagctcgaagcgcgtcgcgatagcaacgagcaaatctcaattagcgccagcagttctcagaaagagaagaccgctgcactgaagatgatcgataagctcaacaaagcgattgaagaggtgaacgactacgagcgtgaggtactttatccgttggcaggtcagaacatcgccatcgatctcgatgatggtgtgaaacacaactatcccttgttcggcaaagcgctgaagaagatcacaggcttgagctaa

SEQ ID NO: 2471 - DNA, 3615 bp, Escherichia coli
atgaataccaataacatcaaaaaatatgccccacaggcccgtaacgacttccgcgatgcggtgatccagaagctaacgacgcttgggatcgctgcagataaaaaaggcaatctgcagattgccgaggccgaaaccattggcgagaccgtgcgttacggtcagtttgattacccgttatcgacccttccccgccgcgaacggctggtaaaacgcgcccgggagcagggttttgaggtgctggttgagcactgcgcctacacctggtttaaccgcttatgtgcgatacgctatatggagctgcacggttatcttgatcacggcttccgtatgttatcccacccggaaaccccggccgcgtttgaggtgctggatcatgtgccggaagtggcagaagctctgctgccggaaaataaagcgcagctggttgaaatgaagctttccggtaatcaggatgaagctctgtaccgtgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcggaaaagaaagatgctgtgattggcaaagtggtgaagagcgaagatattcctgccgccacccagctgtttacgccaaactggattgtgcagtatctggtacagaactccgttggccgccagtggttgcagacctacccggactcaccgctgaaagacaaaatggagtactacattgagcctgcggagcaaacgccggaagtgcaggcgcagctggcggcgattaccccggccagcattgaacccgaaagtattaaagtgctcgacccggcctgcggctccggtcatattttgattgaagcctataatgtgctgaaaaatatctacgaagagcgtggttatcgcgggcgtgatattccacaactgattctggaaaataatatttttggtcttgatatcgacgaccgggcagcacagctttccggttttgcattattaatgatggcgcgtcaggatgaccgcagaatatttacccgcgatgtacgtctgaatattgtctctttgcaggaaagcctgcatctggatatcgccaaactctggcagcaactcaatttccaccagcagatacaaaccggcagtatgggggatatgtttgctgaaaataacgcgttaacacaaaccgacagcgcagaatatcagctgctgctgcgcacgctgaaacgctttgtgaatgccaaaacgctgggttcactgattcaggtaccgcaggaagaagaagcggaactgaaggtattcctggatgcgctgtatcgcctggaacaggaaggcgatttccagcagaaggccgcagcgaaagcgtttattccgtttattcagcaggcgtggattctggcgcagcgatatgatgcggtggtggcgaatccgccgtatatgggcggcaagggaatgaatggtgagctgaaagagtttgccaaaaataatttcccggatagtaaagctgatttgtttgcaatgtttatgcagcatgcattttctttacttaaagaaaatgggtttaatgcacaaataaatatgcaatcttggatgtttttatccagttttgaggtgctacgtgaatggctgatcgaaaacaaaacgtttgttaacatgattcacctcggatctcgagcatttgcggagatttcaggcgaagtcgtacaaacaactgcatgggtaatgaacaattatgagatcaataaatatcaacctatatttttcaggttaattgaaggtaacgaatctcaaaaaaataaaactttaaaaaaacgtgaaagtaactataaagacatcactgttgatgatatgaaaaacatacccggagcaccaatcacgtattggttaaagggcatacataacttcaagcgagctaagctagctcattatttcttatcgggtggaagaaataaaactcataacaacgatctttacgttagatacttctgggaagtttctttgaaagaaaaaaaatgggttacctatgcaaatggtggagagtccagaaaatattatggaaatgatcaatatgtaattaactggagtgatgaagcgaagctttactatgactcgcatggtggcctttccaattctaagttttggaataaattaggtataacatggtcccttattggcacaaaaagtatttcatttcgtattaaaccaaaacatctccaatacagttcgggatcacctgttattttttgcgaggatttaaatcaaacatatgttactctggcatttttaaactccactgttggtcaatattatctttcagcaatcagccctactattaacactacagtaaatgatgttttatcgttaccagttcctgaactagactgcatgcatagtgataaaataatttcactgactgaaagttatataaatattagctcagatgactggaattctttggagacatcacctgaattcaaaaaaaacagtttagctttcaatattgcaaaacaaaaaaaaataaaaaaatcatgtttgtatttgcaggagaaaaacaacgccaccttgataaaagctcaggaaattgaaaatgaaattaataaaatattcattagaaattataatctagatgaatactctgaaatcgtaaaagaccgtgacgatataactttatatataaatttaaaacacctttatggtagcgatatctcagataacatacgtcaaaatagatatttttccgatcagttatctgagatgatgtcatattccatcggctgcatgatgggccgctactccctcgatcgcgaaggccttgtctacgcccatgaaggcaacaaaggtttctccgaactcgtcgccgaaggtgcctacaaaaccttcccagctgacagcgacggcatcctgccgctgatggatgacgaatggtttgacgacgacgtcacctctcgcgtcaaagagtttgtccgcaccgtctggggtgaagaacacctgcaggaaaacctcgaatttatcgccgaaagtctctgtttatacgcgatcaagccgaaaaaaggcgaatctgcgctggagaccattcgccgctatctttccacccagttctggaaagatcatctgaagatgtataaaaagcgtccaatctactggctgtttagctccggtaaagagaaagccttcgagtgcctggtgtatctgcatcgctataacgatgccacgctgtcgagaatgcgtaccgaatatgttgtaccgctgctggcgcgttatcaggccaatatcgatcgcctgaacgatcaacttgatgaggcgtctggcggtgaagccacacgtctgaaacgcgaacgcgacagcctgatcaaaaaattcagcgaactgcgtagctatgacgaccgcctgcgtcactatgctgatatgagaatcagtattgatctcgacgatggcgttaaggttaactacggcaagtttggcgatctgctggcagatgtcaaagccatcaccggcaatgccccagaggtgatctaa

SEQ ID NO: 2472 - DNA, 2700 bp, Enterococcus faecalis
atggacaaaaaagcaattaaaaaattcgccatggaatctcgtgtaaaacttcgtgagggagttatcaataggctggctaagctaggcataactgaaagtaatatcgatcctgtcatagaattagggaatgacacaattacaatctcttcaaatgaacaacgttacacaggaaaagatgtaataaatcgtacaaagttagtagaagcattaaaggcaagagagaaacaacttgatttaggcgaaaagaaaagtaaagcgattgcgtttgataatttggttgaagaggtagcgtatacatggtttaaccgtttaattgcgattcgtttcatggaagtaaacaattatttgccagaacgacaacgtatcttatcaagcgaatctggtattcgtgaaccagatatcattacgaatcttttaagttcaaacttatatgcagaaatggatcctgatacaaaaagtcgagtagtggatttaatgtcagataactcagcagctgctgtagacgaactttatcaattagtatttattaaacaatgcaatagtttgaatcagttactgccagacctttttgaaaaaattgacgactatactgaacttttgtttacgatttcttatattgatgaaaatggtgttattgcaagcttactatcaatcccagaagaagactttgacgtcagtaaagaaggacaagtcgaaattattggttggatgtatcaatactacaatactgagccgaaagctgaggcaatgaaagcgcagaagaaacggaaaagccgtgcagatgaaattcctgcgctaactcaattgtttacgcccgattggattgtgagatatatggttgaaaattcacttggacgttattatattgatcaaaaactagcaatgcctactgaaacgcgtacagaaaaagaaattgcagacgaatttggttggaaatactatttaccgacagcagaacaacccgagaatgtacaattacaaattcaagatgaacgtaaagataaaaatgttatcgctctacaagagataaaacttattgatccatcaatgggaagcggacatatacttgtttatgcctttgatgtgctgattcaactttatgtagcagaagggtttcgagaacgagatgcggctgtatcaattttaatgaataacttgtatgggttagatatagataagagagccttccaattaacctactttgctttaattatgaagggtcgtcaatattctcggcgtattttgtctaaaggtattaagcctaatgtttatgcaatcccaaataacttagaaattagtgaagcagaattacaacttttacacatagattttccaaaccaacaaaaagcccaagaagatttattacagttaattaatagcttcaaaaacggtgcagatttaggttcattgatagaatttaaggatatcgatttcgaaaacttgaaagtgggatttggtaacggttctataacgttctttgaccaaatgattaatgaaatgatacatgtcggagaattattgcaacagaaatatgatgttggaattacgaacccaccttatatgggtagttctggaatgaacaaaaatttgtctaattttataaaaaaagcttaccctgatagcaagagtgacctttttggtgtatttattgagcgacttaaaaaaatgataaaatcttctgggtactattctatgattacgcaacatgcttggatgtttttatcaagctttgaaaaattacgtcataaaattaatcaacaaactattatcaacatgattcatttgggaacgcgtgcatttgaagaaattggtggtgaagttgttcagactactgcatttataatgtcccctcttgaacataaaggacatgttggaagttatttaagacttgtcgattttgttaatcatggactaaaagaaacaaaatcgctcgaagcaatcgaaaagagaaacgttgattatctttaccaaaccgttcaagataattttgctaaaatcccaggtcaaccaatttcgtattgggtaagcgaaaatattttatattcttttaaaaatgataaaaatattggggattatggtgtttctagaaatggattacaacctaaacaaactgatagatttgttagacaatggttcgaagtggaaaaaaataatataaattttggtattattaacattgaacaaacagatactgccgaagaaaaatggtttccgtataacaaaggaggagcgaaaagaaagtggtatggaaactatgactatgttgtaaattggtataaaaatgggcatgaaattcgaaatattaaacgtaatggaaaaccgtatgcggtaatccccagtcaaaaatactatttccacgaatctctaacttggccaaagataacgagtggtgacatctcattacgatatagaatttctggtagtattccagccgatgccggaaactctacgttttttaaaagcacacaaaatttattctatattcttggattaatgaatactaaagttggaaattatatgcttaatttagtaaaccccacgcttaacttacagacgtcagaattttcttcaattccaattaaaaaaatagctaacaaaaatgaaattattagcatttccaaacacagtatcgatatatgcaagaatgattgggattcttttgaaacatcttgggattttgataagcaccccttgatttga

SEQ ID NO: 2473 - DNA, 3591 bp, Pseudomonas syringae
atgaacaccagccacatcaaaagctacgcccccaaggcccgtaccgcctttatcgccgccatgaccaagcgcgcggcgctgtttggcattcgcgaatccagcatccccgccatgggcattgcgcccgtggagcaaaagggcgatctggtcctgatcggcgaccgcgccttgccggccagcgtcattcgcccgcgcgccgcattggtgaaaaaggtcgagcaactgggctttgcccaggccatggaacaggccgcctacagctggttcaaccgcctgtgcgccatccgttatatggagctgcaggactacctcgaccacggccgccgcgtgctcagcgccgccgatggcagcgcgggcaccccgcaaattctggaagactgtttagagatcgacctgccgggcctcgataaacagctgattaccgagctcaagctcgacggcaacaaagacgaagaactctaccgcgaactgctgctggcccagtgtcacgccctgcaccaggccatgccgtttctcttcgaggcggtggatgacgccaccgagctgctgctgcccgacaacctgaccaaaaccgactcgctgatccgcgagctggtcagcgccattccagaagaagactgggccaatatcgagatcatcggctggctctaccagttctacatctccgagaagaaggaccaggtcatcggcaaggtggtaaaaagcgaggacattcccgccgccacccagctgttcacgcccaactggatcgtcaagtacatggtgcagaactccctgggcgcgcagtggctggcgacctacccggactcgccgctcaaagcgcagatggagtactacatcgagcccgccgagcagaccgccgaggtcaacgcccagctcgccgccatcaccccggaaagcctcaacccagaagcactgaccctgatcgacccggccagcggctccgggcacatcctggtggaaggctatgacctattcaaagccatttacctggagcgcggctaccggcagcgcgacgtggctcagctgatcctggagaagaacctgtttggcctcgacatcgacggccgcgccacacagctgactggctttgccctcatgatgaaaggcagagcggatgaccgccgcctcttcgagcgcgggataaagctcaatgtcatggcgctggtggacagtgcagggttcgatcctgaggtattggctaacggtttaaagctggcggattacgggttgcagctgggcgatctaaacgagctgaagcgtttgtttgagcacgccacgacctttgggtcgttgattcaggtgccagaggggctagcgaagaagctactagggctgaagcagctttgcgaagcaaccagtctcgatctgtttgtgacggaatcgttcaagcgcctaggaccgttggttcatcaggcagagctgctcgcagcgcagtacgacgcggtagtgatgaatccgccgtacatgggcagtagtgggatgaacagccccctgaaaaagtacgccaaggacaaattccccgaagcgaaggaaaacctgttcgcttgtttcattgagcgatgctgcctgctggcaaaagataccggacagagcgctttggtgacgatgcacaactggatgttcctatcttcattccagaagatgcgcgagcgcttgctgaggatgaaaacgatcacaacgatggctcatctcggggcaggcgcctttgggagcatctcgggggaggtcgttcaggcagcaacctttgtgttgaagaacgctccaccgcggggctatcggccagtcttcttccggttactggatggcggcgaggaaagaaaacgaacagctcttcgtcttggcgagaaccgcttcgccgaggcagcgcagagcgagttcgaaaagatccccggaagcccgattgcctactgggtgactgcgaaagtacgagagtctttcgtggaattccctgctgcttcagcgtcacttgatccaagggaagggctggccaccggcaacaacgaccgatacgtccgctgctggccagaagtgtctattgaagaaatcgggcttggttgtgaagaccgcactgcagcaaaggaaacaggcaggcgctggtttccatataacaaggggggggagcttcggaagtgggctggcaacatttggttcttggtggactggttagacgatggcgaagagctccaaacgaagctacatccatcgggagcccgggtctgggcccataacttcaatctagatttcatcttccgtccgttcctaacctggtctgacataacgtcgaaggggctttcagttcgcctctaccctgcaggcttcctatttgacgccacgggcctatccgcgtttgctaaggacggcgcgtttgggggcgcgattgagcgagcgaccgctttgggaaactcacatcttggtacgatgttcgcccagattcttaatccaaccctgcacttcaaatctggcaacttcggtgttctccctgtcaacgagacgctggatttgtcagcatcggttcggcaagcagttgctgtcgcgactaaggactgggatgcatatgaacgctcctgggacttcaaatctctcccgctcctgtcggccaccttcgactccacgcgtaaccttgaaggcagctacaccgcatggatcacccaaaaccgcgccaccatcgccgagatgcagcggctcgaagaggagaacaaccgactctttatcgacgcctatggcctagcggatgagctcaccccagacgtgcccatcgagcagatcactctcacagtcaacccggcctaccgctacggcggcaagctgagtgaagccgagctgtggacgcgttttcgcgaggacagcatgcaggaactggtgtcctacgccatcggctgcatgctcggtcgctacagcctcgatgagcccggcctgatctacgcccatagcggcaaccagggcttcgaccccagccgctacacccgcttcccggccgatgccgacggcatcctgccgctcaccgataaagagtggtttgccgacgatgcggccaaccgcctgatcgagtttatttcagtggcttgggataaggcccacctcgaagccaacctgcgctttctcgccgatagcctttcgccgaaaaagaccgagtccagccgcgacaccctgcgccgctacctctgcgacaactttttcaaagaccacctgcaaacctacaaaaaacgcccgatctactggctattcagcagcggcaaacaaaaagccttccagtgcctggtctacctgcaccgctacaacgaaggcaccctggcacgcatgcgcaccgaatacgtcatccccctcagcgccaaactgagcagctacgccgccaaactggaaaaagacatcgaagccagcaacagcaccgccgaaaagaaagccctggaaaagcagctttcaaccctgcacaaccaacaagccgaactcgccaccttcgacgaaaaactccgccaccacgccgaccaacgcatcagcctggatctggatgacggagtgaaggtcaactacggcaagtttggcgacttgttggccgaggtgaaggcagtgacgggtgataaggctgagtga

SEQ ID NO: 2474 - DNA, 3675 bp, Escherichia coli; identical to SEQ ID NO: 2305

SEQ ID NO: 2475 - DNA, 3567 bp, Pseudanabaena biceps
atggacacctcaagactcaaaagatttgcacaatttgcccgacgtagtttgatcgagcaggtcactagtcgcttgaatctggttttgcagcctgagagtatggcgcggcgggaatatggggaggcgatcgccgatctcgaaaaggagattaaggctagttctaaggaacaggtgatcgatcgcgtggcttatgtttggtttaatcgattttgtgcgctgcggtttatggatgtaaatcgctatacgaagattggggtgttgtcgcctgcggagggacagtttcagcctgagattttggctgaggcgaagatggggcatattgatgaggatttggtggcggatgcggtggtgcgcgatcgcatttttgctttattaaatggcactagccctagtcccgatccgcaaactgaggcttatcgatcgctgattgtgtcggtatgtaatcatttttataaggcgatgccctatttatttgatcgcattgccaactatacggagcttttgatgcctgatgatttgttgtcgggcaattcgattttggcttatacccgcgagacgttgactcccgatgtttgtaaggatgtggaggcgatcggttggctctatcagttttatatttcggagaagaaggatgaggtgtttgatgcgttgaagaaaaatcgcaagattacgcccgaaagtattcctgcggcgactcagttgtttacgcctaaatggattgtgcgttatttggtagagaattctttgggtcgtttatggatgttaaatcatcctaattcgcggctgatcgagcagatggaatactatattgctcccgaacagacggaaacaaattttctgcgaattgcgaagccagaggatatcaaaatctgcgatcctgcttgtgggtcggggcatatgttggtgtatgcgtttgatttgttgtatgcaatttatgaagaagaagggtatgagcctgcggagattcctgaaaagattttgacgttgaatttgtttgggattgagattgacgaacgggcgggtgagttggcggcgcttgcgttgacgatgaaggctactaagcatcggcggttttttaataagggaattaagccgaatatttgtgtgttggagaatgtgagttttgcggatgatgatgtgcagggctatatggatttcgtggggcgagatctctttactgcgcctttgttacggactttgcatgagtttgaggagtcgaataattttggttcgttaatccgtccgacggtgacggatgtggcggggatggttgagattttgcggtcgaagaatgtggaaggtagtctgtttttttacaggactcatgagaaggttttgcgggtgttgaggcaggctgattttctgagttctaagtatcatgtggtgattgcgaatccgccttatatgggtgggaaggggatgaataatcgaatgtcggcttgggtgaaggataattatccagatagtaagtctgatttgtttgcaatgtttatggagcgtaatcttgagcttgctgtcaagaatgggttagtggctatggttacaatgcaaagttggatgtttttgtcttcgtttgagaagttgcgagagaaattaattgcaaaacaagatatagcaacattaattcagattggctacaatagttttccagacttaaattctaaggttgtgcaagcttgtgcttttgttttggtaaattctcctcacaaaaatttaggggcttacattaatctcaatgatgcgccacagtctgcggataaagaacttgttttcattgaaaagaagaaaaacaatcttatttatcgggcttctgtcgatgactttaagaagattcctagtagtgcgatcgcttattgggtaagtaagagagtcctagatatttttgctacatcagaaaaattagagagtcttgcttctccaagacaaggattagcaacggctgacaatgatcgatttattaagttatggtttgaagtaaaacataacagtatcggatttggattgcagaatagaaaagaagctcaagattctaagagaaaatggtttccttataacaagggtggtgaatttaggaaatggtatggaaatcaagaatatatcgttaattggaaaaatgatggatatgagatcagaaactttggcactgaaaatggtggtaaatctaaatcgcgccctcaaaatacagatttttactttcaagaaagtgtaagctggtctaaagtttcaagcagtattttttcgttaagattttttccaagaggttttattttcgctgacgctggaatgtccatttttaatctaagtcaagaagttttaaaatcgatacttggagtaatgaattctccaataatgtctaatacagttgcagcaatatctccaactcttaattttgaggtgggacaaattaaagcattcccaattaatcaagaaataattaatcctaaccaagatagaataaaatcaatcgataatattattaatattagttgttcagattggaattcttacgaaacttcatgggattttacaactctgccacttctaaaagtagaaagtgataagtacgaagtagaaagcaatcaaaacaacaaactccacacttcaaactctctactctccactaaatacgcccaactccgctaccactggcaacaaacaaccctagaaatgcaacgcctcgaagaagaaaacaaccgtatcttcattgaagcctacggactccaagacgaactcactccagaagttccattaaaagaaatcactttaacctgtaaccctcactaccgctatgatagcaacaaaagcgaagccgaactagaaacacttctactagccgacaccatgcgcgaattcatctcttatgcagtaggctgtatgtttggcagatattctattgataaagaaggactcattttagccaaccaaggagaaaccatagaagattatcttcaaaaaattcctaatcccagtttcatgcccgatcgcgataacgtcatccccatcctcgaaggcgactggtttaccgatgacatcagcgaacaatttcgcaaatttttacgcctcaccttcggtgaagaaaactatcaaaccaacctaaccttcatcgaaaaagccctagacaaaccaatacaaaaatacttcctcaaagacttctacaacgaccacgtaaaacgctacaaaaaacgcccgatttattggctattcagtagccccaaaggaagctttaacgtcctcatctacctccatcgctaccgccccgacaccgccagcatcgtcctcaacgactacctccgcgaatatcgcgccaaactcaccgcccacaaaaaacacctcgaagccgtcagcatcgaccaaaacgccacccaatccgaaaaaactaaagccctcaaaaccatcgaaaacctacgcaaaatcatcgacgaactcgaaaaatacgaacgcgatattctctatcccctcgccagccaacaactagcgatcgacctcgacgacggcgtaaaagtcaactatggtaaatttggcgcagccctgaaaaagatcgcaggactagaagctacggatgattaa

SEQ ID NO: 2476 - DNA, 3741 bp, Vibrio cholerae; identical to SEQ ID NO: 2398

SEQ ID NO: 2477 - DNA, 3741 bp, Vibrio cholerae; identical to SEQ ID NO: 2398

SEQ ID NO: 2478 - DNA, 3675 bp, Escherichia coli; identical to SEQ ID NO: 2305

SEQ ID NO: 2479 - DNA, 3738 bp, Actinomyces sp.
atggacatcaatatcaacgcgctcgagtcgttggcgacgaagtcgcgcgcgcgcctgatcggccaggctacgggggcgatccagcggctgctggacgatcctttgaccgaggcagaggaccgcaggcggatcgagcgggcggtggcccaccacggcggcgttgagggcgcggcgcgggaggcggcgtactcgtggttcaaccgtttgacggcgctgcggtacatggacgccgtcggcgtgtcggggacgcacatggtggtgacgcccaccggtgcctcatccgagcccgagtgcctgtcgcaggcgcgggtcggcgctttcgatccccgcgtcgaccgcgctcccgccagtccggacgcggacggccgcccgggcgtggcgcagcgggtcgggcgcctgctcttcgagaaccgggacgtggaggcgtacgtggtgctgctgagcgcctacttcgacctgtggcacccgctgataccggatatgttccccgccggggaccattggacgaacctggtgccgcccagcgacctgctgtcggcatcgagtgtgcgggcggacatcgtggagggcatcgccgtgggcgagtcgggcggccccggcgtggaggtgatcggctggctctaccagttctacatcgcggagcgcaagcagcagatcaacgacgcgaaggtgaagatcaccagcaaggagctggccccggtcacccagttgttcacgccgcactggatcgtgcggtacttggtggagaacacggtgggggcgcagtggctgcgcgcccacccgggctcgcccctgcgcgaccgcttcgactacctggtggccccagtgccgggccaggaggaccagggaatggggatcggggacccgaaggacttccgcgtcatcgatccagcgtgcggatccgggcacatgctcacctacgctttcgacgtcctgtggcagatgtacgtggaggcggggtacccgaagcggcggatcgcagcggccattctggacaacaacctgttcggcgcggagatcgacgcccgggctgtccagttggcgtccttcgccctcatgatgaaggccgtggagcacgatccgggtttcctggagcgcaaactgcgcgagcaggaccgcaaggccgcgggaccgggtgctgggcggccgcgcatcacccacgtccactcggtcgtcttggaggacctctcccccaccgagatcgcacaggcagtgcgcggtgccttcgggagcgaggatagcgagcgcgcgtcggtggggctggaggtcaaccgcgtcatcgaggacctgcgcaatgccgacaccttcggctccctcatccgtgtgcccgctgggaccgccgagatcttcgaggccatcgcccgcagtatcgaggagggtcggcgcgacgtgcaactcggttccgccgatacgcagcagtggcgcgaggcagcggggatctgccgggtcctggaggactcccgctacacgacgatggtggcgaacccgccgtaccttgtctcaaagaaattcggcgacggactaaaggagtatgcccggcagtcctaccccgattcacggcaagaccttgcgacgatgttcatgcaacatgccctcaccttcacaagaaaacgtgcctcgatcggcaccctcacactcaattcctggatgctgaccagctcattcgaacgattccgcattcgtttgctcaagaacgcttccattcagagtatcgcaatgcttgggcgcggccttgctggaatccaattagacttctgcgcgacagtgttctggaatgcctgcccacgttcagatcgtactatcaggtttattactgctagcgaaccagccacatcaccaagcaatccaattcgcattcagcgcctacaggaagcggcacagaatccaaagtcgtctgacaatattgaagtcacatattctcgcatcaccagaatgcctcgatccgcttttctgcattcgatctcagatcagattctcgagggatttaaaactccactggcggaggttgcgcggcccaggcagggactcgctaccgccgataacgagcgtttcctccgcctgtggttcgaggtcagctcgtcccgctcgtacctgacggcgaccagcagggaggacgccgacgcctccggcgcgcggtggttcccccacaacaagggaggatccttccgtaagtggtggggcaaccaggattacctcgtcaattgggaagatgacggacgagaaattcaagaatatcgcgatccatataccggaaaacaacgctcacgtccccaaaacatagacttctacttcaaaccatgcgtctcgtggtctaacgtttcaagtggcaccccatccttccgtctctacaacgagaattttatattcagtcatgtgggacaggcattattttctgatacagaacaccacccggccataatgtcctttgcgaactccaccgttgtgaccaaaattctagaagctattgctcccggcacccacttcgaagtcggacagatcaagactctcccgtggatcgaacctgagagtttcgacccgacacccattgaacgcttgattgagatcttccgggacgactgggacgcccgcgagacctcgtgggacttccagcgcccgccctatctggtgggcgattcatccctgctggaggagcttttcgccgcctggtacgagcgcagcgtaagcaccgcccgggaggcccagcgcctggagagcgagaacaaccgcttctgggccggtgtgtacggcctggaggacgaggtcgagatcgacgtgcccctgtcccgcgtgtcactgacctacaatccacgattcccgcccgccccctcgaaaggcgcggagcgcagcgaggaggagtaccggtggctgcactaccagcgcagcgcgacggaactggtctcctggttgatcggcgtcatcatgggccgctacagcctcgacgctcccggcttaatcctggcggaccaggggtcgacgctcgacgatttccaggcgcgggtgcccaccgcctcgttcatgcccgacgccgatgggatcgtcccgatcaccgactcgctcttccacgacaatgcggacttgcgcctcaccgatgcgctgagcgcgctactgggtgcggacagcctcgggcagaacctcgacttcctggcgcgctgcctggccgtgaagaaaccaacatcgaatggcgcggacttccaaccccccagaccggtggtggactcccgggcagcactgctcaagtacatgaagagcggtttcctcaaggaccacgagcaggcctactccaaccgcccggtctattggatgttctcgtcgcctaaaggcagtttcaaggccctcatgtacctgcaccgctacactcccgacaccgtggggcacgtgctcaccgagtacgcctccgaagtcgtcgcgaagctggccgaccagatcgaagtcatcaaccggcgcctgccggacatgggcggcagcgaccggacccgcgcacaggggaaacgggagaagctgagggcccagttgcacgacgtgcaggggtacatcgactccaccctttacccgctctcgcagcgccgcatcgtcctggacctggacgacggcgtgcgcgtgaaccgcctcaaactggcctatgggatgcgcgaggacctggacgagctggcctccccagcactccagatgcctgacgatttgaaatggatgaccgaccagaagcgcaagggcaacatctggtggtccacgcagaattag

SEQ ID NO: 2480 - DNA, 1899 bp, Fusobacterium necrophorum
ttgtacttttatattacaaaatactgtaacaaaaaaataggggaatatattaaactttcagactttaaaggggtcaaaaatcaacctattaagacattggaagctattcaaaataaaaattgtacttggaggtatcaagccaatcaaaaagactttacaaaaattccgggaagtcccattgcgtattgggtgagtgatagaattagggagatttttgagaaagagaaaaaattaggagaagttggagatgcaaaagtaggattacaaacaggagataataataaatttgttagactttggcatgaaattaattttaataaaataggttttggaatgaaaagttccgaagaagccttaaaaagtaaaaagaaatggtttccttataacaagggcggagaaaaaagaaaatggtatggaaatcaagagtatgttgtgaattgggaaaaagatggatatgagattaaacatttctgtgataccaatgggaaattaagatcaagaccacaaaatacagaatattattttaaaaaatcaatttcttggtcaaaaattagctctggaaatttttcaatgagatttttcccagaagggtttattttcgccgatgcaggaatgagctatttttcagaaaataaacttgaatataaattaagtatttgtaattcaaaaattgctaatatgattttaaacttgttatctcctactttaaattatgaagtgggacacattgcttctcttccgataaagagtacttctaagacaaatttagaaaatatagaaaaaattccagaaagctgtattgaaatttctaaaatagaaggggattctcgagaaacttcatgggattttgaaagattgtttttattgaatggaaaaacagtaaaagaagcctatgataattattgtcgctattggaaagaacaatttgtacaaatgcacaaaaatgaggaagaattaaatcgaatttttattgatatttatggtttacaggaagaaatggatgaaaaagtagatttttctgacattactttattgaagaaagaagcttccattgtagaaaatatagatagtactagttcttgcggatatttggaaaatcgtggagtaagattggaatttcattctttagaattagtaaaacaatttttatcctatgcaataggttgcactatggggagatattctttggacaagcccggtttgattatggcaaatagtgatgatgtgctaaatatgagttctaataaaataacagtgagtggagtggatggagaaattcgccatgaaattttaaatcctagttttttcccggaagaatttgggattctttccgtaacagcagaagaacgatttgaaaatgatgttgtaagtcgtgtgattgcttttatttctgctgcttatggaaaggaacgcttagaagaaaatctagaatttattacggaaattttaggaaagaaagcaggagaatctcatgaggaagtattacgaaattactttatcaaagatttttacacagatcattgccaacgttatcaaaaaagaccgatttactggatgttacatagtggaaagaaaaatggattttctgctctcatctatttacatcgctatgaaaaagataccatagcacgagtgcgaagtgattatttacttccttaccaagagtttatggaacaacaggaagctcattatagtaagattgcttctgatgagatttccactccaaaagagaaaaaagatgctcaaaagaaagtgaaagaattacatgatattctgaaagagttgaaagactatgcaaataaagtgaaacatattgcagagcaaagaatttctttggacttggatgatggagtaaaagtcaattatgaaaaattgggaagtgttttgaagaagatatag

SEQ ID NO: 2481 - DNA, 3522 bp, Acinetobacter radioresistens
atgaataccagtaatattaaaaaatacgcaccgcaagcacgtaacgattttatcgcagcgatgcgcaagcaggccgccaaatacggcatcaccgcagacagcattttaccggctgaacagaaaggcgacttgctgctgattggcgatcaggtttttccgctatccgtcatgaaacctcgtgagaagctgatcaaacgcattcaaaccagcagttttgagcagacgattgattatatcgcttacagctggtttaaccgtctctgtgcgattcgctacatggaatgcaaaggcttactcgatcatggccgccgtgtgttgagtagtgctgatggcagtgccggcttgccacagattttggaagaatgtctggatatcgacctaccgggtttagatgctagccgtgtggctgagcttaagctggatggcaataaagacgaagagctgtatcgtgagctgttactggctcaatgtcatgcgttgaatcaagtcatgccactcttgtttgaacaggtttctgatgagtctgaactactgttaccggataacctgaccaaaaccgattcgttgatccgtgatttggtcagcagcattccggaagaagattggtcggatgtgcagattattggctggttatatcaattctatatttctgaaaagaaagaccaggtgattggtaaagtcgtcaagagtgaagatattcctgcagcgacacagttattcaccccgaactggattgtgaaatacctggtacagaatagtgtcggtcgtttatggatgatggcgcagccggaaagtaccctggccagtgagtgggaatactatattcagccagcggaacagaccgatgaagtcaatgcccagttaaaacagctgattaatgtacggatcagtgaagatggcgatactttaaatcctgaaagcatcaccgtgctggatcctgcctgtggttcggggcatattctggtggaagcttatgattgcttaaaagcgatttatttagagcgtggttaccgtagccgtgatattccacgtttgattctggaaaataacctgtacgggattgatattgatactcgtgccgcacagctcgccagttttgcattgttaatgaaagcgcgtgaggatgaccgccgtttatttagcaatccaccaaagctgaatattattgcgttacaggacagtcagccggaacgtttagaagcattcagtcaggatttggcaagtactggtattgcacaggcagatttaaaagagttgctggacttgtttgaacatgcttctacttttggttctttgattcaaatccctcaagcattcgctaaaaagctgtctgatttagaaagcaagctgaataaagcattagaatcaggcgatatttttgcgcaacagtcagcacaagagttattgcctttagtacagcaagctaaattactggctaaacaatatgatgccgtgattgccaacccgccgtatatgggcggtaaaggcatgaatacagcacttaaagattttgcgaaaaagaaattccctgacagcaagtcagatatgttcgctatgtttatagagcgttgccaagccctttctaaaatatctggggaaacagcgtttgtaacaccttatgtgtggatgtttatttcttcttatgaggaattacgaaaaaaacttgtttctgaaaatacaattaagtcactcattcaacttgaatataatgcgtttgaaccagcatgtattcctgtgtgtgcctatacgatatccaaagctcatgtaaaagactatgtgggtagttacattaaattatctgactttaaaggtcatgaaaatcaagcaccgaaaactatagaagcgattaacaatcctgattgtggttggttttttactgctaaaccagatgattttaagaaaatacctggaagtcctgtggcttattgggtgagtgataaagtgcggagtacttttcaatcagggatgtctatacaaagatacgctgttccaagacagggtttggcaacaggggataatgaaaaattcttaagaatttggtatgaagtagatcataaattattttctataagaatcgatagtgatttaaataattcgaaatggtatccatgtaataaaggtggtgcgttccgtaaatggtatggcaacaatacttatgttgtgaactggcaaaatgacggttatgaaataaagaactttgtagatgagaatgggaagcagcgctctagacctcagaatactagttattattttagagaaggtgtgagttggtcaactataagtagttcagctttgtcaatgagatactctcccaaaggatttttatttgaaacgaaaggttctgtttgttttccagagaataaattgcagttaaatctagttttagctttgatgaactcctatgtagtaaaggaattattattggctatatctccaactttagatttccatgagggacctattggaaaagtaccagtaatcacagagttggaaagttcaacaaaagaatatgttgatattttagtaaatatagccaaaaatgactgggactcctatgaaacttcatgggatttcgctcaaaacccaattattcgtactaaccaatcaaccttagaacaagcctttaatgcatggcagcagcaaaatactgacgccgtggctgaaatgaaacgtcttgaagaagaaaacaataagctgtttattgaagcctatggtttacaggacgaactcacacccgatgttccagatgcgcaaatcaccctcacccgagctgaccgtgaaaaagacagccagcgtttagtgtcttatgcccttggctgcatgatgggacgttatagtctagatgaaccaggcttgatctatgcccatgcaggcaatcaagactttgatgccaaccgttatcaaaaattcccagccgatgcggatggcattattccactgaccgaaatgcattggtttgaagatgatgcaacacatcgtattcgagagtttttaactgcggtttggggcaaagatacattagatgccaatatgcagtggctcgcagaaagtttggataaaaaagccagtgaaaccgctgaagatacaattcgccgttatcttgctagcaagttttataaagaccacatgcaaacctataaaaagcgtccgatctactggttatttagcagtggtaaacagggggctttccaggcgttggtgtacttgcaccgctataacgaaagtaccttggcgcgtatgcgtaccgaatacgtgatgccactgatttcaaaaatggcagcgatggttaattctttgcaaagtgaaatagaaaacagtgattcagctgctgaaattaaacgtaaagagaaagaactacaaaatctgcataagcaacaggctgaactgagtagctttgaagaaaaactgcgccattatgccgatcagcgtatttcgctggatctagatgatggggtgaaagtgaactacggcaagtttggggacttgttggctgaagtgaaagctgtgacgggggaaaagtga

SEQ ID NO: 2482 - DNA, 3741 bp, Vibrio cholerae; identical to SEQ ID NO: 2398

SEQ ID NO: 2483 - DNA, 3591 bp, Bifidobacterium bifidum
atgaacacgtcgaaactgcaagctttcgcaacggatgcgcgccgccagctcatgaatgcggtacaggcacggcttgacgccgcattggtgccgaattccgacgcccaggttgacgacccgcgtgcattcgattttctgaagcgtgagatcgaacaggccggtggaagtgagcagggtcgcaagcatgtggtggagcgttatgcgtaccggtggttcaaccgtatcatcgcgttccgttacatggatgtgcacgggttcaccggcacgccggtggtctctccagctggcctgaccagcacgaatggtctgccggaagtgcttgcagccgcgaaacgaggcgagtatgacagcagggtgttctcgttgcgggtgaatgataaggccaaagagcgcatcgaaggattgctgagcggctccatcatggcagatgatccgcagggccgcgcgtatggtctgctgctgcaatccgaatgccggttctggaatcgtaacctgccgttcatgttcgaaaacgtcggcaaggaggccggcagagtggatgaactgctcatgccagccgatctgctcgccgaggattccgtgttgaggaatgcggtggaggctatgactccggaggattgcggtgttgacgatccgtccggcaacgtggagatcatcggctggctgtaccagtactacatttcggaacgcaagaacgaggtgatggacgggttcaagaagaaccacaaagccggagccagtgagattcccgccgccacccagctgttcacgccggattggatcgtgcgctacctcgtgcagaacaccgtgggcaggttgtggatgcagtcgcatccggatagccagctgcacaaaaactgggattattacatctggccttcagagaatgattccgtcgggaacgaggatattctcgcaatccggactccggaagacctgaccgtatgcgatcccgcatgcggttccggccacatgctcacctacgcattcgacctgctgtatgagatctacgaggaggaggggtatgcgccgagcgatattcccagcctgattctcaaacacaacctgtacggcatggaaatcgatgaacgagccgcaagccttgccgccttcgctctgaccatgaaggctcgctcccgttcccgtagattcttcaagaaacaggtggagccgaatattcagcgcattgtgccgattgcgttcaaggaagacgaagtcgccgagctgaatgatctataccaggtgaatctggactccacggtatggaacacctatgcgaaggcggacgtgtatggttcgctgatccagccgccgcaggagcttgttgaattggcggcgtcatcaccggaaagcgaggatggcatcgatacgttgttcgacccacttctgcgtgaacatgcagaggacgtatttactcaaacaaggtacctcgcacgtaaatacgcggcagtggtggcgaacccgccatatatgggtgcgaagaacatgagtggcgagcttaaacagttcgtgcaggaccattatgaggatggcaaagccgatctcttcgccgcgttcattttgtgcaatcggcagttcattcagcatggtgcgatgctaggaatgattaccatgcaaagctggatgttcctctcatctttcgaggatttgcgacgtaagttgcttgattcctcgtccatcgaaactatggcgcatcttggtgccggggcattcgacagcattggtggtgaagttgtttccaccacagctttcactctcaaaaatggtttcagtagtgggaatggtacgtatatccggttagtgaatgtctctggtgacgataatcaatcaaatgcctgcatcaatgcgattaagggagatgtggattatcgcttcgaggtgagccagcgcgaattcgcgcaaatccccggctcgccaattgtctattggctcagtgaggacgttttatcgctttttagcttaaaaagtttgtcatcaaaagctgtctgcaagcatgggatgtccacgggcaataatgaatcaatgcttcgcctgtggtctgaagtgagctataagcgagtttatctgtattgtaaaacgcgtgaggaagcatatcatgcaaacgggtggttcccatacaacaaaggtggggaatacagaaagtggttcggcaatagacaatttattttgcggtatgattccatgggccagaaacggatgttgaatctgcctggttttaggcacgatggacgagattacttttttaaaccagctatttcgtggtcgaaaatttcttcaggccaacctgcatttaggctttaccgagaaggatttgtttttgatgttgctggttgttcgttttttccatgcgaaaataccgagttgttgaacttattgggtatggtaaattcgtcaactgttcagcttctgctctcggcattgtctccaacgctcaattacgaggttggacaaattgctaagttgcctttctgtcagttacctgatctagctgaatccatcattacacagataattaatgtctctgcgaaggattggaactcgttcgagacatcgtgggatttccagcgattcacgttgctcgatcctaatcagggtgcacaagtgggagatttgcttgaagaggcggtatcacatcttcgcgagtactgggattgtgtatctgaggaacagcgccagcgtgagatccgtaataacgagatggttgcggacgtgtatggcgtgcgtgatgacgtgccgtgcgatgtactgttggaacgcgtgtcgctgaagcgcaacgtcgcgttcgcatatccgaaggatactccggaagtgcgcaacgagaaattcgcgcaagatgtggttaaggagctcatttcgtatgcggtgggctgcatgttcggcaggtattcgctcgataagcctggtttgattctcgcttcgcagggtgaaacacttgatgactaccatgcacagattccgaacccgtcattcggaccggacgcggacaatgtcattcctgtcacggagacggactgcttcgaagatgatatcgtgacacggttccgcaggttcctcaccgtggcgttcggcaaggagaatctgggcgcgaacatcgcctacatcgaacaggtactgggcaaaagcatccgcaagtatttcgtgaacgacttctacaacgatcatgtgaagatgtattcgaatcgaccgatttactggcaatactctagtcaaaccagcaacaagggaaccttcaaggcgctggtgtacctgcatcggtatacgccgaaaaccacaaacgtggtactcaactatctgcgtgactatgccaacaagatcgccgacatcgccgataacttggaacattcagatcgtgccgcggaccagaaacaggccgccaaactacgcaaggccgttctcgagtgtaaggattacgaggaccagaccctgtacccattagctacccgcaacctggaaatggatctggacgacggcgtgctggtgaactacctgcgcatgggcaaagcccttcgtgccattccctccatcgagcgaaagcgcaaagaagtctccacctggacctggcccgttcacccactgggagaacaagcatga

SEQ ID NO: 2484 - DNA, 3603 bp, Bacteroides ovatus
atggacaccaatagaataaaacgcttcgctaccgaagctcgcaatatattaaaagccggcattgcagctaagataactacacttggcttcgacaagaaaggtaatgttgccgaagagcaccgtccacaactgatgcaaggaggtgcactttggaacggacaattttatacagagggattctactatcagtggatgtccctctataatcgtattcagcaaaaaggcatcaacgaagtgtatgaagaggcagcgtatacttggttcaatcgtctgtgcgctattcgtattctgcagaagaacaatctctgttctcctgtgcttcagtatgccgatgctgcacgtaccccaattattgtggacgaagcacgccagggtcatcttccacagatgaaagaagaccttcgtcagcgtattgtcgagcttttggatgacgatacgaaggtcaccgaacaatttgccctgcttattacagcatggtgtcacgataatcccatcctcaaccagtgtttcggttctatggccgactataccgagctacttctaccaaacgatattctggcagaaggtaaattcatggatatgctgaaccatactgaatttattaccgatgaagagtttcagtctccggaactaattggttggctctatcagttctatatatcagagcgtaaagacgaagtttttgcaaagaaaggaaaattcgaggctgacgaaataccggcagctacacagatattcacacccaattggatagtgaaatatatggtgcagaacacagtgggtcgcatctatctggataataatccctatgaaacaacacttcaaaagaagtggcgatacttagtgaaccagacagaaaaaccgactccagaaaatttactgaaatacaacgagcttaccgacctgaaggttgccgatttggcctgcggttctggacacattctaaacgagtgcttcgacttgttttatgacctttatattgctgaaggctatggccgtggtgaagccattgaaaacattttccgtcataaccttacaggtattgacttggataatcgtgcaaaacaattagcaacttttgcccttttgttgaaagcatgccaaaaggattcatcttttgctgatgcgcattgcttgccgaatatactgaccatgccgaaaccatggaatgaagaaacggatgaaaacttaaatgatttcctttctctttatttccagggagagaacacttcttcacaaaatgaagaacttgccgcttgctttgaactgatgcataatgcagactcgctgggttctatcatgaaattcgacattagcgacagcacaagattactggttaaacagactactgattactggtgcagtcaagagattatgcccgatgccgtgcgcttgcaacttccagcttttgagctaattttggctttgacggagaagtatgacgctttggtaatgaatccgccgtatatgggtggtggcaacatgaatgaggtgctgagtaagtatgtgaaggcaaattatgaagaaggcaaaggagatttattctccacctttatgttgttggctattgacagacttgcagacaacggcaaatatagcatgattaacatgcagagctggatgttcctttcttcattcgaaaaactacgcacgtctttactcgagaactatcatattgaaaacatgcttcacttgggccctcgaactttcgatgagctgagtggtgaggtggtgcaaaacacttcctttgttgtagctaaaaataagtctgatgaaggtggtgtgtatttccgactggtagatggtaagaattgcgcagagaagaaagatatgttcctccaggcattgcaggaacatacagccaaggtgtattacccaaatgtccctcaatctaactttgagaaaatcccgggatgtccgattggttattgggtttcacccaatatcttaaaaatatttacatcaaatctcgcattgtcagcagtttgcagcccaacacaggggctggcaactgctgacaatgcgagatttctccgcagctggttcgaggtcagccgaagccgtataggcttcggcttcgaaaatgccgcgtcagcggctcgatccagattaaaatggttcccatataataaaggtggagatgttagacgttggtacggtttgagcctcagtgaaaacatcattgattggtataacgatggagaaatattaaaatcatttaaacctgctgttataagaaatcccggatattatttcacagatggaataacttttccaagaattggttcaaatctattttatgcaaggatattacaacctggatttatctttgactgtaatggcccttcttgcttcccacaagaaaagaaggagtatattttgggcttcctaaactcaaaggttatgcagcaattgctatttatattatgtccaactctatcttttcaaattggagattctttcaaagtaccatatataggaaaaaataatgattatataaatcattgtgttcaacaaaacatcaacatttccaaacaagattgggacaatcatgaaacctcatgggacttcgaaactaatcccctattagctgtaaacgagaacacctatatcgacaatatccgccacgaggaaaagctgcacgaaaaagaaacagacaaacacatctgtatcaatcctgccgcaccgcaacttggcagtctgaaatggcgtatggagcaatacaagacaaagtgggaacacctcttcatgcagcttcacgagaacgaagaagagctcaaccgtcagttcattgacatatacggtctgcaagatgagcttacaccagatgttacactctctgagataaccattctgcaacaaggagaaatcaatattgcagatgacagtctcagttggaacgacgaagtattgatgaagcaacttattagctttgctgtaggttgtatgttgggacgctatcgtcttgataagccaggattgcatatcgctcaccccaatcctactgatgaggaaactgcttcttacacatttaacggacagtcttgggaaattgatgacgacggcattatgccgctgatggcaaatgattgcggattcagtgacaacgcatcatatcgtttcgctgatttcctacgtgtggtactgggtgaagaacttcatgtggagaatcttaactacgtggagcaatgtttaggtaagaccatagagcaatatttcgtaaaggacttttggaaagaccataaaaagatgtatcagaaccgtccaatctattggctatttgcatcaaagaaaggttccttccaagtaatagcttacatgcaccgtatgaatgcctatacagttgagcgcatccgagcaaaatatctcctccccttcattgaacatctggaacaggaaatcaacaaacttgacttgcgtcgggcagaacttacgactaaagaaagcaaacagctccaaacgcttcagaagcaattggatgaatgtcgtgaatatcacgaacgtttgcaggttgtagcagagcaggccatcagcttcaatcttgacgatggtgtcacagtgaattatgctaagttcggagacgttttacagaaaatcaaataa

SEQ ID NO: 2485 - DNA, 3741 bp, Vibrio cholerae; identical to SEQ ID NO: 2398

SEQ ID NO: 2486 - DNA, 3603 bp, Parabacteroides sp.
atggacaccaatagaataaaacgcttcgctaccgaagctcgcaatatattaaaagccggcattgcagctaagataactacacttggcttcaacaagaaaggtaatgtagctgaagagcaccgtccacaactgatgcaaggaggtactctttggaacggacaattttatacagagggattctaccatcagtggatgtccctctataatcgtattcagcaaaaaggcatcaacgaagtgtatgaggaggcagcctatacgtggttcaaccgtctgtgtgccattcgtattctgcagaagaataatctctgttctcctgtacttcagtatgctgatgctgcacgtaccccgattattgtggacgaagcgcgccaaggacatcttcctcagatgaaagaagacattcgccagcgcattgtagaactactggatgacgatacaaaggtaacagaacagtttgccttgcttattactgcttggtgtcacgataatcccatcctcaatcagtgtttcggttctatggccgactataccgagctacttcttccgaacgatattctggctaaaggtaaattcatggatatgctgaaccatactgaatttattaccgatgaagagtttcagtctccggaactaattggttggctctatcagttctatatatcagagcgtaaagacgaagtttttgcaaagaaaggaaaattcgaggctgacgaaataccggcagctacacagatattcacacccaattggatagtgaaatatatggtgcagaacacagtgggtcgcatctatctggataataatccctatgaaacaacacttcaaaagaagtggcgatacttagtgaaccagacagaaaaaccgactccagaaaatttactgaaatacaacgagcttaccgacctgaaggttgccgatttggcctgcggttctggacacattctaaacgagtgcttcgacttgttttatgacctttatattgctgaaggctatggccgtggtgaagccattgaaaacattttccgtcataaccttacaggtattgacttggataatcgtgcaaaacaattagcaacttttgcccttttgttgaaagcatgccaaaaggattcatcttttgctgatgcgcattgcttgccgaatatactgaccatgccgaaaccatggaatgaagaaacggatgaaaacttaaatgatttcctttctctttatttccagggagagaacacttcttcacaaaatgaagaacttgccgcttgctttgaactgatgcataatgcagactcgctgggttctatcatgaaattcgacattagcgacagcacaagattactggttaaacagactactgattactggtgcaatcaagagattatgcccgatgccgtgcgcttgcaacttccagcttttgagctaattttggctttgacggagaagtatgacgctttggtaatgaatccgccgtatatgggtggtggcaacatgaatgaggtgctgagtaagtatgtgaaggcaaattatgaagaaggcaaaggagatttattctccacctttatgttgttggctattgacagacttgcagacaacggcaaatatagcatgattaacatgcagagctggatgttcctttcttcattcgaaaaactacgcacgtctttactcaagaactatcatattgaaaacatgcttcacttgggccctcgaactttcgatgagctgagtggtgaggtggtgcaaaacacttcctttgttgtagctaaaaataagtctgatgaaggtggtgtgtatttccgactggtagatggtaagaattgcgcagagaagaaagatatgttcctccaggcattgcaggaacatacagccaaggtgtattacccaaatgtccctcaatctaactttgagaaaatcccgggatgtccgattggttattgggtttcacccaatatcttaaaaatatttacatcaaatctcgcattgtcagcagttgccagcccctgtgttgggctgcaaactgctgacaatgcgagatttctccgcagctggttcgaggtcagccgaagccgtataggcttcggcttcgaaaatgccgcgtcagcggctcgatccagattaaaatggttcccatataataaaggtggagatgttagacgttggtacggtttgagcctcagtgaaaacatcattgattggtataacgatggagaaatattaaaatcatttaaacctgctgttataagaaatcccggatattatttcacagatggaataacttttccaagaattggttcaaatctattttatgcaaggatattacaacctggatttatctttgactgtaatggcccttcttgcttcccacaagaaaagaaggagtatattttgggcttcctaaactcaaaggttatgcagcaattgctatttatattatgtccaactctatcttttcaaattggagattctttcaaagtaccatatataggaaaaaataatgattatataaatcattgtgttcaacaaaacatcaacatttccaaacaagattgggacaatcatgaaacctcatgggacttcgaaactaatcccctattagctgtaaacgagaacacctatatcgacaatatccgccacgaggaaaagctgcacgaaaaagaaacagacaaacacatctgtatcaatcctgccgcaccgcaacttggcagtctgaaatggcgtatggagcaatacaagacaaagtgggaacacctcttcatgcagcttcacgagaacgaagaagagctcaaccgtcagttcattgacatatacggtctgcaagatgagcttacaccagatgttacactctctgagataaccattctgcaacaaggagaaatcaatattgcagatgacagtctcagttggaacgacgaagtattgatgaagcaacttattagctttgctgtaggttgtatgttgggacgctatcgtcttgataagccaggattgcatatcgctcaccccaatcctactgatgaggaaactgcttcttacacatttaacggacagtcttgggaaattgatgacgacggcattatgccgctgatggcaaatgattgcggattcagtgacaacgcatcatatcgtttcgctgatttcctacgtgtggtactgggtgaagaacttcatgtggagaatcttaactacgtggagcaatgtttaggtaagaccatagagcaatatttcgtaaaggacttttggaaagaccataaaaagatgtatcagaaccgtccaatctattggctatttgcatcaaagaaaggttccttccaagtaatagcttacatgcaccgtatgaatgcctatacagttgagcgcatccgagcaaaatatctcctccccttcattgaacatctggaacaggaaatcaacaaacttgacttgcgtcgggcagaacttacgactaaagaaagcaaacagctccaaacgcttcagaagcaattggatgaatgtcgtgaatatcacgaacgtttgcaggttgtagcagagcaggccatcagcttcaatcttgacgatggtgtcacagtgaattatgctaagttcggagacgttttacagaaaatcaaataa

SEQ ID NO: 2487 - DNA, 3654 bp, Escherichia coli
atgaatacgtcaaatatcaaaaaatacgccccggtggcacgtaaacagttccgcgatgcggtcatgcaaaaactgaccacgctgggtattgacgccgataaaaaaggcaacctgcaaatagcgcaagcaaccgatcttggcgacagtgtgcgatatggtcagttctcgctggataaatcactggcttcacgccgtgaacgtctggtcaagcgtgcagaaaagcagggctatgacgtgctggtggagcacatcgcttacacctggtttaaccgcttttgcgctattcgctatatggagctgcatggctatcttgatcacggtttccgtatgctgtctcacccgaccctggaagggagttttgaggttctggatcatgtgccggaagtggctgatgcacttgggctggacaaatcacgcctggtggagatgaagctggcgggcgatcgtgacgaagagctgtaccgtgaactattgcttgcacagtgccatgcgctgcacggcgctatgcctttcctgttcgaagcagtcaatgatgatatcgaactggtattgccggataacctgactcgcaccgactctattctgcgcgggctggtggacacgattcctgaagaagactggaaacaggtcgaagtgatcggctggttgtatcagttttatatttccgagaaaaaagatgatgtgatcggcaaggtggtgaagagcgaagatattcctgccgctacccagctgtttactccgaactggattgtgcagtatctggtgcagaactcggtgggccgccagtggctgcaaacctatccggactccagcctgaaaggcaaaatgccgtactacattgagccagcggaacaaacgccggaagtgcaggcacagctggcggctattaccccatcaagcattgaaccagaaagtattaaggtgctggacccggcctgcggctccgggcatatcctgaccgaagcctataacgtgctgaaggccatttacgaagagcgtggctaccgtacccgtgacattccgcagctgattctggaaaacaatattttcggcctagatattgatgaccgtgcggcgcagctttccggttttgcgatgctgatgcttgcccgtcaggacgatcgtcgtattctgggccgtggcgttcgcctgaatatcgtttcgctgcaggaaagtaaactggatatcgctgaactgtggaccaagctgaactttcatcagcaggcgcaacgcggcagcatgggagatatgtttacccaagggacgtcactggccaataccgacagcgcggaatataagctactgatgcgtactctggctttgttcactagtgcaaaaacgctgggatcactgattcaggtgccgcaggaagatgaaacggcgctgaagacattcctgggtggactatatcgtctggctgtcgagggtgatatcccgcagaaagaagcggcagcagagctgattccgtatattcagcaggcgtggattttggcgcagcgttacgatgcggttgtggcgaacccgccgtatatgggtgggaaagggatgaacggtgaactgaaagagttcgctaagaaacaattcccggacagtaagtcagatttgtttgcgatgtttattgagcggggtttttcctggctcaaagatgctgcgtacaactcaatggtgactatgcaatcatggatgtttttgtctagctatgaaaatatgcgtgcgaatatattggataaatacactattgagacgatggtacatatgggcaatggcgttatgaaaattgcctttggtaccaatgcaacagtgtttagaaatgttcacattccttcttatcaaggggcattctcttatactgagaatgacgatatcaatgatgaaggatatccaaaagaatttccggttaaaaacgatcgtttaaagactgccgctgccgatgacttccaaaaaatccccggtgcaccgattgcgtattggctcagcgaaagtgaggttaatttatttgataataaaaaaatatctcaaattgcctcaacacgccttggaatggcaacagcggataatgagcgttttttacgtttttggcatgaagttaatttcgcgaatatcggttttgattttactgatcgtattcaagctaaaaaatccggtctgaaatggttcccttatcagaaaggtggtgaatatagaaagtggtacggtaatcttgattatgtcgtaaattggttcgacgatggtcgggaaattcaaaattttaccgatgaaaaatcaggaaaggtacgttcgcataactataatttagattttatatttaaaaaagggattacatggaacgctctttcctcaagcaagacatctgcaagagtctcagagtcctcattatttgacaatgcagggtcttcgttatttgttaataatgaagacctttacctgcctgtgttagcatttattaatagtgatattattatctctttaataaaggctatctctccaacattaaattatcaaccgggggatataagtaaattaccagcattttttgatgagaaaatgattgagagcctatccttgaacactgctgaactaatttctctggctaaagaaaattggagtcagcaggaaaatagttatcagttttccttcaatcaggatgcgtttcaaaacggcagcctagtaaacatattaaaaaaccagactgaagttttttatcaaaagttaatcaaaacacatgagctagaatgtgataataacaaaatattttatgaaaaatgcaatattttaaacgaaaacaatcttgccttggcagaaataacattggaaaataatgttttccagtcattaagctcaatttcaaaagatgaatataaccaatttaaggcgattcaggttataaactcacttagcctggctattggctgcatgatgggccgctattcccttgatcgcgaaggcttggtctacgcccacgaaggtaacaaaggcttttctgaattagtagatgaaggcgcctaccaaaccttccctgccgatgaagatggtatcctgccattaatggattctgactggttcgatgacgatgttacctcccgcgttaaagagttcgttcgcacagtctggggcgaagaacatttacaagaaaacctcgatttcatcgccgaaagcctctgcttgtacgcaatcaagccgaaaaaaggcgagtcttcgctggataccatccgtcgctatctttccacccagttctggaaagatcatatgaagatgtacaagaagcgcccaatttactggctattcagctcaggtaaagagaaggcgtttgagtgcctggtgtatctgcaccgttataatgaaggcacattgtcacgtatgcgtaccgaatatgtagttccgctgctggcacgctaccagggaaatatcgatcttgttaacgatcagcttaaaaatgcagaatcgggcgctgccaccacacgcctgaaaaaagagctggatgggttgactaaaaaattcaacgagctgcgcaattttgacgatcgcttgcgtcactatgctgatagacgtatcactattgatctggatgacggcgttaaggttaactacggcaaatttggcgatctgctggcggatgtcaaggcgatcaccggcagtgcgccacaggaggcataa

SEQ ID NO: 2488 - DNA, 3465 bp, Lachnospiraceae bacterium; identical to SEQ ID NO: 2442

SEQ ID NO: 2489 - DNA, 3741 bp, Vibrio cholerae; identical to SEQ ID NO: 2398

SEQ ID NO: 2490 - DNA, 3612 bp, Bacteroides ovatus
atggatactaatagattaaagaaatttgctattgaagcacgcaatatactaaaggcgggtattgccgccaaactcaccagcttgggctttgacagcaagggtggagtggctgagaatttacgcccgcaactcttgcagggcggtacgctttggaacggacggactctctccgaaggattttatcaccaatggatgcggctctatgaggaggtgcaggctaagggtgtgaacgaagtatatgagcaagcagcttacacatggtttaatcgtctggtagccattcgtatcttacaaaagaacggactttgcgaaccggtaagtacatacgccgactctgcacataccccgcagattgtaaaccaagcccggcaagggcttttccctccaatggaggaggcgagcaagcgtcaccttttggaactccttgatgacgatacgaaagttactgaacagtttgctgtgcttttggtggcatggtgccatgccaaccctatcctgcaacgttgctttggcactatggaggactatactgaactgttgcttcccgccaatattttggtggagaatggttttatcgacctcttgaaccacactgagtttatcaccgacgaagagtttcgctcgcccgaactgattggttggctttatcagttctacatcagtgaacgtaaggatgaggtgtttgccaagaaaggtaagtttgaggctgatgagattcctgccgccacgcagatttttacgcctaactggattgtgaagtacatggtgcagaatacggtgggacgtatctatctcgataacaatccctataccactttggcttataaggagaaatggcaatacctcgtggagcctgcagaaccgactcctgctaaagctattcttcattacaatgaactgaccgatttgaaagtagctgatcttgcttgtggttcggggcatatccttaacgagtgcttcgatttactctacgatctttatatcactgagggttatactcgtgtcgaagccataacacatattttccaagataacctcacgggcatcgatctcgatcctcgtgcacagcaactttcgctctttgcattgacgctgaaggcttgccaacgtgagcatagctttgcagatgcacattgtttgccacgggtgctgacgatgccgaaggtgccattgccattgcctactgatactcgattagcggtagaaattgatgcggccaatattttgttgaaggatgctgattctttaggtagcatcatgaagtttaaccttacacctgctgctcgtgaatgggtggcttcgctggttgctgagaatgaggcggcagcgttggtggtagcgttgacagagcagtatgatgcgctagtgatgaatccgccatatatgggcggaggtaatatgaatgaggtgttgagtaaatatgtgaagaagaattatgaggatggaaagggagaccttgcaaccgtttttgtagagatgatggcacaacgtacatcaactcatggtcgttatgcctttataatacctccttcatggatgttcttaagtactttcgaaggcttgcgaaagagcattatcaacaatcgaactattgattcattgcttcatttgagtcgtggtgtgtttggtgctgacttcggtgcgtcttcggttgttatttccaatacaaaaagttccgatgcgtgtggcatttactttcgtctcatcgaacgtaccttccaagagttcgatcaaaagcatttgcaattactctttgaaaagacattgttaaaccatgacttccgttatctctttgctgattacagcaaggatgtggaggatgttgtctattccgaacaaggtgcaaagatatactaccccaatgtgccgcaggctaactttgagaagattcccgaatgcccgattgggtattgggctacacgaaatctagttcttacattcaaaaataaacttataaaagatgttgctgatcccaaagctggattagcaacaggtgataataatacttttatgcgtttgtggtcagaagtagactatcataacataggtaaaggatgcaagacaacagaagatactaaaaattgtagcgtaaaatggtttccttgtttaagtggaggccatgcgagaaaatggtctgattatattgaatatgtggttgattgggaaaatgatgggtataatttaaagcgctttataggtaaaaatgggaaacttgcatcaaggcctcaaaatacgcgctactattttaaaaaaggactaacttggaataagattagctccaatactttttctgtaagatataaacgtaccggaagcatctttgatgatactagtagatgtgcttttattgaagaagatgataaatttatattttatctggttggattgctttgttcaaatgttagtttcggttatctaaagctgtttaatcctactatgagctttactaatggtgatattcaaagaattccaattatagataaatgttcagacattatagatgatttggttaagcagaatatcgcaataagtaaactcgattgggactcccacgaaacttcctgggactttcagcaaaatgagcttatctctcttataaatttcacagaacaagaccttactcctgaatcacttattgctttatgtagtactactgcacaaagtgacgcagtaagacaacaagctgatgaaagtcctcgtgcgattcgtatgaaggacttgatagaacgttatcacaaaaagtggtacactctatttatgcagcttcacgccaatgaagaagaactcaaccgccagtttatcgctatctacggcctgcaagacgaacttacccccgatgtttctttgaatgaaatcaccatcttgcaacaaggcgaagtaaacactgagggcaattccgtgaagtggcacgatgaagtaatattgaagcaactcctcagttacgccgccggtgtatggatgggccgctaccgtcttggcaagccggggctgcatatcgctcaccccaaccccacagctgaggaattagctccttatacctataacggtcacaccatcgagatagatgatgatggcattttccccttgatggctgccgatagtggcttcacagataatgcctgcctacgtactgctcaattcgtgagcgatgtgtttggtgcggagtatcaggtggagaaccttaactacattgagcataccctcggcaagaccatagagcagtattggcaaaaggatttttggaaagaccataagaagatgtatcagaatcgtcccatctattggctgtttgcgagcaaaaaaggcagcttccagtgtattgcctacctgcatcgcatgacaccttatacccccgaacgcatccgcagtaaatatcttctgcccttcattgaaacattaggtcgcaagattgccgatctcacaactcgtgctgccgacctcagcaccgccgaacgtaagaagcttgacacattgaacaagcagctcgaggagtgccgtgaatatcatgaccgtcttgctgtagtagctgaacaagctatcccgcttgatcttgacgatggcgtggtggtgaactatgctaaattgggtgatgtagttagtaaactaaaatag

SEQ ID NO: 2491 - DNA, 3633 bp, Enterococcus faecium; identical to SEQ ID NO: 2445

SEQ ID NO: 2492 - DNA, 3675 bp, Yersinia ruckeri
atgaatacgtcaaacatcaaaaaatacgccccagtggcacgtaaacaattccgcgatgcggttatgcaaaaattgactactctgggcattgaagcagataaaaaaggcaatctgcaaatttcgcaggcgacagatcttggcgacagcgtgcgatacggtcagttcacgctggaaaaatcactaactgcgcgtcgtgaacgtctggttaaacgtgcagaaaatcagggctacgaagttctggtagagcacatcgcttacacctggtttaaccgcttctgcgccatccgttatatggagttgcatggttatttggatcacggcttccgtatgctgtctcataaaaatccgacactggaaggcggttttgaggtgctggatcatgtgccggaagtggcggatgctctggggctggacaaatcgcgcctggtggaaatgaagcttgctggcgatcgtgacgaagagctgtatcgtgaattgctgcttgcgcaatgccatacccttcagggcgctatgcctttcctgttcgaagccgtcaacgatgatatcgaactagtgctgccggataacctgacccgaaccgactccattttgcgtgggcttgtagacaccattcctgaagaagactgggctcaagtcgaagtgatcggctggctgtatcagttctacatctcagagaagaaagacgacgtgatcggcaaggtagtgaagagcgaagatattcccgccgccacccagctgtttaccccgaactggattgtgcagtatctggtgcagaactcggtgggccgccagtggctgcaaacctatccggactccagcctgaaaggcaaaatgccgtactacattgagccagcagaacaggcaccagaagttcaggcacagttggcggcaatcactccatccagcattgaaccagaaagcatcaaggtgctggacccagcctgtggctccgggcatatcctgaccgaagcctataacgtgctaaaagctatttacgaagagcgcggttaccgtacccgcgatattccgcagctaattcttaaaaacaatatctttggcttagatatcgatgaccgcgccgcacaactctccggctttgcgatgctgatgctggcgcgtcaggatgaccgccgtattctgagcccaaaccgtggcgttcgcctgaatattgtttccctgcaggaaagtaagctggatatcgttgaactgtgggccaagctgaatttccatcagcaagtacagcgcggcaccacgggccagatgttccctgaagggccagcactggccaataccgacagcgcggaatataagctgctgatgcgtacgttggcgttgtttaccagtgcaaaaacgctggggtcgttgattcaggtgccgcaggaagatgaagctgcgttaaaagcgttcctggacgggttgtatcgtctggctgttgagggggatattcagcaaaaagaggctgcgatggagctaatcccctatatccagcaggcgtggattctggcgcagaaatatgatgcagttgttgcgaacccgccgtatatgggtggaaaaggaatgaatggtgaattgaaagagttcgctaaaaaacaattccccgacagtaagtcggatttgtttgcgatgtttatgcaacatgcgttttctctgcttaaggagaatggtttcaatgcgcaggtgaatatgcaatcgtggatgttcctgtctagctatgaagcactacgcagctggttactggataataaaacgtttgtcaccatggcacatcttggtccgcgtgcatttgggcagatctcgggagaggtagttcagactactgcatgggtgattaataacaaccatgtagcatattatcagcctgtatttttccgcttgatagatggtaatgaagagaataagcaagctatgttacttgagcgtaaacatcgctttgatagcatcgttcaaaacaatttcaaaaaaatcccaggagcatcgattgcttattggataaaagaaaacttattgcatgcatttgagaactcaccaaagctaaattcgattgcagaacctcgtaaaggaatggtaacagctgataatccgcgatttattcgctcttgggttgaagtatgttttgggaaattgggtattaatattaaaaaccgagaagaggctattcattcagaaaaaaaatggtttccttatcaaaaaggaggtgagtatcggttatggttcggaaaccatgaatgggttgtgaattgggaaaatgatggccgtgaacttttcaatatgcaaggaaatggatataaagttggttcaacaaatcacaatcttgaatatattttcaagccggcaattgttttttcaaagataacatctagcacacctcactttcggtatgcccctcaaggctttttgtttgatgatgcctcaggtctgtgtgcgataaaagatgaaaagcaaacctttaagttgttggcatttctttgttcaggagtgtgttctgttttcaacaacataatcaatccgacattaaatttacagcctgggaatgtagccaacttaccagccccgctcattaatgagtctgaatacattgcactaaaattagtatctgcatttaaggaggactgggactcatatgagatgtcttgggattttaaagaagataaattgcttaaattcaaatgcaattcactaagtgaggcatatgataaatatttatcatatgtagatttaactgttgataacatcttagaacttcatcagcagaatgatgagcttttcatcaagcatcttgacttagaaaatattatatatcataaaaaaacaaaatccgatatatcgttgacttgtaacccattttactcatattcaaatgatagtgaattggacagaatcaataaaaataaaacaacaattatatttgaattactgaattatattttgggctgcatgatgggccgctactccctcgatcgtgaaggtctgatctacgcccacgaaggcaacaaaggttttgctgagctagtcgccgaaggcgcatacaaaaccttccctgccgaccaggatggcattttgccgctaatggattccgactggttcgacgacgatgtcaccgctcgcgttaaagaatttgtccgcacagtctggggtgaagaacatctgcaggaaaacctcgactttatcgccgacagcctctgtttgtacgctattaagccgaaaaaaggcgaatcttcaatcgataccattcgccgctatctttccacgcagttctggaaagatcataagaaaatgtacaaaaatcgcccaatctactggttattcagctccggtaaagagaaagccttcgaatgtctggtctatctgcaccgttataatgatgccacgctgtcacgtatgcgtactgaatacgtggttccgctactggcgcgttatcagggcaatatcgatctggttaacgatcagcttaaaagcgccgaatcgggagccatcactacgcgtctgaaaaaagaacttgatggtctaagcaaaaaattcaacgagctgcgtaacttcgacgaccgcttgcgccactatgctgatatgcgtatcactattgatctggatgacggcgttaaggttaactacggcaaatttggcgatctgctggcagatgtcaaagcgatcactggctgcgctccacaggaggcataa

SEQ ID NO: 2493 - DNA, 3642 bp, Pantoea sp.
atgaatacgtcaaacatcaaaaaatacgccccagtggcacgtaaacagttccgcgatgcggttatgcaaaaattgactactctgggcattgaagcagataaaaaaggcaatctgcaaatttcgcaggcaacagatcttggcgacagcgtgcgatacggtcagttcacgctggaaaaatcactaactgcgcgtcgtgaacgtctggttaaacgtgcagaaaagcaggactacgacgtgctggtggagcacatagcttacacttggtttaaccgcttctgcgccatccgttatatggagctgcacggctatcttgatcacggcttccgcatgctgtctcacccgacgctggaaggcggttttgaggtactggatcatgtgccggaagtagcggatgctcttgggctggacaaagcacgcttggtcgagatgaagctggcgggcgattgtgatgaagagctgtaccgtgaactgttgcttgcacaatgccatacccttcagggcgctatgcccttcttgttcgaagctgtcaacgatgatatcgagctggcgctcccggataacctgacccgtaccgactctattctgcgtgggctggtagacaccatcccggaagaagactgggcgcatgtagaagtgatcggctggctgtatcagttctatatttcacagaagaaagctgacgtgatcggtgaggtggtcaggagcgaagatattcctgccgcaacccagctgtttaccccgaactggattgtgcagtatctggtgcagaactcggtgggccgccagtggctgcaaacctatccggattcagcgctcagagtcaaaatgccgtactacattgagcctgcggaacagacgccaaatgcacaggcccagttggcagatacccccccatctagcattgaaccagaaagcattaaggtgctggacccagcatgcggatctgggcatatcttgactgaaacctataatttgcttaaggccatttatgaagagcgcggctaccgtacacgggatattccgcggttaattctggaaaacaatatttttggcttggacattgatgaccgcgccgcacagctttcaggctttgccatgctgatgctggctcgccaggacgatcgccgcattctgggtcgtggtgtgcacctgaatatagtttccctgcaagaaagtaaactggatatcgctgagttgtggaccaagctgaatttcaaccagcaagtgcagcgaggcagcatgggggatatgtttgctgaaggagccacactggccaatgccgacagcgcggaatattcgctgctgatgcgaacgctggcgcttttcaccaatgcaaaaacgctggggtcgctgattcaggtgccgcatgaagatgaagcggcgctgaaagcattcctagatggactatatccactggctaacgaaggtgacattcagcagaaagaagcggcggcggagctgattccgtatatccagcaggcatggattttggcccagcgctataatgcagtgatagcgaacccgccgtatcttgatctagggaatatgaacccggccttaaaaacgtggctggaacttaaatcaccgatgacaaaacagaatcttgacatctgttttttaaatacggctcttcatttgagtaagccctgtggccggagtgcactgattacccaaagaagctggatgttcctctccagaatggaagagttcagaatacaaaaactaaaatcagatacgcttgaaagcatgatttaccttggccctcgggctttccccgaaatcgatggggagaaagtacaaaccacggcttttgttttttgtaaaaataagccaaacgattatttgactacattttttaacttaaccgatgaaatgggtgaaaaaaaggcggatgaccttctgaaagcgaaaggtaaatacataaaatgcgtcaacgattttattagtcttcctggcttccctctggccttctgggcatctgaaaaactgatttcaacattttcctacggtgaaggcttaggagaaattgttgaaatcagagttggtttagacactgggaataatgacatatttattcgctcgtggtttgaggtgtcaacacaaaaaattggagttaattttaaaacgcacaatgacttcctgaaaaacaagaaaaaatgggtgttccacgctaagggtgggacatacagaaaatggtacggtaatatagttgatgttttatcttttgatcaagattcctataacaggctattaaatcagggcaacaaactcccctccagaaattactatttcaaaaaaggattattctattccagagtcagctcaaatgaattatcaattcgagaactccctgtgggaatggtctttaattcagcaagtccatctattttttctgataatgaaaacgacttaaactttacgcatgcattacttaactctagctcagtaaatgcaatactggagtgtctgagccctacattaaacttccaggctggagagttaagaaaaataccaattttcaaagagatagacaatgacttcatcaatcagaacacatctcaactggttgatatatctaggaacgactggaacgccaaagaagtctcttttaacttcattgccagtccgctcgttaacaatgaactctcgattaaatccgccttcctgaaatacaatgaggagtgtgaattgaatacagagatgatgagaaagttagaagagaaaaacaaccactattttgcgcaagctttaggtctttccagtaacatcgtgagcaatgtccctgtagagaaaatctcattgtcagggaatattcattatctttataaatccaccgctgacaaaaatgatttatttagatcggaaacgctctcagaatttatcagttacgcattaggcgttatgatgggccgctattcgctcgatcgcgatggcctagtctacgcccatgaagggaacataggctttgccgaattagtcgccgaaggtgcctacaaaacattccctgccgatgaagacggcatcctgccattaatggacactgattggttcgacgatgatgtcaccgctcgcgtaaaagagtttgtccacaccgtctggggtgaagagcatctgcaggaaaacctcgattttatcgccgaaagcctctatttgtacgctattaagccgaaaaaaggcgaatcttcactcgataccattcgccgctatctttccactcagttctggaaagaccatatgaagatgtacaagaaacgccctatttactggctgttcagctccggtaaagagaaagcgtttgagtgcctagtgtatctgcaccgttataatgaaggcacgctgtcgcgtatgcgtaccgaatacgtagttccgctgctggcgcgctatcagggcaatatcgatttggttaacgatcagcttaagagtgcagaatcaggtgctgccactacccgcctcaaaaaggagctggatggtctgactaaaaaattcaatgagctacgtagcttcgacgaccgcttacggcactatgctgatagacgtatcactatttatctggatgacggcgtaaaggttaactatggcaaatttggcgatctgctggccgatgtgaaggctattaccggtagcgcacctgaggaaatctga

SEQ ID NO: 2494 - DNA, 3606 bp, Escherichia coli
atgaataccaataacattaaaaaatatgccccacaggcccgtaacgacttccgcgatgcggtggtccagaagctaacgacgcttgggatcgctgcagataaaaaaggcaatttgcagattgccgaggccgaaaccattggcgagaccgtgcgttacggtcagtttgattacccgttatcgacccttccccgccgcgaacggctggtaaaacgcgcccgtgagcagggttttgaggtgctggttgagcactgcgcctacacctggtttaaccgcttatgtgcaattcgctatatggagctacacggttatcttgagcacggcttccgtatgttgtcccacccggagacgccgaccgcgtttgaggtgctggatcatgtgccggaagtggcagaagccctgctgccggaaaataaggcgcagctggttgaaatgaagctttccggtaatcaggacgaagccctgtaccgcgaactgctgctggggcagtgccacgccctgcaccacgcgatgccgttcctgtttgaagcggtagatgacgaagcggaactgctgttgccggataacctgacccgtaccgactctattctgcgtgggctggttgatgatattccggaagaagactgggagcaggtagaggttatcggctggctgtatcagttctatatttcggaaaagaaagatgccgtgattggcaaagtggtgaagagcgaagatattcctgccgccacccagctgtttacgccaaactggattgtgcagtatctggtacaaaactccgttggccgccagtggttgcagacctacccggactcgccgctgaaagacaaaatggagtactacatcgagcctgcggaacaaacgccggaagtgcaggcgcagctggcggcgattaccccagccagcattgaacccgaaagtattaaagtgctcgacccagcctgcggctccggtcatattttgattgaagcctataatgtgctgaaaaatatctacgaagagcgtggttatcgcgggcgtgatattccacaactgattctggaaaataatatttttggtcttgatatcgacgaccgcgcggcacagctttccggctttgcattattaatgatggcgagtcaggatgaccgcagaatatttacccgcgatgtacgtctgaatattgtctctttgcaggaaagcctgcatctggatatcgccaaactctggcagcaactgaatttccaccagcaggtacaaaccggcagtatgggggatatgtttgctgaaaataacgcgttaacccaaactgacagcgcagaatatcagctgctgatgcgcacgctgaaacgctttgtgaatgcaaaaacgctgggctcactgattcaggtgccgcaggaagaagaagcggaactgaaggtattcctggacgcgttgtatcgcctggaacaggaaggcgatttccagcagaagacggcggcaaaagcgtttattccgtttattcagcaggcgtggattttagcgcagcgatatgatgcggtagtggcgaatccgccgtatatggggggtaattatatggagacagaacttaagaatttcgtctcttcttactaccctcaaggaaaggcggatctttattcttcatttatggtcagattacttttacaattaaaagataatcgcactttaagcctaatgaccccctttacttggatgaatttatcatcatttgaagagctccgaaaaattatacttacaaatttcagcattcagtcattagtacagcctgaatatcattcattttttgagtcagcttatgtcccaatttgtgcttttagcatttcaaataccccattaagctggaatgcaaaattttttgatttatcagatttttatggagaaaaaaatcaagctccaaattttcagtatgcaattaaaaatgacaataaatgtcattggaaatataacagaatcaccacggactttctatgtactcccggatatatcattgcttactctctgcctgattctgcgttatcttgcttcaaaacatccaaaaaacttcatgatgtttgcaatctaaaacaaggattaattactggtgataatgaaagatacctaagattctggcatgaaatcagctataactctttcagtctcaatgaaaaaagaaaaaaaacaaaatggttcccatatcaaaaaggtggtgcataccgtaaatggtatggtaataatgattatgttgttgactgggagaatgatggttattccattaaaaacttttataatgacaaaggtaaattacgctcacgccctcaaaacatacaattttattgtaaagagggtttaacatggacaagtttaaccatttcgtcactatcgatgagatatgtaccaaatggatatatttttgatgcaaaaggacctatgtgttttccgaaatcctctttggatatctggaatattcttggctatgcgaatagcaaagtaatagatatatttctcaaacaattagcgcccaccatggattattctcaagggcctgttggaaatgtcccattcaaatttaacgatggtgatttgaacgagataataaaagaactcgtaaacattcacaaacgtgactgggatgaaaatgaaacatcttttgagtttaagagagatatgttggttcatttttcaagagatattaacactattaagggtagttttacactaaggcaaggggaaaataaaaaagcgattaacagaacaaaatttttagaagaaatgaataactctttctttataaattgctttaatctaactgatattttatctccagaaattgaactaaacaaaatcacgttaacgcatgcaactattgaaattgatattcaaaaaataatttcatatgcaataggctgccaaatgggacgttactcccttgatcgcgaaggtctggtatacgctcatgaaggcaataatggcttcgccgatcttgtcgccgaaggtgcttataaaagcttcccggctgatagtgacggcattctgccgctaatggatgaagagtggtttgacgatgacgtcacctctcgcgtcaaggagtttatccgcaccgtttggggcgaagaatatttgcgcgaaaacctcgattttatagccgaagttctcaagcccaaaaaaggcgaatctgcgctggagaccattcgtcgctatctttccacccagttctggaaagatcatctgaaaatgtataaaaagcgtccaatctactggctattcagctccggtaaagagaaagcgtttgagtgcttggtgtatctgcatcgctataacgatgccacgctgtcgagaatgcgtaccgaatatgtggtgccgctgctggcgcgttatcaggccaatattgatcgcctgaacgatcaacttgatgaggcttctggcggtgaagccacacgtctgaaacgcgaacgcgacagcctgatcaaaaaattcagcgaactgcgcagctatgacgatcgcctgcgtcactatgctgatatgagaatcagtattgatctcgacgatggcgttaaggttaactacggcaagtttggcgatctgctggccgatgtcaaagccatcaccggcaatgccccagaggtgatctaa

SEQ ID NO: 2495 - DNA, 3741 bp, Vibrio cholerae; identical to SEQ ID NO: 2398

SEQ ID NO: 2496 - DNA, 804 bp, Escherichia coli; identical to SEQ ID NO: 2457

SEQ ID NO: 2497 - DNA, 2142 bp, Escherichia coli
atgaataccaataacatcaaaaaatatgccccacaggcccgtaacgatttccgcgatgcggtgatccagaagctaacgacgcttgggatcgctgcagataaaaaaggcaatctgcagattgccgaggccgaaaccattggcgagaccgtgcgttacggtcagtttgattatccgttatcgacccttccccgccgcgaacggctggtaaaacgcgcccgtgagcagggttttgaggtgctggttgagcactgcgcctacacctggtttaaccgcttatgtgcaattcgctatatggagctacacggttatcttgagcacggcttccgtatgttgtcccacccggagacgccgaccgcgtttgaggtgctggatcatgtgccggaagtggcagaagccctgctgccggaaagtaaagcgcagctggttgagatgaagctttccggtaatcaggatgaagctctgtaccgcgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcggaaaagaaagatgccgtgattggcaaagtggtgaagagcgaagatattcctgccgccacccagctgtttacgccaaactggattgtgcagtatctggtgcagaactccgttggccgccagtggttgcagacctacccggactcgccgctgaaagacaaaatggagtactacatcgagcctgcggaacaaacgccggaagtgcaggcgcagctggcggcgattaccccagccagcattgaacccgaaagcattaaagtgctcgacccggcctgcggttccggtcatattttgattgaagcctataatgtgctgaaaaatatctacgaagagcgtggttatcgcgggcgtgatattccacaactgattctggaaaataatatttttggtcttgatatcgacgatcgggcagcacaactttccggttttgcattattaatgatggcgcgtcaggatgaccgcagaatatttacccgcgatgtacgtctgaatattgtctctttgcaggaaagtctgcatctggatatcgccaaactctggcagcagctcaatttccaccagcaggtacaaaccggcagtatgggggatatgtttgctgaaaataccgcgttaacccaaaccgacagcgcagaatatcagctgctaatgcgctcgttgaaacgctttgtgaatgcaaaaacgctgggctcactgattcaggtaccgcaggaagaagaagcggaactgaaggcgtttctcgatgcactgtatcaactggaacaggaaggcgatttccaacagaaagcggcagcgaaggcgtttattccgtttattcagcaggcgtggattctggcgcagcgatatgatgcggtggtggcgaatccgccgtatatggggggaaaatacttagctccggcggttaaaaatcatctgaaagaaaattattctggatatgataaagatctattttcagcctttattataagaaatttacaactttccaaaaatggtgcacaacttgggttcatgacgccatttgtctggatgtttatttcaagctatgaagaactacgtctccaactaattaataatgaaacaatcatttcattaatacagttagagtactcaggttttgatggtgccaccgttcctatttgtactttcacattgcaaaaaaatcatatttcaaatttttcaggtagttatattcgactttctgattttcgcggagcggcaaatcagggaccacgagcacttgaagcaataaataataaagattgttcttggcgctatcaaaccaatcaagaaagcttcaaaaaaatacctagcaatcctattgtatattggataaaaccccaaacctcaatcctttttacaaataaaaaaattggtgaactctatgaggttaaagaaggtcttggtacacgtgatgatgatatatttttgcgtagacactgggaagtatcaagaaaaaaacaaaaactgacaagagtttaa

SEQ ID NO: 2498 - DNA, 2556 bp, Collinsella intestinalis
atggacaccaaggcacttgagaagttctgcccctgggcgcgcgtcgagctcatcgacgccgtgcgtctgcgctgcgtgcgctacgcactggacgacgccggccgcgccgcccaccccgccgatgcggacgtggtcgccggcaccgtgttggccccttccgagaaagcgcagcgcgccgcgctgttcgagcgcatcgagcgcctgaacgaggagcgcggcggcaagggctacgccgcgttttgcgagcagcaggcgtacagctggttcaaccgcttcgccgccatccgcttcatggagctgcacgggtacctgagcaacaacgtgcgcatgctctccgcgggcagcggggcgtttgaacccgaatgcctgcgcatggcaagcgagctcgacctgcccggactcgagctcgcggaggtgctcgacctcatcaccgcaggcgacgacgaggtgctcttccgccgcatcctcgtggcgcagatgaacgagctcgccgactgcctgcccaccgtgttcggccacgtggacgacgccgacgccctcaccctgcccgacaacctcctcgcccacggcgagcatgacgtgctgttccatctggttgcggatatccccgaggagacctggggcgacgtcgaggccctgggctggatgtaccagttttacaattccgagctcaaggacgcgtttttcaaatccaagcgaaaggccgcggcggaggacctggcgcccgccacgcagctgttcacgcccgactggatcgtgcgctacatggtggagaactcgctcgggcgcctgtggatgctgaacaaccccggcagccgcctgcgcgaggacatggcgtacttcatcgagcctgatgcccagcacgaggatttcatccgcatcgaggggcccgaggacatcaccttctgcgacccggcgtgcggaagcggccacatcctggtctacgccttttccctgctgttcaaaatgtacgccgagcgcggctatcgcgaacgcgacgtcccgcggctcatcctcacgaagaacctctccggcatggagatcgacgagcgcgccgcccagatcgcgagcctcgtgctcgccatgtgcgcccgcgagcacgaccgccggttcttcacgcgcggcgtgacggcggacatccaagtgttgagcaacatcgagattgatgtcgatgccctcgatcccgccagcgccctgcgtcaacgcccacagctcatcgaagcgcttgctcatctgagcgagatcggcagcctgctcagcccctcccccgaagacctgggcgccctcaagagcgaactcatgcgcaacctctccggagacctcttcgtctcccacacccaaaccaacatcgagcgcgctgcgaattgctgtgaaacgctctctcgcaccttcgatgtggtggtggccaacccgccctacatgggaagcggaaacttcaatccgtttatgagcaagtggtcgaaagagaattactcgtcagagaaaagcgatctttgctacatgtttatagagcgaatcaaaaaccaaaggaagcaccttggatatgctggaatagccgcgagcaatagctggatgtttttatcctcctcagaacaatcgagacgaaaggtcctcgaagaatgcaacatcattactctggttcaactcgcgcaaggaggttttaaaggcatcgccgcacaagtgtttgctttcattcttgcaaatcgatgtgacgcgccccgcaggggcacatatattcgattgtgtgattttagaagcccagctcttcaggcggagaaaacaatctgcgcgatcaatgacccctcatgcaaatggtcctacaaaaccgattcatccgtattcttcgatcttccaggaacgcctatcgcctactgggcaacctctgcattgcatgatgcatttcaatgtaattccccaattggatcctggttaataacccgtcaaggtatgtcgaccgccgacaacgatcgtttcctacgtgaatggtgggagccttcctactgcacaatcgcctttggcatcaggtgcagctctgaagcgcaggaatgcgggctccgatggttcccctatcaaaaaggaggcgactatcgaaagtggtttggaaacaatgacctggtagttgactggaagaatgatggtgaggcgatcaagaacaatgcagatccgcgaacagggagaattcggtcacacaactataacggcaattattcatttaaagaaggaataacctggtcagatgtctcatcgggcaatatccatctgcggctatctgagtatggttcactttttgatggtcgaggtgcaaaggggtttgcaaaatctcatcaagagaacctttacgccctcgccctcctcaactccaatatcgcgctcaaatttcttgagtttttagcgcccaccctcacatatcaagtaggggatgtcgcaaaaatccccgatccacatttaaacatcgagcgttcctcggcaattgcgaatgcaaacgtcaatttggcgaaggccgactggaacacccaagaaacctcttgggacttcaaacgcaacccgcttatatag

SEQ ID NO: 2499 - DNA, 3678 bp, Salmonella enterica; identical to SEQ ID NO: 2365

SEQ ID NO: 2500 - DNA, 3618 bp, Escherichia coli
atgaataccaataacattaaaaaatatgccccacaggcccgtaacgacttccgcgatgcggtgatccagaagctaacgacgcttgggatcgctgcagataaaaaaggcaatttgcagattgccgaggccgaaaccattggcgagaccgtgcgttacggtcagtttgattacccgttatcgacccttccccgccgcgaacggctggtaaaacgcgcccgtgagcagggttttgaggtgctggttgagcactgcgcctacacctggtttaaccgcttatgtgcaattcgctatatggagctgcacggttatcttgatcacggcttccgtatgttgtctcacccggagactccgaccgcgtttgaggtgctggatcatgtgccggaagtggcagaagctctgctaccagaaagtaaggcgcagttggttgaaatgaagctttccggtaatcaggacgaagctctgtaccgtgaactgctgctggggcagtgccacgccctgcaccacgcgatgccgttcctgtttgaagcggtagatgacgaagcggaactgctgctgccggataacctgacccgtactgactccattctacgtgggctggttgatgatattccggaagaagactgggagcaggtagaggttatcggctggctgtatcagttctatatttcggaaaagaaagatgccgtgattggcaaagtggtgaagagcgaagatattcctgccgccacccagctgtttacgccgaactggattgtgcagtatctggtacagaactccgttggccgccagtggttgcagacctacccggactcaccgctgaaagacaaaatggagtactacattgagcctgcggagcaaacgccggaagtgcaggcgcagctggcggcgattaccccggccagcattgagcctgaaagcattaaagtgctggatccggcctgcggttccgggcatatcctgacagaagcctataacgtgctgaaggccatttacgaagagcgcggttaccgtacccgtgacattccgcagctgattctggaaaacaatattttcggcctggacatcgatgatcgtgcggcgcagctttccggatttgcgatgctgatgctggcacgccaggatgaccgtcgtattctgggccgtggtgtgaggctgaatattgtctccctacaggaaagtaagctggatattgctgaggtttggaccaagctgaacttccatcagcatatgcaacgcggcagcatgggagatatgtttacccaagggacggcactggccaataccgacagcgcggaatataagctactgatgcgtactctggcattgttcactagtgcaaaaacgctgggatcactgattcaggtaccgcaggaagacgaagcggcgttgaaagcgtttctggagagattgtatcgtctggctgttgaaggtgatattcagcagaaagaggctgcggcagagctgatcccatatattcagcaggcgtggatactggcgcaacgttatgatgctgtggtcgcgaacccgccgtatatgggggggaaagggatgaatggtgatctgaaagagtttgctaaaaaacaattcccggacagcaagtcggatttgtttgcgatgtttatgcaacatgcattttctttactcaaagaaaacggttttaatgcgcaagtgaatatgcagtcatggatgttcctgtctagctatgaagcgcttcgtggatggttgctggataataaaacctttattacgatggcacatttgggggctcgagcatttggtcaaatctctggagaagttgttcaaactaccgcatgggtgattaaaaataaccattcaggattttataaacctgtatttttccgtttagttgacgataatgaagaacataaaaaaaacaatctcttgaatcggatgaattgctttaaaaacactctgcagaatgactttaaaaaaatacctggttcacccattgcttactgggcaacattggcgtttattaattcctttcttaaattgcctgctcttggaactcgtgctgtgaaaggactagatacaaacgggtccattgatgtatttttgcgcagatggccggaagtcagcataaattcctttgatgcattagggaaaggtaactcaaaatggtttccgattgcaaaagggggtgagctgaggaagtggttcggaaatcatgagtatatcataaactatgaaaatgatggcattgaattaagaaaaaacaaagcaaacttgagaaataaggatatgtactttcaggaggggggaacctggactgttgtatcaaccaccggtttctcaatgagatatatgccaaaaggattcctttttgaccaaggcggttctgctgttttttgtgaaaataatgatgagctatcgatatataacatcctggcctgcatgaactctaaatatatcaactactctgcaagtttaatttgtcctacgcttaactttacaaccggtgatgttaggaaattccctgttataaaaaacaatcaccttgaagatttagcaaaaaaagcaattgagatatcaaaagcagactggaaccaattcgagacatcttgggagttcagtaaaaacaagttaattgaacacaaaggaaacgttgcttattcgtatgctagctattgtaactttcaagataaactgtatgaacagctagttaatattgaaaaaaatattaataacataatcgaagaaatactgggttttaaaatagaaacaacagagaatagtgagttaattacattaaactcgaacaaaatatatcgttatgggcaaagtgaaaccaatgatacattcctaaacaggcatcggagtgacaccatttcggaactcatctcatattcagtcggctgccaaatgggacgctattccctcgatcgcgaaggcctcgtctacgcccatgaaggcaacaaaggctttgccgaacttgccgctgaaggtgcgtacaaaaccttcccggcagacaatgacggcatcctgccgctgatggatgacgagtggtttgaggacgacgtcacctctcgcgtcaaagagtttgtccgcaccgtctggggcgaagagcacctgcaggaaaacctcgaatttatcgccgaaagtctctgtttatacgcgatcaagccgaaaaaaggcgaatctgcgctggagaccattcgtcgctatctttccacacagttctggaaagatcatatgaagatgtataaaaagcgcccaatctactggctattcagctccggtaaagagaaagccttcgagtgcctggtgtatctgcatcgctataacgacgccacgctgtcgagaatgcgtaccgaatatgtggtgccgctgctggcacgttatcaggccaatatcgatcgcctgaacgatcaacttgatgaagcttctggcggtgaagccacacgcctgaaacgcgaacgcgacagcctgatcaaaaaatttagcgaactgcgtagctatgacgaccgcctgcgtcactatgctgatatgagaatcagtattgatatcgacgatggcgttaaggttaactacggcaagtttggcgatctgctggcagatgtcaaagccatcaccggcaatgccccagaggcgatctaa

SEQ ID NO: 2501 - DNA, 3516 bp, Nitratireductor indicus
atggataccaacgccctgaagaaatttgcccaaagcgcgcgcaacctgttgatcgatcaggttaccgcccggctggatatggtgctggccgaaggagcggcgggtcgccgggagcatcccaaggcagtcgccagactggaagccgccgccaacagcaaccgccagcaggtgatcgagcaagcagcctatacatggttcaaccgcttcaccgcgctgcgcttcatggacgcgaccggcctgaccaacccgcgcgtggtgtcgcccgccgatggcgcgacccggcctgaaattctggccgaggcgatggccggcaacctgccggatcgtgcacggccggagattgccgaatatctgaacggcacccgtcccgcccatgacgggcaggcggaggcctatcggttgctggtgatccatgcctgcaacgaatggcacggcgcgatgccctatatgttcgagcgcgccgatatgctcgaccgggccgaggattataccgaactgctgatgcccgatgatctcctgtcgccggacagcatccttgcacgcctgcgcgaggtgatgacggaagaggcctgccaggatgtcgagatcatcggctggctttaccagttctacatcagcgagaagaaggatcaggtctttgcgggcctgaagaagaaccagaagattacggcggaaaacattcccgccgcgacgcagctcttcaccccgcactggatcgtccgctatctggtggaaaactcgttggggcggttgtggctgctgaaccgcccgcaatcgaagctggcggcgaagatggattattacatcgcgccggaggagcccgagacggatttcctgaagatcactcggcccgagaatattcgcatctgcgatccggcctgcggctcaggccatatgctgacctacgcctttgacctgctctatgaaatctatgccgaggaaggccatgacgcggccgagattcctggcctgatcctgaagcataacctgacagggattgagattgacgaccgcgccggggcgctggcggcgttcgcgttgtcgatgaaggccgcggcaatgctgggacggcggcggttcctgcggatggaggcgaaacccgacatcgtcgtgctgcaggatgtgcgcttcacccctgccgagatgcaggacgtggccgccgtggtgggcaaggatttgttcaccgatgaactgcgcgaaacgctgggacagttcgagcaggccaagaacttcgggtcgctgatcgtgccgaaactgcgcgacccggccgagacgctgcgagtggtcgaggcgcgggattttggttcagacctcctgctgaaggaggtgcaggaacgggtcgtggcagtgctacgcatggccgaggtgttgtcgccgaactatcacgtagtggttgcgaacccgccgtatatgggcgcgcgcaacatgaaccctgttctcaagaaatggacagacaaaacctatccagatagccgaacggatctctttgcacttttcatggagcgttcgttggctgcatgcatgaaaagcggctacatggccatgatcaacatgcagtcttggatgttcctgtcttcgttcgaaaagttgagggctaccattctctccaagggcaccattcttactatggcacatcttggagaacgcgcttttgataccattagtggcgccgtcgtgtcgaccactgccttcgtctgtcgaaatggaagcaaggacaattatgcaggggcattcatccgtgcggtaggaggtcgaaatgaggctgaaaaacaagaaattttgttaggtgtagccgatggtagatcgaccgactgcctcttccatatctcacaaaaagagcttgtcggtgtccctgggtcaccaatcgcatactggttgagcaaaggggtgcgagacgcttttggtagcttcgaagctctccgatcaatcagtgttccacgccaaggaaataccactacagataacgaaaaattcgttcggctttggccagaaatttccaaagattccctaggtctagattatgaaagcgccgaaaaatttaacgcagataataagaagtgggcaccttataacaaaggcggcggatctcgccgttggtttgggcaaaatgattcagtagtaaattggtataaaaatggatgtgaaataaaggcaattccgcactcggtaattgccaacgagagaagctatttctcacccggccttacgtggtcaacaatttcgacaaacgatattggttttcgttacttcggcaatggattcctcttcgacaacaagggggcctgcatttttgtctctgacatcatgcagcaataccttgctgctctactaaatacgaagattttcgtcagtattctgtatcaaattaatccaactgtatcgctacagcccggggatgttgcgaaatttccagtaattccgatcgaggtcgctgactcagcttcgacgagcgctaatgcgataagctgcatcaatctaacgaaatccgactgggacgcctatgaaacgtcgtgggattttaccacgcttccattgctgtcgcccgatcaccgggaagagacactggcggctagctacgccaatctccgggtccattggcagggtatgacggatgagatgcagcagctggaacaggagaacaaccgcatcttcatcgacgcctatggcctgcaggacgaactcacgcccgaagtgccggtcgaggaaatcaccctcacctgcaacccggcctatcgctatggcgtgaaaggcgcggaagaagaacgcgaggcgcggctcttgcaggatacggtggccgaattcctccattttgccgtgggctgcatgttcgggcgctacagcctcgacgcgcccggcctgatccttgccaatcagggcgaggggatcgaggagtatctggcccgtgtgcccgagcccagcttcgcccccgaccgcgacaatgttatcccggtgctggatgccgactggttcgccgatgacatcgtcacccgcacccgtgatttcctgcgcgtgacctttggcgaggcgaagtttcgtgaaaacctcgccttcatcgaatctgcgctcggcaaggatctgcgcaaatggttcaccaaggacttcttcgactatcacgtccgccgctataaaaagcgcccgatctactggatgttctccagccccaggggcagcttcaacgcactgatctatatgcatcgctatcggcccgacacggtctcggtcgtgctgaaccaatatgttcgcgaattcatccacaagctggaagtcgagcgcgcccggctggaaaagctggccgtcgatcccgccgctacgcccgcccagcaaacaagggcgcagaaggaaaccgccacggtcatcaagcagatcgccgagctgaccgaatgggaacgcgatgtcgtctatccgatggcgcagcagaagatcgccatcgatctggatgacggcgtgaagcgcaactatccgctgttcgccggcgcgctaaagccgatcaaggggctggaggctgcggatgactga

SEQ ID NO: 2502 - DNA, 3606 bp, Escherichia coli; identical to SEQ ID NO: 2494

SEQ ID NO: 2503 - DNA, 3468 bp, Acinetobacter baumannii
atgaataccagtcatattaaaaaatacgcaccgcaagcacgaaatgattttatcgcagcgatgcgcaagcaggccgccaaatatggcatcaccgcagacagtattttaccggcagaacagaaaggcgacttgctgctgattggcgatcaggtttttccgctatccgtcatgaaacctcgtgagaagctgatcaaacgcattcaaaccagcagttttgagcagacggttgattatatcgcttacagctggtttaaccgtctctgtgcgattcgctacatggaatgcaaaggcttactcgatcatggccgccgtgtgttgagtagtgctgatggcagtgcaggcttgccacagattctggaagaatgtctggatattgacctaccaggtttagatgccagccgtgtggctgagcttaagctggatggcaataaagacgaagaattgtaccgtgaactgttactggctcagtgtcaggcgttgaatcaggtgatgccactcctatttgaacaggtctctgatgagtctgaactactgttaccggataacctgactaaaaccgattcgttgatccgtgatctggtcagcagcattccggaagaagactggtcggatgtacagattattggctggctgtatcagttctatatttctgaaaagaaagaccaggtgattggtaaagtcgtcaaaagtgaggatattcctgccgcgacacaactcttcaccccaaactggattgtgaaatacctggtacagaatagtgtcggtcgtttatggatgatggcacagcctgatagtacgcttgccagtgagtgggaatactatattcaaccagctgagcaaagcgacgaagtcaatgcacaactgaaacaactgattgatgtgcggatcagtgaagatggcgatactttaaaccctgaaagcattacggtgctggatccggcatgtggttcggggcatattctggtggaagcttatgattgcctcaaagcgatttatctggaacgtggttaccggagtcgtgatattccacgtttgattctggaaaataacctgtacggcattgatattgatactcgtgcggcacagttggcgagttttgcgctgttgatgaaagcacgtgaggatgaccgccgtttatttagcaatccaccgaagctgaatattattgcgctacaagacagtcagccagaacgtttagaagcattcagtcaggatttggcaagtaccggtattgctcagaccgatttaaaagaactgctggatttatttgaacatgcttcaacctttggttctttgcttcaggtgcctgcaacatttgctaaaacgctgtctgacttagaaacaaagctgaacacagcaacagcgtctggtgatatttttagtcagcagtcagcacaagaactgttacctttagttcaacaagctaaattacttgctaaacaatatgatgctgtgattgcgaatccgccgtatatgggtggtaaaggcatgaatgcagcactgaaagactttgccaaaaagcaattcccagacagcaagtcagacctgtttgccatgtttattgaacgtggttttaactggtgtaaggacagcggctttaacagcatggtgaccatgcaaagctggatgtttttatcctcttatgaagcgatgcgtgaaaagttattaaaggatcgaacattgtctaatatggtgcatatgggtaatggggtaatgggtattgctttcggtacagctgcaactgtgatgctgaataagcatattagtgattacgaaggtagcttttcttattgtgaaaatgatgatgtaaatgaagatggggttccaaaacaatttcctgttcaaaatgaaagactgaaaatagcaaaatcagatgattttcaaaagatacctggtagccctattgtttattgggtgagtgataaattacgtgctcttttttcattaaaaaaaataggctcactattaaaatctgatgggcagttattaactggtaataacgaaaaatttttacgtaatttttgggaaataaactctaatgaaataggacatgataaaagctggaaactccatcacaaaggaggtgattacaggaaatggtatgggaatgttgaatgggtagtagcgtgggataaaaaaactcgtgagcattatcgtagagataaaatcgctcgtattcctaaagaagaagtatgggatttagagggtgtaacatggtcaactattacctcagcaaatgcatcttttagaaaagttttatggtttgagagttttaataaagctgcaccaacattgcttggtaaagattctaaagatatagatttgtgtttagggatattaaattcaaaaatttcagaaaaacttttaaaaatacttaatcctaccgttaattgtttggttgaggatattgaagcgatacccattttgaagatcaattcaccagattttcttaagaacgtgagaaggtgtgtactaatttctaaaatagattgggattcctatgaaaactcatgggagtttaatcaaaacccaattattcgtaccaaccaatcaaatctagagcaagcctttaactcatggcaacagcaaaatactaacgccgtggctgaaatgaaacgcttggaagaagaaaacaataaactgtttattgatgcttatggtttacaggacgaactcaccccagatgtacctgatgagcaaattacgctgactcgtgccgaccgtgaaaaagacagccagcgtttagtctcttatgcgcttggctgcatgatgggacgttatagcctggatgaaccaggtctgatctatgcccatgcaggcaatcaaaactttgattccaatcgttatcaaaaattcccagccgatgctgacggcattattccactgaccgaaatgcactggtttgaagatgatgccacccatcgtattcgagagttcttagctgcggtttggggtaaagacacgctagaggccaatatgctgtggctggcagaaagcttggacaaaaaagccagtgaaacagcggaagacaccattcgccgttatcttgctagtaatttctataaagaccatatgcagacttataaaaagcgcccgatctattggttattcagcagtggtaaacaaggcgctttccaggcgttggtgtacttgcaccgctacaacgaaagcactttggcacgtatgcgtactgaatacgtgatgccactgatttccaaaatggcagcgatggttaattctttgcaaagtgaaatcgaaaacagtgattccgctgctgaaattaaacgtaaagagaaagaactacaaaatctgcataagcaacaggctgaactgagtagctttgaggaaaaactgcgccattatgccgatcagcgtatttcgctggatctagatgatggggtgaaagtgaactacggcaagtttggggacttgttggctgaagtcaaagcagtgacgggggagaagtga

SEQ ID NO: 2504 - DNA, 2325 bp, Escherichia coli
atgaataccaataacattaaaaaatatgccccacaggcccgtaacgacttccgcgatgcggtggtccagaagctaacgacgcttgggatcgctgcagataaaaaaggcaatttgcagattgccgaggccgaaaccattggcgagaccgtgcgttacggtcagtttgattacccgttatcgacccttccccgccgcgaacggctggtaaaacgcgcccgtgagcagggttttgaggtgctggttgagcactgcgcctacacctggtttaaccgcttatgtgcaattcgctatatggagctacacggttatcttgagcacggcttccgtatgttgtcccacccggagacgccgaccgcgtttgaggtgctggatcatgtgccggaagtggcagaagccctgctgccggaaaataaggcgcagctggttgaaatgaagctttccggtaatcaggacgaagccctgtaccgcgaactgctgctggggcagtgccacgccctgcaccacgcgatgccgttcctgtttgaagcggtagatgacgaagcggaactgctgttgccggataacctgacccgtaccgactctattctgcgtgggctggttgatgatattccggaagaagactgggagcaggtagaggttatcggctggctgtatcagttctatatttcggaaaagaaagatgccgtgattggcaaagtggtgaagagcgaagatattcctgccgccacccagctgtttacgccaaactggattgtgcagtatctggtacaaaactccgttggccgccagtggttgcagacctacccggactcgccgctgaaagacaaaatggagtactacatcgagcctgcggaacaaacgccggaagtgcaggcgcagctggcggcgattaccccagccagcattgaacccgaaagtattaaagtgctcgacccagcctgcggctccggtcatattttgattgaagcctataatgtgctgaaaaatatctacgaagagcgtggttatcgcgggcgtgatattccacaactgattctggaaaataatatttttggtcttgatatcgacgaccgcgcggcacagctttccggctttgcattattaatgatggcgagtcaggatgaccgcagaatatttacccgcgatgtacgtctgaatattgtctctttgcaggaaagcctgcatctggatatcgccaaactctggcagcaactgaatttccaccagcaggtacaaaccggcagtatgggggatatgtttgctgaaaataacgcgttaacccaaactgacagcgcagaatatcagctgctgatgcgcacgctgaaacgctttgtgaatgcaaaaacgctgggctcactgattcaggtgccgcaggaagaagaagcggaactgaaggtattcctggacgcgttgtatcgcctggaacaggaaggcgatttccagcagaagacggcggcaaaagcgtttattccgtttattcagcaggcgtggattttagcgcagcgatatgatgcggtagtggcgaatccgccgtatatggggggtaattatatggagacagaacttaagaatttcgtctcttcttactaccctcaaggaaaggcggatctttattcttcatttatggtcagattacttttacaattaaaagataatcgcactttaagcctaatgaccccctttacttggatgaatttatcatcatttgaagagctccgaaaaattatacttacaaatttcagcattcagtcattagtacagcctgaatatcattcattttttgagtcagcttatgtcccaatttgtgcttttagcatttcaaataccccattaagctggaatgcaaaattttttgatttatcagatttttatggagaaaaaaatcaagctccaaattttcagtatgcaattaaaaatgacaataaatgtcattggaaatataacagaatcaccacggactttctatgtactcccggatatatcattgcttactctctgcctgattctgcgttatcttgcttcaaaacatccaaaaaacttcatgatgtttgcaatctaaaacaaggattaattactggtgataatgaaagatacctaagattctggcatgaaatcagctataactctttcagtctcaatgaaaaaagaaaaaaacaaaatggttcccatatcaaaaaggtggtgcataccgtaaatggtatggtaataatgattatgttgttgactgggagaatgatggttattccattaaaaacttttataatgacaaaggtaaattacgctcacgccctcaaaacatacaattttattgtaaagagggtttaa

SEQ ID NO: 2505 - DNA, 966 bp, Escherichia coli
atgttggttcatttttcaagagatattaacactattaagggtagttttacactaaggcaaggggaaaataaaaaagcgattaacagaacaaaatttttagaagaaatgaataactctttctttataaattgctttaatctaactgatattttatctccagaaattgaactaaacaaaatcacgttaacgcatgcaactattgaaattgatattcaaaaaataatttcatatgcaataggctgccaaatgggacgttactcccttgatcgcgaaggtctggtatacgctcatgaaggcaataatggcttcgccgatcttgtcgccgaaggtgcttataaaagcttcccggctgatagtgacggcattctgccgctaatggatgaagagtggtttgacgatgacgtcacctctcgcgtcaaggagtttatccgcaccgtttggggcgaagaatatttgcgcgaaaacctcgattttatagccgaagttctcaagcccaaaaaaggcgaatctgcgctggagaccattcgtcgctatctttccacccagttctggaaagatcatctgaaaatgtataaaaagcgtccaatctactggctattcagctccggtaaagagaaagcgtttgagtgcctggtgtatctgcatcgctataacgatgccacgctgtcgagaatgcgtaccgaatatgtggtgccgctgctggcgcgttatcaggccaatattgatcgcctgaacgatcaacttgatgaggcttctggcggtgaagccacacgtctgaaacgcgaacgcgacagcctgatcaaaaaattcagcgaactgcgcagctatgacgatcgcctgcgtcactatgctgatatgagaatcagtattgatctcgacgatggcgttaaggttaactacggcaagtttggcgatctgctggcagatgtcaaagccatcaccggcaatgccccagaggtgatctaa

SEQ ID NO: 2506 - DNA, 3633 bp, Enterococcus faecium
atggataagaaagcgataaagaatttcgcggtcaatgcccgtagaaaattaattgatgaagtaatgactaaagcaaaacgtttaggaattgatgaatcaaaaattgaagatgtgaagaaaattgatagcaatttacaagaaatcgaaaaatcaggaataagaattcaaggaaaagaaatagcgcaaagaaacaaattgattgcagaactaaaacaacgtgcttctgtcacttcttattcagaagcttttcaagagttaatcgaagaggttgcttatacgtggtttaaccgattgattgccattcggtttatggaggtaaatgattatttacctgacacgtatcgtgtattatctagtgaaataagtgggaaaattgagccagatattattacagatatttatgatgccgatatctttgaagaattatctagtaatgaacagcaacaagtcagaacttggaaaacagataattcagcagaagcaatggacaagctgtatcaattgatttttataaaaatctgtaatcaattgaatgattacttacctgagctatttgaagaagtagaagattatacagaacttttgtttacagcttcttatattaaaaaagatggtgtaatcgctgatcttttaagtattccagaggatgatttcaatgttcaagctggtggacaggtagagattattgggtggttgtatcagtactataatagtgagccacataatcaagtggtgaatatttataaagggattgtcaaaaaacaagatattccggcagcaactcaactatttaccacagattgggtcgttcgttatatggttgacaatagtttaggaaagtattggttagatcattatcccaatagtgaattaagaaataagttgaaatacttaattccagataaatatgcttttgaacaagcaacatctgtaagtaatttaaaaccagaagaactaaaaattatcgataacgcaatggggtctgggcatattttagtttacgccttcgatgtattgatggaaatttatcttacgttaggatattctgagcgtgatgctgcacgtgcaatcgttgaatacaatttatatggtcttgaaatcgataaaagagcgtatcaattgtcttattttgcaattatgatgaaagggcgtcaatacgatcgtctttttttgaaaaaaagtctatcgccgaatttaagagagtttattgattctcctaaagtgacagacgagtatcaagagcgtattagtgaattgaacaatgataagtatagtgaacgctggaatgaatacaaagagttaatttttgatcaatttgaaaatgggaaagaacttggatcaatcattaagttagtcgataaaaataatcaggcaataactaaagaatacttaggaaaagtaagagagtatatatcaaaattcaacgaatttacgaatatggatattctttatgggatgaaggaaatacaagaaaaatacttgcacattcttgacgtggctgaaatgctagttgataaatatgtagcggtagtcactaatccgccttatcttaataaaatggataagaaattaaaaaaatatgtaaatgataactattctgatgtcaaaaaagatctattttctgtgtttattaaattgaatagccaaatgctgattgataatggatatgcttcctttatgacgccatttgtttggatgttcatttctagctatgaaaagttacgctcatttttaattaatgaaagaaacatttctagtttgattcaaatggagtattcagcttttgaagaagcaaccgttccaatttgtacgtttacgataaaaaattcaaatgaacaagatggaagctatataaaattatcagattttaaaggtggaatggaagttcaaaaaattaaaacgttagaagcaattcatcagcatggtgaatgcgattatttttatagtactaatcaagacaacttcaaaaaaatcccaggaatgccgattgcttactgggcaagcgataacgtaatcactgattttgctcaaggaaaattaactaacgatgttgcagatgcaaaacaagggttggcaaccggaaataacaataaatttttgcggtattggtttgaagtagaatttaacaaaataaagtttgatgctaaaacattagaggacgctaaaaagtctagaaaaaaatggtttcctacaactaaaggtggtcgttttagaaaatggtatggaaacaatgaatacgtggttaactgggagaatgatggagatgaaataaaaaattatgttaatgaaaatgggaagttaaaatctagaccacaaaatcttaattactattttaaaaagggaattacttggtcgacactttcatctggacaagtatcttttagattgcagaatcaggcaatttttgaaactaaaggatctgttctgttctcaaaggatataactgactttgaagaaatatttggctatgtaaactctaaattagttaatcactttttaacttttatttctcccaccttggattaccatgaaggaccaatgggaaaactaccttttcttaaagttacatctgagagaaaattaaaaaaaataagagaaaaagtggatgaaaatatcgatatagctagaaaagactataatgctcttgaaacgtcatacgagtttagaagaaacattttgttaagttatatgtttaaaaaagatctctcagaggcatttaactgtctaagtaggcagttggttaatcaatttaatactctaaaatcgaatgaagaggaactgaacgacatattcattaatcattattctcttgaaaaagaattaacaaaagaggttcaagatgaatatatctctgcaaggttacctgataaggcgagggaaattaaggattttatttcttattcaataggttgtatcttcggtcgttactccctagacgaagatggtctcatcttcgctggcggcgaatgggatccttcccgctatcaaaaatttaaacctgatactgataatgttttactcatcaccgatgatgagtatttcaaggatagccaaattgacattgtcaatcgtttcattgatttcgttgagattacttttggtaaagaaacccttgaagaaaatctccagtttatcgctgacactttaggtggcaaagggacaagtcgagaaattattcgtcgttacttcgtacaagatttttacaaagaccatttaaaaacatactccaatcgaccaatttattggcaattggactcaggaaaacaaaatggctttaaagcgttaatgtacttgcatcgctatacaccagatcaattaggaaaagtacgtactgaatacctacacgaactacaaaaagcgtatgacaatcgaatcgaattgcgtcagcaacaaatttcaacaagtgataacccaaaagaaagaaatgcaatgacaaaagaaattgtaaagattcagaagcaattaaaagaagttcgtgagtatgacgagaagttgggtcacttagcattaaaacgaattgaattagacttagatgatggtgtaattgtcaattatgataagttgcagcgtgatcctaaaaccggcgagaaattccaaatttttgcaaaaggggtcaaagaaccaaaaaaatag

SEQ ID NO: 2507 - DNA, 3534 bp, Alcanivorax sp.
gtgagcgaaagcatgaataaatccgcactcaagaagtacgctccccaggcgcgactcgattttatcgctaccgttactcgccgtgccgagctgctggggctgaatcctgaaagtcccgccaaagttgaaaagcagggcgaagccctgctcatcaatggtcgtgccttcccggcagcctatggccaaatgcgcactacccttgaagctcgcattcgggagcaaggttttgcgcaggtgatggaggccatggcctatacctggttcaaccgcctggtggccgtccgctatatggagctgcacggttttctggatcatggttatcgggtgctcagccatcctgccaatacagaaaccggtcatactcagcccgagatcctagaccatattgcagacctggacttgccggggctggataagtccgtcgcgctggaactcaaactggcgggcaataaagatgaagagctgtaccgcgaggtgctgctggcccaatgccacgctctgcatcaggccatgcccttcctgttcgaatccctggacgacgccaccgagctgctgctgcccgacggcctgctgcgcaccgattcgattctgggcaagctcgtcaccgccatcgatgaggccgactggcaggacgtggaaatcatcggctggctctaccagttctacatcagcgagaagaaggatcaggtcatcggcaaggtggtgaaaagcgaggacatccccgccgccacccagctctttacccccaactggatcgtcaaatacctggtgcagaacagcctcggccgtctctggctgatggccagccccaccagcacactggcaaccaagtgggagtactatatacagcccgcagaccagacggataaagtcaacgcccagctggacgcgctcatccagactcgcatcgacgaggacggcgccaccctcaaccccgaatccctcacgctgctcgacccggcctgcggctccggccacatcctggtggaagcctacgacctgctgcgcgacatctacctcgaacgcggctaccgccggcaggacatcccccggctgattctggaaaagaacctctacgggctggacatcgacgaccgtgccgctcaactcgccggctttgccttgttgatgaaggcgcgggcggatgatcggtgcttgtttgggcagccggtggcgttgaatttactggccttgcaggaagcgaaggaaggcagtgcggcggatctacacagtgcgctgaatgcgccgcagattgaatataggaaggtcagccagcttgtggagaccttcgagcaggcgaagacctttgggtcgctgattcaaattcccaacgaactggccgatactctccctgaactgaaacgggagattgaaacaattcgagggagtggggatttgcttgggcgcgacgcggctgagaccctgctgaaactggtagaacaggcggaaattctagacaaaaagttcgatacagtggtagcaaatccgccgtacatggacagcaagggcatgggcgatgacctcaaggcatgggccaagaaaacgtttccggccggcaagtcgaatttgtttgctatgttcatcgaacggggtttcggttggtgtaaacctgctggattcaacagtatggtcacgttgcagagctggatgtttcaatctacattttcagaattacgttctcgacttctaaaaaaaagcacaatcgactctctggtgcaaataggattcaacagtttcccggaattaaattctaaagttgcccttggagcagccttttccatttttcggtcaaatgttcctttcgcgaccggaacttttgtaaatctcaatagcgctccgcgctcagcagacaagggatctgtatttcgagatcgcgacgataatattgtgtttttcgttgggcaagaagctttccaaaaaattcctgactctccaattgcttactgggcaccatacgaacgcgtttttaagtattcaccgctaaacgacttctacgagtctggtgggcgttgtaagactcacaatgacgagaactttgttcggttccactgggagctggaatctggaagcgtcggcccgaacaaccgttggagatattacgagaagggtggggacttcaggaaatggtatggcaatcgcctcttcgtggttgattggtcagagacggcaagggcttattatgcaagaaagggtggccttacgagggaaatgtactggaataggcaaggtatcacttggtctgatattggcatccaaagtggcttccgtttgaagcttgaagatactgaatatagctctgtatcacctacgatattcccgcttggagagaagctggatttgaggatcttgctattgctcaatagcagtctttcgaaatgggtgatgtctgccctaaatcctggcttacatgcgaacccgggcgaggtattgaagctacctaacctactcagcggggatccgaacacagcagagaaagctatccatttggcaaaggacgactgggattcatatgaagttagtggggagttttcatcttctcctctcgttcagataaatagtgtctcttgtcgaattagtgattgtgcgagagcgcttattcagggtcgtcaagatcgcaccaatgaactcagaaatttggaagagcagaacaataaggaaatcattgatcgattgggtttatcagatcatgtgtctccgaaagttccgctatctgagatttctttaactggaaatttggcctatcgcgggaaagggaagaatcgatcaagcggcgcggaagaacataggaagttggtctccgaagagctagcttcctacgccatcggctgcatgatgggtcgctacagcctcgacacccccggcctgatctacgcccatgccggcaacgaaggcttcgaccctagctgctatgaaaccttcccggccgacggcgacggcatcgttccgatcaccgatgaagcctggttcgacgacgacggtgccaaccgcatccgcgaattcgtccgcgtcgtctggggcgaagacactgaagctgaaaatatggcctggctcgccgaatccctcggcagcaaagccagcgaatccgctgacgacaccatccgccgctacttaagccgcgacttctacaaagaccacctgcaaacttacaaaaaacggcccatctactggctgttcagctccggcaaacacaaagccttcgaagcccttgtctacctgcaccgctacaacgccggtacgctgtcgcgcatgcgcatggaatacgtcgtgcctctccagtcccgcatgcaggcccgcatcgacaacctggatcaggacatccaggcctccacctccagcgccgaacaaaaacgctttcagaagcaaaaagacaagctcatcaaacaactccacgaactccgccgcttcgacgaaaacctccgccactacgccgaccagcgcattacattggatctcgatgatggggtgaaggccaactacggcatgtttggtgatttgttggctgaggttaaggctgtgaccggtaaaaagggttaa

SEQ ID NO: 2508 - DNA, 3741 bp, Vibrio cholerae; identical to SEQ ID NO: 2398

SEQ ID NO: 2509 - DNA, 3741 bp, Vibrio cholerae; identical to SEQ ID NO: 2398

SEQ ID NO: 2510 - DNA, 3648 bp, Escherichia coli
atgaatacgaacaacattaaaaaatacgcaccaaaagcgcgccgcgaatttatggatgcggtagctaaacgattaaatacctttggtatcaccgcgaataaaaagggcgagctacaaattgcagaagcgaatctacaaggttctgtgcttcaaatcgccggtaacagttttgacggtaaactggccgagcccagaaaacgcatagtagccagaagccagaaacttgggtatgcacaacttattgaacaagtagcttatacctggttcaaccgtctgtgtgctattcgctatatggaaatccatgactatctaggccacggttttcgtgttttgtcgcacccagacaaccctaaaggctttgaaattatcgaccatgcccaagacgctgcggatgaactcggattagatagagctcgcattgttgaactcaagcttgcgggcaacaaagacgaagagctgtatcgtgaactgctgttaggccagtgccataagcttcatgaggcgatgcctttcttatttgacgcattggacgatgaaactgagcttcttctaccagacaacctaacgcgtaccgactcaattctgcgtggattggtagacggcatccctgaagaggactggcaacaggtagaagtgattggttggctttaccaattctacatctctgaaaagaaagatcaggtaatgggtaaggtggtcaagagtgaagacatccctgccgccacccagctatttacacccaactggattgtgaagtacctggtacaaaactcagtcggtcgtcaatggctgcaaacctacccagactctgccattaaaacgcagatggaatactacattgagcctgctgaacaatctgacgaagttaaccaacagctaaaggctattacgccagaatctattgaacctgaaaccatcaaagtacttgaccctgcttgtggttcgggccacatattgattgaagcctataacgtgttaaaagccatctacgaagagcgtggtttccgctctcgtgacattccaaagatgattctggagaacaacctctacggcttggacatagatgatcgtgcagcgcagctatctggctttgcgctgatgatgatggctagagatgacgataagcgtatttttacccgtaacgtgcgacttaatgtactgtcattgcaggaaagtaaccatcttgacctgccgaccttatggaaagcactcaacctatcgggaagttggcaaagtggcacgtctcagggcttgttctcagatgatgtacaagatttaagctcgttcaatgcagacaaacgctaccaacttctgaagcgaacgttggtaaggttcactcaagccaagacctttggttctttgatcgatgtaccaagtgatgagtatgagcagctaaaagatctactgaacacgcttgtcgagctgcaagagtcaggtgactcaatgcaaaagcctgcggcgaaggaattgatagaatttgtgcatcaagctttggttttatcgattcgttatgatgctgtcattgcgaatcctccctatatgggagcaaaaggaatgaatgcggacttaaaggatttcgcaaagataaatttccctaatagcaaatcagatttgtttgccatctttatcgaacgagggtttggctggctgaaaaaaacaggtcttaattcaatggtaacgatgcaaagctggatgtttctatctagctacgagcaaatgagagattctattcttaatggaagaactcttgaaagcatggttcacatgggaaatggagtaatgaaaattgcatttggcactaatgctactattttcagcaatacccatattaaaggttatcgcagctcattttcttacgttgataatgatgatatcggtgatgatggtaatccgaaggaatttcccgtaaacaacggaaggttacgggattgtgcatcggatgagtttaagaacataccaggtagcccaatagcatattgggttgatagttctgtggttgaatgctttagaaataataaaacaatcggtgatgtttctgacgtgaagcaaggtttagcaactgctaatgatgatcgtttcttgcgggcttggtttgaagttgattgtagcaaaatatcatttccatcttatttcgatccaaataaaaaatggtttgccttcaataaaggtggtgattttaggaagtggtatggtaataactatttggttgtaaattgggagaatgatggagaggagatcaaaggttttcgagagggaggaaaacaaaagtcaagacctcaaaatacatcctattacttcaagcaaggcgtaacctggggacaaactagtagcggaaagtcttcattcagatgggttgacagtggttatgtatttgctcacataagctcaatgttatttagtagctccgatgtcgatggtaagttgaaactggcttttctaaatagcacatcaggcatatatcttttggagctattcagtcaatctatgggcgtcgaagtcggtcatataaaaagtcttccttatatacctgttggtgatggtgagataatatcaaaaattgataggttgatatcaattcataagtgcgattgggatagttatgagacatcattcggctttaaagcacataaattcgttgcaattaagaaaaaatcattacgggaaatagctaactatttcttagagtttgacctgaaagttattgaggaaattcgtttggctgaggctgaaattaattcgtttttttctcaagtgtgcggtctttcaaatgttgtttcaaatgatgttgaaatatctgaagtcagtgtttctacgaaccctcactacctctatccaaacgattctaataggatagatagatatacaagtgattcacttgttcaacttataagctattcaattggctgtatgatgggtcgttactctcttgatcgtgagggcgtaatgtatgctcattccgacaatgaagaatttgataagttaaccgctgaaggtacatatttcgcatactcgtctgacgaggacggtattattccactaactgaccaagaatggttcaaagacgacgcaaccaatcgtttccgtgagtttgtccaagttgtttggggtgaagaacacttacaagaaaatctcgattttgtcgctgaatcactgtgcctaaacgccattaaaccgaaaaaatctgaatcagcgctggagactattcgccgctatttatcgactcagttctataaagatcacctgaaaacttacaaaaaacggcctatttattggctatttagctcaggtaaacaaaaggcttttgagtgcttggtttacctgcaccgttataacgagggcacgctttcgcgtatgcgtaccgagtatgtcaccccgttactaggcaaatacgatgcttatgcagagcaacttgagaagcagattgaaacggcagactcgaccagtgaagcgaaccgcttcaagaaagagttggatgctttaatcaagaaacaggttgagctacgagagtttgatgacaagctaaaacactacgcagatatgcgtatttcactggatcttgatgatggtgtgaaagtgaattacggcaagtttggtgatctgttggctgatgttaaggccattaccggttcagccccggaggttaactaa

SEQ ID NO: 2511 - DNA, 3588 bp, Bifidobacterium bifidum
atgaacacgtcgaaactgcaagccttcgcaacggatgcgcgccgccagctcatgaacgcggtgagggcccggcttgacgccgcattggtgccgaattccgacgcccaggttgacgacccgcgtgcattcgattttctgcagcgtgagatcgagcgtgccggtgacggtgaagagggccgcaggcatgtggtggaacgttatgcgtaccgatggttcaaccgcatcgtcgcgttccgttacatggatgtgcacgggttcaccggcacgccggtggtctctccagccggtctgaccagcacgaatggtctgccggaggtgcttgcagcggcgaaacgaggcgagtatgacagcagggtgttctcggcgcacgtgaatgataaggccaaggagcgtatcgaaggtttgctgagcggttccattttggcagatgatccgcagggcgtggcttatggtctgctgctgcaatccgaatgccggttctggaatcgtaacctgccgttcgtgttcgaaaacgtcggcaaggaagccggcagagtggatgaactgctcatgccagccgatctgctcgccgagggttccgtgttgaggaatgcggtggaggtcatgaccccggaggattgcggtgttgacgatccgtctggcaatgtggagatcatcggctggctgtaccagtactacatttcggaacgcaagaacgaggtgatggacgggttcaagaagaaccataaggccggtgctgaggagattcccgcggccactcagctgttcaccccggattggattgtgcgctacctcgtgcagaacacggtgggcaggctttggatgcagtcccatccagacagccagctgtacaagaactgggactactatattcagccttcggaggatggttccactgagaacgaggatattctcaacattcaaacgcctgaagagctaaccgtgtgcgatcccgcatgcggctccggccacatgcttacctacgcgttcgacctgctgtatgagatctacgaagaagaagggtatgcgccgagcgatattcccggattgattctcaaacacaacctatacggcatggaaatcgacgagagagccgcaagccttgccgcctttgccctgaccatgaaggcacgctcccgttcccgcagattcttcaaaaaacaagtggagccgaatattcagcgcattgtgccgatttcgttcgaggaaagcgatgtcgtcgatctgaatgacctataccaagtggatttggacttcacggtatggaatacctatgcgaaggcggatgtgtacggttcgctgattgagccgccacaggagcttgttgatcttgccgcatcggcagaagatgctgaagccgaaaccacattgtttgactcgcttctgcgtgaacgcgtggagggggttttcgcccagacaaggtatctcgcacgtaaatacgcggcagtggtggcgaacccgccatacatgggcgcaaagaacatgagcggcgagctcaaacagttcgtgcaggatcgctatgaggatggtaaagccgatctcttcgctgcgttcatttacagactgcttggaatggtgcctgaacatggacaacttggcttcatgactccttatgtgtggatgtttatatcctcctatgagcaaatgcgtcaacatattattcgacaggaacatatcagttcgttgattcaactggaatattccggattcgaaggcgccaccgtgcctatttgcactttcactttagaaaaggggcatagtgacaggaagagtgcattcgtcaggctcagcgatttcgtgggagctaagcagcaagggcctcgtgcattgggaatcattgatgcgcacaataatgagcaatctgcccattcgggtatgcgcaagtattttttcgaggtgaaccagcacgagttcgcgcaaatccctggctcgccaatcgtctattggctcggtgagcaattaagaaaaacgttgataaatccagcttcggacactattcttttcagcgatggtttaattaaaacaggtgataatctccaatatttacgcttgtggtgggaattgatatctactaatgtaaataataaatcacgttaccgtttctgtgctaaaggcggtaaagaacggaattattatgggaatttaaataacgtcgtgaaatgggatgaggaaactcgtgattattaccgttcagataaagtagctcgaatttctcctaagtatttatgggataaagaaggaattacatggacaaaaattagttcgagaggtggaacatttcgccttcttcgtaaggaagatattgctgagactggaggtccaagtttattcttaaaagataatgtagatggcaatgatttgttgtcgttcatcggtgtgattacatcttcgcttgctccatatattttgcaggggcttaacccaacattaaactatcagacaggggatgtacttcggtttcctcttcctattaaaaaagaagaagcgttgcctagtttggttcactcaatgattggatcttcaaaagaggactgggattcttttgagacgtcatgggattttcaacggtttgcgttgcttgaccctaatcagggttcacaagcgggagatttactcgaagatgcggtaacgcatcttcgcgagtactggaatcgcgtatccgaggaacagcgccagcgtgagatccgtaataacgagctggtggcggatgcgtatggcgtacgtgatgatgtgccgtgcgatgtgccgttggaacgtgtgtcgttgaagcgtaacgtcgcattcgcgtatccgaaagatacgccggaagcgcgcaacgagaaattcgcccaagatgtcgtcagggaactcatttcctatgcggtgggctgcatgttcggcaggtattcgcttaataagccgggattgatcctcgcctcgcagggcgagacgcttgatgatttccacgcgcagattccgaacccatcgttcgaaccggatgtggacaatgtcattccggttacggagacggattgcttcgaggacgatattgtgacgcggttccgcaggttcctttccgtggtgtttggcaaggagaatctggctgcgaacatcgcctacatcgaacaggtcctgggcaagagcatccgcaagtatttcgtgaacgatttctacaacgaccatgtgaagatgtactcaaaccgtccgatctactggcagtactccagccagaccaacaacaagggctcgttcaaggcgctcgtgtacctgcatcgttatacaccgaaaaccacaaacgtggtgctcaactatctgcgtgactacaccggcaagatcgctgatatcgctgatggtttggagcgttccgaccgtaccgcggacaagaaacaggccgccaaactgcgcaaggtcgttcttgagtgcaaggactatgaggatcagaccctgtacccgctggctacccgtaatctggaaatcgatttggatgacggtgtgctggtgaactacctgcgcatgggcaaggctctgcgttccatccccgctatcgagaagaagcgcaaagaagtttccacctggacctggcccgttcatccgttgggcaaggagtag

SEQ ID NO: 2512 - DNA, 3654 bp, Escherichia coli; identical to SEQ ID NO: 2487

SEQ ID NO: 2513 - DNA, 3678 bp, Salmonella enterica; identical to SEQ ID NO: 2364

SEQ ID NO: 2514 - DNA, 3627 bp, Vibrio cholerae; identical to SEQ ID NO: 2397

SEQ ID NO: 2515 - DNA, 3654 bp, gamma proteobacterium
atgaacacaaacaacgtaaaaaaatacgcacctaaagcccggaaagcctttattgaggccatgagtaaacaggctgcgaaatatgggatcactaaaaagaaaattgagcctgcggagcagaagggcgacctggttctgattggtgatagaccgtttccggcgtcggttattaaacctcgtgaacgcttggtaatgcgcatcgaacagcaaggcttcgaccaggtaatggagcatgtggcctatagctggttcaaccggctatgcgctattcgctacatggaacgcaaagggtttcttgaccacgggcgtcgcgttcttagtagtgcagaggggagcgcggctgacggcagtgccggtgtgccccagatactggaagagtgtctggatgtcgagttacccggcctggaccaggccaaagttagagaattgaagcttgatggcaccaaagacgaagagctttaccgtgagctgttactggcccagtgtcatgcactgcatcaagcaatgccatttctgtttgaggcggtagcagatgaatccgagctgctgttgccagaaaacctgaccaagacagactcactgatccgtgaattggtggaaagtgttcccgatgaagactgggaccatatcgagattattggctggctttaccaattctatatttccgagaagaaagatcaggttattggcaaggtcgtgaagagcgaagatattccggccgcgacacagctttttacgcccaattggattgttcagtacttggtccaaaactcagtcggtcgtcagtggcttcagacgtatcctgattctccactcaaggagaaaatgccgtactacatcgaacctgctgagcaaataccggaagcagaatcgcgcctggctgagattacaccttctgacattgcgccagaatctataaaggtcttagacccagcagcgggttcgggccacatactggttgaagcttataaggtattaaaagccatctacgaagagcgaggttaccgaacccgagacattccgaagctcattctagaaaacaatctcttcgggctggatattgatgaccgtgccggacagttggcagggttcgcgttgatgatgctggcgagagaggatgatcggcgagtcttcagtcggaatatcagtctcaatgttttgtcgttacaagagagctccaatgtaaatctgccttctctatggcaggcattgaatttgtccggagaatggcagagtggtacttcacaggggctctttgaagatgggcaacaggatctgagtgcttttgcagcagataaccgctaccagttgtttcagagaaccatagagagatttaaaaacgccaagacttttggctctttgattgacgttccccatgatgattgcgaggagttgaaggggctttttgtcactctacgcgaactggatagttcaggcgactcgatgcaaaaagcggcagcaggccaattgcttccttatgtccaacagggggtgttgttatctcaaaaacatgatgcagtgattgctaaccctccttacatgggtagcaaagggatgaatgctgacttgaaggagttcgcgaagaaagaatatccgaatagtaaatctgacttgtttgctgtgtttatggagcgagcattcaaactgttaaacccaacaggcttcaatgctcaagttaatatgcaatcgtggatgttcttgtctagctatgagcaactcagaagtaacctcttggaagaccataccttcgtgacaatggcccacctgggggcgcgtgcttttagccagataagcggcgaggtggtgcagactactgcatgggttctcggaaaatatcatgtagataaatatcagccgactttttaccggctgatagaaggtaatgaagaagacaagaaaaagtcactgctaaagcgtgaaaatcaatactcatctacggcgcaagatgatttcaaaaagattccggggagcccgattgcgtattgggcgaatagagcggcaatagagtcttatactgataatcagacgtttgctgatatcgcgccttttaaatcaggaatgtcaacaaccaacaacgacagatttctacgcttgtggcacgaggtagactattgcaatttaaagcttgattccaaatctctagaggaggcacaggctagccaaaagaaatggtttccctacaaaaaggggggagcttataggaaatgggcgggcaacgatgattatgtggttaattggttcaatgatggggaagagattaaagaatccgtagttaataatcctagcgatccaaacactacgcactggtcgagaagaatctttggggttccatatttctttaaaccttcattaacatattcaaggatttcatcttcggatttctcagtcaggtattcatccggaggagctattttttccgatgcgagtaacggatgcttccccaaaagtaatcatttgctatttctggcttttttgaactccgattttgcaaaagaattattacaatttctatgcccaacaattaattttatggcaggtgatgtacaaaaactaccatctccattaggcattacttgggggagagacgaagaatctctagtagagaaatgtattcagattgcgcaagaagactgggattcacaggaaactagctgggcgttaaagtggtgcaatcatgatcgaaagtatattcaaaaacatatagcaaataaaaatgcattgtggatagaaaaaaagaatgatcttgccaagatggagtccatgctcgacgctaaattcaatcttcattttggaaatgaaactatcgaagaacgacattcagtatatgcaaattacttgcacaatgatcttgaagaaaacgaatttgtctgtgttgaaacccaaaagataatttcattttcctttggagcaatgttcgggcgctattcccttgatagagagggcgtggtttatgctcgctctggcaacgaaggctttgctgaactggtttccgaaggggcctataaaaccttccccgcagacgatgatggcatcatcccattaacagaccaagaatggttccccgatgacgcgaccaatcgctttcgagagtttgtaaaagtcgtttggggagaagagcaacttcataaaaatctcgactttgtagcagagtctctctgcctgcacgctatcaaaccgaagaaatccgaatcgtcgatggacacgattcgtcggtacctatctacccagttttataaagaccacctgaagacttacaaaaaacgccctatctactggctgttcagctctggtaagcaaaaggctttcgagtgcctggtttatctgcaccggtacaacgaaggtacgctggctcgtatgcgtactgagtacgtcattcccctgacagctaagatggcgtcctatgctcaaaaactggaaaccgataaagaggccagcggttcggcagcagaggtgaagcggcttgaaaaggaaattgcccaacttcacaaacagcaggctgagctgagcgagttcgacgagaagttacgccactatgctgaccagagaataagcctggatctggatgatggcgtaaaggtcaactacggcaagtttggtgatttgctggcagaagtgaaagccattaccggtgagtctccggaggctctgtcatga

SEQ ID NO: 2516 - DNA, 3627 bp, Acetivibrio cellulolyticus
ttgaataaaaccgcactcaagaaatttgccattgaagcaagaaatgacttaagggacaaggtgaaaacaaaggcttttcagtacggaattactgaagaaagcattaataataaaaatacagtaccctccaatgatttttttaaagacggaaagaatgccttaacaagagaggaaaaagaccaaagggataaagtaaaatccttgatggaaacaaaaggttttaatcaggttatagaagaagtcgcctatacttggttcaacagatttacagcccttagatttatggaaattcacaattatcttccaagtaaggtgagagttctttcatcaattaatgaaggcagcgttgaaccagatattattcgggaggcattgaacgttgatttgaatgtggacaaggaaatagtatataacctgaaaatgagtactgaaaatgatgcaacagataaattatacaagtaccttattttagctcagtgcgatgttctttcagtaacactgccatttttgtttggaaagacagatgattacaccaagcttttgtttcctgatggattgttggcagaagggtctttcttaaggaaaatgactgacacagaagctctcccagagtctgattggaatcaggttgagattattggttggctttaccagtattacattgccgagaagaaggacgaagtttttaagaacctcaaaaaaaatgttaaaataagcaaagagaatattccagcagcgacacagctttttacacctcattggattgtaaggtacatggttgaaaattctctgggacgtatttgggttgaaagttatcctgaaacgactttaaaaggtgaatggaagtattatttagaagaagctgaacaagaggaagaagtaaaaaaacagcttgaagaaataagatacaaaaatgtaaacccagaagaaatcacatttcttgatccgtgctgtggtagtgggcatatacttgtgtatgctttcgaggtcttttatgcaatgtatctagaaaaaggatatgtagaaagtgaaataccaaaactgatattggaaaagaacttgtacggattagatatagacgatagggctgcacagctagcatcatttgcagtgatgatgaaggcgagggagaagtcaagaagggtttttagacaggaaataaagctgaatatttgtgccattcaggaaagtaattggttaacagataatggtaaatggttagtgatgagtggaaggcgtgataccaatagtattgatgcaatagtagaattgttgatagataaaaatgcaattgaacttgagaagcaacagcaaagggctaccatagaatatttagctgaaatatttatggatgccaaggaatttggatcgattctagatgtaaagccagtggaattgcactttttagagaaacggctgaatcaattggagactgaaccaggagatttatttgaaatgttggctaaacaagagatattggagaaacttccggggataatatgtcaggctaagattatggggaaaaagtatgatgtggtttgtactaatccaccttatatgtctattagtggtatgggagttagattaaataattttgttaaaaagaattatccagatagcaagagtgatttgtttgcagtatttattgagaagtctgtacggttgctaaaggcaaatggctttcaaacgatgattacacaacactcttggatgtttttgtcaagctttgaaaagcttcgtgaaagggtttttagatatgaaattttaaatatggctcatttgggatctaaagcttttgaagaaattggtggggaagtagtccaaacaactgcttgggtattgaggaattgtaatatagaaaaatatgaatcaagttactttagacttgtggattttacaagtcaaggagaaaaagagcaggcatttcttactgggagaaacaaatatttaagtaaaaaaaatcttgcatttaaaattcctggaatgccaatagcttattgggcttcactgaattttataagaagttttgaaaaagaaaagttgtctgataaatataaaatatacttgggaatgagaactgggaataatgaaaaatttctaagatattggcatgaaattaatgattacttatttggaaaaaattttaaaagtgcattagacgcaaggacaagtggattaaagtggttcccatatagtaaaggtgggagttttaggaagtggtatggcaactatgaatatgttgttaattggaaagagaatggaaaagagatcaaagaagagacaaaaattaagtatccatatttaggtgacaatcttggatggaaaataagtggtgaagcatattattttttagaagctattacttggtcacgtataggaacgaataattttggaacaaggtatttacctcatggattcttatttgatactgcaagtccttgcatatttacctcaaataatgacaggttatatatattagcatttttttgtactaagatatttaccaaatatttggagtttttaaacccgaccatggcttttcagattggtgatattgggaatattccaatatctttccctgatagtagtgagcaaaaaattagaattgatgaattggtaaaaaacagtatttccatttcccgaactgattgggactcctttgaattatcatgggacttcagtcagcatcctttactaatacaaaaaggtgagaataaaacaatagaatcagcatttgcgacttggtcagaatttgctgaaaagcaattcaaccagctaaaagcaaacgaggacgagctaaatcgtattttcatagaaatctacggtttacaggacgaacttagccctgaagttgacgaaaaggatgttactgtaagaaaagtcgatcaagttagagatataaaatcattcatatcctactcagtaggctgtatgtttggacgatattcaatcgatgaggaaggactaatctttgcaggtggtgaatttgacacatcacgatataaaaccttcccggcagatcaggacaacgtacttccagtagtttcagacacatattttgaagatgatatagtatcaaggtttattgaatttgtggaagtaaccttcagcaaagaaactctggatgagaatcttaagtttatcgctgaaacccttagcaaaaaagctggagaaacagacaaggaaactataaggagatacttcctgaatgacttctacaaggatcatgttcaaacctacaaaaaaaggccgatatactggatgataacttccggcaagagtaaagcatttaatgccttgatttatatgcaccgatatgacaagacaactctttcaagggtaaggacggattatctccatgtgctgcaaactaggctgaatgcacaaagggagaagttactgtcaataattaatggtaatgaatcagaaaaggaaaaaagcaaagcaaaaaaagagcttaagaccattgaaaagcaaattgaggagctaaaggactttgatgaagtgctccatcatatggctgataaacagattgaaattgacttggatgatggtgtggcagtaaattacatgaaatttaaagatctgttgttagacattaagttgaaggattcagaggaagaataa

SEQ ID NO: 2517 - DNA, 3615 bp, Fusobacterium sp.
atgaataaaagcaatttgaaaaaatttgccataggagcaagacaagaattgagagagaaaacaaaggctcaattaaaacgattaggaatggaagaaaagaagatagaagaaggaaaagacatgggatctcaagtagaaatctatgggaaattatattctaaatccagttatcaacatcttcttgtaaaatatcattctttaggatatgaagaattggtagaagaaagtgcctatctttggtttaatcgtttgacagctttggcttatatggagcttcatgattgtttttcagaacacatgattttttcgaaagggagcaagggagaacctagtattctggatgaatactttcaagctgatttttttcaaaagatgcctttagaaaagcaggaagaacttcatcagctacgagaccaaaatacttcggactctttggaaacactttattctattttgatggaagaaaaatgtgaggaactttctaaaattatgccttttctattctcaaaaaaaggaaagtatgcagatattttgtttccaagcggcttgttgatgcaggattctgttttaaaaaaattacaagctattttattggaaatacaggaagaagaccaaagtattccggtagagattttaggttggctgtatcaatattataactcagaaaaaaaagatgaggtgtttgcgggattgaagaaaaatcaaaaagtgacaaaagaaaatattccggcagcaacacaattattcactcctcattggattgtaaaatatatggtagaaaattcgttaggaaaacttatcttagaatatattccaaatatggaatctatcaaaaaagattggaactattatattgaaacggaaatcgaatcaagttctgaaaaattgagtattgaaggtattaaaatattagatcctgctatgggtagcggacatatgctgacctatgcttttgatattctttttgatgtgtatcaagaattaggttggagtaaaaaagagtcggttctttctattttacaaaacaatctgtatggattggaaatagatgatagagccggacaaattgctgcttttgcattacttatgaaaggaaaagaaaaatttccaagattgtttcaagttttggaacgagaagaaaattttgaaatgcctgtcatttctttacaagaaagcaatgctatttccaaaagaatgtatacaatgttagaagaatctcctactttacaagacttgttaaaaggctttgaaaatgcgaaagaatatggaagtattcttaaaatagattcttttgcagaaagtatactgcaagaggaatatcaaaaactgcaagaaaagattcaaaatcaaggacaattttctctgttaaagaataatgaattcttagaaggagatttagaagaagacttagaacgattagaacgtattatccgacaatacaagattatgatacaaaaatatgatgttgtcattaccaatcctccttatatgggaggaagaggcttttctccaaaattaaaaaattataccgaaaaaaattacaaagatagtaagagcgatttattttcagtattcatggaagtgtgtcaaggatttacaaagaaaaatagatatacagctatgattacaatgcaatcatggatgtttttaagttcgtttgaaacattgagaaatcatatgattacaaaaacggaaattcaaactttaaatcatttggggacaagagctttctcggagttggcaggagaagtagtacaaacagtttcatgggtacaaaaacataaaactcctgaaaaaaaagggacgtatataagattagtagactacaacaatggagaggaaaaagaaagagaattttttaataaggagaattattaccaagccaatcaaaaagactttacaaaaattccgggaagccccattgcatattgggtgagtgatagaattagagaaatttttgagaaagagaaaaaattaggggaagtcggagaagcgaaacaaggattggcaactgcggataataatcgatttgtcagactttggcatgaaattaactttcatacaataggatttgggatgaaaaattccgaagaagctttaaatagtaaaaagaaatggtttccttataacaagggcggagaaaaaagaaaatggtatggaaaccaagagtatgttgtgaattgggaaaaagacggatatgagattaaaaattttaaaaattctgttgtaagaaatccaagttattattttaaaaaatcaatttcttggagtgatattacttcatccgggaattcttttaggctttatcccgaaggatttatatatgatgtcacaggaatgagttattttattgaggataagttccttacttatttaggaatatttaacactaaaatttattctaagttaacgaaacttatcaatcctacccttcatttacaaattggagatatgattaaaatgccttattttcaaatacaaaatcctttgtttgagcagctggttagcttaattctttggatttcttttgaggagtgggcatctcgtgaaacttcatgggattttgaaagattaacactattaaacggagaaaatctatctaaagcatataaaaaatattgtacttattgggagagtaaattttttagcgtacactcttctgaggaagatttgaatcgtattttattggaaagttatagtttacaggaagaaatggatgaaaaagtaggtttctctgacattactttattgaagaaagaagcttccattgtagaaaatatagataatgctacttcttgcggatatttagaaaatcgtggagcaaaattggaatttcattctttagaattagtaaaacaatttttatcctatgcaataggttgcattatggggagatattctttggataaatccggtttgattatggcaaatagtgatgatgtgttaagcatgagttctaataaaataacagtgagtggagtgaatggagaaattcgccatgaaattttaaatcctagttttttcccggaagaatttggaattctttccgtaacaacagaagaacgatttgaaaatgatattgtaagtcgtgtgattgcttttatctctgctgcctatggaaaggaacacttagaagaaaatctagaatttattacggaaattttaggaaagaaagcaggcgaatctcatgaggaagtattacgaaattactttatcaaagatttttatacagatcattgccaacgttatcaaaaaagaccgatttactggatgttacatagtggaaagaaaaatggattttctgctttaatctatttacatcgttatgaagaaaatacaatagcacgagtacgaagtgattatttacttccttaccaagattttatggagcagcaggaagctcattatagtaaaattgcttccgatgaggtttccactccaacagagaaaaaagatgctcaaaagaaagtgaaagaattacatgacattctgaaagagttgaaagattatgcaaataaagtgaagcatattgctgagcaaagaatttctttggacttggatgatggagtgaaagtcaattatgaaaaattgggaagtattttgaagaagatataa

SEQ ID NO: 2518 - DNA, 3633 bp, Enterococcus faecium; identical to SEQ ID NO: 2506

SEQ ID NO: 2519 - DNA, 3741 bp, Vibrio cholerae; identical to SEQ ID NO: 2398

SEQ ID NO: 2520 - DNA, 3678 bp, Salmonella enterica; identical to SEQ ID NO: 2365

SEQ ID NO: 2521 - DNA, 3741 bp, Vibrio cholerae; identical to SEQ ID NO: 2398

SEQ ID NO: 2522 - DNA, 3648 bp, Fusobacterium nucleatum
atgaataaaagtagcttaaaaatttttgcaatagaagcaagaaaagaattaatggaaaaaatgagaactagacttgaaattcttggaataactaaaaatggaatagaaaaagcaaaagttataggaaaagaggttgaagtaaaaggaacactttatccaaaagaaagctatgatagtttaattagaaaatataaacaagttggctatgaagaacttatagaagaaagtgcttatacttggttcaatagattaacagcattagcatttatggaagcaaatggatatattgaagagaaaatgatatttaacaatggtgttaaaaatgagcctgcaataattgataattattatgaatttgaattttttaaaaatttagataataatttacaaaaagaattgcataatttaagagatgaaaatacaccaaattcaatcgaaaaactttattctattttgatggaagaaaaatgtgaagatttatcaaatattatgccatttatgtttaagaaaaaagggacttattcagatattttatttccaacaggtttattaatggaaaattcgttgttggtaaggcttagaaaagaaataggagaagaagcaccaattgagttaataggttggctttatcaatattataattcagaaaaaagagaagtcgtatacaatggtagtatgaaaaaatcaaaaataaataaagaatatatagcaccagcaacacaattatttacaccagattggatagtaaaatatatggtagaaaattcattaggaaaactagcattagaatctactggaataaatgaaaatcttaaaaataattggaaatattatatagattcagaaaaagaagaaaattcagaaaaaataaagatagaagatataaagatattagatccagcaatgggaagtggacatatattagtttatgcttttgatttattatttgagatgtatgaaaatcttggttggagtaccaaagaaactgtgctatcaatattaaggaataatctatatggattagaaattgatgaaagagcaggacaattagcttcatttgcacttatgatgaaagcaagagaaaaattttcaagattattttctgtattaaaaagagaagaagattttaaattaaatactttaatattagaagaaagtaatagtttatctgaaagaattagaaataaaataaaagctaataacttaaataaccttaacaaaataatacaagagtttgaagatgcaaaagaatatgggagtattttaaaattagaatctattgataaagaaatattagaaaaagaatttaatatattaaaagaaagttttaataataatgaacaagaaacattaatatttaatgaagatgaaatgattatagatattaatgaggaattagaacttattgtaagtttaataaaacagcatataataatgataaataaatttgatataactgttactaatccaccttatatgggaaatagtagaatgaatggaattttaaaagagtatattgataaaaattactctgatgtaaaaagtgatttgtttgcagtatttttcataaaatgttgtgaaataacaaagagaaaaggctatttaggttttatgtctccatttgtatggatgtttataaaatcttatgaagaattaagaaaaatatttattaatgggaaaactatatcaagtttagttcaattagaatattcaggttttgatgatgcaacagttcctatttgtacttttgtattacaaaatagttatacagataaaaaaggcgaatatataaaactttcagattttaaaggtgctaaaaatcaacctataaaaacattagaagctgttaaaaatccaaattgtaattggagatttcaagctaaacaaaaagattttgaaaagataccaggaagtccaatagcttattgggtaagtgataaaataagagaaatatttgaaaaaaatcaaaaattaggggaagttggtgaggcaaaacaaggattagcaacagcagataataatagatttttgagattatggaatgaagttaattataataaaattggatatagtatgtcaaattcacaagaagcattagaaagcaaaaagaaatggtttccatataataaaggtggagaatttagaaaatggtatggaaatcaagaatatttagttaattgggaaaatgatggatatgagattaaaaatttctatgatgagaaaggaaagttaagatcaagacctcaaaatactgaatattattttaaagaatcaatttcttggacagatataacttcttctggaaattcttttagatactatccaaaaggatttctttatgatgtaacaggaatgagttattttatagatgagtcaaaacaaaaaaatctattagggattttaaataataaattgatttatataataactaaaattttaaatcctactttacatttacaaataggtgatttaataaaagttccatattttacaataaaaaatgaaaagtttaatattttagttcaacaaaatatagatatttcaaaagaagaatgggattcaagagaaatttcttgggactttgaaaagttatctttgatagatggaaaagatttaaaaaccacttatgaaaattattgtaatcattggagagataactttgttcaactacataaaaatgaagaagaattaaatagattttttatagaaatttacgatttacaagatgaaatggatgaaaaagttgcttttgaagatattactatattaaaaaaagaagctactattattcaaattgataatagtgttcctaagaatttttctagtgaatcagaaaaatatttatatgatagaggagttagtttagaatttaataaagatgaattaataaaacaatttttatcttatgctgttggttgtattatgggtagatattcaacaaataaatctggacttattattgcaaatagtgatgatatattagagttatcagaaaataaatttattgttaaaggaactgatggagaaataaggcaagaagttgaaagaaaatttttacctgatgaatttggaattatcccaataacagatgagaaagatttttcaaatgatatagttgaaaagataaaagagtttataaagtttgtttatggagaagataatttaaaagataaccttaattttattgcagaagcattaggaaataaagataataaacctgctgaagaaattattagagcatattttataaaagatttctatgcagaccatttacaaagatatcaaaaaagaccaatttattggctaatgaatagtggaaagaaaaatgctttttcttgtttattctatatgcacagatatgaacctttaacagttgcaagagtgagagcagattatttgataccttatcaagaaatgttagaaaataagagaaagtttatagaaagacagttatcagatgatgatatatcagcaaaagaaaagaagaatattgaaaaacaattaaaagaattagatacattgttaaaagaattaagagaatatgctaatgaggtaaaacatattgctgaacaaaagattccattggatttagatgatggagtcaatgttaattatgaaaaattggggactattcttaaaaagaggtag

SEQ ID NO: 2523 - DNA, 3648 bp, Fusobacterium sp.
atgaataaaagtagcttaaaaatttttgcaatagaagcaagaaaagaattaatggaaaaaatgagaactagacttgaaattcttggaataaataaaaatggaatagaaaaagcaaaagttataggaaaagaggttgaagtaaaaggaacactttatccaaaagaaagctatgatagtttaattagaaaatataaacaagttggctatgaagaacttatagaagaaagtgcttacacttggttcaatagattaacagcattagcatttatggaagcaaatggatatattgaagagaaaatgatatttaacaatggtgttaaaaatgagcctgtaataattgataattattatgaatttgaattttttaaaaatttagataatgatttacaaaaagaattgcataatttaagagatgaaaatacaccaaattcaatagaaaaactttattctattttgatggaagaaaaatgtgaagatttatcaaatattatgccatttatgtttaagaaaaaagggacttattcagatattttatttccaacaggtttattaatggaaaattcattgttagtaaggcttagaaaagaaataggagaagaagcaccaattgagctaataggttggctttatcaatattataattcagaaaaaagagaagtcgtatataatggaagtatgaagaaatcaaaaataaataaagaatatatagcaccagcaacacaattatttacaccagattggatagtaaaatatatggtagaaaattcattaggaaaactagcattagaatctactggaataaatgaaaatcttaaaaataattggaaatattatatagattcagaaaaagaagaaaatttagaaaaaataaagatagaagatataaaaatattagatccagcaatgggaagtgggcatatattggtttatacttttgatttattatttgagatgtacgaaaatcttggctggagtacaaaagaaagtgtgctatcaatattaaaaaataatctatatggattagaaatagatgaaagagcaggacaattagcttcatttgcccttatgatgaaagcgagagaaaaattttcaagattattttcagtattaaaaagagaagaaaattttaaattaaatactttaataatagaagaaagtaatagtttgtctgaaagaattagaaataaaataaaaaataataacttaaataatcttaataaaataatacaagagtttgaagatgcaaaagaatatggaagcattttaaaattagaatctattgataaagaaatattaaaaagagaatttaatatattaaaagaaagttttaataataatgaacaagaaacattaatatttaatgaagacgaaatgattataaatattaatgaggaattagagcttattgaaaatttaataaaacaacatacaataatgacagataaatttgacataactgttactaatccaccttatatgggaaatagtaggatgaatggaattttaaaagagtatattgataaaaattatcctgatgtaaaaagtgatttgtttgcagtgtttataaaaaaagttataagttttaataaagaaaatggatttattagccttgtgtctccatatgtatggtggtttataaaatcatatgaggaattaagaaactatattttaaatcatttaactttttataacttaattcaattggaatataatgcttttgaaggagctacaattccagttggaacatttgtgttaaaaaataaaataattccaaattataaaatgattggaataaaattatctgattttaaaggaattgaaaatcaaccaataaaaacattagaagctattaaaaatccaaattgtaattggagatttcaagctaaacaaaaagattttgaaaagataccaggaagtccaatagcttactgggtaagtgataaggtaagagaaatatttaaaaaaaatcaaaaattaggagatattggagaagcaaaagttggattacaaacaggagataataataaatttttaagattatggaatgaagttaattataataaaattggttataatatgtcaaactcacaggaagcattaaaaagtaaaaagaaatggtttccatacaataaaggtggagaatttagaaaatggtatggaaatcaagaatatttagttaattgggaaaatgatggatatgagattaaaaatttctatgatgagaaaggaaagttaagatcaagacctcaaaatactgaatattattttaaagaatcaatttcttggggattaataacttcagctggttcttcatttagatattttccaaaaggttttatatttgatataagtgcagtaagttattttatagaaaaaaaagaaagagaaattttgggaattcttaattcaaaatattttctagaactttctcaaattattaatcctacaataaatttttctaatggagttttcgcattattacctgcattgtttgtggaaaatgaaaaatttaataatctagttcaacaaaatataaatatctcaaagaaagaatgggattcaagagaaacttcttgggattttgaaaaactatctttaattgatggaaaagatttaaaaaatgcctatgaaaattattgtaatcattggagagataattttgttcaactacataaaaatgaagaagaattaaatagactttttatagaaatttatgatttacaagatgaaatggatgaaaaagttgcttttgaagatattactatattaaagaaagaagctaacattattcaaattgataatagtattccaaaaaaattctcaacagaatcagaaaaatatttatatgatagaggagttagtttagaatttaataaagatgaattagtaaaacaatttttatcttatgctgttggttgtattatgggtagatattcaataaataaatctagacttattatagcaaatagtgatgatatattagaattatcagaaaataagtttattgttaaaggctctgatggagaaataagacaagaaattgaaagtaaatttttacctgatgaatttggtattattccaataacagatgagaaagatttttcaaatgatatagttgagaaagtaaaagagtttataaaggttgtttatggggaagggaatttaaaagataatcttaattttatagcagaagcattaggaaataaagataataaacctgctgaagaaattattagaacatattttataaaagatttctattcagaccatttacaaagatatcaaaaaagaccaatttattggctaatgaatagtggaaagaaaaatgctttttcttgtttgttctatatgcacagatataaacctttaacagttgcaagagtgagagcagattatttgataccttatcaagaaatgttagaaaataagagaaagtttatagaaagacagttatcagatgataatatatcagcaaaagaaaagaaaaatattgaaaaacaattaaaagaattggatacattgttaaaagaattaagagaatatgctaatgaggtgaaacatattgctgaacaaaagattctattggatttagatgatggagttaatgctaattatgaaaagttgggggctattcttaaaaagaggtag

SEQ ID NO: 2524 - DNA, 1556 bp, Acinetobacter lwoffii
atgaataccagtaatattaaaaaatacgcaccgcaagcacgcaatgattttatcgcagccatgcgcaagcaggccgccaagtatggcatcaccgcagacagcattttaccggctgaacagaaaggcgacttgctgctgattggcgatcaggtttttccgctatccgtcatgaaaactcgtgagaagctgatcaagcgcattcaaaccagcagttttgagcagacgattgattatatcgcttacagctggtttaaccgtctctgtgcgattcgctacatggaatgcaaaggcttactcgatcatggccgccgtgtgctgagcagtgctgatggcagcgccggcttgccgcagattctggaagaatgtctggatattgacctaccgggtttaaatgccagccgtgtggctgagttaaagttggatggcaataaagacgaagaactgtaccgggaactgttactggcgcagtgtcatgcgttaaatcaggtgatgccactgctgtttgaacaggtttctgatgagtctgaactgttactacctgacaatttaaccaaaaccgattccttgatccgtgatttggtgagcaacattccggaagaagactggtcggatgtacagattattggctggctgtatcagttctatatttctgaaaagaaagaccaggtgattggtaaagtcgtcaagagtgaagatattcctgcagcgacgcaattatttaccccaaattggattgtaaaatatctggtgcaaaacagtgtcggccgtttatggatgatggcacagcctgatagtacgcttgccagtgagtgggaatactatattcagccagcggaacagaccgatgaagtcaatgcacagctaaaacagctgattgatgcgcggatcagtgaagatggcgatactttaaaccctgaaagcattacggtactcgatccggcttgtggttcggggcatattctagtagaagcttatgactgcttaaaagcgatttatttagaacgtggttaccgtagccgagatattccacgtttgattttggaaaataacttgtacggcattgatattgatacccgtgcagcacagctctcaagctttgcactattaatgaaagcgcgtgaggatgaccgccgtttatttagcaatccaccgaagctgaatattattgcactgcaagatagtcagcctgagcgtttagatgcattcacccaggacttggcaagtaccggtatcgaagagtcagatttaaaagaattattagacctatttgaacattcgtcaacctttggttctttaattcaaatccctcaagcatttgctaaaaagctacctgaattagaaacaaagttaaatacagcattagattcaggggatatttttgcacagcagtcagcacaagaactgttacctttagtacaacaagcgaaattactcgctaaacaatatgatgcagtgattgcgaatccgccgtatatgggtaataagtacttaaatccaaatcttaaaacctatttaaagaaaaactatctaggctatgaaaaagatttattctcagc

SEQ ID NO: 2525 - DNA, 1896 bp, Acinetobacter lwoffii
atggtttggatgtttatttcatcttatgaaaatttaagaacctattttattgatcaagcaattatctatagtttaattcagcttgaatataatgcctcaggtgaggttcgagtccctttatgtgcatttattttatcaaagcaacatattgctaattttattggttcatatatcagactaacagaatttccgggttacgatgttcaaccggtcaaaacgttagaggcacttaaaaatcctaaatgtggctggttttacactgcaaaaccagatgattttaagaaaattccaggtagtcctttagcatattgggtgagtgaaaaggtaagggaaatttttgagaaaagtccttccttaggagaggtagctgatgcacgacaagggcttgcaacggctgataacaatcgctttttacgtttatggcaagaagtcaatattcagagaattagctttggaatggaaaaccgagaacaagcccaattttcagcaaaaaaatggtttccttataataaagggggcgagttccgtaagtggtacggaaatcaagagtatctaataaattgggaaaatgatggaaaagaattatttgatttcattcctaaatcagtcatccgcaacccttcttattatttcaaaccatctgttggctggtcaaaaataacatcctctcttttttctatgaggtatttcccaactggatttatttttgctgatgctggaatgtcagtcttcgccgaagattcaacaattaaaaaagttatgggttgtctaaattctaaagtatcagaaacactcttatcgaatatgtcacccacgttaaattttgaggctggcacaataagcaaattcccattaatagaggatatcaataattatcaggaagttatagatcgacttattacacaatctaaaaccgactgggattcttacgaaacctcttgggacttcactgaaaacccaattatccgtacggggcaaccaaatctagaacaagcctttaatacatggcaacagcaaaatgctgacgccgtcgctgaaatgaaacgtctggaagaagaaaacaacaagctatttattgatgcttatggtttacaggatgaattgatgccagatgtaccagatgagcaaattacccttacccgtgccgaccgtgaaaaagacagtcagcgtttagtgtcttatgcactgggttgtatgatgggacgttatagcctagatgaaccaggtttgatctatgcccatgcaggcaatcaagactttgatgccagccgttatcaaacattcccagccgatgcagacggcattattccactgaccgaaatgcactggtttgaagatgatgctacgcgccgtattcaagagttcctaactgctgtttggggtaaagacacactggataccaatatgcagtggctggcagaaagcttggataaaaaagccaatgaaaccgctgaagataccattcgccgttacttagccagcaagttctataaagaccacatgcagacctataaaaagcgtccgatctactggttattcagcagtggtaaacagggggctttccaggcattggtgtacttgcaccgctataacgaaagcaccttggcacgtatgcgtaccgaatacgtgatgccattgatttctaaaatggcggctatggtgaattctttgcaaagtgaaatcgaaaacagtgattccgctgctgaaattaaacgtaaagagaaagaactacaaaatctgcataagcaacaggctgaactgagtagctttgaggaaaaactgcgccactatgccgatcagcgtatttcactggatctagatgatggggtgaaagtgaactacggcaagtttggggacttgttggctgaagtcaaagcagtgacgggggaaaagtga

SEQ ID NO: 2526 - DNA, 3555 bp, Lactobacillus casei
atggataaaaaagctatcaaaacatttgcgattcaggctcgccgcagtttgattgaaagcattaaattgaaacttgaaaatctcgggattaccaaggacggcgttgctgagaaaatgtctcagtccacaaacgaaattgaatattacggtgacaaaggattgtcaataacgggccaggatattcgccgacgtcgtgaactagttgcccgacttaaaggcatggcaaaacaagaagagtggtcagatgcattaacagatttgatcgaagaagttgcctacacatggtttaaccggattattgcaattcgctttatggaagttaacgaatatcttccgagtggcgtacgggttttgtcgtcggaaacaaagctaaaggtgccagacatcttgcgagaggcttttgaaattgaagatgatcttggtgggtatagtgttgatgaacatgaaattattcaaaaagcacttgatactgaggatccaactgatatggatgcagcctacgttattctctttactaagcaagcaaatgcactaaatcactatctccctgagctttttgagaaaactgacgatttcatgcaattattgttcactccaagctattcttcgggtgtcattaaggacttggttgatgacattaaggaagatgattttgatgtggataagggcgggcaggtcgagattattgggtggttgtatcagtattacaatattgagccacatgacaaagttgtcaatattaatggcggcccaatcaagactaatgacatacctgcggcaacacagctgtttacaacggactgggttgtacgctatatggttgataactcgctgggtcgattatatctggagtacttccctgattcgccaatcaaggcgaatctgacctatcttctgcctggcccaattgagacacgcacggattcatttgatctttcaaagctcaaagtgttagatgacgccatgggttctggccacattctggtttacgcattcgacttgttaattcaaatgtatgaagaacaaggttacggcaaacgagatgcgacagatgcgattttggcacacaacttgtatggactagagatcgataaacgcgcctatcaacttgcttattttgcactaatgatgaaggcgcgccaatacaatcggcgaatcttaagcaaaccagttcgacacaatcttcatgtgtttgaatcaactgttgatgtgccaaatgaagtgtttgaaaaaatgaatgcatccaaagatacccttggtgacttacacacgctggtgtcaattttcaagcaagcaaagttgctcggatcaattatgcattttgaaaagaagtttgattttgatgcattattcagcgctgttaattcattaccagattcaactcagttggacttatttggccttcaagcggcgaagaactcccttctcggcattctgaagattgctcaagttcttcagactcattttgatgttgtcgcgacaaatccgccttatttgaatcgaatgaatggcgatcttaaaaagtacgtcaaaaaatactataaagcttattcaggtgatctcttctcggtgtttatctggaagaacattgagatgaccaagcaagatggatattctgcttacatgacgccattcgtttggatgtttatcaaaacttatgaaggattgcgtaagtcaattttggactctaaacaaatctctagtttaattcagatggaatactcagcatttgaggaggccactgttccaataaacacttttgttttaaagaatgatatgagtgcggattcaactggtacttatttaaaactttcagatttcaagggcggcatggaagtgcaaagaaggtatgtgctgaaagctgttgctgatccttcagtgagttatctgtatcgtactaaacaaacgaactttgagaagattccagggagtccaattgcatactgggcaagtaacaacttgatccggagctttgagatcgggacgcctctgaaagatcttgtacagcccaaagtgggattacaaaccggcgataataacagatttcttcgtcaatggtacgaagttgagccatttcggattagtttcacctctacaagcacagaggacgccttaaaatcgggggaaaagtggtttccttataataaaggcggatcatatcgcaaatggtatggcaactatgattatgttgttaattggcaggatgatggatacgaaataaaacactttgttgattttaatggtaaagtccgatcgcgtcctcaaaacacggattattactttcgtgaggcgataacatggtctgatgtaactagtgggcatttcagtatgcgttatagaaaagaaggctcaattttcgacgttgttggaatgtccttattctcgtctgataccaaaaggctcttacaaatcctactattttctaatacaaaagtaatgaattatattatgagttttttaaatccaactatacatgcaagcatcggttatgttagcctgacaccaataatttttacggagaatacagctgcttttgatctagcaaatcaatgccttgccaatactgaaaaagactggaattcatatgaaaactcttggagcttccaaaaaattcccttattggacaatattgctgatcatcatcgaaattggactgtcgagggtgcttttaaacaatggcagaaagaggcggatgatcgttttaaccagttgaaggccaatgaagaggaactaaatcgaatctttattgatttgtatggcctacaagacgagcttagtcccgaggaggaagataaagacgtatctgttagacgcgcttgcttgcctcgcgatataaaagcttttatgtcgtactttattggttgcgtctttggccgatactcaattgacacacctggacttgcttatgctgggggagattgggatgccagtaaatataagactttcatcccaaacgaggacgatgtgattctgctaactgatgacgattactttggtgatgaccgggatgtcatgaatcgctttaaggagttcttgacgactagtttcggttcggaaaatttgaatgagaacttgaaattcattgctgatgctttaggtaaacggggagaaagttctgaagaaaagattcgggcttatcttcgtgatgattttttcaagaaagatcatctatcaacttatcagaagcgaccaatatattgggaattcaattcaggacgaaatggcggctttaaggcgctaatgtatttgcatcgttatgatcggaacactgtcgcgatgattcggactaaatacttgcatccccttcaagaagcttatgagcgcaagcttgtacagcaaaaaaaattagaagaagacgagcagcagacccgtcaaaaaaataaatataagaagcggatcaccacgattaccaaagaattggacgaattgattaagtacgatgaaaagttacaacacgttgcaaacctgcatattgatcttgatttagatgatggtgttctggtcaatcatgccaaagcacaagctgatacaaaaattttgacaccattaaagtga

SEQ ID NO: 2527 - DNA, 3606 bp, Escherichia coli; identical to SEQ ID NO: 2494

SEQ ID NO: 2528 - DNA, 3534 bp, Acinetobacter sp.; identical to SEQ ID NO: 2261

SEQ ID NO: 2529 - DNA, 3741 bp, Vibrio cholerae; identical to SEQ ID NO: 2398

SEQ ID NO: 2530 - DNA, 3480 bp, Holdemania filiformis
atggataaaaatgcgataaagaaatatgctgtctgggcacgaacagagttgattgagcgtgtgcgccagagagcgttgaaatatgaggtggcagctgatgccgatgccaatgccgacagtgcatccggcaaggtgctgactgacattgaaaaaacacagcgtgcagcaggcattgcccgtatgcgtgaaaaaggctatgagtatgtgattgaagaggtcgcatacacatggttcaaccgctttgctgccctgcgctatatggaagtgaacaactatctgcctacaagggtgcgtgtgtttaccgatgagaacggtaatttcaaaccacagattcttgccgaggctatccacctggatttggatggactggacatggaaaaggtctatgccctaaaggaagcagaaaacaacgacgagctgtataagtatctgcttatcacccagtgcaatgcactgagtgctgttttgccgcagatgttcaagccagtggatgaacgctgtaaagaagaaaagaacgattataccattctgctgttcccggacaaccagctccgggagggcagtgtggttgagcagatgatagcaaaaatcccggaggataactttgatgttaattccgaaaatggtcaacttgaaataattggttggttgtatcaatattacatctcggaaagacatgaagaagtcgttaatattagtaataagggagcgataaaaaaggaggatatcccggcggcaacgcagttgtttacgacggactgggtggttcgctatattgttgataattcggtggggagatattggattgaaagaaatccagaatcagcattggcaaatgagttggagttctatgtaagaccgcaaaacttatcatctcttgaagcactaaaaaaagtttcaccggaagaaatcacgttttttgacccctgtatcggttccggacattttgcaatttatgcatttgatgttttgatgaagatatacacagaatatgggtattcacaaagagatgcagttgcagcaattgttgagaaaaatatatacggtttggatattgatgatagagcttctcagcttgcttacttctctatcatgatgaaagcgtgtcaatatgatagacgattttttactcgaaacattcagccacacattttgtctataaccgaaagcaatcaattggattcgtattgcgtggattacttctgcaacggtgatacttcacttaaggaaatgatgagcgaaattgaaaaatgtatgcataatgcaaaagaatatggctcattgcttacaattccagatttagatttttgtaaattgcgtattcgattggaagaaattaaagaagacattagtattgtccgggaggcaacgatagcacagattaaaccattgattgatgtggcagagatactatcccaaaaatatgcgatagttgcgaccaatcccccatatctcaatagatacaatgagacactgaaaacatttattttggataaatataaggattattctggcgacttgtttagtgtgttcatgtaccataattttaatttcacgttgcctgatggttattgcggttttatgactccgtttgtgtggatgtatattaaatcttatgagaaattaaggaaatacatcattaataacaaagggattgctaccttgatacaaatggaatactcggcatatgaagaagctactgttcctgtttgtgcatttgtgttagcgaacgaatgtgatgtggaagttggagaatatttcgatttatcaaaatatgtaggtggcatggaggttcagaagaaaaaagtattagaggcaatagcgaatccgaaatgtggatatttccatgaatttgagaaaagaaattttgaaagaatagatggaaatcctatagcatttatggcaagcgaacgattgttgcaaatctttgaaaccgcaaaaccattgaaacaaattgcagagccaaaagtcggattgcagacagccaaaaatgatattttcttaagattgtggtttgaatgtgattttactaaaatcggttttggttatacaaatttggaggatacacaaaacggtctgcataaatggtttccgtataataaaggtggagcattccgaagatggtacggaaatagaaattatgtaattaactgggaaaatgatggcgaaaaagttcgtgtatatccgggagcagttattcgaaatccacagttttatttgaaaccttgcattacttggtcggatattacaagtgcatcattttcagggcgttattgtgagggagggttcctttttgatgtaaaagggtcgagcggatttccggaagtaaaaaatttgaattatgtgttaggttttctaaactcgaagatttcgcaaaaatgcattaaaatactgaatccgacgatatcaacacaagtgggtgacatggcaagaatacctgtctattttgaacaatcacacaaagaagaaattgacagattggtatgcgaatgtattgaaatcagcaaaagggactgggattcagatgagctgtcttgggactataagaggtgtccccttatacaaaaaaatatgacattgcagcaggcatattcttcatggaaacaaaaaaacgaggcgagttttgtaagattaaagtctaatgaagagcagcttaatcaaatctttataaacatatatggtttagggggtgaggtgactgctgaagttgatgataaatctgttgaggcttcgtgcaagcacatgacaaaagaacaagctgtgaaaagcttgatttcctatgctgttggatgtatgttcggtcgttattcacttgataaggaaggtcttgtttttgcaggcggagtatgggacacttcgaaatataaaatctttcctgttgataaggataatataattccaatatgcgatgatgagtattttgatgatgatattacgggtctgttcgttaagtttattgaaactgtttatggaagagatacattagaagaaaatctttgttttgttgcggatgcattgggaggacagggaacgcctaaagacattatacgtgagtattttgttagtgataaaggtttttatgcagaccattgtaatatgtatactgtgactggcgcagggaaacgcccgatttactggctctttgactccggaaaaaagaacggcttcaaagcactggtgtatatgcaccgctatcagccggataccatcgcccggatgcgcaccgactatgttcacgagcagcagagccgttaccgcaccgctattaccgatttggagaatcgcatcgtagatgccactacttctgaacgtgtgcgcctgaataagcagctttctaagctccatgaccagagcgaagaaatccgtaagtatgaagagaaaatccatcaccttgctgaccagtatattgcaattgaccttgatgatggcgtgaaagtgaactacgcaaagttccaagatgtgttagcaaaaatcaagtaa

SEQ ID NO: 2531 - DNA, 3627 bp, Enterococcus faecium
atggataagaaagcgataaagaatttcgcggtcaatgcccgtagaaaattaattgatgaagtaatgactaaagcaaaacgtttaggaattgatgaatcaaaaattgaagatgtgaagaaaattgatagcaatttacaagaaatcgaaaaatcaggaataagaattcaaggaaaagaaatagcgcaaagaaacaaattgattgcagaactaaaacaacgtgcttctgtcacttcttattcagaagcttttcaagagttaatcgaagaggttgcttatacgtggtttaaccgattgattgccattcggtttatggaggtaaatgattatttacctgacacgtatcgtgtattatctagtgaaataagtgggaaaattgagccagatattattacagatatttatgatgccgatatctttgaagaattatctagtaatgaacagcaacaagtcagaacttggaaaacagataattcagcagaagcaatggacaagctgtatcaattgatttttataaaaatctgtaatcaattgaatgattacttacctgagctatttgaagaagtagaagattatacagaacttttgtttacagcttcttatattaaaaaagatggcgtaatcgctgatcttttaagtattccagaggatgatttcaatgttcaagctggtggacaggtagagattattgggtggttgtatcagtactataatagtgagccacataataaagtggtgaatatttataaagggattgtcaaaaaacaagatattccggcagcaactcaactatttaccacagattgggtcgttcgttatatggttgacaatagtttaggaaagtattggttagatcgttatcccaatagtgaattaagaaataagttgaaatacttaattcctgataaatatgcttttaaacaagcaacatctgtaagtaatttaaaaccagaagaactaaaaattatcgataacgcaatggggtctgggcatattttagtttacgccttcgatgtattgatggaaatttatcttacgttaggatattctgagcgtgatgctgcacgtgcaatcgttgaatacaatttatatggacttgagatcgataagagagcgtatcagttgtcttattttgcaattatgatgaaagggcgtcaatacgatcgtctttttttgaaaaaaagtctatcgccgaatttaagagagtttattgattctcctaaagtgacagacgagtatcaagagcgtattagtgaattgaacaatgataaggatagtgaacgctggaatgaatacaaagagttaatttttgatcaatttgaaaatgggaaagaacttggatcaatcattaagttagtcgataaaaataatcaggcaataactaaagaatacttaggaaaagtaagagagtatatatcaaaattcaatgaatttacgaatatggatattctttatgggatgaaggaaatacaagaaaaatacttgcacattcttgacgtggctgaaatgctagttgataaatatgtagcggtagtcactaatccgccttatcttaataaaatggataagaaattaaaaaaatatgtaaatgataactattctgatgtcaaaaaagatctattttctgtgtttattaaattgaatagccagatgctgattgataatggatatgcttcctttatggcgccatttgtttggatgttcatttctagctatgaaaagttacgctcatttttaattaatgaaagaaacatttctagtttgattcaaatggagtattcatcttttgaagaagcaacagttccactctgtacgtttacgataaaaaattcaaatgaacaagagggaagctatatcaaattatcagattttacaggtggaatggaagttcaaagagtaaaagcgttggaagcgattaatcattatgaaagttgtaactatttctattgtaccaaccaaaataacttcaaaaaaatcccagaaaaaccaatcgcttattgggcaggtaagaatttatttcgaaattttgagattctcccaagtatcaatgaatttgttgatgttaatcagggattgataacttccaataatgataaatttttgagattatggtgggaagttgagtttgacaaaataaaattcaatgcaaaatctttaaaatgctttgtcaactctggtaagaaatgggcaccttataataaaggtggatcttacagaaaatggtatggaaattatgattatattgttaattgggagaataatggagctgaaataaaaaattttattgatgataaggggaaagtaaggtcgcgtccacagaatattaagcattatttttttgaagctttaacatggtctgaaattactagtagtaggttttctttgaggtatagggaatatggaagtattcatggaaataaaggaatgtcagcatttagtactaatcatttatctatgatgaatattttagcagtggtgaacagtaaagttggagattatatcttaaatattttaaatccaacaatttcactgggggttggagattttaaaagatttccaattaaagtaataaattcaattgatatagataaaatatcagagaacttagtagacatatataaaaaagattgggattcttatgaactatcatggaattttaatagacatccattattaaaaaatatttttaaagataatattttacgacaaagtatcaaggatttagaacaggattgcgttaaaaatatagaagtagcgatagaaaacgaagaatatttgaacgtctgggttataaatgagtatggactgaatagtgagttatcatattcagttaactcttcagatgttggattaagaaaaggaaccaccaaaagcgaaataaaatcttttatttcgtacagtatgggtgttatatttggtcgctactccatagacgaagatggtctcatctacgccggtggagaatgggatccttctcgctatcaaaaatttaaacctgatgctgataatgttttactcatcaccgatgatgagtatttcaaagatagccaaattgacattgtcaatcgtttcattgatttcgttgagattacttttggtaaagaaactcttgaagaaaatctccagtttatcgctgacactttaggtggcaaagggacaagtcgagaaattattcgtcgttactttgtaaaagatttttacaaagaccatttaaaaacatactccaatcgaccaatttattggcaattggactcaggaaaacaaaatggctttaaagcgttaatgtacttgcatcgctatacaccagatcaattaggaaaagtacgtactgaatacctacatgaattacaaaaagcgtatgacaatcgaatcgaattgcgtcagcagcaaatttcaacaagtgataacccaaaagaaagaaatgcaatgacaaaagaaattgcaaagattcagaagcaattaaaagaagttcgtgagtatgacgagaagttgggtcacttagcattaaaacgaattgaattagacttagatgatggtgtgattgtcaactatgataagttgcagcgtgatcctaaaaccggcgagaaattccaaattttggcaaaaggggtcaaagaaccaaaaaaatag

SEQ ID NO: 2532 - DNA, 3636 bp, Fusobacterium sp.
atgaataaaagtagcttaaagatttttgcaatagaagcaagaaaagaattaatggaaaaaatgagaattagacttgaaattcttggaataactaaaaatggaatagaaaaagcaaaagttataggaaaagaagttgaagtaaaaggaacactttatccaaaagaaagttatgatagtttaattagaaaatataaacaagttggttatgaagaacttatagaagaaagtgcatatacttggttcaatagattaacagcattagcatttatggaagcaaatggatatattgacgaaaaaatgatatttaacaatggtgttaaaaatgagcctgcaataattgataattattatgaatttgaattttttgaaaatttagatagtgatttacaaaaagaattgcataatttaagagatgaaaatacaccaaattcaatagaaaaactttattctgttttaatggaagaaaaatgtgaagatttatcaaatattatgccatttatgtttaagaaaaaaggaacttattcagatattttatttccgacaggtttattaatggaaaattcattgttggtaagacttagagaagaaataggagcagaagcaccaattgagctaataggttggctttatcaatattacaattcagaaaagaaagatgaagtttttgaaggtttaaagaaaaataaaaaaataacaaaagaaaatattccagcagcaacacaattatttacaccagattggatagtaaaatatatggtagaaaattcattaggaaaactagcattagaatctactggaataaatgaaaatcttaaaaataattggaaatattatatagattcagaaaatgaagaaaatttgggaaaaataaagatagaagatataaaaatattggatccagcaatgggaagtggacatatattagtttatgcttttgatttattatttgagatgtacgagaatcttggttggagtacaaaagaaactgtgctatcaatattaaaaaataatctatatggattagaaatagatgaaagagcaggacaattagcttcatttgcacttatgatgaaagcaagagaaaaattttcaagattattttctgtattaaagagagaagaagattttaaattaaatactttaataatagaagaaagtaatagtttatctgaaagaattaaaaataaaatagaagctaataacttaaataatcttaacaaaataatacaagagtttgaagatgcaaaagaatatgggagtattttaaaattagaatctattgataaagaaatattagaaagagaatttaatatattaaaagaaagttttaataataatgagcaagaaacattaatatttaatgaagatgaaataattatagatattaatgaggaattagaacttattggaaatctaataaaacaacatataactttaacaaatcaatatgaaacagtagtaactaatcctccttatatgggaggaaaaggttttagtccaaaacttaaaacttatgttgagaagaattataaggatagtaaaagtgatttatttgcagtatttatagaaagatgtaatgagtttacaaagaaaaattgctatacttctatgataacaatgcaatcttggatgtttttatcatcttttgaaactttaaggaagaatattattgaaaaaactgagattaaaagtttaaatcatttaggaacaagagcattttcagaaataggtggagaagttgtatcaacagttgcttggataagtaaaaagataagccctaaaaatgagggaacatatataagattggttgattataataatgcagaattaaaagaacaagaattttataatagagctaactattttcaagctaaacaaaaagattttgaaaagataccaggaagtccaatagcttattggataagtgataagataagagaaatatttgaaaaaaatcaaaaattaggagatattggagaggcaaaacaaggattagcaacagcagataataatagatttttaagattatggaatgaagttaattataataaaattggttataatatgtcaaattcacaagaagcattagaaagtaaaaagaaatggtttccatgtaacaaaggtggaagttttagaaaatggtatggaaatcaagaaataattgtaaattgggaaaaagatggttttgaattaaaagattttaaaaattcagttataagaaatccaagttattattttaaagaagcattaacttggtctactatatctagttcagattgctcatttagatattctccaattggaaatatatttgaaacaaaaggatctaattattttgtaaaagattataaaaatttttattatttatttggatttttgaatacaaaaatagttaattatttactaaaaattatttctccaacattagactatcatgaaggtcctatgagtaatcttcctgttacattagaggatagttcaataaaacttgaaataattaataattttattatagaaaatcttaatatctcaaaagaagaatgggattcaagagaaacttcttgggattttgaaaaactatctttaattgatggaaaaaatttaaagactgcttatgaaaattattgttctcattggagagaaaattttgttcaactacataaaaatgaagaagaattaaatagactttttatagaaatttatgatttgcaagatgaaatggatgaaaaagtttcttttgatgatattactatattaaagaaagaagctaatattattcaaattgataatagtattcctaaagaattttcaacagaatcagaaaaatacttatatgatagaggaattagtttagaatttaataaagatgaattagtaaaacaattcttgtcttatgctgttggttgtattatgggaagatattcaataaataaaactggacttattatagcaaatagtgatgatatgttagaattatcagaaaataagtttattgttaaaggtactgatggagaaataagacaagaaattgaaagtaaatttttacctgatgaatttgctattatcccaataacagatgaaaaagatttttcaaatgatatagttgaaaaagtaaaagagtttataaagtatgtttatggagaggaaaatttaaaagataatcttaattttattgcagaagcattaggaaataaagataataaacctgctgaagaaattattagaacatattttataaaagatttttattcagaccatttacaaagatatcaaaaaagaccaatttattggctaatgaatagtggaaagaaaaatgctttttcttgtttattctatatgcacagatatgaacctttaacagttgcaagagtgagagcagattatttgataccttatcaagaaatgttagaaaataagagaaagtttatagaaagacagttatcagatgatgatatatcagcaaaagaaaagaaaaatattgaaaaacaattaaaagaattggacacattgttaaaagaattaagagaatatgctaatgaggtaaaacatattgctgaacaaaagattacattggatttagatgatggagttaatgttaattatgaaaagttgggggctattcttaaaaagaggtag

SEQ ID NO: 2533 - DNA, 3609 bp, Clostridium butyricum
atggataaaaataaggtaaaatcctttgctatttgggctagaagaagcctaattgcagcagttagtgaaaaggcaaatagaataggaatatcagaaggcaaaattgaagaagcaacagcagtacaaggtggatttattgtagaagggaaagaagagttacattatttccctaaaagtcatagagatgcattagtaagtcaggtaagagaaaagggatttgagcaagtaatggaggaagttgcatatacttggttcaatagatttatgggacttagatatatggaagttaatgattatcttccaactggagttagaatactttcatcatctattgaaggtaaaatagagccagatgtattaactaaggtatcagaaattatagatgagttagggttaaatgctaatgaaatatatgatttattagatacgggagatacgttagatagagaaaaagcatataggattattttagtaaaacaatgcaacgagttaggtaaaataattcctcaaatgtttgaaaaaataagtgattatacagaacttctattacctgataatttattagaagatagttcggttataagaaaaatggttgaggatatagaagaatcagattggcttgaagaagtagagataataggttggatgtatcaatactatatttcggaaaagaaagatgtagtatttgcagacttaaagaataatgtgaaaataacaaaagaaaatattccagccgcaacacaactatttacaccaaaatggatagttaagtacatggtagaaaattcattaggtagactatggcttgaaggacattcaaatgaagaactacaaaaggaatggaaatactacttacaggaatcagaacaagaaccggaagtagaagaagagttaaataaaataagagaagaacatgcaaaattaaaaccagaagatataaaggtgttagatccgtgtatgggttcggggcatattttagtttatgcttttgatgtactttatgaaatatataaaacatcaggatattcagagagagaaatacctagattaatattacaaaaaaatttatatggattagatatagatgatagagcagcccaactagcagcatttgcattaataatgaaggctaggcattataatagaagattatttagagaaataggaagggaaggtttagaattaaatctatgctcaatagaagagagtaatgaaataagtaatgatattattgagtatttttctaatgggaatgaaaacttagaaaaagagtttagatatttaatcgagaaatttattgaatctaaagagtacggatcaattataagattagacaaagtagattttacaatgttaaataaaagattagttgaaatagaaagtgaaaataattttatttttggtgattatagggaaattattttaaataaagtttataagattattaagcaatcagaaataatgaccagttcatataatatttgtgttactaacccaccttatatgggtagtaaaggtatgagtgataaattattcaagtatgtagatattaattataaaaaatcaaagagagatttaagtacagtgctaatggaaaagtgtagtgagtttacttgtaatagtggatatttagcaatgataaatatcccaacttggatgtttttaacttcatatagtgagttcagagaggaattaattaataatgagatatttataaatttaatacatcttggtagaggagtatttggttcagattttggaacagttgcatttgtattatctaaatattctagtaagaaatttaaaggattatttaagaagttatataataaagccggagatgtagaatcattacaagaaaagaaaaaaagattttttgaagatgttaatatatttattaatacaacaggctcctttagtagtattccaagtatgccaatagtgtattgggcatctagtgaaattgtgaaattatttaaaaaaagagatgttgttagtaattatgcagatgtaaaaaaggggttaacaacggctaaagatgatacgtatttaaggttatggcatgaaataagtaatgaaaaatttgttttattttctaatagtaattcaaaatggcatcctataactaaaggtggaagttatagaagatggtatggaaataatgagtatgttgtaaattgggaaaataatgggatggagttgaagtcatttaaaaattcagtaattaggaatgaacaatattattttagagatggaataacttggacatatataacaaatggtaaatttaacttgagaatatttgataacagaaatataataacggcagcaggaccaggaatatatggagataatattaaatatttattggggtacttaaactcatcagtcgcacaatatctgattaatatgataggtgggcagacgataacatatgaggtaggggaggtcgcaaatataccgataaaatcagttaagaatgcggaagtagaacaatatgtagataagtgtataaacatagcaaagcaagattgggatcagtatgaacaatcatgggattttaagaatcaccaattattggaatgcgttaacgaaaatggttcacataaaattgagactatattttcagattgggaaaatagatctaaagaaacatttaaagaattaaaagatgttgaggagaaattaaataaaatttttattgatttatatggattaagtaatgaattaaaagtagaaatagaagataaagatattacaataagaaaagcagatatagaacgtgatataaaatcatttatttcttattctgttggctgtatcttaggtagatattctatagatagcgaaggtcttatttatgcagggggagactttagtgataagtggaacttggcagatagcaaggtaagtaaaatagaaaaggatgatgaaggtaacataatatctgattcatgggttgattctagatttatgcctgataaggataatattattcctataacagaagatgaatactttgaagatgatatagtttcaagatttattgattttgtaagaactgtttatggaaatgatactttagaagaaaacatagactttattgcagattctataggaagaaaagcatcagaaactgcaagacaggcaattagaagatactttattaaagatttctataaagaccacttgaagatttatcaaaaaagaccaatatactggatgtttgaatcaggtaaaaatgatggatttaagtgtttagtatatatgcatagatataatgaccaaacagttgcaaaagtaagaacagactatattcatacattacaaagaaaatatgaatcagaaataaataggcttcaattagttgtagattcggaagactatactgcaaaggatagaacttctgcgaaaaagaaaattgatagaatttctaaacaattggaggaatgtaaagagtatgatcaagttgtagcacatttagcaaatgaaaagatatccatagatttagatgatggtgtcaaggttaattatgctaagttccaggatgtaaaagtaattaactcaaaaggtaaagaagttaaaatgaatttattatcaaaaatataa

SEQ ID NO: 2534 - DNA, 3534 bp, Acinetobacter baumannii
atgaataccagtaatattaaaaaatacgcaccgcaagcacgtaacgactttatcgcagcgatgcgcaagcaagcggccaaatatggcatcaccgcagaccgcattttaccggcagaacagaaaggcgacttgctgctgattggcgatcaggtttttccgctatcagtcatgaaaccacgtgacaagctgatcaaacgcattcaaaccagcagttttgagcagacgattgattatatcgcttatagctggtttaaccgtctttgtgcgattcgctacatggaatgcaaaggcttactggatcatggtcgccgtgtactgagcagtgccgatggtagtgcaggcttgccacagattttggaagaatgtctggatattgagctaccgggtttaaatgccagtcgtgtggctgaactcaaactggatggcaataaagacgaagaactgtatcgggaagtgttactggcccaatgtcatgcattaaaccaagtgatgccactgctgttcgaacaggtgtctgatgaatctgaactactattacctgacaatttgaccaaaaccgattctttgattcgtgatctggtcagcagcattccggaagaggattggtcggatgtgcaaattattggctggttgtatcagttctatatttctgaaaagaaagatcaggtgattggtaaagtcgtcaaaagtgaagacattcctgcagcaacccaactcttcaccccaaactggattgtgaaatatttggtacagaacagtgtgggccgtctatggatgatggcacatccagaaagtaccctatccattgattgggaatactatattcagccagcggaacaaagtgatgaagttaatgcacaactgaaacagctgattgatgtacggatcagtgaagatggcgatactttaaaccctgaaagtattacggtgctggatccggcctgtggttcggggcatattttggtggaagcctatgattgcctaaaagcgatttatttggaacggggttaccgtagccgtgatattccacgtttgattctggaaaataacctgtacggcattgatattgatacccgtgcagcacagctcgctagctttgcgctgttgatgaaagcacgtgaggatgaccgccgtttatttagcaatccaccgaagctgaatattattgcgctacaagatagtcagcctgaacgtttggatgcattcagtcaggacttggcaaataccggtcttgcacaggcagatttaaaagagttactgggtttatttgaacactcttcgacctttggttctttgatccaaattcctgcagcattctctcaaaagctacctgaattagaaagtaagctcaatacagctttagaatcaggggatatttttgcgcaacagtcagcgcaagagttattgcctttcgttcaacaggctaaattacttgctaaacaatatgatgccgtgattgccaacccgccgtatatgggtggcaaaggcatgaacacagcattgaaagattttgcgaaaaagaaattcccagacagcaagtcagatatgttcgcaatgtttatagagcgttgccaagccctttctaaaatatctggggaaacagcgtttgtaacaccttatgtgtggatgtttatttcttcttatgaggaattacgaaaaaaacttgtttctcaaaatacaattaagtcactcattcaacttgaatataatgcgtttgaaccagcatgtattcctgtgagcgcctatacgatatccaaagcacatgtaaaagattatgtgggtagttacattaagctttccgattttaaagggcatgagaaccaagcaccaaaaacattagaagctattcaaaatccaagttgtggttggttctttaatgctaaaccagatgactttaataaaattccaggtagtcctgtggcttattgggtgagttctaagacaattgaaacgtttgaggataacaaatctttatcatttttagcagaacctaaagctggactagctacaggtgacaatactaaatttcaacgtatttggtttgaagtatcattccaaaatatttcatttaactgtaaaagttgcagtgaatctaaaattctctcatcaaaatggtttccctgccatagcggtggcgaattcaggaagtggtatggtaatcatgaaacagtcgttaactggaagaatgacggcgaagaaattagaaactttcgacatgaggacgggcgacagaaatcacgtccgcagaatacgcaatttttctttaagcaaggtttaacatggacaaaactaagttctactttttttgctgttaggttccgtccaccaggttttatttttgatgatacgggacgttctgctttttttgctcacagcgaacatgaattaccgacgctagccgctgtcaattcaaaagctggacagtactttttatctatattaaatcctactatgagttttactagtggagatgtaggcaaagttccattaaatttatcttttggtgatcttcatacctctagagtagaaaatttaattcaaatagccaaaaccgactgggattcttacgagatatcatgggactttactcaaaaccctgttatccgtacggggcagccaaacctagaacaagcctttaatacatggcaacaacaaaatgctgacgccgtggctgagatgaaacgtctggaagaagaaaacaataagctgtttattgatgcttatggtttacaggatgagctgacgccagatgtacctgatgaacaaatcacgctcacccgtgccgaccgtgaaaaagacagccagcgtttagtctcttatgcacttggctgcatgatgggacgttatagcctggacgaacctggcttgatctatgcccatgcaggcaatcaagactttgatgcgagtcgttatcaaaaattcccagcggatgctgatggcattattccactgaccgaaatgcattggtttgaagatgatgctacacatcgtatccaagagttcttaactgcagtgtggggtaaagatacactggataccaatatgcaatggctggctgaaagcttggataaaaaatccagtgaaacggctgaagacacgattcgccgttacctcgccagcaagttctataaagaccacatgcaaacctataaaaagcgtccgatctactggttatttagcagtggtaaacagggggctttccaggcgttggtgtacttgcaccgctataacgaaagtaccttggcgcgtatgcgtactgaatacgtcatgccactgatttccaaaatggctgcctatgctaattctctagaaacagcaaaagaaagcagtgactctgcggctgaaatcaaacgcatcgagaaaaaactgcaagatttacataagcaacaagctgaactgagtagctttgaagaaaaactgcgtcactatgctgatcagcgtatatcactggatctagatgatggggtgaaagtgaactacggcaagtttggggacttgttggctgaagtgaaagctgtgacgggggagaaataa

SEQ ID NO: 2535 - DNA, 1725 bp, Cellvibrio sp.
atggaaaaatatttttttcaggcttcggctgaagatttcaaaaaaattccgggtgtttcaattgcatattggacatctaaatcaattattcaatcattcgagtcgggttcaaggcttggtgaccatttggataccgcacagggtatgaagactcttgacaatgagagatttattcgaagatggcaagaggtgtcgttttcaaaaattacaaaaaaaactgtatcggataaacaatgggttcctataaatcatggcggtggatttagaaaatggtatggctttcatgaatccgttttaaaatggtttaatgatggagaggaaataaaatctctcgccaaagagaaatacaactctgtgacgcgtactgttaccggtatggggcattactttgaaaatggaataacgtggagtgcaatatcgtcggatcttataagtgttaggaaatttggtgaaggttttatatttacgaatgcaggtatgtgcgcttttggtagcgaaaaaaagcaagatatttcaatggcgcttcttaattcgaaagttggagtcgaagtcttaaaaatacttgccccttcggtgaattttggccccaatcaaattggcgaaattagaattattgatcttaatgaaagcgcacacattgttcacattaactcgaaaaaattggtagtactttcaagcgaagattgggatttctacgaaacctcatgggatttcactaatccgccattattgaaactctatcacagacagcacttaatcagcgccacttatatgagactccactcttattggcgcgatatgacattaaaaatgcagcgcttggaagaggaaaataaccgcatttttattgatgcatatggtttacaggaagagctgacacccgaagtagcatcaaaagaaatcaccctcacttgtaatccctattaccgttacagcggaaacaagagcgaggatgagttaagtgcgttactacaatcagacaccatgaaagaactggtgtcctacaccatcggctgcatgatgggtcgctacagtcttgacgaacccggcttaatttatgcccacagcggcaacgaaggttttgatccaacccgttaccaaaaatttaaagccgatgacgacggcattattccgctcaccgacaaagaatggtttagcgacgatgccgccaatcgcctagaggaatttatcgctaccgcatgggatgctgcacacctagaagaaaacttaggtttcttggccgataacctatcgcccaaaaaaggcgaaagcagccgcgaaactattcgccgctacctgtgcgacagcttctacaaagaccacacccaaacctacaaaaaacgccccatctattggctattcaccagcggcaaacaaaaagcgtttcaatgcttagtgtatttgcaccgctataacgaaggcaccctagcgcgcatgcgtacccaatacgtaatcccgctcaccgccaagttagccgcccacgtaaataaactagaacaagacaaagacgccagcaccagcaccccagaaattaaaaagctggaaaaagaaatcgccacactccacaaacaacaagccgaactcagcaccttcgacgaaaaactccgccactacgccgaccaacgcatccccctggatctcgatgacggcgtaaaagtaaactacggcaagttcggggatttgttggcggatgttaaggcgataatgggaggggcgaatgagtaa

SEQ ID NO: 2536 - DNA, 1854 bp, Cellvibrio sp.
atgaacaccagcaacatcaaacgctatgccccccaagcccgtaacaactttatcgcggccattaccaagcaagccgccaaatacggcattaccgaaagcggcatagaacctttagagcaaaaaggcgatctcgcgctgatagacgggcggcctttccctgccagtatcatcaagccccgcgcggcgctcgtacaaaaaatcaaacaactcggtttcacccaagtgatcgagcaagtcgcctacagctggttcaatcgcctgtgcgccattcgctacatggagctgaaagattatttagaacatggccgccgtgtgctaagccaccctgaccaaatcggcagctttcaaattctggacgactgtttagatatagacctcgcaggcctagaccaaaccaaagtgcgcaacctcaagctagatggcacccaagatgaattgctttaccgtgaactcttgctcgcccaatgccatgcgctgcacaaagccatgccctttttatttgaagcggtagacgacgaaaccgaattactactgcccgaaaacctcaccaaaaccgattccttaattcatgaattggtcaatgaaatccccgaggaagattggcaaagcgtagaaattattggctggctgtaccagttttatatttcagaaaagaaagatgaagttatcggcaaggtcgttaaatcagaagatattcccgccgccacccagcttttcacacccaactggattgtgaagtacatggtgcaaaattcgttgggcgcgcagtggttggccacctacccagagtcgcccttaaaagcgcaaatggaatactacataacccccgcgcaacaaaccgatgaagtcaacgcacaactcaaagccataacccccagcgcactcaacccagaagagctaacgctcatagaccccgcctgtggttctggccatatattggtagaagcttacgatttatttaaagccatttatttagagcgcggttaccgccaacgcgatattgcgcaattaattttagaaaaaaatctgtttggtttagatatagaccagcgcgccgcacagctcaccggctttgcacttatgatgaaaggccgcgacgatgaccgccgtttgtttgagcaggatattaagctcaatgttatggcgatggtggatagcacagggtttgatgtggatgccttagtgggtggtgttaatcttgcgcaatacgggttggaggtaaatgatttaattgaactaaaaaatttatttgaacacgcaacaacctttggttcgctaattcaggtgccgagtggattaaaagaaaaattgccagcgctgaaacaactcagtgaatccaatagtgatgatttatttgtaaaagaatcgctagaaaatttgcaggttttggtaaaacaagctgagttattggcgcagcaatatgattctgttgtggctaatccgccgtacatgggtggcaaaggcatgaatacacaactaagagattttgcaaaaaataattattccaacagtaagtctgatctgtttgcaatgttcatcgaacgaaatctagatcttgcagcggggggcggcgcagtagccatgattaccatgcagagctggatgtttctatcctcatatgagtctctgcgtagccgtattttaaatcaacacaccattctttcgatggcgcatttaggcgcgcgtgctttcgatagtattggcggtgaagtcgtttctactacagcattcgtgcttgggaatgtccacaagccagattatcagggcgcttacatgcgtttggtagatggcaattcagaagcagaaaagatggagatgatggccaaggccatcgttcaaggtagaactgtatga

SEQ ID NO: 2537 - DNA, 3627 bp, Faecalibacterium prausnitzii
atgaacaaagcagccataaagaattttgcgatctgggcgcggaataagctgattgcagatgtcagctatgatgcccgcctgatcggtattacggaggacggcattgcaaagccgttgccgcagagcttcggcggcactcagttcttcgatatcggcactgcagaaccgtattcgatttccggcgaggccgtgcgccagcgtgacaagctgatagaggtcatccagcagaaggaaaaggataccgactacaaaaccgcatatcagtatgtgatcgaggaggttgcctatacatggtttaaccgcctgatcgccatccgtttcatggaggtcaatgactatctgccttcccatattcgagtgctttcttccgagagcggaaagttggagccagatctggtcacgacaccgtttgacgcagagcttcccttcactgcggaggaagaagctcagattttccagctgaagcaggacaataagctggacgaagtgttccgcatcctgttcctgaaacagtgcaacgccctgaacgagattttgccagcgctgtttgaaaagacaaagaactacaccgagctgctgctcagcttgtccgttattgaccaggatggtgtagtctatcacctgattcacgatatcccggaggatgacttcaacatcgagcgcggcggtcaggtggagatcatcggctggctgtaccagtattacaacactgagccgaaggccgctgcctttgccaaaagcggcaagatcaccaaagaggaaatccctgccgtgacccagctgtttaccccggactggatcgttcgttacatggtggaaaacagccttggccgtctgtgggtggaaggacacccggaatgcgacctgaaagaaaactggaaatactatctggaagaagcacagcaggagccggaggtgcaggtaaaactggcagaaattcgcaaagagtacgctgccctgaacccagaagatatcaagctcattgacccctgcatgggttccggtcatatcctggtatatgcttttgatgtgctgatgcagatttacgagagtgccggctacagccagcgtgatgctgcaaagagcattctggaacataacatctacggtctggatattgatgatcgtgcctatcagttggcgtactttgccgtgatgatgaaagcacggcagtacaaccgccgtatcttaaacggtgagaacacctgccatgtctatgccattcaggagagcaacagcatcaaccgtgcacacctgaaatatttcggcgcaggaatggacgatatcgagaagaacgcggccaaaatgcagctggaaggtttgctggacaccctgaccgatgccaaggaatacggctctatcctgaatgtggagagctataactgggatttgctgcgtcggtttgtggcagcggaagataccgacggtcagatcagcatggacagcgtgggcgtggaagataccgccgagcagctgaaccgactcattgatatcggtgagacgatggcacggaagtattgggttacctgcacgaatccgccctatgctggaaccagcaaattggataaaagagtaaatgcttttctgaaagacaattatgtggacagcaaagctgacctatacgctgtttttattgaacattgcaaggaaatgatcgtagccaatggatttcaagcaatgataacacaacattcttggatgttcctagcaacatttgagaaattgcgcaagaagatgcttcagatggatatagttaatatggcgcatttgggagctcgtgcgtttgaagaaattggtggtgaagttgttcagactgtggcatttgtacagagagaaagttatgtgccagagtataatggtagttattgtcggttaatcagtgcaactacaccaaaaggaaaagaagaattatttataaaaaaagatacgctgtatactgctaaccaagcagatttcaaaaatatcgctggaagccctattgcatactggacaagttctcacgtgttcaaattgttttcagaggattgcttgagaagccatattgatgcgcgaaatggtatgtctactacagataataataggtttctacgattttggccggaatgcagctttgaaaagaatggattctcgtctaaatcggctgagcaggcaaaagtaagtcaaaagaaatggtttccttataataaaggtggagagtttagaagatggtatggtaacaattcgtatgttgttaattggtttaacgacggcgaggaaatgaagaaatgcgtaacggaaaattatggaagctacagcaaggaactgagaagtgaagataaatattttgcagagggaatttcttggtctgcattaagctctggtaacatatcaatgcgttattcggaaccgggatacatttttgatagtaagggctctaaagcatttatgcgtgatgaaacgaatgtttttttgattctatcatatttgaattcttgcgtagcacaacattttttgggaattttatccccaaccttagactacaataacgggaacattgaaaaacttccatatatttccactaaaaacgatgatgttattattgacttgggaattgatgcagaagagcaaagcaaagccgattgggattcttttgaagtctcttgggactttaagaagcacccattactccgcaacgtttccacgatttacgaagcctttaccctgtggcagtcagaatgtgaagaccgctttaaccagctaaaaaccaacgaggaagagctgaaccgcatttttattgacatttacggcttacaggacgagctgaccccggaagtggaagataaagatgtgacggtgcgtaaggccgacttgcagcgggatatcaagagtctgctcagctacgccgtgggctgcatgtttggccgctactcgctggatgtagaaggattggcctatgcaggcggcgagtgggatagcagcaaataccagagctatattccggacgaagataatgttatccctatcaccgatgaagaatatctggacgatgatatcgtatcgcgcctgtgtgcatggctgaaagcggtgtatggtgcagatacgctggaagaaaacctcgattatatcgcaaaagcccttggcaataagggcagcaccagccgggagattatccgtaactacttcctgaacgatttcttcaaggatcactgccagacctattctgttaccggttccggcaagcgtccgatctactggctgtttgacagtggcaagcagaacggctttaaggcactggtttacctgcaccgctatacgccggataccatcggcaacctgcgtatcgactacctgcacaaaatgcagcgcgtgtacgaatctgagattaaccggatgcaggatatgatggatcacagcgggaatgcccgcgaggtggcagcagcctccaagcgcaaggataaacttgccaagcagctgaaggaatgccgggaatacgatgagaagatcagccatctggcactttcccgtatcgagcttgaccttgatgacggcgtaaaggtcaactaccgtaagctccagaccgcccaggacggcaagttctatgaggtgctggcagacagtaagaatatcatggtgaaagaaaagaaataa

SEQ ID NO: 2538 - DNA, 3588 bp, Fulvimarina pelagi
atgagcgtcgatctttcccgtctgaaatcctatgccccccaggctcgtaaggacttcatgaaagccgtcacggagcgtgcagcccgcatcggcattaccgccaacggtatcgtcgaggcggagcgccgaggggatgtcgtcgtcatcggcggagcggcctacgacaagacgttcgggaagcagcgggacgcgcttgtttccaaggtgaagatcgagggcttcgatcaggttatcgaaggaatcgcttacacctggttcaaccgcctcgttgcgctccggttcatggaactgcacgagtatctggatcacggatttcagatcgtcggaccagggaaagcgggcgggccgcttccggaggctctggtcaatgctgagcttctaaaccttccaaggcttccggtcgaacatgttcgcgagatgaagatcaccggcgactatgaggagaagctctatcgggcgatcctcatcgctcagtgcaacgcgctcagcgagacgatggggttcatgttcgagaagatcggcgatgcgaccgagcttctcctgcccgacaacctgctcgcgactgacggtcttgttcgaaaactcgttcagaattcggacgcggagtcgtggcagaacgtcgaggtcattggctggctctatcagttctatatttcggaaaagaaggatgacgtattcaaggcgctgaaaaagaacgtcaagatttccgctgcgaatattccggccgcgacacagcttttcacgccgcactggatagtccggtatttgatcgaaaactcgctaggtcggctttggcttctgaacaacccgtcttcgaagctagccgagaagatggactactatatcgcgccccaagagcctgagaccgatttcctgaagatcggctcacccgaagagatcaagatctgcgatcccgcctgcggttccggccatatgctgacctacgcgttcgatctcctttactcgatttacgaagaggccggttatcggagccgcgatatagcggcttgcattctcgagaagaacctccaaggcattgaaatagacggccgagccggtgcgctctctgccttctgtctggtgatgaaggcgcgagcgcaagaccctcggttcttcaaacgtcgcgttgcacctcgaatttgcatcctagaggacgtcgcattctctgaaacagagaaagaggatgtaattgccgttgcaggcaaagacctcttctcatgtaaattttgggaaactctcagtcagttcgagcaagccaagaacttcggctcgctgatcgtgccgaaactacgcaacccggtagagacgctgcgggtgattgaggcgcgggattttgaaagcgacctgctgctgaaggaggtgcaggcgcgcgttacgaccgtgctgcgcatggccgaggcgctgtcgccgaagtatcatgtggtggtagccaatccgccttatatgacacttggaaacgcaaattcattcctcaataagtggacaaagtctacctttcctaatagtagcggcgatcttttttctgcattcatcgaacgtggtttaatgcttgctttggattgcggttactctgcgatgattaccatgcagacttggctatttatatcatcatacaaaaaactcagagaaattatgatatcgaattcccaatttattgggctaatcaatatcggctataacacttttcctgagatgaactcgaaagtcgcgcttggagctgcattcgtaatcaacaagtcaacaagtgatattgctggaacatacatcgacctcaacaaggcaccccaatcagtcgacaaagagggtgtgtttctcaaagaaaagattggttcagagaaccaatatttgaggcgtatgagcgtctttcaaaaaattccaggatcgccgtttgcattctgggtgaccgaacccgtctacaaagcttttaacggcgaaataattggtgagaaattcgaagtcaaaggaggcatgtccacttcagacaatgatcgatttctacgcatttggtctgaggtgtcgcaaattcattgttctctgccacttgacaaagagccagccgaaaacgctcgctggtttccttataacaaaggaggtggcttccgtaagtggttcggaaactgggaatatctcgtcaactgggagaatgagggttcagacatcaaacacgccgtgtgcaataatccgaaggacccagacacaactcactggtcgcgacgaatattcaacactgaatatttctttcagaggggcctaacttggggtgatgttaccacgggaccgttcagtgcccgactgcttgagcgcggcgcaatatcggacagcgtgggtatcgctgcatatcggtgtcaatccgagacggtggaatgggcagcactggcagcactgaacgcgaaaacactgaagttcttcacagacattctatgcccgacaatccatttcaactccggcccgatgtccaaaataccgctcccggaaaaggatgggtgggtttcggaagggagtaaacttgctcaaacacttactttgctagcccgatccgactgggacgcctacgaaacctcctgggatttcaccacgcttccactgctctcgtccgattatcgcagcgcgacgctagaagacagctacacgaccctccgctcccactggcagtccatgacggacgagatgaaagctctagaggaggagaacaaccgcatcttcatcgacgcttatggcttgcaggatgaaattgatgagaaggtgttgatcgaagagattacgcttacatccaaccccgcgtatcgatacggagtgaaggggacgtcagaggagcgtgaagagcttctcaaacgcgatacgatgcgcgaactaatctcttatgcgatcggctgcataatggggcgctattcgctcgttgagccgggcctcgcctacgcgaatgcgggtaatattggtttcgatccaacgaagtatggtcacttcccggcggacgatgacggcatcgttcctgtggccgatatcgagtggtttcgtgatgatgccgcggcgcggttcttcgaattcataagccagactttttccggcgaaaagctcggcgaaaatctcgattttattgccgatgcgatagaaccgatccgcaagctctcggcgaccgacaccgttcgaaaatacatcgcacgctcgttcttcaaggatcacctgaagacgtacaagaaccgcccgatttactggctcttctcatctggcaaggagcgggcctttgagtgccttgtttatcttcaccggtataacgagggcaccctcgggcgtatgcgtgccgagtacgtcattccgctgcaaacgaagatgcagaaccgcattcagacgatcggaggcgagatcggacgaggtgatctctcgagcgcgcagatgaaggcgcgcacgaaggaactggcgactttggaagcgaagaagaccgaactcgatcgattcgaagccgatctccggcatatggcagaagagcggatcacacttgatctcgacgacggcgtaaaggtcaactacggcaaattcggcactcttctcgccgagacgaagctggtctgcggcacgaaggacgctgagtga

SEQ ID NO: 2539 - DNA, 3675 bp, Escherichia coli; identical to SEQ ID NO: 2305

SEQ ID NO: 2540 - DNA, 3831 bp, Delta proteobacterium
atggaaaccgaggcggggcaacagcttgaaggtatctacggttggttgcccgaaggccgattcgcggatccgacacgttatcctgctgtcaagcagattccggaagccgccgagacacgccgcagcttggaagcctatgccgaagaggaaaaaaacaccggcctttccccgagggatgcccgcattaagctggtaagagagaccgcttttacctggctcaatcggctggtggctctgcgaatgatggaagagcgcgggatcatcaagtcaaccgtgggcagattggataaatcgaacagttttatttactggcttactgccgacggaaacgatgaaatgtatgcccttcatcagaagggtgctcttcccctgaatgccatgggtgaaggtccgagcgatgtggcttaccgacaatttctgctatggcaatgcggccaattagccggtgatgtgtcggttctgtttgatccggaaaatctttccagccgcctgtttccacggccctctgtgttaaaaaaacttatggaatccatgaacaaagaggatctggcggaggcatggcgaaccggaaatgaagagacgatcggttggatttatgaagggtttatcgaagaagaaaacaaggctgtctttgaaaaattcggcaagggaaaaaaagtaaaggctgacgaaatcggagcagctacccagcgctttacccccaggtggattgtgcggttcctcgtggaaaactccctcggccgcctctggatggagatgcatccggatagccgcttgaaggaaaagctcgaatattttgtaccaacgcaggcaattgaacgttctgctgaatcggctaaagacataacttttttggatcccagttgtggctccatgcatttcggtcttctggcttttgatattttttttgagatgtatcgagaagagctggcgaaggccgggcagcccggttggcctgataaaccgagtgttgcttccataaaggaaatccccgcaagtataattgacaataacatctacggcatcgacatcgactttcgagcggtgcagctttcagccctcaccctttttcttaaggcacgctcactgaataaaaagtgcaccttctcagacaacaacctggcctgtgccaatgtgaaagcaatcacaggaggccggctggaagaattcatcaagcagtcgcaattcagtcaccccatttatgaacgtattcttagggtcattgcagttcgaatgaaggattcggaccagcttggtagtctgcttcgattggaaaaagaccttgaattcctcattggcgaagaacggaagaaggttgacaagaataaacagcttcagtttccttttcccggcttgccacgggatcagtttgaaaccaaagagggcgtcgaagaattttttgagattctttttgagcagttattgcgacatttagacttttttgtgcaaagctcgcgagcaacgggagttgaccccggacactttgctgccgaggcggccaagggtttgcgttatctccgcctggtgtcgagacaatacgatgtggtcgccaccaatccgccatacctaagccggcgcaatatgtcttctttcatcgcgaagcatcttgatgagaattacccaaacactaaaagtgatttgtactctgcattcattattcgttgtctcgaacttgccatatccgtcggtaaggtggccatggtcacccagcagtctttcatgttcataaaagcgtatgaaaaaatgcgcaaggatttgagaaagatcgcttttgttgattctatggcacatctcggccccaaagcctttcccaacatcacaggcgaaaaagtgaacaccacggcttttattctgtgcaaggagacgagcaagcagaagagactagagcatcagggtatttatttccgtttggtacgcgagagggattcacaagcgaagtggcgaagattcgaagaggcagtggcctgtctgagctgcgggaaacatagccccatagtttttagttaccgccaaatcgactttgatccaatccccagcaccccttgggtttattggattacagagggaatacgcaccttgtttctaaacaggccgaaatttgcctcgtttgcaaaaccatgggttgggcttcagacttccgataatgtgagatttttgagattttggtgggaaagtggaataaaccagatcgctttcgtttcgagcgtaaaagatgctgttgagagtggtaaacgctggataccacacatgaaaggtggtgaacactgtcgttggtatggaaaccaggaatttattgtcaactggtttgataatgggatggagatgaaaacgtatgctgaggaattgaagcaacgagttaaatctccaccaggcaatggtccccttcgcgacttcccatattactttcttcctggggtcacatggacccatacgacagcgaaaggactcaacgcgcgatatatgccaccagggttcatttgcaacgtggagggaatggcttgttatccagaacttgaatttggtctcgttgaactatctcttgcaattctaaattcaaaacttgcttgttacattacaaatcaattaaatccaactatacattatggtgcgcgagaaatcggggatctcccatctccttccaaccttcatgcagcggctggcatgatacgattgtctatccaacgtgcgataaacttggccaaagcagacagcgaagaaaatgaaaccacctttgacttcattgttccaccagattggcctgacggtatccagcatgtagccgaacgccacgctagtctttcagaaattgaacaggaaattaatgtggaagtctttcgtttctacaatatagatgatagagatcgccaagccattgaaacagagttattcgaaaatattgcctcattagagcttgacgaggcagaagaaacggaacaagaggggttgagaaaaaatgagtcaatgcaaccttcgtggtcgtgcctggacctttccaaaatgtggatcagctatgcttttggcacggtactggggcggtatggcatcggtcaagctgatggattcggaagagggaatttcgatggagaaactgccgccgctatccgcaccttgatggacgaagacgccgtaatggtgtcggaagcgggccatccccaggatatcacggctcgaacacttcggtgcctggaacttatgcgtggcaaggaaactgctcacgccctgattcgggaagtcgcaggttccgacggggaccccgaggaactgctgcgcggttttctggaccgcttcaccggcaaaccggaagtctccttctggcggcatcatttccagctttaccgcaaacgccccatcttctggcccctccaatcccccaagcgaaaatttgccgtgtgggttttccaggagcgcttcacgacggatacactctttaaagtgcgatcggaattcgttgaccccaagattcgttggctggaagcccgcatcagggaatttaaggaaaaggccgagggaagcactggtgcggaaaagcgaggggcggaaaaggaagtttcacaactgtccgacatcctggacgatgtgcaggaattttccaaacgattagacgccgtcatccagggaggctacaccccgcacatcgacgacggtgtactcctcaacgccgcacccttgtgggaacttctcccttcctggccggatacgaaaaaggcatggcaggagctggagaaaggcaaatacgactgggcgcaccaggccatggatcactggccggaccgtgtccgagagaaatgcaagaccaacaaatcctttgccatcgcccacgggctggagtga

SEQ ID NO: 2541 - DNA, 3633 bp, Enterococcus faecium; identical to SEQ ID NO: 2445

SEQ ID NO: 2542 - DNA, 3516 bp, Lactobacillus johnsonii
atggacaaaaataaaataaaaaaatttgcaattaatgctagaaaaagtttgagagatacgaccgaagttcagctagctaatttgggcattacagatgaaaagattaatgatgaactttctatctctacaaaagataaaaagtactatgtagatgataatgaaaataatgctttaactggtaaacaaattggctggcgaaaagatgttgttaatgaattaaaaaataggggatatgatgatgaccctaagactgtctttgatgattttattgaagaagttgcctacacttggttcaacagaattatcgcaattagatttatggaagttaacaattatctgccaagtagggtaagtgtcttaactagtgaagaaggtaaggctgaacctgacatcattaatgaagcaatggagattgaagacgatttaggtggctatagtgattcagaaaaagaattaatttcgactgctttgactgagagaacccctgaattgatggataagctttatgcaatgctatttattaagcaatgtgatgcactaagtgacattttgtcaggtttgtttgaaaaaactaatgattatttgaagttgttgtttacacctaattataaccgtggcgttattcaagatttgattaatgaaattcctgcgagttattttgatgtaaatgaagaaggacaagttcaaattattggatggctttatcaatattacaataatgaacctcatgaaaaagtagttaatatgaatggtaaagctattaaaaaggatgaaattccggccgctacccaattgtttactccagactggattgtccgctatatggttgataattcattgggaaagtactatttagagcgtcatgaaaatagtcaactaaaagatgaattgaaatatttattaccaagtaagattgaatcagtgaataatgatcaagatatttccgaatataaattcttagataatgctatgggttcaggacacatattaatctatgcttttgacttattgatgaagatgtatcttgaagaaggatattctaagagggatgctgcacaaaaaattattgaaaataatatctttggacttgaaattgataaacgagcatttcaattagcttattttgcattaatgatgaagggtagagaatatgaccgacgcttctttagaagaaatgtagccaataatctctactactttgaagatttacatgtttccgaagatttttataattttatcgataatgaaaaaacaaaagaagatttaaagaaattagcagaagtttttgctgatgcaacggaattaggatctattataaaaatagatcaagacattgatactaataatcttaaatctacaataaagaagattgattttgatgatagcttggatgttttcggaaacaaaagaactaaagataagatccttaagattctaagtattgttagaataatgactaacaaatatgaaactgttgtaaccaatccaccatatatgaataaatttgataaaaagctgaagaaatatttacggaataattataaagattattctaaggatttattctctgtattcatttatcataatatgcatctcttacgtgatggagggtattctggctatatgactccattggtgtggatgtttattaaatcttatgaaccacttcgtaaagatattattgataatgtaaatattaatagtttaattcaaatggagtattccgcttttgaagaagccactgtgccaattaatacctttatattgaagaaagccgatgaaaaatctggcacttatttgagattaagtaattttaaaggcggaatggctgttcaagaacagaaagttttggaagctattgctaatcctgaagttaaatatttgtatcgtgctgctcaagataattttgataagattcctggcagtcctattgcttattgggctatacaatcattatatgaagattttaaaattggtaaaaaatttaatggcgaaactaaaaaaggggttttaactggtaacaataagttatatttgagactgtggtatgaagttttgcatagtaaactttcatgtaatatggaatcttataaagatatgattaattcaaattttaaatggttcccggttacttcaggtggtcaaaaaagaaaatggtttggtaattttgatacagttgtaaatcttgaaaatggtggagaagatattaaagaaaatgtcaaaaattatagattgagggaaccaaagtattattttaaagaagctttaacgtggactgaagtgacatctggaatatttaactgtagatatgtaccaacaggaattttatttggcaatggtggaccagttgcttttattaataataatgatttgtattattatctgggactactaaattctaaagttgcaatggcagtgttaagttttatagcaccgacaattaattttggaccagaacagataaaaaaaataccaattttatattgtacgaaaataactgtagtcaacaatatagttaaaaataatatttctattgcaaaacaagattgggatgcatttgaaacatcatgggacttcaaacgtagtccgttattagtaaataaagctgcaactttagaacaagcttataataattggtcacaagaagctttagatagatttaatcaacttaaagccaacgaagaagaactaaaccgtatctttattgatctttatggtttacaagatgaattaactccagaagaagacgataaggaagtttctgttcgtaaagctgatcaagttcgtgatattaaagcattcctatcttactttatcggttgtatctttggccgttactcacttgatcaagacggacttgcatatgctggcggtgactggaatgcatccctttactcaaccttcaagccaaataaagaaaacattattctcttaaccgatcgtcaatactttgacgatgagcgtgatatcatcgttcggttgcgtgagtttttgtccacgactttcgatccagatcgtttaacagataatgtgaacttcattgctcaaactttagaccctaagaagttcgaacgtggagttagttcagaacagattatccgtgactatttcgccaatgatttctacaaagatcatgctaagatatatcaaaaacgtccaatttattgggaatttaattccggtagaaacaagggattcaaagctttaatgtacttacatcgctacactccagaacaacttgcaatggttcgtcaatatcttcacgacttgcagccggcaatgaacgatttaatcgaaattgataatgatttattagatcaggaaacaactgcaagtgctaagagcaaatatcgaaagattatttcaactcttaataagcaaatgaatgaattagttaagtatgaccaagtcttagatcacttatctcaaagtccagtagatttagatcttgatgatggtgttcttgctaatcatgacaaattgcaacaaggagaaaagttgttgactaatttataa

SEQ ID NO: 2543 - DNA, 3669 bp, Thiothrix nivea
atgaacaccggcaaaatcaaaatctacgcacccgctgcccgccgcgctttcatcgccgccgttacccagcgcctcaacctgttcggcatcagcgccgacaagcagggcaagctcagggttgagcctgccacggtcaccgggtcggtgctgcaaatcggtgggcaaagctttgacgccgggctggcacgcccgcgtgagcggctggtagcgcgtgcccaggcacagggcatgactttcttggtggaacaggtggcgtatacctggttcaaccgcttgtgcgcgatccgcttcatggagttgcaggggtatctggagcatggtttccgcgtgctgtcgcaccctgagcaggccaagggctttcaggtgctggatcatgtgccggaagtggcggcggcactggggctggacgtggaacatctggtcgggctgaaactcgcgggcaatcaggatgaggcgctgttccgcgcgatgctgctggggcagtgccatgcgctgcatcaggcgatgccgttcctattcgaggcgctggatgatgacactgaactgctgctgccggacaacctgacgcgcaccgattcgctgttgcgtccgctggtggacaatatcccggaagacgactggcagcaggtggagatcatcggctggctgtaccagttttacattgccgagcgcaaggatgaggtgattggcaaggtggtgaaaagcgcggacatccccgccgccacgcagttgttcacccccaactggattgtgcagtatctggtgcagaactcgatcgggcggcagtggttgcagacttacccggcgtcctccctgaaggcgcggatgccgtattacatcgagcctgcgcaacagacggcggaggtggcggcgcaactggcggcgctgaccccggaaagccttgatcctgaacagttgaaggtgctcgatccggcctgcgggtcggggcatattctggtggaagcctatcaggtgttgaaggcgatttatgaggaacgcggctaccgtagccgtgagattccgcaactgattctggaaaagaacctgttcgggctggacattgatgaccgggcggcgcaactggcggggtttgcgctgatgatgctggcgcgggcggatgaccggcgcatctttacgcggcaggtgaggttgaatgtactggcgatgcaggcttcgctgctgtcttccgccgcatcttcccccccatccccggcccttcccccgcaaggggggcagggagcaggagcggacttgccgggtctgtggcgggcgctgaacctgcgcggtgactggcagaaaggtacgtccgccgatttgtttggtggcgggcagatgcagcttgcggatgccgccaacgatccggtgtatcagctgctgctgacgctggtgggtttgttccgcgaggccaaaaccttcggctcgctgattgacgtgcccgccaggctgctgccggaactgcaagccttgcagaccctgctggaagagctggcggaacgcggcgacaccatgcagcaacccgccgcgcggacgctgttgccgctggtgcggcaagccatcatccttgcccagcgttacgatgccgtcgtcgccaacccgccctacatgggcagcaagggcatgaatgccgacctcaaaacctttgcaggcaaacactaccccaacagcaaggctgacctgttcgccatgttcatggaacgcgctttcgagctgttgaaagccaatggctataacgcacaggtcaacatgcaatcgtggatgttcctgtccagctacgaaaaactccgcgaatccctgctggatacccgcacattcatcaccatggcgcatttgggcgcacgggcattcgggcaaatttccggtgaagttgtacaaaccaccgcatgggtattagcaacgtctcaccttgccaattaccaacctgtcttttttcgcctcatagagggcaacgaagaagaaaagcaacacgccttactcgcccgcgaaaatcgccacagtcataccaagcaaaccgacttcaataaaatccccggtagccctattgcttattggatcagggataatgttattaatgtatttcaatctacgcaattgcttggtaatgagtcagacgtgcgccaaggtcttgcaactgcggatgatgacagatttcttcgttattggagtgaagtaggctataagaaaattgaattttattcaggccaaggtagtaagtggtgtccctttactaaagggggggcttttcgtaagtggtatggaaataatgaatatattgtaaactggcaagataatggatttgaacttaaggcatttgagcgctcagtcataaggaatgaatatacttattttgaggaaggtttgacatggactttaattagtagcgggtcaacagcctttcgatttgtgccaaaaggttcagtatatggtcataaagggccatgtattcaatcgaaaaaaaatcatcaaattcttttgttattaaactcttgtgttagtaagtatattctgaatattttcagtagcggacttggatttgaagttgggcatttaaataaatttccggttattttaagagacaaccaattttattctgaccttataaaagtagccaaagaagattgggattcgtttgagacgagttgggactttgcggagaatccgttgctggcggcgaagcgcgagagcgtgaagctggcgtttgacgcatggcaggcggcgaacaaggccgccgtgacagaaatgcagcaactggaggaggagaacaaccgcctgttcatcgacgcctacggcctgcaagacgaactcacccccgacgtaccactggagcaaatcaccctcaccgtcaacccccgctaccgctacggcggcaacgccagcgacgccgaactcgcgcaacgcttccagtccgacacctgcgccgaactgctcagctacgccatcggctgcatgatgggacggtatcgcacagaccgccccggactggtctacgcccacgcaggcaatgccgacttccagaagatttatggggaagggggttctttccctccggatgacgacggcatcatccccatcaccgatcaggaatggttcgccgacgacgccaccaaccgcttccgcgaattcgtgcgcgtggtctggggtgaaacccgcgtgcaggaaaacctcgatttcgtcgccatgagcctcacccaatacgcgctcaagcccaaacgcgacgaaagcagcctcgacaccattcgccgctacctcgccacccagttctacaaggatcacctacgcacctacaaaaagcgcccgatttactggctgttcagctccggcaaacagaaagcgtttgaatgcctggtctacctgcaccgctaccacgaaggcaccctggcgcggatgcgcaccgaatacgtcacgcccctgctcggcaaatacagccactacgccgcacaactcgaacaacaagccgatagcgccgactccaccgccgagaaaaaccgcctgaaaaaggagttggtcgaactggaaaaacgccgtgccgaactccgcgccttcgacgaccagctcaagcactatgcggataggcgcatcaagctcgacctcgacgacggcgtgaaggtgaattatggtaagtttggggagttgttggcggaggtgaaggcggtgacgggtggtaaggagtaa

SEQ ID NO: 2544 - DNA, 3615 bp, Escherichia coli; identical to SEQ ID NO: 2471

SEQ ID NO: 2545 - DNA, 3483 bp, Brevibacterium mcbrellneri
atggagaccacaccgctgaagagcttcgccacctgggccaggcgcgaactcatcactcaggtcagcgcccggctgactgccgtgctcgcgcccggatcacctgagcgggtcgagaaccagcgcgccgtgaccatgcttgaacgcgacatcacggccgcgggcggcggcgccaagggaaaggacgccatcgctgacagggttgcctacacctggttcaaccgcatcatcgccctccgcttcatggacgccaacggctacaccggtgttggcgtggtctcgccagcccacggccagcagaccgggcagccagagatactcgcagatgccaagcgtggcagcatcgaccccgctgttgtcagcaacaagcgcaccgtcgacacaatcactggactcctcgacggaacccgccccagtgcagacgctcagggtgaggcctacacgcttctgctcgccgagtactgccgcttctggaaccgctcgatgccgtttatgttcgagcgcgaaggcgattacaccgaactcctcatccctgcgaaccttctcgccgcagactcgatcctcgccagggctgcggcggtgctctctgaggaagtctgccgagatgtcgaggtgatcggctggctctaccagttctacatcgcagagcggaaagacgaagtcttcgccggattcaagaagggcaataaggcaggcgcggccgagattccggccgccacccagctcttcactccacactggatcgtccgctacctggtcgaaaactccgttggccggctctggatgctcaaccaccctgagtctcggctcatcgaccagatggactactacattgcgccggtcgacgaagaaactgacttcctcaagatcgccgaccccgaagagctgacggtcattgacccagcttgcggctccggacacatgcttacctatgcgttcgacctgctctacgcgatctacgaagaggagggctacgcaccgtccgagattcccgggctcatccttgcccaaaacctctacggcaccgagatcgacccgcgcgccggctcactggcggcgttcgcacttaccatgaaggcccgcgctaagcagcgaacattcttgacaaaggggctcgcgccggcgatcacagtcatcgactccatctcgttcaccccggatgaactggaccttctggtcacgaggaatggagacctgcgtgcggaagaaggagtttggaatcagttcgccgaggcaaacgtgctcggggctctcatcctttccgacctgggacaaacccagcggctgtctcaccgcctcgaaacactggacgaagcaaacgacctcgtttggtcggccaccctcaatcgtgcgtcaaaagtgctacgccaagcaacggcactgtcgcggcgctatgccgtagtggtagcgaaccctccttacatgggctcgaaaaacatgggagccacgctcgcggacttcgcgtcggggaagttccccgacagtaaatctgatctgttcgcgatgttcatcgagcgcgggtttgaatttctgaaaccggggggactctcggcgatggtcaccatgcagtcctggatgttcctcaagtcctatgccgggcttcgcaaacaactgctcaatgaccgacatctggaatgcatggttcacatggggaacggagtcatgggcatagcttttggcacggcggcggccatctggcgttctaccccgggggaaggggtctcatctttctccttcgtttcgacgttggacctttatggagacaagccgagggtgttcccagtaccaaactcaagacacacggagatgtcgcttcgagagctcagttctattccgggaagtccgattgcttactgggcgtcctcggcccttcgcgccacgttccaaactgggcgaactatcgaaagtgttgcgccggtacgccagggatttcagacgggcgataatgaccgctttatgcgtttctggcacgaagtgtcccgaacgcgaattgctttcgactccgagtctacggaagagtttcatgcatgtggggcccgattcgctccatacctaaagggcggccccctgcgcaagtggtttggcaacgacgagtacattgttgctttcagtccccatgacttcagtgaactctcgaagcttgggaacaagcttccttcgcggaacctttatttcaaggattcgatcacgtggtcggcgatgtcctcgtccgacttcggcgcacgctatgcgggcgtcggcagtaccttcagtgcaaaaggcgcgtgcgcgtttccagtagatagatactcccgttcgctcacgctggcagtcctgaattcgtcagtggcgcgtcaactcctcgaattcatgggtgcgactatggacttcaacgtggggtccctgcgagagattccacttccagcggagattccgctcgacgacagagatcggatatcttcgctggtcgaactgttggtgcacctccatcagcaggattggaatctgagcgagtctgcgcccgggtacgaagagaatgcgctaatcaagcgcggcggggtaggccgccttgcgagtctggtcgacggacacttcgctgattggcgagcctactctgcgcaggtcaacgaggctcaggaagcactcgacgcgatcatagctaagtcctacggattggagccctcaggtgaacttaatgtcactctgaacaacctggtggtgggcacgcaaggtagagctgagcggaatgttcaattgcgcgacatgattgctgaccttgtttctttcgctgtgggatgtatgttcggccgctacagcctcgacgagaccggcctagttctggccgaccagggcgcgacagtgcaggactacttcgcgaaggtgccgcagccgagattcacccctgatgctgacaacgttctcccgatcgtcgatggcgattggttcgaggacgacatcgtggcgcggctccgtcagttcctgcgggttgccttcggggagcagtacttcgaggagaatctccggttcgttgaggagtcgctcggcgtcaagactctgcgggagtacttcatcacccgagcgggccggtcgaagttctacgacgatcacgttaagcggtacaagaagcgtccgatctactggctgttctccagcccgaagggatcgttcaacgcgctgatctacatgcaccgctacaccccgtccacggtctcaaccgtactgaacgagtacctgcgcgagttcgagtcgaaactggaagcgaacctccagcaccaggagcgtctcgccgccggggagggtacgcctcgcgagaaggcagcggcactgaaggaagccgaacgacttcgaaaggtgctggtggaactcagcgagtacgaacacgacgtgctgtacccactggcgtctcagcagatcgccatcgatctcgatgacggggtgaaggccaactatccgaagttctaccccgccctcaagaagatcgcagggctggaggctaccgatgcctga

SEQ ID NO: 2546 - DNA, 3567 bp, Escherichia coli
atgaataccaataacatcaaaaaatatgccccacaggcccgtaacgatttccgcgatgcggtgatccagaagctaacgacgcttgggatcgctgcagataaaaaaggcaatctgcagattgccgaggccgaaaccattggcgagaccgtgcgttacggtcagtttgattacccgttatcgacccttccccgccgcgaacggctggtaaaacgcgcccgtgagctgggttttgaggtgctggttgagcactgcgcctacacctggtttaaccgcttatgtgcaattcgctatatggagctgcacggttatcttgatcacggcttccgtatgttgtctcacccggagacgccggccgcgtttgaggtgctggatcatgtgccggaagtggcagaagccctgctaccagaaagtaaggcgcagttggttgaaatgaagctttccggtaatcaggatgaagctctgtaccgtgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcggaaaagaaagatgctgtgattggcaaagtggtgaagagcgaagatattcctgccgccacccagctgtttacgccgaactggattgtgcagtatctggtacagaactccgttggtcgccagtggttgcaaacctaccccgactcgccgctgaaagacaaaatggagtactacattgagcctgcggaacaaacgccggaagtgcaggcgcagctggcggcgattaccccagccagcattgaacccgaaagcattaaagtgctcgacccggcctgcggttccggtcatattttgattgaagcctataatgtgctgaaaaatatctacgaagagcgtggttatcgcgggcgtgatattccacaactgattctggaaaataatatttttggtcttgatatcgacgaccgagcggcacagctttccggctttgcattattaatgatggcacgtcaggatgaccgcagaatatttacccgcgatgtacgtctgaatattgtctctttgcaggaaagcctgcatctggatatcgccaaactctggcagcagctcaatttccaccagcaggtgcaaaccggcagtatgggggatatgtttgctgaaaataccgcgttaacccaaactgacagcgcagaatatcagctgctgatgcgcacgttgaaacgctttgtgaatgcaaaaacgctgggctcactgattcaggtaccgcaggaagaagaagcggaactgaaggtatttctggacgcgctgtatcgcctggaacagaaaggcgacttccaacagaaagcggcagcgaaggcgtttattccgtttattcagcaagcgtggattctggcgcagcgatatgatgcggtggtggcaaatccgccgtatatgggcggcaaagggatgaatggcgagctgaaagagtttgccaaaaataatttcccggatagtaaagctgatttgtttgcaatgtttatgcagcatgcattttctttacttaaagaaaatgggtttaatgcacaagtcaatatgcaatcatggatgttcttgtcgagctacgaagcgcttcgcggttggttattaaataataaaacatttatcacaatggctcatttaggagctcgagcttttgggcaaatttcaggtgaggttgtacagacaactgtatgggtagttaataataaccatactgagttttaccgccccgtatttttccgcttaatcaatgggagtgaagaggaaaaaaaaagtgcactaatttcgcgcaaaaatatgtttaatcacaccttacaaaacgacttcaaaaaaatccctggagagccaattgcttattgggtaagtgatatatatagggatattttcacccagtcaccagctctctcctcaatagctaaaccaaggcaagggcttgcaacttcagataataatagatttttgaagctatggtatgaaccatcattaagaaaaattaacttttccgcaaaagatcgtgccgacgcattaaattctcaggcaaaatggtttccttgccaaaaaggtgggagttatagaaaatggtttggtaatcatgagtatcttgtaaactgggaaaatgatggccgtgaacttcttgattttgcagcaagcctgtatggttctccaaccagaacaataaaaaatatccctttttattttagagaaggtgcaacttggtcgacaatttcgtctagtgatttttcaattagatatagcccaactggttttatatcagaaaccaaaggtgctgtttgttttgctgatgataaagatattttattatcgatcctaggattcggtaattctaaattagttaattattttttgaaatcattatcaccaacgcttgattaccacgaaggtccgataggtaaacttccttttaaaggaaagcttaaggctcaagttttagaaaatgttgtaaatttaatcgctatttcagaggaagactggaatactgaggaaacatcttgggggtttaaaaaacaccctatcacaaaattagacaacctgaattatttgcaggctagttttgaagcttttaaaaatgatgtacaagaaactataattagaacccaacagcttgaagagttcaataacaaggaaataattagagaatatggactagaatcagagctaaactataaagtttctttagaagaaataacattaacggtaaatcctgattataagtattctggaaccacggatgataaatcaaaaaggatgcagtcagacagtctttcctccctactatcctatgccatcggctgcatgatgggccgctactccctcgatcgcgaaggccttgtctacgcccatgaaggtaacaaaggcttcgccgatctcgtcgccgaaggtgcctacaaaaccttcccggccgacagtgacggtatcctgccgctgatggatgacgagtggtttgacgacgacgtcacctctcgcgtcaaagagtttgtccgcaccgtctggggcgaagagcacctgcaggaaaacctcgaatttatcgccgaaagtctctgtttatacgcgatcaagccaaaaaaaggcgaatctgcgctggagaccattcgccgctatctttccacccagttctggaaagatcatctgaaaatgtacaaaaagcgccctatctactggctgtttagctccggtaaagagaaagccttcgagtgcctggtgtatctgcatcgctataacgacgccacgctgtcgagaatgcgtaccgaatatgtggtgccgctgctggcgcgttatcaggccaatatcgatcgcctgaacgatcaacttgatgaggcttcaggcggtgaagctactcgcctgaaacgcgaacgcgatagcctgatcaaaaattcagcgaactgcgcagctatgacgaccgcctgcgtcactatgctgatatga

SEQ ID NO: 2547 - DNA, 3480 bp, Geobacillus thermoglucosidans
atgaataaaacagagttaaaaaattttgcaatctttgcgcgaagaaatttacttgaaaaagttacattaagagcaaaattatttggaatcgatgagaaaaacggcttagaaatgagagaagagtttgggcaattatatgtgaatgggcatccctatgaattaaaaatgaaatcagcgtttcaatcactagcaaaacaactcgaagtaaaagggtataaacaattaattgaggaagttgcttatacatggtttaaccgaattatcgcgattcgctatatggaagtaaatgattatcttccggaacgagtaaacgtgttatcaagcagcactggaaaaacagaaccggacattttatcgcaatttgaaacaatggacttagatattgatgtcacagaaataaaagaccttattaatcaaggggaaacagaaaaagcctatcggaaactctttattgcgcagtgtaatgcgttacataaaatactaccgtttttgtttgaaaaaattaacgattatacggaattattgctgccggatttcttattggatagtgaatcagtaattaaaaaattagttaataacgaagcgttaacagaaagctttcaagaagttgaagtcattggttggttgtatcagttttataatacggagttgaaagatcaagtatttgctaacttaaagaagaataaaaagattgagaaatatgatattcctgccgctacgcagctattcacaccaaaatggattgttcaatatatggtggaaaactcgctcggacaactttggttagaagccaacccagattcaccgttaaaacaatcgatgcgctattatattgagctagcggaacaagatgaagaagtaaaacaaaaattagaggaaattcgctacaaaaacgtcaatttagaagaaattaaaatcattgacccttgtgttggttctggtcatattcttgtctatgcgtttgacttactgtatcaaatgtatgaggaagcaggataccctagcagtgacattcctcaactgattttagagaaaaacttattcggcttagatattgatgaccgtgccgctcagctggcgtcctttgctttaatgatgaaagcgcgggaaaaatcacgtcgtattttccgtaagaaagttaaattaaatatttatgcaattcaagagtcaaatcatttggataaagaaggaattgcacagctgcttgggcaaaatgaagaggaaaaagaagagatacgttcagtaattgacacatttattgatgcaaagaattttgggtcaatccttcaaccaccaaagatagactataaaaaatatttaaatcgtttagaagaacttggagaggcgcagttaacttcagagacgtttgaggcttatgaacaaataccagcctttcgttatttattaaaaacagcgagagtattgtcctctcaatatgatattgcaataacaaacccaccttatatgggctctaaagggatgaataaaaaactcggtgattatttaagaaaatattttcctgattctaagactgacttatttgctgtttttatggaaagattaagtttatttatcttaacaaaagggtttaatgcgacaattaatcaacattcatggatgtttttaggtagttttgaaaaacttagaagaaaagtattaactaataccactatattttcaatgttacatttaggaccccgtgctttcgaagaaattggcggagaagttgtccaaagtacatcttttatacttcgaaaaccaaagttacgtaattttagagcaacttactatcgtcttgtggattacaattcaccagaaagtaaagaactagcttttaagaatagacaaaatgtttactcacaaaaccaagaaatttttctagaccttcccggttttccaattgcttattggtcaagcaataaagtgattgaaatatttaaaaattacaataaaatctctgaagttgctgaaccaaagcaaggattagctacaggtgaaaacgataaatttttaagaatatggcatgaagtcagtatccaaaaaattggatttaatttttcaaatgctcaagaagcaaataatagcaaaaaaatatggtttccttgcaataaaggtggaaaatttaggagatggtatggtaacaatatctatataatcaactgggctaggaatggagaagagataaaaaaacatagaggttcggtaatccgtaatgaatcttactattttaaagaaggtatgacatggtcaacaatatctactagctcactttcaatgcgtttaagtgaagagggatttatatttgaaaccaaaggctctatgtgttttccaagaaattatagtaatttaaaatatcttttaggatactttaatacaaaattagttaaccattttctgaatatattatccccaactattgactatcatgaaggacctttaggaaaaattcctgttaaactagttgagaataaccaaatagagcaattggtagataagtgtgtatttatctctaaaaaagattgggactcttttgaaacctcatgggattttgaacgtcatccattgctaacatatcgtgaaggtagcactcttttatcagatgcttttaacaattggacaacccatacggaaacacaatttaccaaattaaaggcaaacgaggaagagctaaaccgaatcttcattgaattgtatggtttgcaagacgaactgactccagaagtaccagatgaagaaattacgattcggaaagccgaccgtgttcgtgatgcgaagtcgttcttgtcctattttatcggttgcgtaatgggccgttattctttggatgtagatggcttagcttatgctggcggagattgggatgagtctaaatataagacatttaaaccaaacaaatacggattaatgttgctgacggatgagcattatttcgaagatgatgtgattgctcgcttgtgtgaatttttatcggtaacattcggagcggaaacagtagaagaaaacttgcaatggttagcagagtcacttgaattaaaacgtaacgaaactgcagaagaacgattacgccgctatttcttagatgaattctttaaagaccattgtcaggtatatcaaaaacgcccaatttattggctcgttgattccggtaagcaaaaaggattgcgtacactcatttacatgcatcgttaccgtccagatacaatggcaacgattcgctttaaccatttgcaagaaattcaaacgaaatatcataacgaaataaatgctatcgaattgcgtatggtcaatccaaatttaagtgcaacagaaaaacgcgaattagagaaacgaaaaactgcctatcaaaagcgtctagaagaattacttgaattcgataaaaaacttgcagaatatgcaaacgcacagattgacattgacttggacgacggagtaaaagtgaactatgaaaaattcaaaggtgtacttgcaccaattaaataa

SEQ ID NO: 2548 - DNA, 3741 bp, Vibrio cholerae; identical to SEQ ID NO: 2398

SEQ ID NO: 2549 - DNA, 3633 bp, Enterococcus faecium; identical to SEQ ID NO: 2506

SEQ ID NO: 2550 - DNA, 3633 bp, Enterococcus faecium; identical to SEQ ID NO: 2506

SEQ ID NO: 2551 - DNA, 3627 bp, Vibrio cholerae; identical to SEQ ID NO: 2397

SEQ ID NO: 2552 - DNA, 3492 bp, Sporosarcina newyorkensis
atgaataaaagtgcattgaaaaaatttgcaacagaagcacgaaaagagttgctgaaaagagtagagctacaagcaagaaaacttggcattacagccgaatctattcaaaaagcaaatgtcgaaagctccgatgccgtctttattgacggcaaacagcttttggatacagaaagacgacaacggaataaattgattgctcgtattaacgaaatcggctttgaccgtgtgatagatgagacggcatacacttggttcaaccgtttcatcgcattaagatacatggaagtgaacgactatcttccaacaaaagtgcgggtcctatcttcgaattcaggcagtgccgagccagatatgatgaaagaagcattatcactggaccttgatttagataaagaaaaagtttacgaaatgaaaatgaacaatgagactgacgaactttttaaatatcttattaaaatccattgtaacgatttaaatcgctacatgccatttatgtttgagacgattgaggattatacagcaatccttttcccagaaggattgcttggaacagactcatttgttcgacaaatgacggatacggaaatcattccagaggataattggacaaaggttgaaattattggatggctttatcagtattatatttccgaagaaaacgagcgagttattaaggcaaagaaacgctataaagcagaagagctaccattcgcaacacaattattcacgcctgaatggattgtccgttatatggtgcaaaatgcattaggacgttactggattgaatcacacccagagcaccgagatttaattcaaaactgggagttctatttggaaaatccaaatcccgaagccgattttgagaaaaagttagctccttatattaataaagagttaaacgtggaagatattaaatgcttcgatcctgccatggggagcgggcatattcttgtatatatgttcgatgtcctccatgaaatttatagtaaatgtggatacatggagcgagaaattccacgactcattattgagaagaatctatatggattagacatagatgatcgtgcttatcaattggcgagtttttctgtcgttatgaaggcattgcaatataataaacgtttcttgcgaagtgttgaacgggatggtttaacgatgaatttagcatccattcaagaaacaaacatgctgtcagatgaagaagtggcatttttagctggcgaatcatctggagagcaatttgataaaatgaaggaatttattgaccaatttaaacatgcaaaagcgataggatcacttattaaaatagaatcctataatgcggaatttctacagcaacgattaaaaaccatcgaacaacaatcaggcaatttattcgaattggatatgaaggatcgtacattagctttgtttagaaatctaatcaaacaagcaacgctaatggatttaaaatacgatgtttttattacgaacccaccttacgctggaaatagttatgttacaactgaagtatcgacctatctaacaaaagaatatccagatgttaagtccgatttattctcgtcctttattgaatatagctttcatgcgacaaaagaaagtggacaaatgggctttatgactccatttgtatggatgtttatttcttcttatgaaatgctaagacaaaaaataataaatgaccgttctattagtagtttgattcagttggaatactcggggtttgatggagcaaccgtaccaatttgtacattcactttacgaaattatcaaagtagtattgaaggggaatacgttagactgtcggattttagaggggcagaaaatcaaccaacaaagacgttggaagcagttcaaaatccatctgttccgtatcggtactcatttgatcaagaaaacttcagtaagcttccaggtaatccgattgcatactggtatagtaagcaaaaagtaaaagctttttacgatagtggaagacttgatgattttggagaaacaggcaaaggaattggaacaggaaataacgatagattcttaaaactttggtatgaggtagaagcaaacaaattcttattactaaacaaacaaccagattcaaattcaaagtggtttccttataataaaggcggagaatttaggaagtggtatggtaacaatgagtttgtaataaattgggaaaacgatggcgaagagctgaagaaatttcctaactcatatttgagaaatcagaaggactattttaaatcaggtttaacatggactaaagtgacttcgagcaaatttagtcttagatattttggtgacggttttttatttgatgatggcggatgttgctttttcgcaaatgatcctaaaatgcatttttatattttaggtttattaaactcaaaggtatttaatttaattggggaaataaatcctactttaaattttcagcctggtgacatagcaaaagcaccaatattaatttcaaatgaatctacccaaagagaagtaatgaatatagtaaatgaaaacattcaaatctcaaaggaagactgggacaactttgaaacttcatgggactatcagaaacatccattactgattagtgcaaaagatactttgactattgaaattgcatttaagttatgggatgaatgtgcaaaaaatcaattttatcaacttaaaaagaatgaggaaaggttaaatctgattttcaacgaactttacaacttacaggacgagcaatcaccagaagtattagatagagatgttacagttcgaaaagccaatttagaacgtgacattaaaggattcatctcatacgtaatcggttgttcattcggtcgctattctcttgatgaagaaggtataatttacgcaggaggcgattttgattcttctcgctatcaaactttctcagcagatgaggacaacattcttccaatcctgcaaggagcttatttcgaagatgacatcgtaacaagatttattgattttgttaggataacatttagtgaagagacgcttgaagaaaacctcgatttcgttgcggatgcaattggacgaagaaaaaacgaaacggcaagggaagcgttgcgtcgctatttcttgaatgatttctacaaggatcatgtacaagtgtataagaaacgaccgatatactggctgtttacatctggcaaggaaaaggcgttcaattgtctcatttatatgcatagatacgataaaacaacgctatctcgtattcgaacagattatttacatgaggttcaaactcgcttagatgcagaaaaaaataatttgcttgaaataattaatggggattccacagcaagggaaatcaacagtgcaaaaagagagctgaagtcgctcgataagaaaatcgacgagttaaaagcgtatgatgagctgttacaccatatggctgatatgcaaattgagattgacttggacgacggtgtaaaagtgaattatgagaagtttaaggggttagtggcgaagatttga

SEQ ID NO: 2553 - DNA, 3741 bp, Vibrio cholerae; identical to SEQ ID NO: 2398

SEQ ID NO: 2554 - DNA, 3741 bp, Vibrio cholerae; identical to SEQ ID NO: 2398

SEQ ID NO: 2555 - DNA, 3741 bp, Vibrio cholerae; identical to SEQ ID NO: 2398

SEQ ID NO: 2556 - DNA, 3741 bp, Vibrio cholerae; identical to SEQ ID NO: 2398

SEQ ID NO: 2557 - DNA, 3657 bp, Desulfotomaculum gibsoniae
atgaataaaacagcggttaaaaattttgccatatgggccagaaacaagctcattgcagagattacatataaagccggactgcttggcatcaccgacagtgaagttaaaagtcccctgccgcagtctacacaggtagttcagtttttcgatattggtaccagggaaccttactccatcaccggtgttgaaatagaacagcgcaaaaagttggcagagataatccagcggaaggccggccagacagattataaaactgcctttcaaaatgtggttgaagaagtagcctacacctggttcaaccggctgattgcggtgcgttttacggaggtgaacgactatctccccacgcatgttcgagtactgtcctccgaaagcagcaataaagtcgaacctgatttaattaccaatcccatggatgctgagctagattataccccatatgaaaaagaccggattatgcagctgaaaagtgataatcagttggacgagcttttccgtatgctttttattaagcaatgtaacgcgctaaacgccattttgccggagttgtttgagaaaacccatgactacaccgagcttttgctaaatgtatccttcactgatcaggacggagtggtttatcatctggtgcatgatatagccgaggatgacttcaatgtggcgaaagaaggccaggtcgagattatcggctggctgtaccagtattacaataccgagcccaaggaagagacctttgctttgcttaaaaagaatgtcaaaattaccaaggaacgtatcccaacagctactcagctatttacaccggattggattgtccgttatatggtggaaaacagccttggccgtctttggttggagcgtgagcgggcatcttcgggattgtcagatgagtatctaaacggcagttactttggatggaagtattatctcgaagaagcagagcaagaacccgaggttgaggctcaactctcacaaattcgggaggaatataaatcaatcaagccggaagatatcaaaatagttgacccctgcatgggcagcggccatattttggtatacgcttttgaagtgctaatgcagatttatgagagctatggctatagtcggcgtgatgccgccaagagtattattgagaacaacctgtatgggttggatatagacgatcgtgcttatcagctggcttattttgcagtaatgatgaaggccagacagtatcatcggcgcattttgaatggtgagactaaatgtcatgtttactcgattcaggaaagcaatggcatcaaccgtgggcatctgcaatattttggagcgggcatgagtgacattgaaaaggattctgccctgacgcagatacagcatcttctagatacaatgacagatgccaaggaatatggctcttttcttaatatagaaaatcttgattggacgctgttaaatacattcgttggaagccggaacgtcaatgaccagttgacctttgatacagtagggctgaacgatacacagtcacagctgtgccaactggttgaaattgcggctgtgatggcaaataaatatgatgttgttgtgactaatccgccgtatatgggcagtagtagcatgggggcaaagttatctgattttgttaaacgagaatatccagatagtaagagcgatttgtttgcggtattcattcaaaggtgcggtcaaataacaaagaaaaactgttatcaagctatgataacccagcatgcttggatgttcctttccagctttgaaaaacttagagaaaaaatactgcgaaaaaatatagttaacatggtacatcttggtgcaagagcctttgaagaaatcggcggtgaagtagttcagacaacttcattcgtatttcgaaatagccatttaaaaaaatatcagggtagttatgtaagattggtggattatagtagccagaaggaaaaagaatccgcttttatagacaaacataatttgcatacagctaaccaagaaaacttttctaaaatctctagaatgccaattgcgtactgggttagtgataatataattggtacgtttgaatataaagatatccccaaaatagcagagggaagaatgggtcttacaacaggcaataatgattattacctgagactctggtatgaagtaagcagcagagatataggattcaatcatacgcgaagccaagcaaaacaatcttgtttaaaatggtttccatataataaaggaggaagctccagaaagtggtacgggaatcgtgaatatgtagtaaattggcttgctgatggtaatgaattgcaaacaaaaatgcatcctgatggtaaacgtatatgggcgcataattttaacttagaatatatttttaaaaagcatattagttggtctgatataagtagtggctcaatttcttttagggcatatgaggaaggctttttgtttgattcatctggggcagctgctttcgttgatgattctcagtattattcactgttaggatatcttaatactaatattgttgataatttagcaagaatcttaaacccaacgtttcacttcaaattgggggactttattaatttaccgtataaaattattaaaaatattaatgtagataatctggttaaacagaacatccaattatctgcatgcgattgggatagctttgaaacttcgtgggattttgttacacatccgttgatagcttacaaaatagttgcaggttatgctgaagcacctatggaaaaatcgaagtacaaaataaaagatgcttttgctagttgggaaagcagtgcagaagcactgtttaatcagctcaagaaaaatgaagaagaactcaaccgaatcttcattgaaatctatggtttacaggatgagctgacacctgaggttgaggacaaagatgtaactattcgtaaagctgaccttgtccgtgatatccgttcctttatatcctatgcaattggttgtatgtttggccgctacagccttgatgtaaatggccttgcttatgccggtggcgaatgggatgacagcaaatacagcacctttatcccagacaaagataacattcttcctatcaccgatggggagtactttgaggatgatattgtaggcttgttttgtactttcttaaaaaagacctttggtacagaaacattggaagaaaacctagattttattgctaaagccctgggcaacagtggcaacacttcccgtgacgttatcagcaattacttcctaaaagacttcttcaaggatcattgtaaaatttaccaaaagcggccgatttactggttgtttgacagcggcaaagcagacggctttaaagctctggtttatctgcatcgctataatgaggataccatcggcaaactgcgtattgactatctccaccggatgcagcgtatttatgaaagcgagattgccggaatgcaggaaaccatcgaaaacagccccaatgcccgtgaagtatcagctgccaccaaacggaaagaaaagctggtcaagcagctcaaagaaaccaaagaatatgatgaaaaaatcgcccacctggcgctggcccgtattgctatagatttggatgatggcgtgaaggtcaattacgaaaaagtccagaccggtacggatggccagaagctcaacgtactggccaaaatctaa

SEQ ID NO: 2558 - DNA, 3741 bp, Vibrio cholerae; identical to SEQ ID NO: 2398

SEQ ID NO: 2559 - DNA, 3633 bp, Enterococcus faecium; identical to SEQ ID NO: 2506

SEQ ID NO: 2560 - DNA, 3711 bp, Vibrio shilonii
atgaataccaacaaactcaaaacttatgctccgaaagcccgtttggcttttatggatgcagtaaaaaaacgcgctgccgtactcggcatttacgaaaataaaatcagtgaagccacgacacaaggaactgatacccttattgaagggcgtatctttacacgcaagcaaggtcaacagcgtcaacagttagtgaaacgcatcgaagcgcttggtggtggtaaagatggctacaaccaatttattaacgaaatggcgtttacctggtttaaccgttttacagccattcgtttcatggaagtgaatggctatcttgaccatggcttccgtatgctgagtaaagaagagggttcagagtttggccaaggttttgaaatcttagctcatgccgctgatgtggcagaggatttgggattaaataaatccgacatcgtagaaatgctattagctggcgacaaagaagaagagctgtatcgtgaattattgctcgctcaatgccaccagctcagcaaaatcatgccattcatgttcgagaaactggatgatgccaccgagttgctactacctgataacctgactaaaaccgactcgattctaaaagagctggttaatgacgtacctgaagataactggcgagaaatcgaagtcatcggttggctgtaccagttctacatttccgagcacaaagatgcggttattggtaaagtcgttaaaaaagaagacattccagctgctacacaactttttactccaaattggatcgtaaaatatttggttcaaaactcacttgggcgccagtggctagccacctaccctgactctgagctgaaagataaaatggaatacttcatcactcctgccgagcaaagtgatgaagtaatagaacaactaaaagcgatcacgcctaccagcatcgatccagagcaaattaaagtcctcgatcctgcttgtggtagtggtcatattttggtggaagtgtacgaggttcttcgtgaaatctacctggagcgtggctaccgcttacgcgaaattcctgagttaatccttactaagaatatctatggcttagatatcgacgaccgcgccgcgcaaatggctgctttcgctgtactaatgaaggctcgcgaagatgatcgccgtatctttagccgcgttgatgacaatcgcattcaactaaatattcactcaatccagtcaacagaacaccttgatatcaataagctttggcaagacttagatctagatgaaaataaacaagcaggctctatgaatgatctgtttgcagagccgcagttagagatagcagaaccatcaactgagaacaaaaaatatctagagctacttcgctatctaaaacaaaaatttattgatgctaaaaaccttggttcgttgattgaaattgacagccagcgctatgatacgctttctaagctgaaaacaaagctggaggaaaaagagaaagatagtaacccaacagttcgtgaaacatctgagacactgttacctatcattaatcagtcactaacgttatcaaccaagtatgatgtagcagtagcaaacccgccttacatggggtctaaaggtatgaatagtgttcttaaagactttgcgaagaagaactatccaaactcaaaatcagacctttttgcgttgttcatcgagcgtggtttcaaatggcttaagcaacaaggctacaactctatggtaactatgcaatcatggatgttcttatcgagctttgaaaaaatgcgacagggtttacttaaaaactcaaccatcgaaacgatggtgcatatgggtaatggtgttatgaaaattgcatttggaacaaatgcaactatcttcagaaactctcacatcaacggatacataagctcattctcatattgtgagaatgaggatataaacgaacacggcgtaccatttgattttcctgtacaaaataatagactaaaaaatacaccttcagatgaatttcaaaaaattcctggaaatccaattgcttattggatagaggaaagtgttttcaaacttgtaaaaaactcacaaactttgggtaacatcgctttggcaagaatgggccttgcaactggaaacaatgctaaatatgtgcgtctgtggcatgaaatatcgcacgataattttggtataggattagaatcaaggcaagactctcaaaagagccagctaagatggtttccatacagtaaaggaggaagttatcgaaaatggtatggcaacaatgaacatgtcgttgattggttcgatgatggcaaacaattacagacgactatgcaccctgatggaaaaagaatctgggcgcataatttcaacctagatactatcttccaggattcaattacttggtcagatatcacttcaggaaacctatctgttaggtacaacgattgtggttttctatttgatggtgcaggtacaagcgcattcttccaaagccaagaacataagatttccgtcattggttacttaaatacccacttcgcaaatggcttctcaaaagtactaaatccgacaatgcactttcagactggtgatttcagaaatatgcctgttccagaaatcatacactgtaaagagtggaaagagacagcattgaagctaattgacattcacaaagcagattgggattcaaaagagacatcatggggatttacatcaaacgagttgattaagcatcgcaataaaaaaacagagtatagcttcacatctttagttgaatatcgggaaaatgttgtatcaaatgctttcaaattggaaaagtggcttaatgatagtttaagttcttctataggcttatctgaaccagttttagactcagcaatattatcgagtataactttatttgctaatcctagtcactgctatgcaaatgataaaacagctactgaacaaatcaatctcgtgcaatcttctactatcagcgagttattatcatactctatcggctgcatgatgggtcgctactcgctagaccgcgaagggttagtctacgctcactctgggaataaaggctttaaagaattggttgctgatggagcatacaaaaccttccctgcggatgacgatggtataattccattatcggtcgaagaatggttatttgaggacgatgcaactagccgcttccgagatttcgtcaaaacggtttggggagaagaacatctacaagaaaacctcgacttcgtagcagaaagcttatgcttagatgcaatcaaaccgaagaaaaatgaaagctcgatggagacgattcgtcgttacttctcgactcagttctacaaagatcatctgaaaacttacaagaagcgtcctatttattggctatttagctctggcaaagaaaaggcatttgaatgcttggtgtacttgcatcgttacaatgaaagtacccttgcccgtatgcgtactgagtatgtcaccccattgatgggtaagctggaaactcagcactcggtcttaacggaaagccgcacaaacgcgagtagcacagaacagcgacgtattgataaagagttgaaatcaatcgagaagaaacaatccgaactccgtgccttcgatgaagagttgaagcacttagcagaaatgaagatttctatagacttagatgacggcgtaaaagttaactacggtaaattcggcaacctactcgcagatgtcaaagcgattcatggtaaaaatccagaagaacttaagtaa

SEQ ID NO: 2561 - DNA, 3393 bp, Brachybacterium paraconglomeratum
atggacaccgcaccgctcaagtccttcgccacgtcagcacgcaccgaactcatccgcgaagtgagcgcccgcatcaccgcggtgctcgcccaggggtcgcccgagcgcgtcgaacagctccgggccgtgaccgctctggaacgcgtcatcgccgccgggggcggcggagacaagggcagggcgcacgtggccgacaaggttgcgtacacctggttcaaccgcatcatcgccttgcgctttatggacgccaatggtcacaccggtctcggtgtcgtctcgcccgcgaccgatcaggtcggccagcccgaggtgttggcggccgccaagcgcggccagatagacggtgatgtggttaagggcgcaagcgccgcaaccatcgccgggctgctcgacggcacccgccagcctcgccccggcgtcgacgcacaagccgaggcatacgcgctcctcctcgcggattactgccgctattggaacaaggccatgcccttcatgttcgagcgcgaaggtgactacaccgagctgctcatacccgccaacctgctcgccgagggctccgtcctgaaccgctcggtcaaggtgctcaccgaggaagtctgccaggacgtcgaggtcatcggctggctctaccagttctatatctccgagcggaaagacgaagtcttcgccgggttcaggaagaacaagaaggccggcgccgacgaaatccccgccgccacccagctcttcaccccacactggatcgttcggtacctcgtcgagaactccgtgggccggctgtggatgctcaaccatcccgagtcgcgcctcatcgatcagatggactactacatcgccccggtcgatgaagagaccgacttcctcaagatcaccacgcccgaggacctcacggtaatcgaccccgcgtgcggttctggccacatgctcacctacgccttcgatctactcttcgcgatctacgaagaggagggctacacgccgtcgcagatcccgagcctgatcctcacgaacaacctctacggcaccgagatcgacccgcgcgccggggccctggctgccttcgccctgacgatgaaggccgcagccaagcgcaagctcttcctgaagaaccccgtcgagccggccatctgcgtgctcgaaccgatctccttcagcgccgacgaactgagctacctcgttaccagagacggcgagcgttacgctgaggaagtgttctggaaccagttcgccgtcgccgataccttcggatcactcatccaacccgaccccgccctgacggtccggctcgccgatcacctcgcgacgctcgacgctgagggcgacatcctccgtgccgacgcgcttgacagggcccaggaggtcgtccgccaggcgaagttcctgtcacctcgctactccgccctcgttgcgaatcccccctacatggatgcgcgaaacatgggaggggttctgtatgacttcgtagtggagtacttcccggaaggattcacagggatagatctcgccttcgtgcttcggtcgcgttcactggtccaacggaagggtttcctcgggcttctgagcatggatagctggctcgggaacgtcgaatgtggggagttccgagatgtcgtccgtgagacattgcttccccgtacagtgctccacctcggcccgcgggcgtttcccgagatcgcgggtgaggttgtacaggtttctgccacggttttccagaatgccgctcccgccgccgtcaagagcacattcatcgcggctaccgggggagctaccacggaggcgaaggtcgcgcagttccgcgacccgtctcggcgctacgtgcatacgcttgattggttcgatgtctttccgggtcgggtcttcacgccctatgcagcgtccgaaagcgcacacagcacgttcgcctcagcaccgaccatgagttcgatcgccgaagtccgtacaggactccagaccggagacaacgccgggttcctgcgccagtggtttgaggtctcctactccagcgttcatgtcgatggattcgcagggacctctcgctgggtgccgtacgtgaagtcaagttcgccgacccgatggttcgcgcgcgaggacttagtcgttgactggcggggcgatggcgacgacattcgagcgcatccgagttccgtggttcgcaacgcggcgtactactttcggcgcggtctttcctacggtggactcgcggggcacctcaaggcacgccttgtgccagcgggcgccatcttcgatcagaagaactcaatggtgtttcctgtcggggcgaccacgacagggcagctgcttgcgctaatgaacagtcctgccttcgaggttcttgctcggctggtctctccaaagggtttcggtgtcggcacactcgcccgactcccgatcccgaaagaagcgctggcggcgccgcgtatcgaagcaatcgccgagcgagcggccgagctttcgcgcacaggatttgatcggtcggagacatctcgcggtttcgtggggctcgactccatcttcatgggcgccgagaggcattcctcacttcgggtcggcgtggaggcgatccaggagacggacacccgaattaagagtgagttgagaaacattgaggcagagaacgcgcgaatttttcaggcggccctgctcgccgtccctgaggagccgccagccgaggtacgggccgcgccgccctaccctggcgcctcaatagctcaggatctggcgtcgtacgctgtcggttgcatgtttggtcgatacagcctcgatgagtccgggctgatcctcgctgatcagggtgtgacgttgcaggactacctcgcccgggtgccgacgccgacgttcatgccggacgctgacaacgtcatcccgatcgttgatggcgactggttcgaggacgacatcgtcgaacggttccgccaattcctgcgtgccgcgttcggcgagcaacacttcgaggagaacttgcggttcgtcaccaagtcactcggtgtgaagaacctgcgcgactacttcgtgaagtccttctacaaggatcacgttcagcgatacaagaagcgccccatctactggctgttctcgagcccgaagggctcgttcaacgccctgatctacatgcaccgctacacaccgtcgaccgtctcaacggtgctgacctacctgcgggagtacgtgaccaagctggagtcggctctccagcaggccgagcgtgcggggaacgcgaaggaagcggatcgactccgcaagatcctcgtcgagctgaacgagtacgagcacgacacgctcttcccgaaggcgtccgagaacgtcgtgatcgacctcgacgacggcgtcaaggcgaactacccgaagttcggtgccgcgctgaagaagattccgggtctgggaggcggcgagtga

SEQ ID NO: 2562 - DNA, 3678 bp, Salmonella enterica; identical to SEQ ID NO: 2365

SEQ ID NO: 2563 - DNA, 3660 bp, Eubacterium cellulosolvens
atggataagactgcgataagaaattttgcgatcgaagcaagaaaaatcttaatgaagtctgctattacagaagcaggtttttatggaataactgaagatggatgcaaagatcctgtgcagaaaggtaatgattttgaggtatacgaaactgttgccggtacagaaaacagaatctttggagatgatattaagcgccgtgcaaatcttgtgcaggcaattagagacctgggctttgagcaagtgattgaagaaactgcttatacctggttcaaccgtattatcgcgatccgttttatggaggtaaacaactacctccctacaagagtgcgagtcttatcctctgagacaggtagtggaacaccggacattattacgcaggctgatactgtggagctgaacctcacttcagatgaacttgaaaagattcagactgctaagagagaaaatcgttatgacgatgcgttcagaatgctttttataaagcagtgtaatgaattgaatgctatattgcctggactttttgagcagaccgatgattacatggaacttcttcttaaaatcacttacaccagtgatggcgtaattcgtatgcttgtggattccattccggaagatgatttcaatgttgagaccgaaggtcaggtggagattattggctggatgtatcaatactacaacaccgaactgaaagatgatacatttgcgaagctgaagaagaatataaagattaccaaggaacgaattccagctgcaactcagctttttacacctgactggattgtaagatatatggtcgagaactcccttggtagagtatggattgagcatttacgtgcggtaaatccatctgttgacgaaaaagcaaaagctgaggaatttgggtggaagtattatcttcctgaagcggagcaggaagatgatgtgcaggctcaacttgtggaaataagaaagacttataaggacttaacacctcaggatattacctgtatcgatccttgtatggggtctgggcatattcttgtttatatgtttgatgtccttatggatatctatcgcagtgaaggcttcagtgagagagaagctgtatttgacatactcgaaaagaatatcagaggtcttgatatagatcgtcgagcttatcagctgtcatattttgccttaatgatgaaggcaagaggatataacagaattttcttcagaggccacgaggatacaaatggaaatagagttcaggctgtgccacaagtatatgccattgaagagagcaattttgttgacagagaacaattaaaatattttggagctggcttggatgaacttagtaagaataatgcatttaaccagttaaatggtttgattgattcactaaaggacgccaaggaatatggctcaattcttaatatagaaaactatgattggaatttgctgagaacatatgtggctggaattaatgaagaaggtcaatcgtctttgtttgggtatatggcataccaatccagtgctttattaaagcggcttatttccgtaggtgaggtgcttgcatgtagatacgattcagtggttactaatccaccatatatgggtagtaatggtatggataaatcattaactgattatttggttagtaattatcctgagacaaaatatgatttaagtacagtcatgatggagagaagcttgaaatacgccaagcatggtggatatatttcaatgataaatattcctgtttggatgtttctttcaagttatgaaaagctaagaaagagattgttaaatgactgtacattcgcaaacatggctcattttggacgaggtgtgtttggatcggattttggaactacttcgtttgtaattagaaacttgaagcaagataattattgcggctattataaaaaactgtacaaaagacaaggcgcagttgactctcttgatgaaaaacttgagatgttttttgatgagcagttgaattattacacaaaacaagaagacttttatttgattccagggtatccaattgcttattgggtgaaaaataaagaattgtttactgtgggcgaaccattagagataattgcaaatcctcgtcaggggcttaaaacccttgataatgaaagatttttgaaaaattggtatgaagttgattttactaaagtaggatttgatttttcgtccttagaagaagcaaaagcatctaagaaaaaatggtttccaattaatcatggtggtgaataccataagtactacggaaacaattgtattttggtgaattgggagaatgatggcgaagaaatgaaaaaacttgccattgataaatataattccattacacgtacaattaccaatatgggctcgtattttaaggaaggcatcacatggactgttatttcctctgcctcgacatcattcagaaggtattataaaggttttattttcagcaatagtggacaatcaatagttccagagacccctgaattattggattatttaacaggattattaaatacaaaaattatacagtatattctggccgttttgtcaccaacattaggctttgaatcagggtatctgaaaaaaatagcaattcgtgttgatgataattataagcaggaagttgagacactaaccagagaagctattcaaatatcgaaagaggattgggattcttttgaaaccagctgggattttaaaaagcatccttttattcaatacaaaacgacaggcttaataaaagatgcttttgaaaactggagagaagtgacaaaccaacgttatcggcgaatgaaagatattcagcaacgactgaatgaaatattcattgatatttatggacttagcgatgaattgactccggaaatagatgagagagacattacgcttagcatggctgataagaaagaagatgcagagtcttttgtatcatatctagtaggatgcatttttggaagatattcagttgacacagatggaatagcatatgccggtggagaatgggaaacggatggatataaaacgataagtgttgatatggataatattatcccgattactgatgaggaatatcttgaggatgatattgtcaatcgaatttgtagcgcaatagcggatatttatggcgaggaaaatctagatgcgaatattgcgtttatagcagattctttagatgttagtggtgcaaatcctaaggataaacttagacactattttcaaggaaatttctttaaaaagcattgttcaacatattcatttggctcttctggtagaaagcctatttattggatgtttgatgcaggaaagcaaaacagctttaaatgtcttatttacttgcatagatatgaggaagataccgttggacttattaggtctgattatttatcaaaagtgcagaatgcaattgaaaatgcgctgaaaaatgcagagtatgcgataaatacatcgggtagtgctgtagatagagcacaagcaacaaaaaagcgtgataagtatatcaaacagctggctgagattagggcttattatcctgcattatctcatattgcactacagagaataggattaaatctggatgatggggtaaaagcaaactacgccaaattccaaggtattgaagtctctgttgaaggtgagaagaagcagaaagtggatttgttggcaaagatataa

SEQ ID NO: 2564 - DNA, 3669 bp, Pseudoalteromonas luteoviolacea
atgaacacgaaaaatttaaaagcatacgcacctaaagcacgaagagagtttatcgcagcagttaaaaagcgtgctgcccaatttggcatttatgaagatcgtatagaggaagtacgcatagaaggtggcgctgccattattgaaggtcgtgcatttactcgtaaagaaggtgagcagcgcaagagattagaaagcaaagtcttagtacgtggctatgacatgttcatccgtgaaatggcttacacatggttcaaccgtcttgcggccatacgttatatggaactgcatgattactttgaccatggttttcgtgtgctttctaatcccagtaaccctgacggtttacctgaaattctaagtcatgcgtcagatgtcgctgacagtttagcgttagacaaaagtcacattattgagttacagctagccggtgataaagaagaagagctttaccgcgagttactgctgggccaatgtcatcacctccataaaatcatgccgttcatgttcgaagcattggatgatgcaacagagctactacttccaaataacttaaccaagactgattcaattttaaaagggtttatcaacgatatccctgaagaagattggcaagaaattgaagttatcggttggctttatcaattctacatttcagaacacaaagatgcagttatcggtaaagtggtcaaatcagaggatattccagcggctactcagctattcacgccaaactggattgttaagtatctggtacaaaactcagtaggtagacaatggttagctacttaccctgactcagagcttaaaggtaaaatggaatattacattgagcctgcggaacaatctgatgaagtcatcgagcagctaaaagcgatcacacctacaagtattgatccagaagaaattaaagtactcgatcccgctgctggttcaggtcatatcttggtagaagtctatgaagttttgcgagaaatctatcttgagcgtggttacagacttcgtgaaattccagagctaatccttaccaaaaacatctacggtttagacatagatgatcgtgcggcgcaacttgctggctttgctttaatgatgaaagcccgtgaagatgatagacgcatctttcaacgcgttgaagacggtgaagtgtcgcttaatgtcttctcattacagtccacagaaggactagatatcaacaccatatggaaaggattagatttagaaggcaatcaacaaattggctcaacaggtggtctttttgacgagttatctgtcgcccccgacgacctcattcctgcgaatgcaggaatctacaaagaatactttgaattactgcaaatgcttaaaactgcgtttctacaagccaaaacccttggttcgttgatacaaattgacgctaagcatttagataaccttttttcacttaaacagcttttattagaaaaattagcaaattctgatacccaatcaaaacctgaagtcgaaaaaacactgcctattgttaaccaagcaattgtgctagctcagaagtacgatgcggtatgtgccaatccaccttatatgggatctaaatatcaaacaccgatagttaaacaatatttaaaagataattttaaaggttatgagaaagaccttttctcggcatttattattaggaatttacagctagcaaaaaataatggtgaacttggttttatgactccatttacatggatgtttatcgctgcgtttgaatcgttaagaaatcatttaattaataaggaaattataagtagtcttattcaattagaatattcaggctttgagggggcaactgtaccgatttgtgcttttacactaacacgttccaacattgaagattatcggggttcatacataaagttatcggatttcaaaggagcaaataatcaagctcctaaagtgcttgaagccatcgatgagcctgattgtggttggttatatagtgtaaatcaaaaaagttttaatgttattccatcctctcctatcgcatattgggcatcaactgatttacttaaaatgttcgaagaaatcaaagttgaaaatttttctgttgcagagagcagtcaaaatcttacgggtaataacgaaaggtttttacgtttttcgtgggaagttaactcaaatactatcggaattgaaaagaagtggcttttctatgctaaaggtggcggatttagaagatggtttggaaatttagataatgttatcaattggagtgatgaagcaagaagtttttataaaaaggaaaaagtgccaagaataataccagaatatctttggtataaaccaggtgtgacatggggatttattacatcatcaattccaagttttagattattgccaaaggccgcaacttttgatgttggtggtagctcaatcttcttcaaagatgataacaatattaacttttttttggggctttttaattcaaaagtaactctagacattgttggtatatataacccaactttaaactatcaattaaaagacatacgcaatttacctgtgcctgcactatcgcctgaattaaaggatgaaatatcgatgctggtgcagcactgcattgatatttctgagaaagattggtcaaggctagaaacatcaaatagctttaagtcgatagagtttgattctacgcatggactattgaagcaaaactatttgaagcttgagggtaagtggcaagaggaagtttctagactgaaagaatttgaaactaaattgaataagatatttatatcatcatatggtttgtgtgatgaaattaattacaaagtagaaaataaacgaatttcactttctataaacccggactatcaatatgggggtggttcttccgagaatcgattcagattgaagtcagataagagtgttcagcttttgtcatattcaattggctgtatgatggggcgctactcattagatcatgaaggtcttgtttacgctcattcaggtaacgacggttttaaagatttggaaacaaaaggagcttacaaaactttccctgccgacgacgatggcattattccattagcttccgaagaatggttatttgacgatgatgccaccactcgttttaaggattttgttaaaacagtgtggggcgatgagcacttatctgaaaatctagagtttgtcgctgaaagcttatgtttacatgcgcttaaaccgctctctaccaaaaagggagggggcgaaagtgcgatggatactatccgccgttacttctcatcgcaattctttaaagatcactgtaagacatacaaaaaacgacctatttactggctatttagctctggtaaagaaaaagcatttgagtgtttagtctatctgcaccgttataacgaaggcacattatctcgtatgcgtactgagtatgttacgcctctcatgggtaaatatgatgcacaattagcaaggctttcagacgacatggttaacgccaccggctcagaagcccgccgcatcgaaaaagacatcaaagcgttagagaaaaaacaagccgaactccgcaccttcgacgagcaactaaaacattatgccgaaaaacgcatcaccctcgacctagacgacggcgtaaaagaaaactacggcaaattcagcaacctactagctgacgtgaaagccatccacggaaaggcggtgaagtag

SEQ ID NO: 2565 - DNA, 3615 bp, Clostridium perfringens
atggataaaagtaagataaagtcttttgctatatgggcaagaagaagattaatagaatccgtaagtgataaggcttctaagataggaatctttgaaaatgagattaaggatgtagtagcagttcaagggggatttaaaatagtggggagtgaagaaattcttcccctttcaaaagaacatagagatgctttagtaagtcaaattaaggataaaggctttgaacaggttatggaagaggttgcatacacttggttcaatagatttatggggcttagatacatggaggttaatgagtatcttccttcaggaataagaatactttcttcagaagtagaaggaaaatcagaaccagatgtattaagtaaagtatcagaaattattgatgaattagaattaaatggagaagaaatgtactctcttttagattcaggaaaaaatgaggatagggagaaggcttacagaataattcttgtaaaacaatgtaatgaattaggtaagataattcctcaaatgtttgaaaagataagtgattatactgagcttttattaccagataatcttttagaagaaggatctgtaataagaaggatggttagtgatatagaggaagaggattggaaagaagaagtagagataataggatggatgtatcaatactatatttctgagaaaaaagatgaagtctttgcaggattaaagaaaaatataaagataacaaaggaaaacatcccagcagctactcagctatttacaccaaaatggatagttaaatatatggtagaaaactcattaggaagactatggcttgaaggtcatccaaatgaagaacttaaaagacattggaaatattacttagaagaagcagagcaagagccagaagttcaagaagaattaaataaaataagagaagagcacagtaaactaacaccagaggatttaaaagtgttagatccatgtatgggttcaggacatattctagtttatgcttttgatgttctatatgaaatatacaaaacagcaggatactcagaaagagaaattccaagaaaaatacttcaaaacaatctatatggattagatatagatgatagagcagcacaattagcaagctttgccttaataatgaaagcaagacattataacagaagattatttagagaaatacaaagagaagaattagatttaaatctttgttcaatacaagaaagtaatggaatagaaaaagaagcaatagaatacttctcaaatggaaacaaagaacttcaagaagatgtagaatacctagtaaaagtattcacagatgcaaaagaatatggttcaatcctagaagtagaaaaagtaaactttgaagcagtaaaagaaagattaaaagaaataggacaagaagataacttaatgtttggtgactatagaaaaatacttttagaaaaacttcctactttagtaaaacaagctgaaataatgagtagaaaatatgaaatttgtgtaactaatcctccttatatgggaagaaaaggaatggggaaaaaattagctgaatatttagattttaattatttagaggcaaaaggagatttatattcagcactagtattaaaattatcaaaacttactaaattaaaatatttttattctgccatagtaccacaatcaattatgtttttatcaagttttgaagaaattagaaaaaacatttatgaaacatcaacaattaataatatggtgcatttaggaatggggacatttggagcagattttggaactactacatattgtatacaaaaacttaacatgaaaaaatataaaggaacgtatatacgattatctgattttaaaaatgttgatgataaaaatagtgaattttttaatataagccatagatatgtaataagtataggagaaatagagcatatagcaggtaaacctatagcttactgggttagcaaacgaatgattggtaattttaatcaaaatagtttatcgagttattctaaatgctgtaagggaattgatacaggaaataatgaaaagtttttaaggtattggtatgaaataaatattaaaaaggcttttttatataatgagaaatattgtttaagtgaaatatcaaaatggttcccatataataaaggtggagctactagaagatggtatgggaataatgaatatgttataaattggtttgataatggtaaagaagtcatacaatatccaaagtctaatattcgaaatataaactttcaattaaaaaaggggataacatggacaacaacatcatcatccttttttacagctagaattagtgaagagggtcatttattcgattcaaaaggatgtatgtcttttccattagataataatgatatcaattatatattagctttaatgaattctaaaccagcatatgagtttttaaaaataataactcctactgtggattataatccaggaccagttgggaaaataccaactataatgcaaaatgaggatagtatatatgagttgacagagtataatattaaaatttcaaaaaatgattgggattcatttgagacatcatgggattttgaaaaacatcctttattaaaatatttaaataatagtgatgataataaaataagttctgctttttctaagtgggaagaagagtgtgaaaataattttaatcaattaaagagtaatgaagaagagttaaatagaatatttattgatatttatggacttcaagatgaacttactccagatgttgaggataaggatgttactattagaaaagctgacagggaaagagatattaggtcatttatttcttatgctataggatgtattttaggtagatattctattgatgcagatggtcttatttatgcaggtggagattttaaggataaatgggatttagaaaataagaaggttagaaagatagagaaggatgaagatggtaacataatatctgattcatgggtagatgctactttccttccagatagggataatattattccaattactgaggatgagtattttgaggatgatatggtttctagatttgttgattttgttagaactgtttatggagaggataccttagaggaaaatttagattttatttcagattctattggaagaaaaggaaatgaaacttctagagccactattagaagatacttcttaaaagatttctacaaagatcacttaaaagtatatcaaaagagacctatttactggatgtttgaatcaggtaagaataatggatttaaagctttagtttatatgcatagatatgatgagcaaacagtagctaaggttagaacagactatcttcatacacttcaaagaaaatatgaagcagagatagaaagagtaaaattaacaatggattcaagtgaagcaacagcaaaagaaaaaacagattctaaaaagaaaatagataaaataatgaaacaaatagaagaatgtaaagaatatgatgaagttgttgcatacttagcaaatgaacaaataaatatagacctagatgatggtgtaaaagttaattacgctaaattccaaggagtaaaaattataaattcaaaaaacaaagaaactaagatgaatttactagctaaaatttaa

SEQ ID NO: 2566 - DNA, 3633 bp, Enterococcus faecium; identical to SEQ ID NO: 2506

SEQ ID NO: 2567 - DNA, 3627 bp, Vibrio cholerae; identical to SEQ ID NO: 2397

SEQ ID NO: 2568 - DNA, 3675 bp, Escherichia coli; identical to SEQ ID NO: 2305

SEQ ID NO: 2569 - DNA, 3741 bp, Vibrio cholerae; identical to SEQ ID NO: 2398

SEQ ID NO: 2570 - DNA, 3741 bp, Vibrio cholerae; identical to SEQ ID NO: 2398

SEQ ID NO: 2571 - DNA, 3672 bp, Fusobacterium ulcerans
gtgaataagaatagcctaaaaatatttgctatagaagctagaaaagaacttatgagaaaaatggaagttagattgaaaatacttggaataaataaaaataatttagatattccagtaatattaggaagtcaagtagaagtaaaaggaaatctatactctaaatcaagttataataagttgattgaaaaatataaggaacttggatatgatgaattaatagaggaaagtgcatatatatggttcaataggcttatagccttggcatatatggaagcaaataaatatatagatgaaaaaatggtatttagtaatggctcaaaaatagagccagcaattatagatgaatatcttgaagctaatttttttcaaaaattagaaagagaagaacagaaaaaaatacatgaattgaaagataaaaatactctagaatctctagaaaagatgtattctatattggtagaagaaaaatgtgaggaactttcatctattatgccatttatattttcaaaaaaggggggatattctgatatactctttccttcaggattattaatggataattctgttcttgtaaaactaagatatgaaatagaggaatctaaagaaaatggtttggtgccaatagaattaataggttggttgtaccaatattataactctgaaaagaaaaatgaagtttttgagggattgaaaaaaaataaaaaaataacaaaggagaatataccagcagcaacacaattatttacacctaaatggatagttaaatatatggtagaaaattcattgggaaagttagctatagaatcattaggagtagactcagaaattaaaaaaaattggaaatactatatagaaactgaaaaagatataaatgttgaaaaaataaaaatagaagatataaaaatacttgatccagcgatggggagcggccatatgcttacttattcttttgacatactttttgaaatatatgagaatcttggttggagtaaaaaagatgcagtattatctataatgaaaaacaatatattgggattagaaatagatgagagagctgctcaacttgcttcatttgcaataatgatgaaggcaaaagaaaagtttcctagactattcaaagtattggaaaaattagatggtgaagaaaaatttaagttaaacatattagtgataaaagaaagtaataatatatctacaagaacaagaaaattaatagctgaaaattcattaaaaaatttagctataatgcttgataatttttatgatgctaaagaatatggaagtattttaaaaatagaagatatagatacaaaaaagttagaagaagaatttaaatctttaaatgaaatattaaaaaatcaaggtcaaacatccatgttcagaggaaatgacattttagatggaaatatagatgaagattttaaaaaaataaaaggaatgatacatcagcaaaaaataatggcagataagtatgaggtagttataactaaccccccatatatgagtagtagtggaatggatgaaaaattaaaaaagtatgttgaaaagaattataagaatagtaaaagtgatatgttctctctatttatagagaaatgtgaggaatttactaaggaaaatatgtatacctcaatgataacaatgcactcttggatgtttttaagtagctttgaaaatttaagaaaaaatattatagaaaatacagagatacaaaatttaactcatttggggacaagggcatttgcagatattggaggagaagtacttcaaactgttgcttgggtaagtaagaataaaatgccagaaatatcaggaaattatataagattagtagattataatagtgctgaatggaaggaaaatgaattttttaatcccctcaataaatataaagcatatcaaaaagattttgaaaaaatcccaggaaatcgtttaggatattggttgagtaaaaaagaagtgaaaattatttcatcttcggaaacaatggaaactatatcatatcccgcaacaggaatgcaaacagggaataattcttattatacaagagattggagtgaagtctctataaataatataaattttaaacctagtggatatgattttagagataaaaaatgggctttatatcaaatgggaggagattcaagaaaatggtatggtaacttggatagccttattaactggaaggataacggtaaggaagtaaaaaatgaaaaaagtgctgttataagaaacgagaaattttttttcaaaaaaggatttagttggaaaaggattacttctggggtaaatacaattagacttttaaaaccagattttatttttgatcaagctgctgattctgtttttcttaaacaggataaaaactttttatatacaatgagtttttttaatatgaaaattatgaaaagaattttcgagtttatagcacctactttaaatttgacatctggaactgttaaagaaatacccatttattttactgaagatttagaagttttcaaaaaaattaattgtctaacagaaaaatgtataaatatatctaaacaagaatgggactttcgtgaaacttcttgggattttgaaaagctttctttaattgatggggaaaatttagaatcagcatacgattcttactgtaattattggagaaatcaatttgtccaaatgcataaaaatgaggaagagctaaacaggatttttataaatatatatgaattacaagatgaaatggatgagaaagtagaatttgaagatattacattattaaaaaaagaggcaactataaaaaaaatagttactaattccatacaaatagaagaaggatttgaagaaatggaaaaaacttcagaaggatatctatttaatagaggagtagaactggaatttaataaagaagaattagtaaaacaatttttatcatatactataggttgtattatgggaagatattcaatagataaacctggacttataattgctaattccgatgataacttgattattgaaggaaataaagtcgttataaaagggacagatggagaaattagacatgaaatagaggaatcaagattttttgctgatgtctatggaattattcctgtaacagaagaagaagtttttgaaaatgatattgtgaagaaggtaatagaatttgtgaaaattctatatggagaaaagaacttgaaaaaaaatcttgaatttatagctgaagctctaggaaagaagaaagatgaaacagctgaagaagtattaagaaaatactttataaaagatttttatgatgatcatcttcaaagatacaaaaaaaggccaatttattggatgctgaacagtggtaagaaaaattctttttcatgtcttgtatatctacatagatatgaagaaaatactattgctagaatgagaactgattatcttacaccttatcaagaaataatagaaaatcaaagatcttattatgaaaaaatagttatagatggtaaaactattccaaaggataaaaaaattgctgagaaaaaattaaaagaattagaaaataacctgaaagaactaagagaatatgcaaatgaggtaaaacatatagctgagcaaaaaattgtattagatttagacgatggagtaaaagttaattatgaaaaatttggaaaaatattaagaaaaatataa

SEQ ID NO: 2572 - DNA, 3486 bp, Roseobacter sp.
atggacacgaacgcgctgaagaagtttgcccaatccgcccgtaatctgttgatcgaacaggtccgctccaagcttgatcttttgcttgatccggcctcgcctgcgcggcgggagcatccgcaggcaatgaaggagctcgacgccgcgatcgcgcgggatggtaaggcgcagttgatcgagcaggtggcttatacctggttcaaccgcttcaccgcgctgcgcttcatggatgccaatggctacacgactgttggggttgtatccccagcggaagggcagacacggcccgagatattggctgaggcgatggcggggaacctgcccgaggacgcgccggggagcatcgcggcgcttctcgatggccgcaccccgtcttctgatccgcaggccgaggcctaccgcctgctgttggtacatgcctgcaatcagtggcacgggccgatgccgttcctgttcgaggagctggatgactacaccgaactcctgatgcccgaggatatgctgtcgcaatcctcgatccttgccgagctgcgcaaggtcatgaccgaagacgcctgtcaggacgtcgagatcatcggctggctctaccagttctacatctcggagaagaaggatcaggtcttcgcggggctcaagaagaaccagaaaatcacggccgagaacatcccggccgcgacgcagctcttcaccccgcactggatcgtccgctacctggtggagaactcgctggggcggctgtggctgctgaaccggccgggctcaaaactggccgagcggatggactactacatcgcgccggaagaacccgagatggatttcctgaagatcgccaagcccgaggagatcaaggtctgcgatccggcatgcgggtcgggccacatgctgacctatgccttcgacctgctctacgccatctacgaggaagagggctatgacgcgacagagatccccgcgctgatcctgacgcacaacctgactgggacggagattgacgaccgcgctggggcgctggcagcgtttgcgttggcgatgaaagccgctgaaaagcttggtcgccgccgtttcctgcggatggagacgaagcccgatatctgcgttctgaagaaagtcagcttcgagccagcagaactccaagacatagaagccatggttggacgcagcctgttcacggcagatttgcgggcaacccttacccagtttgagcaagccaagaactttggttctctcatcatcccgaaactaaaagaccctcaggaatgcctgcgagtggttgaggaacaggatcttggtggcgacatgttccgtgccaagttgcgggaacggttgctgacagtccttcggatgtctgaggcactctcctccaaatatcatgttgtagtggcgaacccgccttacatgggcggaaaagggatgaacgggcctcttggggactacgccaagaaggaatatcccgacagcaagtcagatatgtttgctgcattcattgagagaggtttcgattttatccagcgcaatggatactctgcgatggtcacgatgcaatcatggatgtttctttcttcctacgagaaactccgcatcaaacttaatgagcaaagccatatcgtgaacatggcccatatgggcaacatggttatggggattgcttttggcacgagcgctacggtttggaagcaagggcaaaacacctcccagccaggcaactttttctatgtagactacgaagacttatctgaggaaaaaatccctgtcactttccctcctcaaaacgagcgaaactcaaaacaacgagatcgtggctggttctatcgggcctctgcaaatgattttgagaaaattcaagggattccaattgcttattgggcctccgcccgcgtgcgaaatgtctttgccaaaaataaaaatatcagcgaaggttttgatgcacgccaagggatggccactggtgataatgatcgcttcattagaatttggtctgaagtatctataggcaattttgaagaattttcaggttcaatggaatctgcatttcagtcaggaagccgttggtttccttacaataaaggtggagactataggaagtggtatggcaatagaatatttgccataaacttcaatagagcggattttgaggtgctggctaagatgggcaatcattgcccatcacgtcaattttattttagagaagcgattagttggtcaagaattggcagctcattaaattcttatcgatactatgatcgaggatttctgtttgatcaggcggggcattcaatttttcatgaggatgggagcgcgcttgagaatatttgcttaatgctgaacagtaagatgttttccgccgttgcaaaaatcgtaaatccaacacttaatcttgaagtgggaaatattggtcgttttccagacctatcaaatacagccaagcaaaaccgccatattttcaaagatctgattgcgctctctcggtcagactgggacgcctacgaaacttcttggaatttcacctcgctcccgttgctttcgtctgatcatcgcggcgagacgctggcggacagctacgccacgctaagcgcccattggcagtccatgacggacgagatgcagcggctggaggaagagaacaaccgcatcttcatcgacgcctacggtctgcaagacgagctgacccccgaggtgccactgaatgagatcaccctcacctgcaaccccgcctatcgctatggcatcaagaatgatgacgcggccaacgagacccgcctgcgcgccgacaccatggccgagttcctctcctacgccgtgggctgcatgttcggccgctacagcatcgatacccccgggctgatccttgccaaccaaggcgagacactggccgactacctcgcccgcgtgccggaaccgacgttcatgctggacgaagacaacgtcatccccgtgctcgacgccgactggttcgccgacgacattaccgaccgcttccgcctgttcctgcgcaccaccttcggcgaggcgcatttccgcgagaacctgcgctatatcgaggacgcgcttggcaaggacatccgtaagtatttcaccaaggatttctacgccgatcacgtgaagcggtataaaaagcgcccgatctactggatgttctccagccccaaggggacgttcaatgcgctgatctacatgcaccgctaccggcccgacaccgtctcggtcctgctgaacgactacctgcgcgagttcatcagcaagcttgaaggtgaacgtgggcggctggaaaagctgtccgatgatccgagcgccagccagggccagcgcacaaaggcgttgaaagacatggcggtcatcgccaagcagatcgacgagctgaacgaatgggaacgcgatgtcgtcttcccgctggcgcaggccaagatcgagattgacctcgatgatggggtaaaggcgaactatccgaaattcggcgctgcgttgaaaaagatcgttggggtgagctga

SEQ ID NO: 2573 - DNA, 3675 bp, Escherichia coli; identical to SEQ ID NO: 2305

SEQ ID NO: 2574 - DNA, 3522 bp, Paenibacillus elgii
atgaataagacagcattgaagaactttgcgattaatgcacgtaaagagctgatagagaagattaaagctaaggcttttaaaatagggattacggaggaaagcatcaagaaagctcaatttgaaagctcggatgcaatttacattgatggtaagcaactttctgcaactgaaaggaaacaacgggagaagcttattacccgcattaaagaaatcggatataagcaggttgtagaagaagtagcatatacgtggtttaaccgttttactgcattgcggtttatggaggtaaacaactatcttcctactaaggtaagagtattgtcctccagcaactctgatagccctgaacctgatattattaaagaggcattgacggttgatttggatattgataaagaactggtttatgagttgaagttaaacaataaaacagaggaactattcaagtatttggtcattaagcagtgtaatggcttgaataaaattctttccttcatgtttgaaactattgatgattataaagaaattcttttcccagatggattactggctaaagattcatttctgcgagagatgacggatgtaacaataattccagaagcggattgggaacaggtcgaaataattggttggttatatcaattttatataacagaagagaaagatagagtatttaaagcaaaggaaaaatataaatctgatgaaattccactcgcaacccaattgtttactcctcgttggattgttcaatacatggttcaaaacacattaggacggttttggatagagtctcatcctgaaaatcgtgacttaatcggtggctggagatactatcttgaatcacaggaggacaagcaagaaaatgcagtctctaaagcgttgagagtagaagatataaaatgcctagatcctgcaatgggaagtggacatatccttgtctatatgttcgaagtattctatgaagtctattgtaagtcagggtatatggaaagggaaataccgaaattaattattgaaaataatctttatggtttggatattgatgatcgtgcgtatcaactcgcatgcttttcaataattatgaaagcaatgcaatataacaatcgcttcttgagagttatcgaaaaagaaggcttgactataaatttagcttcaatacaagaaacttatatacttcattcaaaggatgttgaatacattgctggtgaaggaagcggcataaacattgagaagaccaaagaatttattgatcagtttaaaaatgccaaaacgataggctccttgttaaaggttacagaatacgatagcatttttttaaaagatagattggaaaaaatccaaaaagatccaattgatgatatttttatggaagaatcacgagttaaagcagacagattgctaccagctcttctaaaacaagctgagattatgaagatgcattatgatattgtggtgacaaaccccccatatatggggaatagatatatgaatgatgaattatcttcatttttaaatcgagaatatcctgactctaaatcagatacgtttgcgtcatttatggaaatagatcactatttaaagcccgaaagttttctttcaatgatcaatcaacactcgtggatgtttttatccagttttgagcaactaagaaaaaaggtaattaagaaaaagacgatatattccatgttgcatcttggaactagggcttttgaagaaattggtggtgaagttgtacaaacaactgcttttgttcttagaaactctttagacgaaaaattcaagggtcagtatgtgcgattggttgagtttcaagattcaaaagaaaaaatgcttaaaacaagaaaagctattgagaacccaagcgtaaattatagatatattgcaactatgaatgagtttgataagattcctggtgaaccactagcatattgggtaagtgcaaaggtaaaggtgctattttccaatggaacaaaattaagcgaagtagcagtacccaaacaaggattggcaacagccaataataatcgttttttaaggcaatggaatgaagttgcatttgataaaatcaattttgatgcgaagaatattgaagatgctcaaagttcggggttcaaatggttcccttacaataaaggaggggaatttagaaagtggtttggtaataactacttcattgtgaattgggaaaatgacggatatgaaataaagaactttaaagatgagaaggggaaggtacggtcgagaccccaaaatacgaattattatttcagagagggagttacttggtcagatattagcacctcaaattttggggtgagatatagtaatcagggttttattttcgatgtgtcgggatctatggcatttccattaaaagagaatctattgtatatctcagcattcttatgttcaaaaatagcttatgaatttttactaatcctgaaccctacgatgcattttcagactggaaacatagcagaccttccaattatttttacaacggatacagaagtgaaaaacaaaataaatgagttgtcacggaaaaatatagaatgttctaaagctgaatgggattcttttgaaatatcttgggattttaaaactcatccgttattacagtataaaagtttatcgttaatagaacatgcattcgaaaaatgggatattttttcaaaagaacaactattacaaatgaagagtagagaggaagaactcaatagactgtttattgatatttatggactacaagatgaaatgacacctattgtcgaagatactgatataactttaagaaatgcggatagagtaagagagactaagtcttttatatcatatgctgttggatgcatgtttggtaggtacgcattagatactgaggggcttgtttatgctggaggaaggtttattcctgaggtatacctaaaatttcctgtatatgaggataacattatcccgattcttgaagttgcatattttaatgatgatttaacttcaagatttattgattttgttagagaaacatttggtaaagaaaatatagaggaaaatattgagtacatcgcttattctcttggaaaaaaggaagcagaaacagctagagaaacaataaggagatatatgctcaatgatttttttaaagatcatttacaaacatatcagaagaaaccgatttattggctattcacttctggtaagcaaaaagcattcaactgcctaatttacatgcatcgatatgataaatccacactgtcgagaatcagaaccgactatctgcacgaactccagattcgattagatgctgagaaaaaatctcttctcgacattattaatggtgatggaacaactaaggaaattagcaatgctaagaaagaactcaagtcgcttgatctgaagatcgaagaattgcgagcatacgatgagaagctccatcacatggctgacatgcaaatcgagattgatttggatgacggcgtgacggtaaattacgctgaatttgaagggttactcgctccaatcaaataa

SEQ ID NO: 2575 - DNA, 3675 bp, Escherichia coli; identical to SEQ ID NO: 2305

SEQ ID NO: 2576 - DNA, 3573 bp, Vibrio cholerae; identical to SEQ ID NO: 2440

SEQ ID NO: 2577 - DNA, 3741 bp, Vibrio cholerae; identical to SEQ ID NO: 2398

SEQ ID NO: 2578 - DNA, 3741 bp, Vibrio cholerae; identical to SEQ ID NO: 2398

SEQ ID NO: 2579 - DNA, 3510 bp, Geobacillus sp.
atggttatgcataaaacagagctaaaaaactttgccatttctgcacggagagaattaattgaaaaagttgcattgcgtgccaagctttttggaattgatgagaaaaatggattgaaaatagaggagaaattcggacaactgatagtaaatggagaaacctatccgttaaattggagattggcttttcaatctcttgcaagacaactggagattaagggttatcaacaactcattgaggaagtagcttacacttggtttaaccgtataattgcgattcgatatatggaacttcacggttatttgccagaacgagtcaatgttttatccagcagtaccgggaaagtagaacctgatattcttacagaatttgaatcaatggatttggacgttgataaagatcaaatcaaaagattaatacgagaaggcgatacggaacaagcatatcgtaaattattcattgcacaatgcaatgctttgcatcatattttagatttcctctttgaaaagattaatgactatacagaattattactgcctgactatttattagatagtgaatccatcataagtaaattggtgaaaaatgatgcattaacggaaagctttcaagaagtagaagtcattggctggttgtatcagtactataacacggaaccgaaagaaaaagtatttgcaaatctaaagaaaaacaagaaaattgagaaatacgatattcctgcggcaactcaacttttcacaccaaaatggattgttcaatacatggtcgaaaactctcttggtcaactgtggttagaagccaatccaaattctccgttaaaggaaaaaatgcgttattatattgaacccgctgaacaagaggaagatgtaaagcaaaaactagaggaaatcagatataagaacgttaatttagaagaaattacgattattgatccatgctgcggttcggggcatatccttgtgtatgcatttgagttactttatcaaatgtatgaagaagcagggtatccaagtggagatattccccaattaatattagaaaagaatttatatggacttgatattgatgaccgagctgcacaattagcatcttttacgctgttaatgaagggaagagaaaaatctcggcgtatattacgaaaaaaagtcaatttgaatatatatgccattcaagaatcaaaccaattggatagtgagagtattgcacgtttattaggagaaaatgaaaaagagtattttgaaataaaaacaacaattggtatgttctttaatgcaaaaaatttaggatccattatagagccatataatttagattatggcaaatatttaaaacgtatagataaactaaataatgatcaaatttcaattgaaaattatcatgtctatgatcaattaaatgagattaaaattttgctaaacttagctaaaattatatcttctgaatatgacattgtagttactaatcccccatatatgggccatagtggtatgaatagtgatttgtcaaaatatataaaagaacattttcctaatacaaaaggtgatttaagtactgtatttatggaagtttccttaaaattcgctaaagaaaatggatttgtctctcaaataaatattccatcttggatgtttttgggaacatatgaaaaattgagggttaatttgattaataataaaacattttatagtttacttcatttaggtagaggtatttttggtgcagatttcggtacaacatcatttgttattagaaattgctccattaaaaattttataggtacctacaaaagattatttgagagccaatctgccgttgatagtttagaaaggaaaaaaattagattttttgaagaaaaaccttattttactaagcaaacaaatttcttgaaaattaatggaacaccatttacttattgggcaaaagatatagactttaaaatattcactgaaaaccctaaaattactgatgtggcaaaagcaaagcaaggactggcaacaggtgataacaatcgatttttaagatattggtttgaagttaataaatcaaggattggttttggatataaaagtagctctgaagcaaaggaaagtaataagaaatggtttccctataataaaggtggagagtttagaaaatggtttgggaataatcagtatgtagttaattgggaaaacgatggagaagaaataaaaaattttaaagatgaaaaaggtaagttaagatcaagacctcaaaatactgatttttattttaaagaagctattacttggtcaaaggttactattggtggattttctgtaagatatataccaaacggttttttgtttgatgtagctggatgctcaatattcttagatgagaatgagacggaaaaagaaatttattattatttaggacttttgaatagtaaagtaactagaaggattttgcaatttttaagccctacggtaaattatgaagtaggtcatatttcaaatatccctattaaaaaggatgataactcacgtatctatagtctcgttaaagaatgctttggtatcgcaaaagatgagtgggattctaaagagacatcatgggattttaaaactcattcttttttgaagttcaataaagataataatttaatttcaatggcatttgatgactatagagattataggaataagcaaatttcacaaatgaaagctaatgaggaagaattaaatagcatatttattaatttatatgatttacaaaccgaattgacaccagaagttccggaagaacaaattactatgcataaagcaaatcgaattgatgatacaaaatcatttttatcctactttataggttgtataatgggtcgttattcattagacgttgaaggtttagcatatgccggtggtgaatgggatgaatcaaaataccaaacctttaaaccgaataaatatggtttgattttgttaacggatgagtattattttgaagatgatattattgcccgtttacgtgaatttttatcggtgacttttggtgaagaaactgtggaggaaaatctccaatggttggcggaatcgcttgaaatgaagcgaaatgaaactgctgaggaacggttgcgccggtatttcttggatgagttttttaaagatcattgccaagtatatcaaaaacggccgatttattggcttgttgattccggtaaacagaagggactaaggacattaatttatatgcatcggtaccagccggatacgatggcaacaattcgttttgaacatttgcaagaaattcaaacaaaatacaataacgaaattgatgcggtaaatttacgaataaccaatccgaatttgagtgctacggaaaaacgggaattggaaaaaaggagagaacgttttcaaaaacggttagaagagctgcttgagtttgacaaaaaactggccgaatatgcaaatgcccaaatagtgatcgatttggatgacggagttaaagtgaattacgctaaatttgaaaaagtattagccaagattaaataa

SEQ ID NO: 2580 - DNA, 3657 bp, Escherichia coli
atgaatacgtcaaatatcaaaaaatacgccccggtggcacgtaaacagttccgcgatgcggtcatgctaaaactgaccacgctgggtattgacgccgataaaaaaggcaacctgcaaatagcgcaagcaaccgatcttggcgacagtgtgcgatatggtcagttctcgctggataaatcactggcttcacgccgtgaacgtctggtcaagcgtgcagaaaagcagggctatgacgtgctggtggagcacatcgcttacacctggtttaaccgcttttgcgctattcgctatatggagctgcatggctatcttgatcacggtttccgtatgctgtctcacccgaccctggaagggagttttcaggttctggatcatgtgccggaagtagctgatgcacttgggctggacaaagcgcgcctggtggagatgaagctggcgggcgatcgtgacgaagagctgtaccgtgaattattgcttgcacagtgccatgcgctgcacggcgctatgcctttcctgttcgaagcagtcaatgatgatatcgaactggtactgccggataacctgactcgcaccgactccattctgcgcgggctggtggacacgattcctgaagaagactggaaacaggtcgaagtgatcggctggctgtatcagttttatatttccgagaaaaaagatgatgtgatcggcaaggtggtgaagagcgaagatattcctgccgctacccagctgtttacgccaaactggattgtgcagtatctggtgcagaactcggtgggccgccagtggctgcaaacctatccggactccagcctgaaaggcaaaatgccgtactacattgagccagcggagcaaacgccggaagtgcaggcacagctggcggctattacctcatcaagcattgaaccagaaagtattaaggtgctggacccggcctgtggctccgggcatatcctgaccgaagcctataaagtgctgaaagagatttacgaagaacgcggttaccgtactcgtgatattcctcagctgattctggaaaacaatattttcggactggacattgacgaccgtgccgcacagctgtctggttttgcgatgctgatgctggcgcgtctggatgaccgtcgtattctgagtctaggccgtagtgttcgcctgaatattgtttccctacaggaaagtaagctggatatcgcggagctttggaccaagctgaatttccaccagcaggtgcaacgcggcagcatgggagatatgtttgctgaagggacggcactggccaataccgacagcgtggaatatatgctgctgatacgtacactggcattgttcacgagtgctaaaacgctgggatcgctgattcaggtaccgcaggaagatgaagtggcgttgaaagcatttcttgatgggttatatcgcctagaagctgaaggtgatattcagcagaaagaagctgcggcagaactgatcccctatatccagcaggcgtggattttggcgcaacgctatgacgcggtagtggcgaatccgccgtatatgggcgggaaagggatgaatggcgaactgaaggagtttgctaaaaagcagttcccggatagtaagtcagatttgtttgcgatgtttatgcagcatgcgttttctttgctcaaagagaatggttttaatgcgcaagtgaatatgcagtcgtggatgttcctgtcgagctatgaaatgcttcgaggatggttgctggataataaaacgattattactatggcacatttaggcgctcgagcttttggacagatatctggtgaggtggttcaaaccactgcatgggtaatttgcaatcgtaatgaagataattataaaccagttttttttcgtttgatcgatagtaatgaagattataaaaagaatgccttgcttcaacgtagcggctgctttaaagacgttgcacaacatgaacttaaaaagattccaggtgcaccaattgcatactggctaactgattcgtttagaaaagtttttgaggattctactcctttaggcgaaattgcccctgtgcgacaaggtattgctacggctaataatgaccgttttttgcgaacatggactgaagtttgttttgaaaatataggattatactttcagaatagagaatcagctaaaaaaagtaaccgtaaatggtttccctacaataagggcggggagtacaggaagtggtatggaaataacgagtatgtcgtgaactggtataacgacggtgaggagctggaaaactacaaacctaaagcggttattcgtaatcctaattatttttttagagattcaattacatggtcgtttataagctcaacgtcttttggcgttcgattctctgatgctggggcaatatttgatgttggtggttcttctgcctttccagaaagtaaggatatgtattggcttgctagttatctatgttccaagcagtgttttatatttatggggataatgaatccaacgttaaattttcaagttggtaacgtttcagcacttccaattattgaaaataaaatatcaaaatttaaagatgcgttaagcgagattagtcgggaattaataagtattcacagagatgattgggatctttttgaaacttcttggtcatttaagaaaaatcccctttcagggaaaacatcaaaaagtataagtgatagctttaaaggatatatctcggaagcatctgaatcaattaaaaaagctttgacattagaatctaaatccaatgagatttggttggatgcctatcaattaaaacatgaaattgactatcaagttactaaggaacaaataaccctttcagtaaatacgctttatcgatatggaattgacaatactcaacgattacaatcagatacaattgtagaattaattagctatataattggatgccagatgggccgctattcactcgatcgtgaaggtcttgtctatgcccaagagggtaacaaaggttttgtcgaattagtcgccgaaggcgcctataaaaccttccctgccgatgaagacggtatcctgccattaatggattctgactggttcgatgacgatgttacctcccgcgtgaaagaattcgtttgcaccgtctggggcgaagagcatctgcaggaaaaccttgattttatcgccgaaagcctctgcttgtacgccatcaagtcgaaaaaaggcgaatcttcgctggatactattcgtcgctatctttccacccagttctggaaagatcatatgaagatgtacaaaaaacgcccaatttactggctattcagctccggtaaagagaaggcatttgagtgcctggtgtatctgcaccgttataatgaaggcacgctgtcgcggatgcgtaccgaatacgtggttccacttctggcacgctaccagggcaatatcgacctggttaacgatcagcttaagaattctgagtcgggtgcggccactacgcgtctgaaaaaagaactggatgggttgaccaaaaaattcaacgagctacgcaattttgacgatcgcttgcgtcactacgctgatagacgtatcactattgatctggatgacggcgttaaggttaactacggcaaatttggcgatctgctggcggatgtcaaggcgatcaccggcagtgcgccacaggaggcataa

SEQ ID NO: 2581 - DNA, 3678 bp, Salmonella enterica; identical to SEQ ID NO: 2365

SEQ ID NO: 2582 - DNA, 2629 bp, Collinsella stercoris
atggacaccaaggcactcgagaagttctgcccctgggctcgcatcgagctcatcgacgccgtgcacttgcgctgtgtgcgctacgcgctggacgacgccgggcgcgccgcccaccccgccgatgcggacgtaattggcggcaccgtgctgaccccttccgagaagacgcagcgcgccgcgctgttcgagcgcatcgagcgcctgaacgaggaacgcggcggcaagggctacgccgcgttttgcgaacagcaggcgtacagctggttcaaccgcttcgccgccatccgcttcatggagctgcacgggtacctgagcaacaacgtgcgcatgctttccgcgggcagcggggcgtttgaacccgagtgcctgcgcatggcgagcgagctcgacctgcccgggctcgagctcgcggaggtgctcgacctcatcaccgcaggcgacgacgaggcgctcttccgccgcatcctcgtggcgcagatgaacgagctcgccgactgcctgcccaccgtgttcggccacgtggacgacgccgacgccctcaccctgcccgacaacctgctggcccacggcgagcacgacgtgctgttccacctggttgcggatattcccgaggaggcgtgggacgacgtcgaggtcctgggctggatgtaccagttctacaactccgagctcaaggatgacttcttcaaatccaagcgcaaggccgcggtggaggacctggcacccgccacgcagctgttcacgcccgactggatcgtgcgctacatggtggagaactcactcgggcgcctgtggatgctgaacaaccccggcagccgcctgcgcgagggcatggcgtactacatcgagcccgatgcgggacacgaggacttcatccacatcgaggggcccgaggacatcaccttctgcgatccggcgtgcggaagcggccacatcctggtctacgccttcgagctgcttttcaggatgtacgccgagcgcgggtaccgcgagcgcgatgtcccgcggctcatcctcacgaagaacctctccggcatggagatcgacgagcgcgccgcccagatcgcgagcctggtgctcgccatgtgcgcccgcgagcacgaccgccggttcttcacgcgcggcgtgaaggcggacgtccgcgtgctgggcggcgtcgacatcgacgtcgacgccctcgaccccgcgagcgcgttgcgccagcgccccaagctcatcgaggccttggcgcacctgggcgaggtcggcagcctgctcgcgccctcgcccgaagacctgggtgccctcaagagcgagctcatgcggggcctctcaggcgacctgttcgtctcccacacgcaggctggcatcgagcgggcggcagagctctgcgagaccctctcccgcaccttcgatgtcgtcgtggcaaacccgccctacatgggatcgagcagcttcaacccgttcatgagcaagtggatgaagaagaactaccccgatttcaagagcgatctgttcgccgcattcatctcccgcatcggcagcctctgcgccactcatggcgaagcgggcatcatgtcacccttcgtctggatgttcatcggcagctacgagaaactgcgtaacgtgatgatcgacgagaagaccctcacatcactcgtccagctcgagtactcgggcttctcaggggcgaccgttcccatctgtacattcacgttccacaactcacatgtcgacggctacatgggcggctatgtacgactgtccgattttgtcggggctgcggttcaggggccaaagacgctcgaggccatccagaaccccgactgcggctggttctaccgcgccgatgcctcgaccttccacgacatccccggctcccccatcgcctactgggctagcgacgccgtgcgtcgagttttcgaatacggcgagcctcttggtaatgacactccaacccatcttggaatggcaacctgcaataacgaacgctttctcagatattggtgggaaccgagcaacgaattagttggaacccctgacgatttctctaagggatcttcacaacgtcgatgggccccctacaacaagggaggcatctatagaaaatggtcgggcaatgacgaatacgttgtcgattggaaagacagcgggcgatacatcaactcatgcggcgcggtaatggtaaaagaatcccttcgttttcaagaaatgacctcatggagccgcgtatcaagtggcatgctcgccgttcgatacaaaaaacctggctacctgtttgacatgactgggcccggcgccttcggaaatcactctgatttaatatggcgtactgcatttcttaatagctcaacatccatgtacgttgctcgcttcatgtctgcaagccttgattttcaacccggccagattgcacaataccctatcatcgaggaagactcctctattaagttagtcatgcctcttgcgtatgattgcattgacctcagccaacttgattggaacgacagggaagctgcttgggatttcaagcgcagcccccttattcctaactccgatgctgaggctgccccacaccctaaggccggactgtcttaccacctcatgccggtttctgccaaaattactgagaatccgggggataaatcat

SEQ ID NO: 2583 - DNA, 3567 bp, Glaciecola punicea
atggatacatcaaaattaaagaaatttgctcaatttgctcgtagaagcttgattgagcaagttcaaagcaaattgaaacttgtacttgcagcagatagtgcggctagacgtgagcacccaaaagcaatcaaagagttagaacaaaaactaaatcaacatataaataacaaagaagatgaaaagcaacttatcgagcaagtggcttacacatggtttaaccgtttttgtgcccttaggtttatggatgtaaatcgatacaaccgaattatggtgctctcgccaatatcaggtcagtttcagccagaattattagcagaagctaaagctggtcatttagatgatgtagtttttaatggtaaaatccgtgagagaatacaagggctgctgagtggctcagtaccgagtcgcgatggtcaagctgaaggctatcgaatgatgattgttgctatttgtaatgattatcaccgcttaatgccatatttgttccagcgtatcgaagattatactgagttacttatgcctgatgacttgttatctggtaattcaatacttgcctatacccgtgaagcaatgacacctgagaattgtgaatcggttgaatctatcggttggctttatcagttttatgtttcagagaaaaaagatctggtatttgaagaattaaagaaaaataaaaaaattacaccagaaaacattcctgctgcgactcaactgtttaccccacactggatagtgaagtatctggtagaaaattcattaggccgcttatggatgctcaataaccctaattcaaaagttatcgaccaaatggagtactacataaaaccgttagagaaagaaacggacttcctccgtatcagcaatcctgaagaaattaaattatgtgatcccgctgttggctctggccacatgctcacgtatgcctatgatttgctttatgctatttatttagaagctaactacgatgcaactgatatccctgagttaattttaactaagaatctattcggtattgaaattgatgagcgagccgctgaacttgcagcatttgctttgagcatgaaagcgatgaagggcaactcggccgatgatagcaataaccgaagacgttttttccgaaatccaattaagccgaatatctgccgtttagaaaaagttaaaattgatgcagatgcactagatgaatatatggactttattggacgtgatttattcacgcaggatttaagaaaaacattatccgaatttgaagaggctgataactttggctcattaatccaaccaacattaaaaaacccaacagaaatattagaaatatttgaagctaagaatgctcaagtggatctgttcttaaaaaatacgcacgaatcggttattaaaatcttacagcaaacaaaatacctaagccctatttatcatgtagtttcggcaaatcctccatatatgggaagaaacggaatgaattcaaggctttcaaattgggcaaaggataattatcctaagagcaagtcagatttattcgcgatgtttatagagcgaaatttgaacctcattttagaatctggttactccggaatgataaatatgcaaagttggatgtttttgtcatcatttgaaaaacttcgagtgaaaatgtttgctcaatcgaccattgtatctatggttcatttaggatcaaaggcgttcgatagtattggtggtgaggttgtatcaacaacagcctacatacttcagaataccgttaaggtagatagaaaaggcgattactttagactagttgacggcaaatcagaagctgaaaaaaaccgtgcattttccgaggccataagaaaaatagattgtggctcgaattatcgagcttcaactaaagatttcaataggattccgggtagtccagttgtttattgggcaagtgacaaagtaataactgcatttgaatcagaagtggttgaagataattttttagccaaaaaaggcatggccataggtgataataatagatttttaaggttatggtctgaagtggaaaacaaagatattgaattcaatgctcaagacgaagaagatactaaaataaaaaaatggtatccgtgccttcatggtggagcatttcgcaagtggagcagcaacaaagagtttgtggttaattggatcgcaaacgggtttgaaccaaagtctgcaattacagaaaaaactggtgatcattggtcaagatatataattagtacaaagttattttttaaggaaggtatcaattggagtgcaatttcatcatcttcgttttcagctagataccatgaaaaagggtttgcgttcacaagtgcctccatgaccgcattcccaaaattagaaattgatcctaaggtgttattgttattcattaattctgaggtagggaaattgttcttgtcatttcttagtcctacactcaactttggtatcgctgaaatcaaaaagcttccatttataataaatgatcgccaatctaatctaattgccatagccgaacaactagtagtactttctactgaagattgggatgagcatgagacatcttggtctttcaaatcgtcacccttactcaatttttcacatattcctttatccgattcttataatagattgcgagaaatctggcgcaccagaacgcaaaacatgaaagaattggaagagaggtcaaatcaaatattcataaatgtatatggattagaaaatgacttaaagccagatgtaatgattagtaaaatttctctattttgtaatccaagttttagatataaaaacagctcgaatactaatgaagctgagggagagcttttagcagatactgctcgtgattttatttcttatgcatgtggttgtatctttggaagatactcccttgataaggaagggttagttttagccaatcaaaacgatactatcaagaactgtatgaaagaagttgtgttaccagaatttatgccagacgaagataatgtcattccaataatcgattttgaacttgagaaggataaagatgaatactggtttgaagacgatattaccgagcgctttatagaatttctgcaagttagtctgggtgagaaacatcttgctactaatttagattttattgaaaaggcaattggtaaaaaaataaaaagttattttgctagacatttttacacagatcatgtccggcgttataaaaaaagacctatttactggatgttctctagccctaaaggatcgtttaacgccttgatttatatgcaccgttaccagcccgacacagcaagtattgtccttaatgattacttacgtgagtttagaactaagttagaagcacgcaagcaaagttatgagcaagttgaaattagcgcatctgccagtcaaaaagataagacccaagcgattaaagcgattgccaaaatcaataaggtgcttgaagagattaacgactacgaacatgacgtgctgtatccattagcaggtgaaaaaatcgaaatcgatttagatgatggtgtaaaacacaattaccctttatttggtaatgcacttaaaaaagtaacaggattatcttag

SEQ ID NO: 2584 - DNA, 2742 bp, Enterococcus faecalis
atggacaaaaaagcaattaaaaaattcgccatggaatctcgtgtaaaacttcgtgagggagttatcaataggctggctaagctaggcataactgaaagtaatatcgatcctgtcatagaattagggaatgacacaattacaatctcttcaaatgaacaacgttacacaggaaaagatgtaataaatcgtacaaagttagtagaagcattaaaggcaagagagaaacaacttgatttaggcgaaaagaaaagtaaagcgattgcgtttgataatttggttgaagaggtagcgtatacatggtttaaccgtttaattgcgattcgtttcatggaagtaaacaattatttgccagaacgacaacgtatcttatcaagcgaatctggtattcgtgaaccagatatcattacgaatcttttaagttcaaacttatatgcagaaatggatcctgatacaaaaagtcgagtagtggatttaatgtcagataactcagcagctgctgtagacgaactttatcaattagtatttattaaacaatgcaatagtttgaatcagttactgccagacctttttgaaaaaattgacgactatactgaacttttgtttacgatttcttatattgatgaaaatggtgttattgcaagcttactatcaatcccagaagaagactttgacgtcagtaaagaaggacaagtcgaaattattggttggatgtatcaatactacaatactgagccgaaagctgaggcaatgaaagcgcagaagaaacggaaaagccgtgcagatgaaattcctgcgctaactcaattgtttacgcccgattggattgtgagatatatggttgaaaattcacttggacgttattatattgatcaaaaactagcaatgcctactgaaacgcgtacagaaaaagaaattgcagacgaatttggttggaaatactatttaccgacagcagaacaacccgagaatgtacaattacaaattcaagatgaacgtaaagataaaaatgttatcgctctacaagagataaaacttttagacaacgctatgggttcgggccacgtattagtttatgcttttgatgtgtttatgcagttatatgttgcagaaggattccgtgaacgtgatgcagcagagagtattttaattaataacttattcggacttgaaattgataagcgttcatatcagttagcttactttgccattatgatgaaagggcgcgaatatagccgtcgtattttaactaagaatgtaaaattacatttacatcaatttattgattcagatgatattcctaacgaatactttgagcgattagaagaaatttcaagccttcctagtgatgagtttattgaaaaaagtaatctcttaaaattaattttagatatgtttttacatgcaactgaaataggttctgtcttaaacattcagaatataagccaatctgaaatcaatgaacttagacaacttacttgtgcatttgaagacttttcaaatatggatattctttatcagcttccagaagcacacgaaaaagtaaatcatattttaaatattttagaagttctttcttttagatatacagcggttgtaactaacccaccctatttgaataaaatgagtgctattcttagtaaatacgttaaagataattatcctgaagtaaaaacagacttgttctcagtcttcataaagatgaatagtcaaatgcttacggatggtggctatgctggatttatgaccccatttgtctggatgtttataaagtcttatgaagaactgcgtaatttcttaattgctaataaaaatatttctagtttagtgcaaatggaatactccgcattcgaagaggcaaccgttccagtttgttgttttactatcaaaaatgcaaaatcagaacctataggaaactacttcaaactatctgattttcgaggtggcatgaatgtacaaaaagaaaaagttcttgaaggtatcagaaatccagatgtaaattatttatttcaaacaaaccaaaataatttcaccaaaatccctggtagtcctatatcgttttgggtaagcgaaaatcttattcatgattttgttgtagggaaacgaatggatgaaattgttgaacctaaagttggtttgcaaactggagacaataatcaatttctcagggaatggtgggaagttgatattaatcgcataaaatttgatgcaacttccgtcagtgattctgtaaattctggtaaaaaatggtttccttacaataaaggtggcgcattccgtcgatggtatggcaattacgattacgtagtaaattgggaaaatgacgggcaagaaattagaaatttcgtggatgataaggggaaacttcgatctcgaccacaaaataccgaatattacttcaaagaagcgataacatggccattaattacttctggaggtttgagcgcacgctatcgtgaacaaggaagcattcacgatgtatctggtatgtctgcattctcgtccaatcaaactaacgtttactatgctctcgggttggtgaatacacctattggtaataatattttcaaaatattaaaccctaccattaattcacagattggagattttcaaaatattcctgttattgttaaaatagagaacactagaattatagaactggtaaagtctaacattaatttagctaagaaagattggaatcaacaagatgacagatgggaatttgagaagcatccgttaatctaa

SEQ ID NO: 2585 - DNA, 3537 bp, Pseudoalteromonas flavipulchra
atggatacttcaaaattaaaaaaatttgctcaatacgctcgtagaagcctgattgaacaagtgcaaagcaaattaaagttagtcttagctgaagatagtgcagcgaggcgtgaatatcctcatgcggtaaaagaactcgaagctaaacaaaaagagttcggggatgacaaacttctaattgaacaagtggcatatacatggtttaaccgtttttgtgcgcttagatttatggatgccaatcaatacaatcgtattatggtggtatcgccaattgcagggcagttccagcctgagattttagctgaagcgaaggctgggcacttggatgattctgtttttgatgcaaagtccagagacaagatccggggcttgctatcgggggctattcctagtcgtgacgggcaggcagaagcctatcgcctgattattgttgctatgtgtaatgcctatcatcgattaatgccttatttatttgagcgcatcgaagattacacggaacttctaatgcctgaagatttattatcaggtaattcaatacttgcctacacacgagaggcaatgacacctgataattgtgagtcagttgaatctattggctggctatatcaattctacatttcagaaaagaaagatcaggtatttgagggtttaaagaaaaacaaaaagattacaccagagaatatccctgcggctacccagctatttacaccacattggattgttaagtacctagttgaaaactcgctggggcgtttatggatgctaaataatccaagctcaaaagtgattgagcaaatggagtactacattaagcctgttgaagaagaaagtgattttcttaagataagtacacctgaagagcttaagatatgcgaccccgctgcgggttcagggcatatgcttacctatgcttacgatttactctatgcaatctatcttgatgccaactacgaccctgtagatattccagagttaattttaactaagaacttatacggcattgagattgatgagcgagctgctgagcttgctgcatttgcccttagtatgaaagcgatgaagggcaacccgtttgatgacagtaataacagaagacgctttttccgtaatccgataaagcccaatatttgccgtttagaaaaagtcgaaattgatgatgctgacctagaagcgtatatcgaatttgcgggcaacgagttattcacgcccgatgttcttgcaacgcttaaagaatttgaggaagctgataacttcggttcgttaattcaaccaaccttgaaagacccaacaaaactgtttgaaaaacttacatcgaaagatgcgcaagttgatcttttcttaaaagatactcatgaatccattctaaaaatattaaaacaagcaaagtttttatctcctatatatcaagtggttatagctaacccgccatatatggggttaaggggtatgaatcaacggttagcaaagtgggccaatgaggtatacccaagaagtaaatatgatttattttctatgtttatagaaaggtgctttaaattagctttgagtaaagctaatttagcaatgatcaccatgcatagttggatgtttttaacttcttatgagcgaatgcgtgttagcttaattcgtgaaaagacactattgacgatggcgcatttaggctccagaggttttgatagtttcgggggggaagttgtgcagacaacagcattcgtatttagcaatgataaaaacttagaatacttgggggaatatttagaccttacatcgggtaaaagtgagagtgaaaaaagtaatcatttccgaaagtgcctcaaaacgggagctagccgctacagagtgaaaggaagtgacttaaaagctgtacccggctcaccgtatgcatactgggtaactgaaaatgtcagaaatatattctctgaatataagtctgttggctctgttgctgatacaaggcaagggatggctactagtaataacgctctttttgtgcgggaatggtttgaagttgatacaaaaaacacatgtagggatgctgtagatagaaaatctgcatcgttgagaaatgaaaaatggtttccatttataaaaggtggtggttttaggaaatggtacgggaatctagaacacgtagtcaattggtacaaagatggtgaggaaattttaacctatgcgtcggaattatatggaagtcccactagaacaataaaaagcattgggagatattttcaagaaaatattggttggtctcgtatttcaactggaaaattgagtcttcgttattttccagctggttgtattttttcagatgcaggctcttgtatattctttgatgaaaaaaattataaaaatcaagttttagcgcagttgaactctagtatcaccatgctttttgcaaaaacgctttcaccgaccttaacattcgaagctggacagatagctaaatatccatttttaaaaacagaaaagtcggttgatgagctagttaattcattagtagatattcataagtacgactgggattctgaagaaacatctatggattttaagcttccaaggatacttgaaaataacgaaaatgagacgctgttgagtggtttatttgattctctgaatgttaaacagaaatgtattattgatgaggtttctttaaaggagaagcagttaaacgaattatttgctagggaattcaatttagagaatgaaattagctatcatgtgccattagaggaaattacattaagttgcaatccttattatcggtttggatctaatttaagtgaggagtctttaaatagcaggttaaaatatgagactttaaaggagcttatttcatacgcgatagggtgtttattcggacgttattcaatcgataaaaaaggccttatattatctaatcaaggtgattctcttgatgaatatctaaatgaaataccttctcctagctttatgcctgatgaagacaacgtaatcccaataatagattttgaaggtgactggtttgaagacgatatcactgagcgttttaaagaatttttaaaaattaccttcggcgaaaaaaactttactgaaaatttagcatttatcgaagaagcgattggtaaagatattaaaaaatactttgttaaagacttctatgctgatcatgtcaaacgttataaaaaacgcccgatttattggatgttctctagtcctaaaggctcgttcaatgccttaatttatatgcatcgttatcagccagatacggtaagtatagtgcttaacgattatttacgtgaatttagaaccaaattagaggcgcgaaaagaaagctatgaacaagttgaaataagtgcttcagctagccaaaaagataaaaccaacgcgattaaagccattagtaaaattaacaaagtgcttgaagagattaatgactacgagcatgacgttttgtacccattggcaggtgaaaaaattgaaatcgacctagatgatggtgttaaacataactacccattatttggcaaagcactgaagaaagtcacggggttatcgtag

SEQ ID NO: 2586 - DNA, 3609 bp, Escherichia coli
atgaataccaataacatcaaaaaatatgccccacaggcccgtaacgatttccgtgatgcggtgatccagaagctaacgacacttgggatcgctgcagataaaaaaggcaatttgcagattgccgaggccgaaaccattggcgagaccgtgcgttacggtcagtttgattacccgttatcgacccttccccgccgcgaacggctggtaaaacgcgcccgtgagcagggttttgaggtgctggttgagcactgcgcctacacctggtttaaccgcttatgtgcaattcgctatatggagctgcacggttatcttgatcacggcttccgtatgttgtctcacccggagactccggccgcgtttgaggtgctggatcatgtgccggaagtggcagaagctctgctgccggaaaataaggcgcagctggttgagatgaagctttcaggtaatcaggatgaagctctgtaccgtgaactgctgctggggcagtgccacgccctgcaccacgcgatgccgttcctgttcgaagcggtagatgacgaagcggaactgctgctgccggataacctgacccgtaccgactccattctgcgtgggctggttgatgatattccggaagaagactgggagcaggtagaggttatcggctggctgtatcagttctatatttcagaaaagaaagatgccgtgattggcaaagtggtgaagagcgaagatattcctgccgccacccagctgtttacgccaaactggattgtgcagtatctggtacagaactccgttggccgccagtggttgcagacctacccggactcgccgctgaaagacaaaatggagtactacattgagcctgcggagcaaacgccggaagtgcaggcgcagctggcggcgattaccccggccagcattgaacccgaaagtattaaagtactcgacccggcctgcggctccggtcatattttgattgaagcctataatgtgctgaaaaatatctatgaagaacgtggttatcgcgggcgtgatattccacaactgattctggaaaataatatttttggtctcgatatcgacgaccgcgcagcacagctttccggctttgcattattaatgatggcgcgtcaggatgaccgcagaatatttacccgtgatgtgcgcctgaatattgtctcccttcaggagagcctgcatctggatattgctaagctgtggcagaagctcaacttccaccagcagaacaagaccggaagcataggggatatgtttgccgaaaatactgcattagcccataccgacagcgcagaatatcagctactgatgcgtacgctgaaacgctttgtgaatgctaaaacactgggctcgctgattcaggtaccgcaggaagaagaagcggagctgaaggcgtttattgatgagctttatcgccttgaacaggaaggggatttccagcagaaagccgcagcgaaagcgtttattccgtatattcagcaggcgtggatactggcgcagcggtatgatgcggtggtagcgaatccgccgtatatgggtaatggtgggatgaatagtgatttaaaagtattagctaaaactcatttcccgtacagtaaatcagacctctttgcgatgtttatgcagcatgccttttatttgcttaaaaataatggatataatgctcaagtaaatatgcagtcatggatgttcttatcgagttatgaagattttcgcacctggctattggattgcaaaactttcattaccatggcccatcttggtgcaagagcattttcacaaatatcgggtgaagtagtacaaactacctcatgggtaattaaaaatagctctactaaaaactataaaccggttttcattcgtttagttgatggtaatgaagaacagaaaattaaagagctactctcatataaaaagcatttttacagcattagtcaaaatgatttaaaaaaaatccccggatatccgatatcctattggctaggccagaatataaatattttcgataatgacaaaatagctaattcatggttctctggtggtagaattaaaactcacaatggtgataaatatataagatatatatgggaaactagtcgtctttcgagtaaatggaaaaaactaatcaaaggtggagattacaaaaaacattttggcaatgaaatctttctggtagattggtccgtaaatgctataaaattttatgaaaaaaacggtggcatttatccatcaaaatttagagataaagctggtatttgttggtctaaaatcacatcgggccaagctagctttagagtcaaaagtgaagatgtagaatacgattctgcatcacctgtaatatttaacgataaatttaacagtgatctttatacgcttgctctcttgaatacaaaagtttttaatgttctacttaaagcattgaaccctactattaatacccaagttaatgatgtcatgtcattaccattcatcaaaatggaagcagctgttcaagaaaaaatcgaaactaatgaacagctgctgataaatatagcgatgcacgattggaattcgcaagaaatttcttttgattttatggttaattatttagtcagcgaatcgagagcatcatctgaagtagcatcaagctatgctatagcaagaaaaaagtggcaagatgcttttaataaaacgaaagagttggaagaagaaaataaccatttagtcattacaagtagcaactttaatgggataaatgaagaattaattgattcagaaataactttagtcagcaacccatactacaagtacggtgattcaacgactaataatgaaactcgtttgttatcggattcaatagcagatgtattaagttattccatcggctgcatgatgggtcgctactccctcgatcgcgaaggcctcgtctacgcccatgaaggcaacaaaggctttgccgaacttgccgctgaaggtgcgtacaaaaccttcccggcagacaatgacggcatcctgccgctgatggatgacgagtggtttgaggacgacgtcacctctcgcgtcaaagagtttgtccgcaccgtctggggcgaagagcacctgcaggaaaacctcgaatttatcgccgaaagtctctgtttatacgcgatcaagccgaaaaaaggcgaatctgcgctggagaccattcgtcgctatctttccacacagttctggaaagatcatatgaagatgtataaaaagcgcccaatctactggctattcagctccggtaaagagaaagccttcgagtgcctggtgtatctgcatcgctataacgacgccacgctgtcgagaatgcgtaccgaatatgtggtgccgctgctggcacgttatcaggccaatatcgatcgcctgaacgatcaacttgatgaagcttctggcggtgaagccacacgcctgaaacgcgaacgcgacagcctgatcaaaaaatttagcgaactgcgtagctatgacgaccgcctgcgtcactatgctgatatgagaatcagtattgatctcgacgatggcgttaaggttaactacggcaagtttggcgatctgctggcagatgtcaaagccatcaccggcaatgccccagaggtgatctaa

SEQ ID NO: 2587 - DNA, 3588 bp, Johnsonella ignava
atgaacaagacagccataaaaaattttgcgatctgggcgcggaataagctgattgcagatgttagctatgatgcccgactgatcggtattacggaggacggcattgcaaagccgctgccgcagagcttcggcgacacccagttcttcgatatcggcactgcaaaaccgtattcgatttccggcgaggccgtgcgtcagcgtgacaagctgatagaggttattcagcagaaggaaaaggataccgactacaaaaccgcatatcagtatgtgatcgaggaggttgcctatacatggttcaaccgcctgatcgcgatccgtttcatggaggtcaacgactatctgccttcccatatccgagtgctatcttccgagagtggtaagctggagccggatttggttacaacaccgtttgacgcagagctgcccttcactgcggaggaagaggctcagatttttcagtggaaacaggacaacaagctggacgaggtgttccgcatcctgttcctgaaacagtgcaacgcactgaacgaaattctgcctgctctgtttgaaaagacgaagaactacaccgagctgctgctcagcctgtccgtcattgaccgggatggcgtggtctatcacctgattcacgatattccggaggatgacttcaacatcgagtgcggtggtcaggtggagattatcggctggctgtaccagtattacaataccgagccgaaagccgctgcatttgccaagaacggcaagattaccaaagaggaaatccctgccgtaacccagctgttcaccccggactggatcgtccgttacatggtggagaacagcctgggtcgtctgtgggtgggaggtcacccggaccgcggcctgaaagaaaactggaaatactatctggaagaggcacagcaggagccagaagtgcaggtgaaactttcggaaattcgtaaagagtatgccgccctgaacccggaagacatcaagctcattgacccctgcatgggatccggacatatcctcgtatacgcctttgatgtgctgatgcagatttacgagagtgccggttacagccagcgtgatgctgcaaagagcattctggaacacaacatctacggtttggacattgatgaccgtgcctatcagttggcgtactttgccgtgatgatgaaagcacggcagtacaaccgacgtatcctcaacggtgagaacacctgtcatgtctacgccattcaggagagcaacagcatcaatcgtgcgcacttgaaatatttcggcgcggggttggacgatatcgagaaaaacgctgctaagatgcagctggaaggtctgctggacactctgacggatgccaaggaatacggctctatcctgaatgtggagagctacaactgggatttgctgcgccggtttgtggcagcggaggacaccgacggtcagatcagcatggacagcgttggcgtggaagataccgctgagcagttgaatcggctcattgatattggtgagacaattgcacggaaatattgggttacctgcacgaatccaccctatgcaggaaccaccaacctgagcgcaaaattaaatacatatatcaaaaaatattttcctgacagtaaatcggatatgttcgctgtattgattgaaagatgctaccagtttactttggatagtggatttcaatcaatgattacccagcacgcatggatgtttatcaatagctacgaaaatcttcgtaagaaaatatatgaaaaaagatttatgagccttgttcatcttgggattaaggcgtttgaagaaattggaaatgatgttgttcagacgtgcgcatttgtgattcagggaaaatatattgacggttacagttctcggtttgtaagacttgttgactgtaagaattacaatgaaaaagagcaagaatttttggctgggaactatcgttatatggcggaggttgccaatttcagaaaaattccgggaatgccactggcatattgggtgagcagccaatttataaaaaactttaactctgccaaatatattgagaattatggtgttttaacaggttctcaaaatattacaggtgataatgagaaatatctgaagtgcttctgggaaattgaaaactatcaaataggaaaaagatggcatttctatgctaaaggtggagattatcgccagtattatgggaacttgacatttgttgtagactggtctgatacggcaaggcttttttacgcgaacaataaaacatctaatttgttaagtgaagaattttggttcaagccgggagttacctattcggcaattacaagccgtggaacaggttttagatatttgccggaagggtgtatctttgacaagggcggaccatcaattaacttgagaaagaacattccggaaattttggcgttgctaaatacaaatgttgctaagtactatttctgggtattcaatccatctatcaaccttcaagtgaaagatgtaaagagctttccaattattttgccggaggattcttctctgacagaaatggcaaacacaaatcttaaactttgtgaatatgattggaatgcatttgagacctcatgggaattcaagaaacacccgcttgtttcagagagtgaaaaagaaaaatccaagacaattcagcagtgctttaatcagtggaaggctgattgcgaaattcgttcgactgagttgcgtgaaaatgaggaacgattaaatcaatcctttattgatgcatacggtatgcgggacgaagttgatgcagcagttgaagaacgagacgtgaccgtgcgcaaagctgacttgcagcgggacatcaagagcctgctcagctatgctgtgggttgtatgtttggccgttactcgctggatgtggagggattggcctatgcaggcggcgagtgggatagcagcaaataccagagctatattccggatgctgacgatgttattcccatcaccgatgaggaatatctggacgatgatatcgtatcgcgcctgtgcgactggctgaaggtggtgtacggtgctgatacgctggaagaaaaccttgattacatcgcaaaagcccttggcaataaaggcagcaccagccgggagatcatccgcaactacttcctgaacgatttcttcaaggatcactgccggacttattctgtcaccggctccggcaagcgtccgatctactggctgtttgacagcggcaagcagaacggctttaaggtcttggtctatctgcaccgctacacaccggataccatcggcaacctgcgtatcgactacctgcaccggatgcagcgcgtgtatgaatccgagatcaaccgaatgcaggatatgatggatcacagcgagaatgcccgtgaggtggcagcagccgggaagcgcaaggataaacttgccaagcagctgaaggaatgccgggaatacgatgagaaaatcagccatctggcactttcccgcatcgaacttgaccttgatgacggcgttaaggtcaactaccgcaagctccagaccgcacaggacggcaagttttatgaggtgctggcggatagtaagaacatcatggcgaagcagcgaggaaaagcgtga

SEQ ID NO: 2588 - DNA, 3741 bp, Vibrio cholerae; identical to SEQ ID NO: 2398

SEQ ID NO: 2589 - DNA, 3741 bp, Vibrio cholerae; identical to SEQ ID NO: 2398

SEQ ID NO: 2590 - DNA, 3582 bp, Enterobacter sp.
atgaataccaataacatcaaaaaatacgctccacaggcccgtaaccagttccgcgatgcggtgatccaaaagctgaccacgctggggatttccgctgataaaaaaggcaatctgcaaattgcggatgccgagctcgtcggcgaaaccgtgcgctatggtcagttcgactaccccaaatccaccctcacccgccgagatcgtctggtaaaacgcgcccgcgagcagggctttgacgtgctggttgagcactgtgcctacacctggttcaaccgcttatgcgccattcgttatatggaaatccacagttatcttgaccacggcttccgtatgctctcgcacccggataacccaaacagctttgaagtgctggaccacgtgccggaagtcgcggaagctttgctgccagagaaaaaggcgcagctggtcgagatgaagctttccggcaaccaggacgaagccatctaccgtgaattgctgctggcccagtgccacgccctgcaccgcgcgatgcctttcctgtttgaagcagtcgacgatgaagctgaactgctgctgccggataacctgacccgcaccgactccattctacgcggtctggtggacggtattccggaagaagactggcaagaagttgaggttatcggctggctatatcagttctatatatctgagaaaaaagatgcggttatcggcaaagtagtaaagagcgaagatattcctgctgccacccagctgtttaccccaaactggattgtgcagtatctggtacagaactccgtcggccgccagtggttgcagacctatccggattcgccgctgaaaagcaaaatggactactacatcgagcctgcggagcaaacgccggaagtgcaggcgcagctggcggcgattacgccttccagtattgaaccggaaagcatcaaggtactcgacccggcctgcggctccggacatattttgattgaagcctataatgtgctgaaaaatatctacgaagagcgcggttatcgcgcccgcgatattccgcaattgattctggaacataatatttttggtctcgatatcgacgaccgcgctgcccaactttccggttttgcattattaatgatggcccgtcaggatgaccgacggatattcacccgcgacgtgcgcctgaatattgtctccctgcaggatagtctgcatctggatattgctaagctgtggcaacagctgaacttccaccagcagagccagaccggcagcatgggagatatgtttgcggaaaataccgcattagctcatgccgatagcgcggaataccagctgctgttgcgcacgctgaagcgctttgtaaatgccaaaacgctgggctcgctgattcaggtgccacaggaagaagaagcggaactgaaggcgtttctcaatgcgctgtatcgactggaacaggaaggagatttccagcagaaggcagcggcgaaagcgtttattccgtatattcagcaggcgtggatcctggtgcagcagtatgatgcggtagtggcgaatccgccgtatatgggcagtaaaggaatgaatggtgagctgaaagagtttgccaaaaataatttcccggatagtaaagctgatttattttcgatgtttatgcagcatgctttttctttgcttaaagaaaatgggtttaatgcacaaataaatatgcaagtctggatgtatttatcaacattcaaaaaattaagaaaacatatccttataaatcatactataattaacatgctgcacttaggcgcacgagcttttgaacagatatctggtgaaatagttcaaacaactgcttttgtaattagcaaaactaattattatgattacaaaccaaaatttataaaattaacctcactgaatgcgtccagtaaagctgttgcactttacaataatgaattccattataatatatacacccaaaaagattttttctctattccttcaaatcctatttgctattggatatcccctgacattttattaggctttaaaaaatgggcggctatatctgattatgcttgttgcttgagcggattgatcacaaaaggaacagatgaattcattcgatttaagcatgaggtaaatgtgaataaaatcaatgaatttttaacaaactcacgcgaacccatcggtaataaaaaatgggtacctttaattcatcaaataagtaatatggctttcctaggagagagtgattccctagttgattataaagacaatggttcacattactccaagccaggcaatggttcgctaagaaataaagaaagttattttcaagaatgtatttcttgggctgacgtgagctcagggaactactctttcgcaaagtttccaaaaggttatatccctaattccacatcgcatttcatgatattaaaaaataacaaagatagcaattttttattagggtttctgaattcaaattatgcaagatatatttttaatataataaacccatctattcaccttaatcctggagaagtggcatctttacctatacctcagaatgcgcaggcacaagactggagccatatagataaaattttaatcctcaaaaaagaaatttctctatttgatgagcgctcaatttttttcaatgcacataagttgctttgcaagaaactaaaaatgaaagattcttttaaatttaatgaagaagagttaacaaaaaaagaaaaagaaataaatgacctaacaatattaaacgaagaaaaagtttgcaatattgtaggaatagcctactcaaaacctaaagcgattgtgaatagtatattgcttaaagagctcattatacgttacataagtgtgaacatcggctgcatgatgggtcgctactccctcgatcgcgaaggcctagtctacgcccatgaaggcaacaaaggatttgccgaacttgtcgctgaaggcgcatacaaaaccttccctgcggacaatgacggtatcctgccgctgatggatgacgagtggtttgacgacgacgtcacctctcgcgtcaaagagtttgtccgcaccgtctggagcgaagaacacctgcaggaaaacctagactttatcgctgaaagcctctgtttatacgcgctcaagccgaaaaaaggagaatctgcgctggataccatccgtcgctatctttccacccagttctggaaagatcatatgaagatgtataaaaagcggccgatctactggctgttcagctccggtaaagagaaagcgtttgagtgtctggtctatctgcatcgctacaacgacgcgacgctggcgagaatgcgtaccgaatacgtggtgccgctgctggcgcgctaccaggccaatatcgatcgtttgaacgaacaggtcgatggtgcctccggcggcgaagccacccgtttgaagcgcgatcgcgacaatctgagcaagaaattcaacgaactgcgcagcttcgacgatcgcttacgccactatgctgatatgagaatcagtattgatctcgacgacggcgttaaggttaactacggtaagtttggcgatctgctggcggatgtgaaagccattaccggcaatgcgcctgaggtgatttaa

SEQ ID NO: 2591 - DNA, 3633 bp, Enterococcus faecium; identical to SEQ ID NO: 2506

SEQ ID NO: 2592 - DNA, 3741 bp, Vibrio cholerae; identical to SEQ ID NO: 2398

SEQ ID NO: 2593 - DNA, 3567 bp, Bacillus cereus
atgaataaaactgcaatcaaaaactttgcagtatcagctcgtacgaaattaatggacgctgtaaagcaaaaagcgtatgagcttggtattacaaaaactgaaattaaagaaccagaaacatatgaagatggcttccgaattaataataaattctttaaaagttatgaattagaacaacgtagaaaactaattcagaaaatcgaagaaaaagactataaacaagtaattgaagaagtttcctacacgtggtttaaccgtttcattgccattcgtttcatggaagtaaatgaatatctaccaacaggtgtacgagttctttcctcagcgcaagaggggaaaaacgaaccagatgttattggtgaagtaacgaatatcgctgaagatttagatttaaacttagatatcgtgtatcgattgcaagacgaaaacaaaactgaagatttatttaaatatattttaattaaacaatgtaacaaactaggtgaaattatgccaatgatgtttgaaacaattcaagattatacggaattattactaccagataatttacttggggaaggatcagttgtacgtaatttagtttcgatgattaacgaagaagactggaaagaacaagtagagattattggatggttataccaatactatatttctgagaagaaagatgaagtatttgctgatttgaagaaaagtaaaaaaatcacaaaagaaaacattccagcagcaacacagctctttacaccaaaatggatcgtaaaatacatggtggaaaattcattaggacgcttatggcttgaatctcacccgaatgaagatttacaacaaaagtggaaatattacttagaagaagcagagcaggaacctgatgtacaagagcaactagaaaagctgaaaaataaagaacttagcccagaagatattacagtattagatccatgtatgggatcaggtcatattcttgtttatgcatttgatgtactatatagtatttaccaacatgcaggctactctgaacgagaaattcctcaattaatattggaaaaaaacttatatggacttgatattgatgatcgtgcagcacagcttgcttatttttcgttaatgatgaaggcgcgtagttataaccgtcgtgttttccggagaccgcttggattgaatgtatgttctattcaggaaagtaatggagtttcacaagaggcgattgattattttgttggggattcattggatagagatgaagttgagtacttagttggtgtgtttaaggatgcgaaggagtatggggctattcttgatgtgaaggtaattgattttgaggcattagaaagaagagtaaaagagattggggaaaatgaaggttttagtgatatttttatccttcaatatagagatgctttgcttgaaagaatgcctaatttaataaaacaagctgaaataatgaatcgaaaatatgatgtagtagtgactaacccaccttatatgggtataaaaggaatgaatgaggcactttctaggtttataaaaaaacattatgctgcttcaaaatctgatctttttgcagtgtttatggaaaagttaggccgatacaccaaagaaaaaggatttcatgcagagataaatcagcaaacatggatgtttttaactagttttgaaagtttgcgtaataattttttagataactatacaatatattcaatgttacatttaggagcaggtgcttttgaagagattagtggtgaagtagttcaatcaacagcgtttgtaactagaaatatccatactgatgataattacaaggcgatttattttaaattaaatgaagtcaaaggccatacagagaaagagttagcatttattcaacattctcaaaatatccaatatataattactcaaaaaatattcaataaacttccaggtcgaacattgtcttattgggtatctgaacgtttaatagatatctttactttagatagcaaagtaagtgatattgctgaccctaaagtaggattgcagacaggtgataataatctttttttacgtttatggtatgagactaaaagtagtaaaattcattttggttcaaagaatgcatacgatgccgaaaacataggactgacatggtttccttatagtaaaggtggtggattccggcgttggtatgggaataatgagtatgttgtaaattggtacaaaaatggtgaagaaatccggaattttaaagatagtaaagggaaattaagatctagaccacaaaataaagaatactatttccgagaaggcattacttggtcagatatttctacaggtttatttagtgttagatttttacctgtaggttttatatttgatacaactggaaagtctatgtttgcaaatggttccgaggacaatatattgatgctaggatttacaaatagtaaagtgtttcaatatatattagatgtttcatgtacaggcatgcattataacaatggcataattgcaaaattgcctatgattattaaccctgaaatgcaaaggcgaacgaagccgattattgaaaacaatattacaatttctagattagattgggacttttttgagacatcatgggattttaaacaacatccttttgtaaatgctaaaggtaatgtaaactcacttgtttcaattttcaatgagtggaagttatttactaatgaacaattcaatgaactaaaagaaaacgaagaagaattaaaccgcatcttcatcgaaatttatggattacagaacgaactaacaccagaagtagatgaaaaagacatcaaaattcgcaaagccgacaaagaaattgatatcaaatcattcatctcctacgcagtaggctgcatgcttggtcgttattcactagatcaagaaggattagtatttgctggtggtgagtttgatgaaagtaaatataaaacatttaaagtagatgcggataatatcattccaattacggacgatgagtattttgaagatgatatcgtaagtcgttttattgaatttgttcgtgttacatttagtgaagagacgctagaagaaaatcttgattttattgcagaagcattaaataagaaggcaaatgaaacatctcgtcaatgtattcgtcgttattttttgaaagatttctttaaagatcatgtgaagacgtatcaaaaacgtccaatttattggttgtttgatagtggtaaaaatgatggatttaaagctctcgtttatatgcatcgttatgatgttggtacagttgcggaggttcgtactgattatcttcatacgcttcaacgtaagtatgaagcggaaattgcacgtcgtgatgtattacttgagtctgatgcttcaacaaaggataagacgcgtgcaaaaaaagaaaaagaaaagttacaaaaacaactccttgagtgccaacaatatgatcaagtaattgctcatattgcaaaccaaaaaataacaattgatttagatgatggtgtacaagtaaactatgcgaagttccaaaatgttgagcttccgcaaggagaaggcaaaaagccacttaaggctaatttattagcaaatatttaa

SEQ ID NO: 2594 - DNA, 3633 bp, Enterococcus faecium; identical to SEQ ID NO: 2506

SEQ ID NO: 2595 - DNA, 3678 bp, Salmonella enterica; identical to SEQ ID NO: 2364

SEQ ID NO: 2596 - DNA, 3741 bp, Vibrio cholerae; identical to SEQ ID NO: 2398

SEQ ID NO: 2597 - DNA, 3741 bp, Vibrio cholerae; identical to SEQ ID NO: 2398

SEQ ID NO: 2598 - DNA, 804 bp, Escherichia coli
atggatataaataaaagacatcaatgtgaagttattacagatttaattagctacatcatcggttgcatgatgggccgttactccctcgatcgcgaaggccttgtctacgcccatgaaggcaacaaaggcttcgccgatctcgtcgccgaaggtgcctacaaaaccttcccagccgacagtgacggtatcctgccgctaatggatgacgagtggtttgaggacgacgtcgcctctcgcgtcaaagagtttgtccgcactgtctggggtgaagagcacctgcaggaaaacctcgaatttatcgccgaaagtctctgtttatacgcgatcaagccgaaaaaaggcgaatctgcgctggagaccattcgccgctatctttccacccagttctggaaagatcatatgaagatgtataaaaaacgcccaatctactggctattcagctccggtaaagagaaagccttcgagtgcctggtgtatctacatcgctataacgatgccacgctgtcgagaatgcgtaccgaatatgtggtgccgctgctggcgcgttatcaggccaatatcgatcgcctgaacgatcaacttgatgaggcgtctggcggtgaagccacccgcctgaaacgcgaacgcgacagcttgatcaaaaaattcagcgaactgcgcagctatgacgatcgcctgcgtcactatgctgatatgagaatcagtattgatctcgacgatggcgttaaggttaactacggcaagtttggcgatctgctggcagatgtcaaagccatcaccggcaatgccccagaggtgatctaa

SEQ ID NO: 2599 - DNA, 2142 bp, Escherichia coli
atgaataccaataacatcaaaaaatatgccccacaggcccgtaacgatttccgcgatgcggtgatccagaagctaacgacgcttgggatcgctgcagataaaaaaggcaatctgcagattgccgaggccgaaaccattggcgagaccgtgcgttacggtcagtttgattatccgttatcgacccttccccgccgcgaacggctggtaaaacgcgcccgtgagcagggttttgaggtgctggttgagcactgcgcctacacctggtttaaccgcttatgtgcaattcgctatatggagctacacggttatcttgagcacggcttccgtatgttgtcccacccggagacgccgaccgcgtttgaggtgctggatcatgtgccggaagtggcagaagccctgctgccggaaagtaaagcgcagctggttgagatgaagctttccggtaatcaggatgaagctctgtaccgcgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcggaaaagaaagatgccgtgattggcaaagtggtgaagagcgaagatattcctgccgccacccagctgtttacgccaaactggattgtgcagtatctggtgcagaactccgttggccgccagtggttgcagacctacccggactcgccgctgaaagacaaaatggagtactacatcgagcctgcggaacaaacgccggaagtgcaggcgcagctggcggcgattaccccagccagcattgaacccgaaagcattaaagtgctcgacccggcctgcggttccggtcatattttgattgaagcctataatgtgctgaaaaatatctacgaagagcgtggttatcgcgggcgtgatattccacaactgattctggaaaataatatttttggtcttgatatcgacgatcgggcagcacaactttccggttttgcattattaatgatggcgcgtcaggatgaccgcagaatatttacccgcgatgtacgtctgaatattgtctctttgcaggaaagtctgcatctggatatcgccaaactctggcagcagctcaatttccaccagcaggtacaaaccggcagtatgggggatatgtttgctgaaaataccgcgttaacccaaaccgacagcgcagaatatcagctgctaatgcgctcgttgaaacgctttgtgaatgcaaaaacgctgggctcactgattcaggtaccgcaggaagaagaagcggaactgaaggcgtttctcgatgcactgtatcaactggaacaggaaggcgatttccaacagaaagcggcagcgaaggcgtttattccgtttattcagcaggcgtggattctggcgcagcgatatgatgcggtggtggcgaatccgccgtatatggggggaaaatacttagctccggcggttaaaaatcatctgaaagaaaattattctggatatgataaagatctattttcagcctttattataagaaatttacaactttccaaaaatggtgcacaacttgggttcatgacgccatttgtctggatgtttatttcaagctatgaagaactacgtctccaactaattaataatgaaacaatcatttcattaatacagttagagtactcaggttttgatggtgccaccgttcctatttgtactttcacattgcaaaaaaatcatatttcaaatttttcaggtagttatattcgactttctgattttcgcggagcggcaaatcagggaccacgagcacttgaagcaataaataataaagattgttcttggcgctatcaaaccaatcaagaaagcttcaaaaaaatacctagcaatcctattgtatattggataaaaccccaaacctcaatcctttttacaaataaaaaattggtgaactctatgaggttaaagaaggtcttggtacacgtgatgatgatatatttttgcgtagacactgggaagtatcaagaaaaaaaacaaaaactgacaagagtttaa

SEQ ID NO: 2600 - DNA, 3678 bp, Salmonella enterica; identical to SEQ ID NO: 2365

SEQ ID NO: 2601 - DNA, 3462 bp, Bacillus cereus
atgaacaaaaaagcactaaaagaatttgcagtctatgcccgtaacgaacttcgtgaacaaatcgcattacgagcacaagcctttgggatcacatccgaaggctctcctgtgtttgtaacaggtacggactatgtagaaataaacgggaagaaatatccagtatcttataaaaatagtattcaaaaattgttaaaagaagttgaaacaaaaggctacgatagtgtaattgaagaagttgcatacacatggtttaatcgtttgattgcgattcgttacatggaagtacataactatcttccatccaaagtacgtgtactttctagtgaaacgaaagggaaagtcgatcctaatatcttaacagaatatcaatatacggatttgccagtgaataaagatgaggtagcatccttactagcacaaggaaatcgtgaagaagcatttcgtaagctgttagtagcacaatgtaatgaattaaatggaatgatggatttcttatttgaaaagctcgaggattatacagaactgttgttgccggagtctttattgcatgcagactcattgattaataggttagttagcgatttagaagaaggtgacttccaagaagttgaggtcattggatggctttatcaattttatatgtctgagaagaaagaacgagttgggggtttgaaaaatactgctgttaaaaaagaagatttaccagtagttactcaactctttactcctaagtggattgtacaatacatggtacaaaactcgttaggcaagctgtatgatgagtgggaaccagagaacaatcttgcgaaggaatgggaatattatttgaaatcctctgagaagttaccgatcccagatgtcaaatctctcgaagatataaaagtaatcgatcctgcatgtggatctggtcatattttagtgtatgcttttgatttgctgtatgatatgtatttagaagcaggatattcggaacgtgatataccaagattaattatcgagaagaacttgtatggtctagacattgataaacgtgcagtacaaatggcaagttttgctttgatgatgaaggggcaggagaaataccgccgtttcttgaaaaaagcagatgatttaaagctaaacatttatgaatttgtagatagtggattcatttctgatgaggcattggcattttttgcagaaaaagtgggagatgtaagttggattgctactttgcaagaacagtttaaaaatgcaaaacagtttggttcattgatagtgcctaaagaagcggcatcttgttattttgaatatataacacttattaagtcttataatagcttagaaacaacagatttatttgaagaggcttatatagttgaattagaagaaaaattaattcctttattagagcaagcatctttacttgctttaaaatatgaagtggtagttacaaatccaccttatcataataaatttaatactatactcaagaaatttatgagtgaaaattataaggaatacaagtcagacttatattcagccttcatatatcgttgtacacagatgacgctctcaaatggattttctggattaatgacaccttttacatggatgttcatatcatcacatgaaaaattaagaaattatataattaatgaacaaagtatttcgagtctaatacaattagagtattctgctttttctgaagctactgtgcctatttgtactttcgttatacacaatcagaatagggtatctttaggcgagtatattcgtttggaagaatttaaaggtgccgagatccagcctatcaaggttagagaagcagtggaaaatagagttaattatagatattcttttagtaccgaagaatttacaaatataccaggaagtcctattgcgttttgggtatctgaacgtttaaaatttatatttaaaaattatcagcctttagagtattttgcagaagttagggccggaatgactactggtgataatgagacgtttttacgattgtggcatgaggttgtttatgaaaaggtggattttgggacttttcatatggatagtacagtcgcaaatcaacgaaagtggtttccttataataaaggaggagcttatcgaaagtggtttggtaatcaagaatatgtagttaactgggagaatgatggggaactgttacgaaagtttcctaaatctgttatacgaaatgctggatattattttaaagaggggataacttggtcagatattagctctagccactttggtgttcgatacataccgggtggatttatatttgcaaactctggttcaatgctttttgcagattcagatatgcttaagtatctaatgtgtttattacctaccaaagttacttcttacttactaaaaacttatagtcaaacaatgcactttgaagtcgggcatataaaaaaaattcccgtactctataataaagatatacaggagagagtagaagggatttttaatataaatgttaatatttctaaggaagattgggatatatctgaaacatcctggtactttagaaaacaggtattcttaacacattgtgaacaggttagaacattagaaaaatgctatgctaattgggaagggtatgcggaaaaaaaattccgtcaacttcaacaaaacgaagaagaactaaacaaaatcttcatcgatctgtatggtttacaggaagaactaactccagaagtaccagatggggaggtaacaatccgccgtgctgatcgtgtacgtgatacaaaatcattcctatcctactgcatcggtctcatgatgggacgttattcactagatatagatggtttagtatatgcaggtggagaatgggatgcgagtaagtataaaacattccaaccagattccgatggtatcattccgttaacagatacagagtattttgaagatgatgttgtaactcgtttgcaagagttattggtgattatgtttggacaagatactcttgcggagaaccttcgttggttagctgagtcacttacaatgaaaaataacgaaacgcctgttgagcgtcttcgtcgttatttcttcgatgagttttatagtgatcactgcaagatttatcaaaaacgtccgatttactggatggcggattcaggtaagaagaaaggcttccgtgcgttgttctacttacatcgttatacaccagaaacattagcgacaatgcgtttctcttatgtgcagaatttacaagagaaattgagccaggaacaaaaacgtttagatcaagatcttgtaaatccagatttaacagctgcgatgaagaaacgttataataagcagttaacgacaattaaagcacagcaagacgagctgatcgactttgataagaagatggctgaacttgcaaatgggcgtattgcacttgatttagatgatggagtagttgtaaactacaataagattgaaagcgtgcttgcgaagattaaataa

SEQ ID NO: 2602 - DNA, 3597 bp, Lactobacillus rhamnosus
atggataaaaaggcaatcaagacatttgcgattcaagctagacgtgatctgattaaaagtatcaggttaaagatggagaatcttggtatcacagaaactggtgttgaggagaaatcagcggcatcaaccaatgagattgaatattatggtgataaggggctatttatcagtggccaagatattaagcgtcgccgtgatttggtttctcggcttaaaacaatggccaagcaggaagaatggcgggacgcattttcggacctcatcgaagaagttgcgtatacatggtttaatcgaattattgccattcgattcatggaagtaaatgattacctcccgagtgacgttcgagtgctgtcatcggaaacaaagcttaaagtacctgatatcctgcgcgaagcttttaatattgaagacgagttaggtggttatagctcggatgagcgtgcaatcatccagaaagcccttgataccgaagaaccgtccgatatggatgctgcgtacgtcattctgtttaccaagcaagcgaacgcgctaaatcaatatctccctgaacttttcgaaaaaacagacgatttcatgcaattattgttcactccaagctattcggttggggtcattcgtgatcttgtggatgatattcgtgaagatgattttgatgtggacaagggcgggcaggttgagattattgggtggttgtatcagtattacaataccgagccaaaggagaccgctgtcgcttcccccaaatctcacaagttccgcggaagagaaatagcctcagctacccaaattttcacgccagattggatcgttaaatacatggttcaaaactcacttggaaagtattggattcaagttttaaaagctcgtggcgatgatcgagatgaatcaaaaattgccatggcatatgggtggcaatattacatggttgatgctccccaatctgacgaggtgaacatcaaaatagaaaatcttaatgctcgtttaaaggaaacagatgttcaagaaattcgtttcttggatccggcaatgggttcagggcatattttggtttatgcttatgaactatttatggacatctataaatcagaaggtttctcacaaagggaagcagctacgtctattattcagaagaatctttatggtttggaaattgacgagcgtgcattccagctagcttactttgccattacaatgtgttttagaaagtacaataggcgtgcgttaaatcaagacgtgccagcaaacttgaaggtgttcaatttaaatttacctagtacggggcaattatctctggccaaagattatgtttctaagggaagcttttcagaattaagctcactcttttctaccttccaacatgcaacagaaacaggttcattaatgcaattaaataaagctcaagaagaagcattggatcagattgtgagcaacctttctaagggcgaaacgcctatctatttgcatggcttaacccaaatgctaagcaacgttctgcaagtagcaaatattctgaaatcaaagtggaatgtaattgttaccaaccctccatatatgggttccgcgcgaatgaataaatacctatcctcttatattgataagaactaccgagcaggtaagtcagatttattttcggcattcatggaccggttttataatcaagtaactccagaagggtattgcgccatggtcacaatgcagtcatggatgtttcttaaaagctttgaagcattgcgtgttgagttcctaaatagtcataccatttccaatttaatgcacatggaaaatggtgtgatgggaatcgcttttgggacagcagttacgatagcaagaggtcagaaaatagacgattttgtgggaacttatcaccaaattaagacacaagatgcgtccaacaaggttccagcatctttgccgattcatggaaaccgatttaatcgtactaaacaaacgaattttgaaaagattccgggtaatcccattgcttactgggctcccaaaaaattttttaagatttttttggataaccctaacattggtaaatttggaaattccaggaatggtttacagccaaagaaatcgagtgaatttgtccgacaatggtttgaagtcatcttttcaaatattaattttggtgctctatccattcaggacactttgaactcttctgaaaaatgggttccatataataaaggtggtgcttttagaaagtggtatgggaactatgattttgtcgttaattggtttcacaatggacaagcaataagagctattacgcgtaacggaaagccatatgctgtcatacccagtcaaaaatattacttcaaagagtctttgacttggcccaagataacatcaggaaagatatcagcaagatatcgggaaccaggaagtattccagcagatgctgggaattcaacattttttgatgatagctcatttcttttctatgttatggccattatcaattccccagtaggatattatgttttaaatttaatcaacccaacactaaatcttcagacatctgatttttccgtctttccaattattataaatagtaagattaggataaacagtattgtaaatgaaaacataaacctctgtaaggttgactggaattcttttgaaagttcgtggagcttcaatatcttgccattactggcctatatcgctgagcatcatcgaaattggacggttgaagccgcgtttaatcagtggaaagaagaagctgataaacgcttcaaacaactgaaagcaaatgaagaagagctaaatcggatcttcattgatctttatggtttacaagatgaactagctccagaagaggaggataaggacgtatctgtccggcgtgccgatctatcacgtgatataaaagcatttatgtcatactttgttggctgcgtttttggcagatactcgattgatacacctggattagcgtatgcaggtggtgattgggatgatagcaagtacaagacctttcttccgaatgaagatgacgtcattgttttaactgatgacgattattttggagataatcgagacgttgtaaatcgtttcaaagaattcttgtctgccacgtttggagccgaacatctcgatgaaaacatgcagttcattgtagtcgcattaggcaagcggggaagcagttctgaagagataatacgcgcctatcttcgagacaatttcttcaagaaagatcatttgtcgacgtatcagaagcggccgatctattgggaacttaattctggccggaacggcggttttaaagccttaatgtaccttcatcgatatgacaagaacaccatggcgatgattcgaacaaagtatcttcacccgttgcaagaagcttacgagcgtcgacttgatcaattgaagagcttcgaagcgaatgaacagcaaactcggcaaaggaatgctatcaaaaagcagattacaacgatcactaagcaacttgatgaactagttaagtatgatgaaaaattgcaacacgttgcgaatttgcatatagatcttgacttagatgatggggtcttggtaaatcacgcaaaggcacaggcggacacaaagatctttacgccacttaaatga

SEQ ID NO: 2603 - DNA, 2232 bp, Lactobacillus rhamnosus
ttgttcactccaagctattcggttggggtcattcgtgatcttgtggatgatattcgtgaagatgattttgacgtggacaagggtggtcaggttgagattattgggtggctgtatcagtattacaataccgatcctaaagacaatgcctttaagaaaaagaagtatttgacttctgatattcccccagtgacacaactttttacgccagattggatcgtcaagtaccttgttgagaactcccttggtcgatactggatacgcgttcttcttgatcgaggagataaacggacttctgctgagattgctgaatcatttggatggcactattttatgccagatgctaagcagaatgattcaacgtctcatcccaacatggctgaaaaacgaattgaagacattactttcgttgacccagcaatgggatcaggacatattctgatctatgcatttgatgtcttcttgcaaatttatcaagcagaaggctattcgcgtcgtgaggcagctcaaaagattgttaaagacaatctttttggatttgatattgaccggcgtgcatttcaactagcctattttgcaatgatgatgaaattgcgctgcgaaaacagacggacttttgatcttcatttaaaacccaacatttttgaggttccaactacgaccttaaccccagatgatttttccgagactataaatgcaaataaaacggacaacgaaaagttgaaagagtttttaacaaagttcaacaaaggtaaagaacttgggtcgctaatagatttcagcgccgatatctttaaaaatgccttaattaatgagatcattcataaacagtttactgggcagctcacgttcgatacgtcaaaccaactgacacatcgacatgagttaaagagtctggttcgggtggggatgggtttaagcaataaatatacaatcagtgtgactaatcctccttacatgggttcaggcaagatgccaaaacctctttcagattttgtcggaaaaaattatccggcaagtaagtctgatttgtttgcagtcttcatagagcggctccagcatatgacaaagcaagatggcttttttgccatgattacccagcaccaatggatgtttctttcaagttttaaatccttacgtgaacggatgattaactggccgattataaatatggcacacttagggacacgtgcctttgaagaaattggtggagaggttgttcaaacaacggcctttattattcaaaagcaagcgagttcaaactttatcggaacttatgagcgtttggttgactttgattcacagacacgtaaggaaaaagcttatcttgctgccgttaaagatccaaaaattaagtacgtttatcgtactaaacaaacgaactttgagaagattcccggcacccctttagcatactgggttccaggttcgttgcttaatgtgttttcaaaagaaaaaatctctgattttgcgtttgctggaattggtatgcgtacgggtgacaacaagagattcttgcgaaggtggtcagaagtttgcatcacaaactccaagcttaacgaagcgtctgttgaaagtactttctctggaattcgctggattccatataacaaagggggaaactatagaaagtggtacgggaataatgaatatgttgtaaattggctgaatgacggccaagaaatcaaagataacactaaaaagacatatcctgaattaggagacgatttaggatggaaaatcagtaatgaaaaatattactttaggccaggcatcacttggacaggggtcactagtggaacatttaatgctcgtttttatccagatggttttatttttgattcaggggctaatggacttttcccatttgatgcaaataacacgtggagtattcttgcatttctaaattcaagtgttggaaattatctactcaaactgcttaatccaacaatcaacaccggatctggaaatataagatccttaccatttttggcttcgtcattctcaagtaatattgatgacatcgttcaaaactctgttagtctttcacaagaagactgggattcttgtgagacttcgtggaacttctgtaaagttgttctaactaaccatatcgctgagcatcagaaatcacctccaacaaaattcttgaccttagttgaattttgtgacaaatatgtgccaattcagtttaggaggttgattttttatggtaagttatcaaaaacgaggtaa

SEQ ID NO: 2604 - DNA, 3726 bp, Haloarcula japonica
atgtccacaacacacggtcaacccggtctttcgtcggatcagcgctcgaacattcgaagtgcgattcttagtacgcgccatacgctcgaagatgagcttcgacgccagctcgaaaagtacggcatctacgaggacaagaaactcccacttgagaatctgacacacctctccgttgaggagattcacacccgacgtactcttaatgcggctatccaacgagagctcgaatcgactgagggcgacttggagcggtcgataaccaactacgtccacgaagcgacgaagacctacctaaatcgattcgttgcgctgaaaattatcgaagttcgtggcctcgtcgaggaaacaatcaccgagcgacccgagtacggtaaccgatcatatatgcatcacaccgtcgctgaaatcgccggcgagctaactaacgcacccgacgacggcttcggtgccacactcgatctcgcgtatcaggagatcggtgcagagattcggatgattttcgaggaatctgaacacaccgctatcgaccttgatgcgcaggtacgcgaggaagtccttgatgatctagatctaatcgacgacgaagcatgggagagcgacgaagcactgggttgggtataccagtatttcggtgaggaagaacgcgaagacattgatgagcgtatcgatgaagagaactacaagattgctgggacggatatagccacgaagactcagttgttcactccacggtacatcgttgagtggatggttgacaactcattgggtcgaacgtggctcgaaatgcagggcgaacgaacaaatattgacgatgagaagaattgcttctatctctccccgctgcaagactctttgattgaacgagagaccaaagcagttgaggacattactgtgcttgaccctgcttgtggcagcggtcatatgctattctacgcctttgatgtgctctaccagatgtatttagaggaaggagagatccccgaaaaatacattccacgtgagattctccgcaacaacctctacggaatcgatattgactctggtgcagcacaaatcgcggccctgtcactatatcttaaagcgaaagcacgggctccaaatatcgatgttgaccaaattaatattgtctcggcagatgcagtcttgataaatggtgaaaaaaagcaggaagtccttaaccgatcacaatcggagctcgaaaaggaaattctggaacagatttggactagttttgaacatattcgtgagtgggggagtcttgtccgagtagaagagcgtatcgaggggattatcgatgaataccgggacgaactcgaagcagcaggtcaatccaagtttacgcaaagtgggggacttgaaaaacaggcttccgttgtttcgttctcggataatgaatcggaatcatgggacgctgtgaaagagcggttacttgagaacacccgtgaaatagctcgaatcgcccttaacgaggataacccaattgacgaaatgtttgcctcagaggtatcgaagacagttgaacttcttgacgttctaattcgtgattacgacgtggtggtcgctaatccaccttatatgggtagcgcgaaaatgggggataatttaaaacaatatgtgaaagacggatatgttggaacccgcgatttgtatgctgccttcattcagcgatcttgggagttcgctaaggatgatggatatgcttcactagtcaccccagagaactatatgttttcgtacagctatcggaagcttcgtcggattctacttcagaatcatcaatttgtcgaaggggtccatctctcccgttatggatttgatcaacaaaaagacgcctacactatcccattccttcttcgaaatagtgagccgggggagcttactgaaacacgcttctaccgtatgactcacgaacaagatcaatacgagaactacgaaaagaaaatacagggcttgaactacttagtcaaacaaatcagaaaaggtgatgacccagacgacatttatataatcaattcgaatgattttctatcgattggtcgacagccattcttatactggtttggtgattcccttctcaacctcttctcccaatatcccgcgatagaagagtcagtagaagtgaaacagggactagccaccggggatgatgaccgatttgttagaaaacattgggaagtaccctctgaggaattaaaaagctattatgttccatatcagaaaagtggatcttcttctccttactatgatactcaacgtgattatcttgactgggaaaatgatggtaaagaggtgaaagaatatagcggaagccgccctcaaaatccagattactacttccgagagggcatctcattccgaggtttcggaaattatgcagttgctcgccaaaagccagatgacactatcttctatcacaaatcgcacttcgtttactcaccggaaataagtgacaagtatctacttggctatggtaattccacgttggttcggttccttttgaacggaatcaatccgtcgttgaatttcgaagtcggtgacgtgaagcgactaccaattgatccggaaccggcggaacaagaaaaagtagaggatctcgttaaccaggcattggaacgcagggagcgattagtatcgctagatgaaactagtgatcagtttgacccggaactcttcaccgactgcgtccaaggtggagtgagagaactactgtatcataaagaccagctcaatgcagaagtgggtttgatccacgggcttatagacccagttatctatgacgaatactcaatcccaacagaagaaagggaccgactatacaataatttgcccaataatctctcaacatatcctatcgtagaaaacttagaaacgaattatggaaccttcggtgatgaggttcccaagaagaccctaacactggatgaatatgagaatttgctctcagacatttcggaaggcccagaagacattcgtgacgcagcggaagatttggaaatatcgcctctaacaatcgcagatgcccggtacattaagaatctctatgatgacgaaagactcgaacaatctgtcggttatgttctgtcattctgtctagggttactcttcgggcggtgggatgtcaataaagatatagaaactgttgatgatggaataataagtttcaacgagagcgccaatcaaaatgtaagtgagcaaatttcgagctgtttggaaacggtttttgacgatggttcgagtgtgcagtcgtctcttgaagattccctaggaacttcattggaagattggctacgtgaatccttcttccgataccatcattgcaaggaataccgtcgtcgaggtcagcgcattccgatttactggcaactcgaaagtccggatggtgcattcagttgcttcgtttactatcacgcaatagactcgaacacacttccaaaacttcgcggccagtatcttgatcaacgtattgacgaactcgaaaacgaacttgaaaccctaaatgcccagactagtggcaataacccagacaaggatcttctaaaccggaaagagaaagtccaaaaagatctcaatgataccaaagaattccgagatacgatcgacaaaatgattgacgacggcgttaccgttgatgtggagaaagggatttgggagaatatcaaagaatgggaccaatacgaaattcttgaaactggactcccaaaactgaaatcaagctactccaggtag

SEQ ID NO: 2605 - DNA, 2232 bp, Lactobacillus rhamnosus; identical to SEQ ID NO: 2603

SEQ ID NO: 2606 - DNA, 3597 bp, Lactobacillus rhamnosus; identical to SEQ ID NO: 2602

SEQ ID NO: 2607 - DNA, 3678 bp, Salmonella enterica; identical to SEQ ID NO: 2365

SEQ ID NO: 2608 - DNA, 3621 bp, Vibrio tubiashii
atgaacaccaacaacgtaaaaaaatacgcacctaaagcccgtaaagccttcattgaggccatgagtaaacaggctgcgaaatatgggattaccaaaaataagatcgagccagcggagcagaagggcgacctggttctaattggtgatagaccgtttccggcttcggttatcaaacctcgtgaacgcttggtaaagcgcattgagcagcaaggcttcgaccaggtaatggagcatgtggcctatagctggtttaaccgtctatgcgcaattcgctacatggaacgcaaagggttccttgaccacggtcgtcgggtattgagcgcggctgacggcagtgccggtgtgccccaaatactggaagagtgtctggatgtcgagttgcccggcctggaccaggccaaggttagagagctgaagcttgatggcaccaaagacgaagagctttaccgtgagctgttactggcccagtgccatgccttgcaccaagcaatgccatttctgtttgaggcggtagcagatgaatccgagttgcttttgccagaaaacctgaccaagaccgactcattgattcgtgatcttgttgctagtgttcccgatgaagactgggaccatatcgagattattggttggctttaccagttctacatctccgagaagaaagatcaggttattggcaaggtcgtgaagagcgaggatattccagccgcgacacagctttttacgcccaattggattgttcagtacctggttcagaactcggttggtcgccactggcttcagacgtatcccgattctccactcaaggagaaaatgccgtactacattgagcctcctgaacaatcgcctgaagtaatgtcaaagattgcagatattacgccttcagaagtttctcctgagtcactaaaaattgcggatattgcttgcggctctggtcatatattggttgagacctatagggtcatgaaggctatatatgaagaacgaggctatcgttctcgcgatattccacaacttattctcgaaaacaacttgtttggtttggatatagatgaccgagccggacaaatggcagggttcgcgttgttgatgttggcgagggaagatgatcgacgaattttcagtcgcaatataagactcaatatcctgtcgttacaggaaagtgctaatgtaaatcttcctagtctatggaggtcattgaacttaaccggagaatggcagagtggcgcatcgcaaggactatttgaagaagagcagcaggacctgagttcttttgcagcagataaccgctaccagttgattcagagaaccttagaaaggttcaagaaggctaagacatttggctcattgattgatgtttctcatgatgactacgaggaattaaaagagctttttcagaccctatgcgaacttgagattgctggcgattctatgcagaaagcagcagctagccagttgataccatttgtccatcagtcgatagtgctctctcaaaaatatgaatcggtattggctaacccgccatatatggggagcgcctattacaatagcacgcttaaagattttgcatcattaaagttcgatgaatggggaggagatctcttcacatgctttattaagcagtctttagatatgattgcgcgtgaaggtagtgtcgctttaattacgattggaacatggacctttttaccaacgtttgaagcgatgagaagacagttgctagattgctgcatttttacatccattattgataatgggcgtggcgtttgggggtctgatcatggttctttgatgttttcagcaaaaaagatagatggcgatctatgtggtaataaagtcgcgactaagtatctttcaagagggaaaggaaaggttcagcaagtaaacgttatacggagtaaatatttaagcgataagcccctgtatatagaacaggatctttttaagaagattcctggatatgttatttcagtaggcgctactccagagctattaaatcagtttttagagtcacatagattaagggatctagcggacgcaaggcagggtataaaaacgggagatattgcaaagtacctgagatattggcacgaagtatcttacagcaacataaagttcgactgtaatagttcagacgaatcaatggttgcaagtgagcaatggtatccatgcaataaaggaggggaatttcgtaagtggtatggaaatcaagattatgttctgaattggaagtctgacggttttgagattagaaactttaaagatgaatctggaaaactgaggtctaggcctcagaatacgcatctcttcttcaaggagggcattacttggtcaacagtaaccatgggaaggccatcgtttcgatattctaaacccggtcgaatctttgaatctggcggctcaactatatttactaatgaagatatttattatcttcttggtgtgctgaattctaagttaggtgaggtttcagtaggaatactttcgccgaaggtaagcctgggtgaaggggcggtttcaaagtttccgattccggatttaagctctgataaaaaggataaaatatcggaatgcgctaaaaccttagtccagatattttcaacaattgactcatgggatgagagcacatttgatttcaccggcctttttgattttccttcccaagataatttagaagtctatgcgacacgttggattgaaaaatacaagtcgattttaaacgatataaaacgtcaagaagatctcataaattcaattgtactagggagcggttttgaaaaaaataccgatgaggtcgatccgcaagattacggcctgcctgaaataaacagttcggtcattgtcgagcgtatagtgagttttgctattggatgtatgatggggcgcttttcattagagtcaaaaggagttgtttatgcagattccaatgaagagaaaggaaactcatcatcatttgaattgataaaaacgacaagtaatttttcggttgatgaagatggaattatacccataacgggaattgagtggtttcctgatgatgcggcaaacaggcttcatgagttcctcatgtccgtttggccgaaagatagattgggtgagaacgtagatttcgtagcaaattcgctttgtaattcaagtatgaaggcaaagcaaaatgaatctacctcagacacgattcgtcgctacttatctacccagttctacaaggatcaccttaagacctacaagaaacgtccaatttactggctgttcagctctggtaaacagaaggctttcgagtgccttgtttatctgcaccggtataacgaaggtacgctggcgcgtatgcgtaccgagtacgtcattcccctgacagcgaagatggcggcctatgctcaaaagctggagaacgataaagaagccagtggatcggcagcggaggtgaagcggcttgaaaaggaaattgcccaactgcacaagcagcaggctgagttgagcgagttcgacgaaaagttacgccactatgctgaccagagaataagcctggatctggatgatggcgtaaaggtcaactacggcaagtttggtgatttactggcagaagtgaaagccattaccggcgaggctccggaggctctatcatga

SEQ ID NO: 2609 - DNA, 3741 bp, Vibrio cholerae; identical to SEQ ID NO: 2398

SEQ ID NO: 2610 - DNA, 3741 bp, Vibrio cholerae; identical to SEQ ID NO: 2398

SEQ ID NO: 2611 - DNA, 3678 bp, Salmonella enterica; identical to SEQ ID NO: 2365

SEQ ID NO: 2612 - DNA, 1188 bp, Escherichia coli
ttgaaatcattatcaccaacgcttgattaccacgaaggtccgataggtaaacttccttttaaaggaaagcttaaggctcaagttttagaaaatgttgtaaatttaatcgctatttcagaggaagactggaatactgaggaaacatcttgggggtttaaaaaacaccctatcacaaaattagacaacctgaattatttgcaggctagttttgaagcttttaaaaatgatgtacaagaaactataattagaacccaacagcttgaagagttcaataacaaggaaataattagagaatatggactagaatcagagctaaactataaagtttctttagaagaaataacattaacggtaaatcctgattataagtattctggaaccacggatgataaatcaaaaaggatgcagtcagacagtctttcctccctactatcctatgccatcggctgcatgatgggccgctactccctcgatcgcgaaggccttgtctacgcccatgaaggtaacaaaggcttcgccgatctcgtcgccgaaggtgcctacaaaaccttcccggccgacagtgacggtatcctgccgctgatggatgacgagtggtttgacgacgacgtcacctctcgcgtcaaagagtttgtccgcaccgtctggggcgaagagcacctgcaggaaaacctcgaatttatcgccgaaagtctctgtttatacgcgatcaagccaaaaaaaggcgaatctgcgctggagaccattcgccgctatctttccacccagttctggaaagatcatctgaaaatgtacaaaaagcgccctatctactggctgtttagctccggtaaagagaaagccttcgagtgcctggtgtatctgcatcgctataacgacgccacgctgtcgagaatgcgtaccgaatatgtggtgccgctgctggcgcgttatcaggccaatatcgatcgcctgaacgatcaacttgatgaggcttcaggcggtgaagctactcgcctgaaacgcgaacgcgatagcctgatcaaaaaattcagcgaactgcgcagctatgacgaccgcctgcgtcactatgctgatatgagaatcagtattgatctcgacgatggcgttaaggttaactacggcaagtttggcgatctgctggcagatgttaaagccatcaccggcaatgccccagaggtgatctaa

SEQ ID NO: 2613 - DNA, 2454 bp, Escherichia coli
atgaataccaataacatcaaaaaatatgccccacaggcccgtaacgatttccgcgatgcggtgatccagaagctaacgacgcttgggatcgctgcagataaaaaaggcaatctgcagattgccgaggccgaaaccattggcgagaccgtgcgttacggtcagtttgattacccgttatcgacccttccccgccgcgaacggctggtaaaacgcgcccgtgagctgggttttgaggtgctggttgagcactgcgcctacacctggtttaaccgcttatgtgcaattcgctatatggagctgcacggttatcttgatcacggcttccgtatgttgtctcacccggagacgccggccgcgtttgaggtgctggatcatgtgccggaagtggcagaagccctgctaccagaaagtaaggcgcagttggttgaaatgaagctttccggtaatcaggatgaagctctgtaccgtgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcggaaaagaaagatgctgtgattggcaaagtggtgaagagcgaagatattcctgccgccacccagctgtttacgccgaactggattgtgcagtatctggtacagaactccgttggtcgccagtggttgcaaacctaccccgactcgccgctgaaagacaaaatggagtactacattgagcctgcggaacaaacgccggaagtgcaggcgcagctggcggcgattaccccagccagcattgaacccgaaagcattaaagtgctcgacccggcctgcggttccggtcatattttgattgaagcctataatgtgctgaaaaatatctacgaagagcgtggttatcgcgggcgtgatattccacaactgattctggaaaataatatttttggtcttgatatcgacgaccgagcggcacagctttccggctttgcattattaatgatggcacgtcaggatgaccgcagaatatttacccgcgatgtacgtctgaatattgtctctttgcaggaaagcctgcatctggatatcgccaaactctggcagcagctcaatttccaccagcaggtgcaaaccggcagtatgggggatatgtttgctgaaaataccgcgttaacccaaactgacagcgcagaatatcagctgctgatgcgcacgttgaaacgctttgtgaatgcaaaaacgctgggctcactgattcaggtaccgcaggaagaagaagcggaactgaaggtatttctggacgcgctgtatcgcctggaacagaaaggcgacttccaacagaaagcggcagcgaaggcgtttattccgtttattcagcaagcgtggattctggcgcagcgatatgatgcggtggtggcaaatccgccgtatatgggcggcaaagggatgaatggcgagctgaaagagtttgccaaaaataatttcccggatagtaaagctgatttgtttgcaatgtttatgcagcatgcattttctttacttaaagaaaatgggtttaatgcacaagtcaatatgcaatcatggatgttcttgtcgagctacgaagcgcttcgcggttggttattaaataataaaacatttatcacaatggctcatttaggagctcgagcttttgggcaaatttcaggtgaggttgtacagacaactgtatgggtagttaataataaccatactgagttttaccgccccgtatttttccgcttaatcaatgggagtgaagaggaaaaaaaaagtgcactaatttcgcgcaaaaatatgtttaatcacaccttacaaaacgacttcaaaaaaatccctggagagccaattgcttattgggtaagtgatatatatagggatattttcacccagtcaccagctctctcctcaatagctaaaccaaggcaagggcttgcaacttcagataataatagatttttgaagctatggtatgaaccatcattaagaaaaattaacttttccgcaaaagatcgtgccgacgcattaaattctcaggcaaaatggtttccttgccaaaaaggtgggagttatagaaaatggtttggtaatcatgagtatcttgtaaactgggaaaatgatggccgtgaacttcttgattttgcagcaagcctgtatggttctccaaccagaacaataaaaatatccctttttattttagagaaggtgcaacttggtcgacaatttcgtctagtgatttttcaattagatatagcccaactggttttatatcagaaaccaaaggtgctgtttgttttgctgatgataaagatattttattatcgatcctag

SEQ ID NO: 2614 - DNA, 3612 bp, Lactobacillus reuteri; identical to SEQ ID NO: 2323

SEQ ID NO: 2615 - DNA, 3741 bp, Vibrio cholerae; identical to SEQ ID NO: 2398

SEQ ID NO: 2616 - DNA, 3741 bp, Vibrio cholerae; identical to SEQ ID NO: 2398

SEQ ID NO: 2617 - DNA, 3615 bp, Escherichia coli; identical to SEQ ID NO: 2471

SEQ ID NO: 2618 - DNA, 3633 bp, Enterococcus faecium; identical to SEQ ID NO: 2506

SEQ ID NO: 2619 - DNA, 3741 bp, Vibrio cholerae; identical to SEQ ID NO: 2398

SEQ ID NO: 2620 - DNA, 3675 bp, Escherichia coli; identical to SEQ ID NO: 2305

SEQ ID NO: 2621 - DNA, 3537 bp, Sphingobium indicum
atggatacctcgaagctcaagaaattcgcccagtttgcccgccgcgccctgatcacccaggtcagttccaagcttgaatccgtggttgccgaaaattccgcagctcggcgtgagcatcctgatgcgatgcggaagctggaatcggcaatcgccaaggacgggaaggatcaggtggtcgagcgcgttgcctacacctggttcaatcgcttctcggcccttcgcttcatggacgtaaacgaactgaacccggtccgggttgtctctcctaccacaggtcagtttcagccagagatcctggccgaggccaaggctgggcatatggacgaagaccgcgtgcccgaccggatccgcgacaaggtccgcagcttgttggatggccgaaccccgagtacggatgcccagaccgaagcctatcggttcctcatcgtcgccatttgcaatgatctgcacaaggcaatgccgttcctgttcgagcgaatcgacgactacacagagcttctgcttccagacgaccttctctcgaatgcctcgatcctcgcttatgtgcgtgaggcgatgacgcccgacgtctgcgaggatgtcgaggttatcggctggctttaccagttctacatctcggagaagaaggacgaggtctttgcgggcctcaagaagaacaagaagatcacggcggaaaacattccggccgcgacccagcttttcaccccgcactggatcgtgcgctatctggtggaaaattcgctggggcggctttggttgctcaaccgaccgaactcgaatctggcggcgcagatggattactacatcgcgccggaagagcccgagacggatttcctgcgtatttccaggcccgaagatatccgcatctgcgatccggcctgcggatcgggccatatgctgacctatgcctttgatctgctctacgcgatttatgaggaagaagggtacgaggcgaccgatatccccgggctgatcctgaccaacaatctttatgggatcgaaatcgatgaccgtgcgggcgcgctggccgcctttgcgctggcgatgaaggcggcgaccaagctcggaaggcgaaagttcctgcggcaagccgttcagcccaacatctgcgttctgcaggatgtgcgcttcacggcgtccgagatgcaggacgttgccgccgtggtgggcagcgatctgttcaccgccgattttcgcgaaacgatggggcagttcgagcaggccaagaacttcggctcgctcatcgtgccgaaattacgcgaccctgccgaggtcgcccgggttgtgcggctgaaggatttcggtggcgacctgctgctgcgcgaggtgaaggagcgggtgctgaaggtgctggagatggctgaggtcctctcgcccaaataccatgtggttgtggccaacccaccgtacatgggtgcaagcaacatgaatggtgtgttgaaggattggacggcaaaggcttttaagagatcaaaggctgatctttacgcgatgtttatcgaccgaaaccgtgatttaatccgtaaaggcggatatttcggaatgatcaccatgcatggatggatgttcatttctacatactcgaagctccgcgaattcatagtgaaaagcaacacattggtttcgatggctcatcttggcacaaggggctttgacagcattggaggcgaagtggtttccaccaccgcctttgtccaaagaaacgttcgccccaagcaggatctcggcacgtatgttcgactcacagatgccccctctgaaagagcgaaggcagaactatttcggtcagcaaaaaagagtctgaataacggtccccgctttgaggcccgaacgtccgacttcgagaagattcctggctctccaattgcgtactggcttccagaaacggcgagaaagctcttcaaggaaggcgatgcctttggtgactttcttgacgcacggattggcctcgcaaccggtcgaaatgattattatctgagattccattacgaggtttcgacaaagaatgttgccttctcgtgtggcgataggagtgaagccaaggctactggcaaaaaatggtttccattcaataagggggggagtctccgcaagtggtatggcaactgtgagtttgtggtaaactgggaaaatgatgggcatgaactccagacgacgatgcatccgtctggagaaaggatatgggcccacaacttcaatctggattatatcttcaagccaatggtttcgtggtctgacatcactaccgaaggtctggctgtgagattctatcctaaggggtttattttcgacagcactggtgtttctgcatttgagaaaggttcggggcagtcacaaaagtgcatcggggcaatctgcaacacgaaactcggaacctacttttccgaagtacttaatccgacccaccactttacgcctggtgatttttcccggttcccagttccgagaggattggtggatagcagtcacgatgagaacgtcgcgcgtgcgacttcaatagctaaatccgactgggacgcctacgagacctcctgggatttcgccacgctcccgttgctctcgcccgatcatcgggccgggacgctggaaggcagctatgcccgcctacgggcccattggcggggcatgacggacgagatgcagcggctagaagaagataacaaccgcattttcatcgacgcctatggcttgcaggacgagttgactcccgaggtgccgatcgaggagatcactcttatctgcaaccccgcctatcgctatggtgtgaagggctctgaagatgaccgtgaaacccgcctgcgcgccgacagcatcgccgagttcctcagctacgccgtgggctgcatgttcggccgctacagtctcgacgcgccgggcctgatcctcgccaaccagggcgaggcacttgccgattatctcgctcgcgtaccagtgcccacattcgaaccggatgtcgacaacgtcatcccggtactggacggagactggttcgctgacgacatcgccgagcgtttccgcaagttcctgcgggtgactttcggcgagccgaagtttcaggagaacctggccttcattgagggtgccttgggcaaggacatccgcaagtggttcacgaaggacttcttcgattaccacgtccgccgcttcaagaagcgcccgatctactggatgttcaccagccccaagggcagcttccaggcgctgatctacatgcaccgctaccggccggatacggtcagtgtggtgttgaacgattatctgcgtgagtaccgcaataagctggaagcccaccgcaaggcccaggaggcgcagagcatcaaccccgaagtcacgccaggccagcggaccaaggcgctgaaggaagtgggcgaggcaaccaaggtgattgaggagctcgatggctatgagcgcgacgtgctctatccgcttgccacgcagaagatcgagatcgatctcgatgatggggtgaaagccaattacccgaagttcggcgcggcgctcaaaccgatcaagggcttgtcggatgcggatgactga

SEQ ID NO: 2622 - DNA, 3741 bp, Vibrio cholerae; identical to SEQ ID NO: 2398

SEQ ID NO: 2623 - DNA, 3741 bp, Vibrio cholerae; identical to SEQ ID NO: 2398

SEQ ID NO: 2624 - DNA, 3678 bp, Escherichia coli
atgaataccaataacatcaaaaaatatgccccacaggcccgtaacgatttccgcgatgcggtgatccagaagctaacgacgcttgggatcgctgcagataaaaaaggcaatttgcagattgccgaggccgaaaccattggcgagaccgtgcgttacggtcagtttgattatccgttatcgacccttccccgccgcgaacggctggtaaaacgcgcccgtgagcagggttttgaggtactggttgagcactgcgcctacacctggtttaaccgcttatgtgcgatacgctatatggagctgcacggttatcttgatcacggcttccgtatgttatcccacccggaaaccccggccgcgtttgaggtgctggatcatgtgccggaagtggcagaagctctgctgccggaaagtaaggcgcaactggttgagatgaagctttccggtaatcaggatgaagctctgtaccgtgaactgctgctggggcagtgccacgccctgcaccacgcgatgccgttcctgtttgaagcggtagatgacgaagcggaactgctgctgccggataacctgacccgtactgactccattctgcgtgggctggttgatgatattccggaagaagactgggagcaggtagaggttatcggctggctgtatcagttctatatctcggaaaagaaagatgctgtgattggcaaagtggtgaagagcgaagatattcctgccgccacccagctgtttacgccgaactggattgtgcagtatctggtacagaactccgttggccgccagtggttgcagacctacccggactcgccgctgaaagacaaaatggagtactacattgagcctgcggagcaaacgccggaagtgcaggcgcagctggcggcgattaccccagccagcattgaacccgaaagtattaaagtgctcgacccggcctgcggctccggtcatattttgattgaagcctataatgtactgaaaaatatctacgaagagcgtggttatcgcggacgtgatattccacaactgattctggaaaataatatttttggtcttgatatcgacgaccgcgcagcccaactttccggttttgcattattaatgatggcgcgtcaggatgaccgcagaatatttacccgcgatgtacgtctgaatgttgtctctttgctagaaagcctgcatctggatatcgccaaactctggcagcaactcaatttccaccagcaggtacaaaccggcagtatgggggatatgtttgctgaaaataccgcgttaacccaaaccgacagcgcagaatatcagctgctgatgcgcacgttgaaacgctttgtgaatgcaaaaacgctgggctcactgattcaggtgccgcaggaagaagaagcggaactgaaggtatttctggacgcgctgtatcgcctggaacaggagggcgatttccagcagaaagcggcggcgaaagcgtttattccgtttattcagcaggcatggattctggcgcagcgatatgatgaggttgtgacgaatccgccgtatatgggtaatggtggaatgaatagcgaacttaaagcgtttgcaaaaaataatttcccggatagcaaatctgatttgtttgcaatgtttatggagcgtgcattttctttgcttaaaagcaatggatataatgcgcaaataaacatgcagtcatggatgtttttatcaagctatgaaaaattaagagagaagcttcttaaattaaaaacatttcatactatggcccatcttggagcaaaagcattcagtcaaatatctggtgaagttgttcaaacaacagcctgggtggcattaaacgaacatatagatatgtttaaacccacgttcttcagaataattggaggttctgaacacgaaaaacaaaaaactcttatagaaaaaaaagatggtattatcttgcatagtcaaaataactttatgaaaataccgggagctccttttgtttattggaatgtagataaaataagtaagtactttgaaaatacaaaaactattggagatttatgtgatgcacgtaaaggtatggggacgggagacaatgcttcatttgtaagagcttggcatgaagtttcattaggaaatatcgggtttaattttgatagtcgagaaaatgcttcagcgtcgaatattaaatggttcccatacaacaatggtgggcgttatagaaaatggtatggtaacaatgaagatgttgttaactggtatcaagatggggttgaagtcaaagcaacggccacgatcaaaaacaatggtggtcattggtcaagatatcttgttagcttagatcgttttttctgccaaggtttaacttggtctgatatttcatcaggcaactttggtgctcgttattttgacaaaggatatcttttctcaagtgtaggtatgtgtgttttttctgaaacacatagcatatacaatctactaggtgtacttaacagttcaataactcaagagatattagatagtattagcccctcactacattatggcgtcggagaaataaaaaaaattccattaaaaataatcaataatgacgatgaaatcaaagaattagtccaaatttatgcaaatgactggggttcagttgagacttcatatgaatttttaacgctaccaattattgctaacaaatcagatgcacaatcaatcagaaataattattccagcttactggaaattcaacaaaaatatattgacaaagcgttttttttagaaaaaaacaataatattcgatacttagaagcatataacattaacaaaaatgactatcaggaaattagcgaaagagaactaacattatttattaacccatattataagtttagcaatattaaagatgataatttaatttgtaaagctcagcaatcagatacctcacaaagtttattatcctactccatcggctgcatgatgggccgctactctctcgatcgcgaaggccttgtctatgcccatgaaggtaacaaaggcttcgccgatctcgtcgccgaaggtgcctacaaaaccttcccagccgacagtgacggcatcctgccgctgatggatgacgattggtttgaggacgacgtcacctctcgcgtcaaagagtttgtccgcactgtctggggtgaagagcacctgcaggaaaacctcgaatttatcgccgaaagtctttgtttatacgcgatcaagccgaaaaaaggcgaatctgcgcttgagaccattcgtcgctatctttccacccagttctggaaagatcatctgaaaatgtacaaaaaacgcccgatttactggctattcagctccggcaaagagaaagcctttgagtgtctggtgtatctgcatcgctataacgacgccacactgccgagaatgcgtaccgaatatgtggtaccgctgctggcgcgttatcaggccaatatcgatcgcctgaacgatcaactcgatgaagcttctggcggtgaagccacacgcctgaaacgcgaacgcgacagcctgatcaaaaaattcagcgaactgcgtagttatgacgaccgcctgcgtcactatgctgatatgagaatcagtattgatctcgacgatggcgttaaggttaactacggcaagtttggcgatctgctggcagatgtcaaagccatcaccggcaatgccccagaggtgatctaa

SEQ ID NO: 2625 - DNA, 3567 bp, Sporolactobacillus vineae
atgacagaacagaccaaaaatgatcctattgataaaaaggctattaagagctttgccgttgcagcacgcagaaaactgatcgaaggtgtggaacagaaagcctatgcgtttggcattaccaagcaacaaattcagaatgcagattctgtgaagattaatggctttccgatggatgagacgcagcagaagcagcggaaacatctcgttgaaaaaataaaacattctggattcaatgaggttattgaagaagttgcttatacgtggttcaaccgttttatcgccttgcgattcatggaagtgaatgattatctgcccagtggtatccggattctctcatcgattgatgggaaacgtgatccggatattctgagcaatatcgaactcgtcgctgatgaactgcaacttgataggaacaaagtttatgatcttcaggatcggaacgcattggatcaattattcaaatatatcctgattcatcagtgcaacgagttgagccagatgatgccgagcatattcgaaccgattgacgatgcaaccgagttgctccttcctgatcatctgctaagggaaggatctgtcatccggaaattggttgatgagatcaaagaagaaaattggaaacatcaaattgagatcatcggctggctgtatcagtattatatttcagaggagaaagatcaggtctttgcccgactgaagaagaatatcaaaattggtaaagaggatattccggctgccacacaattgtttacacccaaatggattgtgcaatatatggtagaaaactcactaggcagactgtggctggaatcacaccctgatcaggaaatgcgtcagcagtggccttattacctggatgaagcacaacaggaagctgaagtgcagaaaaaaattgatgcacagaaaaatcatcaactcagtccggaatcaatcaaatttctggatccgtgcatggggtccggacatattctggttgatgcgtttgatgttttcttttcgatttatcaaaaagcaggttattcggttcgggacatccccagactcattcttgagaagaatctttatggtctagaaattgatgaacgtgccaagcagcttgcttatttctcattaatgatgaaagcgcggcactatgatcgacagctatttcaaaagccggttcatgtgcatgtgtatgccattcaggaaagcaattcaatcactcaagatgaaatcgatcttgttgcaggagacaattcagatcgaaatcaggttgtcgcactagttaacctgttcaaagatgccagattatacggatcaatccttaaggtccctggtgaaattgatctcgacctgctgcgatcgagattgaaagctttacgtgaggataaaagtcataatctgtttatagaggaatttcaacagcgaaaccttaaattgtttgaaaatatgctagagcaggctacgatgctttccatgaaatatgatgtggttgtgacaaatccaccgtatatggggcggaaggggatgaatgataaactttcgatttacataaaaaaacattatcccgatgaaagtgcagatttatttgctgtcatgatggaaagatgcagatgcttttcagagaaaaaaggatttatcagtatgattactcagcaatcctggatgtttctctcatcatttgaaaaaatgcgcatccacctattaaatcaagaacaaatttattccatggttcatcttggtgcaagagcatttgcggaaatcggtggagaagttgtccaaagtacaatgtttgtatctcatcattattacattcctaactaccaaggcactttcattcgtttagttgatttcaaaagtgctaatgaaaagcgcaaacaatttaataataacaggttttattatacaagatctcaatccgctttttcagacatccccggttctccgattgcctattgggcaagtgatcaagttagaaaaatttttcgagagaatccaaaattaggagacgtagcagaacctaggcaaggaatggcaactgcggataataatcgctttttgcgattatggcatgaagttaattttaatagaattggatttaactataagagccgggaagaagcacttcgatcaaagcaaaaatggttcccatataataaaggcggagcctttcggaaatggtatgggaatatggaatatgttgtgaattggaaaaatgatggagaagagataaaaaattttgtcattaagcggtatccatatttgaatggaaattatgaatatgttgtgaaaaacatgaagtattattttcgtgaaggaatcacatggactgcgatttcacgtaaacatttttcagttcgatatgtagataagggttctatttttagtaatgcgggtatgatgatttttacacgtaacaaagttgaattattatttttattagggctagttaattcaaaacaagccttcatgttaattagtcagctctcgtctacattaaattttgatcaaggcgtggtacgacgcataccagtcaatgagggtaatagcgatgcggttataaatctcgtcaataaaaatataaatatagctacaattgattggtactccttcgaaacgtcctgggacttcaagcagcatcccctcatagagttccgtaatggtgccgcgactattgatgaggcatacaataattgggctcgcgaagcagagcgacgctttacaacactgaaagcaaatgaagaagaattaaaccggattttcatcaatctgtatggtctgcaggatgaactgacatcggaagagtcggatgatgaggtaacggtccggcgagcggatcgcgagcgtgatgtgaagtcatttctgtcctattgtgtgggcattatgtttggacgctattcgctgggcgaagacggactgatttttgccggcgggacgtttgatcggaatcgttatcggacctataagccggataaggacaatgtgatccctattacggatgaaacttattttgaagatgatatagtcggccgttttattgatattgtcaaacggatttttggcgaacagacattggaacagaatcttgattttattgctgaatcgctgaagaaaaagtcgggggaaaccgcgcgtcagcggatccgccgctattttctgaaggagttttataaaaaccacgtgcagatctataagaagcggccgatttactggctgttcgacagcggaaaagagaatgggtttaaggcactgatctatctgcaccgttatgaaccggggctggttgcccgagtacgaaccgattatctgcatgccatggagcggaaatatgaagaagagatgcaacgtctggatctgcagatggaagctgaggcaccggaacgggacaaggtacgagcaagaaagcaaaaagagaaactgcagaaacaactggaagagtgccgacagtatgatcaggtggtggctcatgttgccagtcaacaaatcccgcttgatctggatgacggtgtgaaagtgaactatgccaaattccagaatattgacgtgccggggaagaaagtcaaggtcaatctgctggcgaagatctga

SEQ ID NO: 2626 - DNA, 3741 bp, Vibrio cholerae; identical to SEQ ID NO: 2398

SEQ ID NO: 2627 - DNA, 3501 bp, Streptomyces sp.
atggaaaccgctccgctcaagtccttcgccgcctgggcgcgcgccgcactcatccgcgaggtagcggcccgcatctccgtcgtgctcgctcccgcctcgcccgagcaggtcgagcagcgcaccgccgtcgcggcactggagaaggccgtcaatgcggctggcggaggcggcacgggccgcgccgctgtagcggacaaggttgcctatacctggttcaaccgcatcatcgcgctgcggttcatggacgccaacggctacaccgggatcggagtcgtttcgcccgagcgaggccgcgagggcggccagccggagatccttgccgaagccaagcgcgggaacatcgacagcacggtcgtcaccaacatgcgcaccgctgagacagtgacgaacctactcaacagcacgcgccgcagcgacgacccacagggcgaggcgtattcgctgctgctcgcggagtactgccgccactggaaccgctcgatgccgttcatgttcgagcgcgagggcgactacaccgagctgttgatgcccgcgaacctgctcgccgacgactcagtgctggcccgtgccgtcaccgtgctcactgaggacgtctgccaggacgttgaagtcatcggctggctgtaccagttctacatctccgagcgcaaagacgaggtcttcgccgggttcaagaagaacaagaaggccggcgccgccgagatccccgccgccactcagctcttcaccccacgctggatcgtccgctacctcgtagagaactcccttgggcggctctggctgctcaaccggcccgcttcccggctcgccgaccagatggagtactacatcgctccggtcgatgaggagaccgactacctcaaggtctccagccccgaaaagctgaagattatcgaccccgcatgcggctccggtcacatgctcacctacgcgttcgacttgctgtacgccatctacgaagaggagggctacgcgccgtccgacatccccgcgctgatcctctccaacaacctgtacggtactgagatcgaccctcgtgccggtgcgctggccgcgttcgcactcacgatgaagggccgcgcccgtcagcgaacgttcttcaaccgggatgtcgagccgaacatctgcgtgctcgaacctgtctcgttcacctccggtgagctggatgccctcgtcaccggcagcggagaccgtgccgacgaggaggcgttctggaaccaattcgcgcacgcggacaccttcggcgccctcatccggccgaagagagccatggttgagtcggtcggggagcactttccggtgagtgactcggccgaccacggactgttcgcgcaagatctgcgtgagcgtgccgagatcgtcatcaagcaggccgcttatctgtcccagccttacgacgtgctgattgccaaccccccttacatgggcggcaagaacatggcatcccgcctcgcccagtacgtcaaggaggagtatccgagcaccaagtccgatctcttctccatgttcatcgagcgatcgttcggcatggtggcggtcggtggatattccgcgatggtaacgatggaggcgtggatgttcctcctcacatacaaggagctccgcgaaacgatcgtcacgcgcaagagcattcggaacatggtgcacatgccctacgttggcaaaggcagcactagcatgggaatcaatttcgggactgcggccactgtgattcagaacgtgcccgatccgagagcgaaggccacgttccagtgtgtccgctattacgagacggactcaaccggcgttcccttgacattccctgtcaccaatgagcgatacgcgttgtttgcgccgagtgagttcacggtcgttccggacacgcggatcgcctactggctatccgcccagatgctcaaggcgttctctctggggaggccgctcgcgcaggtcggcgtgccgcgacagggaatggcgaccgcggacaacgagcgtttcctccgcctgtggaccgaggtgagcgtcgatcgcttcggccatggcctcaccagagaggaagccgcaggaagcgcgttcaagtggttcccctacaataagggtggcgattaccgaaagtggtacgggaatcacgactgggtcgtcaactgggagcatgacggccgggagctgatggccgaacgccccaaggcggtgatccgcagcccgcagctctacttccgcccgtcggtgtcctggtcgaaggtcgggacagggctgcccgcgttccgtttctttccgaccggtttcatcttcgccgacgccggttcgtcgatattcgggagcgaacgggatctgctgcacctagcggcgatctgcaatgcgacagtcgcccgggagatgctggctgcgacgtcaccgaccctcaacgtcgaggtgggaacgctcgctcagctgccggtcgtcgatgtgtccgacaccgccgtctcctccgtccaagaactcgtcgacattcaccgagccgactggaacagccgtgagacggcatgggagttcggcgccctggacatcgtggccggcggcgagagtttgctgcggaaggcggtcgccaacgcgctagagagcggcaccgctgtctccgcgcgtgcgcgggcactggagagccaagtcaacgcggaggtcgccgacgcgtacggcctggcgtccgaggtcgacgtcgacgtatcgcttgaccgcgtcacgctgcactgcaacccggtcgcccgcttcggggagggcaagtcctcggcccaacaggaaaagctgtatgcccagcagagagccaacgatctcgtctcctacgcggttggctgcatgctcgggcgctacagcctcgacgaaccggggctgatcctcgccaaccagggcgacacacttcaggactatctcgcaaaggtgccgaacccgtcgttccagcccgacgaggacaacgtgatcccgatcgtcgatggcgactggttcgaggacgacatcgtggcccgattccgtcagttcctccgggctgcgttcggtgaggaacacttcgaggagaacctgcggttcgtcaccgagtcgctcggcgtcaaggacctgcgcgactacttcgtgaagtcgttctataaggaccacgtccagcggtacaagaagcgacccatctactggatgttctccagtcccaagggatcgttcaacgccctcatctacatgcaccgctacacgccgtcgaccgtctcgaccgtactgaacgagtacctgcgcgagtacaaggcgaagttggaggccagccgccagcaccacgagcgtctctccgcagggacgggcacgccgagggagaaggctgccgcgcagaaggaggtcgaccgcctgcgcagggtgttgctcgaactcgacgagtatgagcacgacgtgctttatccgctggcgacccagcaggtgcagatcgaccttgatgacggcgtgaaggcgaactacccgaagctcggtgccgcgctgaagaagatccccggccttgaggcaagcaatggctga

SEQ ID NO: 2628 - DNA, 3678 bp, Salmonella enterica; identical to SEQ ID NO: 2365

SEQ ID NO: 2629 - DNA, 3633 bp, Enterococcus faecium; identical to SEQ ID NO: 2445

SEQ ID NO: 2630 - DNA, 1593 bp, Escherichia coli; identical to SEQ ID NO: 2464

SEQ ID NO: 2631 - DNA, 1905 bp, Escherichia coli; identical to SEQ ID NO: 2465

SEQ ID NO: 2632 - DNA, 1137 bp, Escherichia coli
ttgccattacttgatcttcataaaacagaaatagcgtcattatccaaagagaatgtggatatttcaaaaattgattgggattcttttgaattatcatggaattttaaaaaacacccattaatttcaagagaagcttctatagaaaagagttacaaatataatctcattgaaaataaaaaaagaatagataaaacaaaagaaaatgaagaagttattaataatatttttgcttgtgggttaggtcttactgacattatatacaatacagttccaatcgcagaggtaactttaaattgcaatccgttatatcgatatggaaatattaaagatgacaaaacgctgcatctacgatttcagtctgaaacattatccgaattgatttcatactccatcggttgcatgatgggccgctactccctcgatcgcgaaggccttgtctacgcccatgaaggtaacaaaggcttcgccgatctcgtcgccgaaggtgcgtacaaaaccttcccggctgacagtgacggtatcctgccgctgatggatgacgagtggtttgacgacgacgtcacctctcgcgtcaaagagtttgtccgcaccgtctggggtgaaaagcacctgcaggaaaacctcgaatttatcgccgaaagtctctgtttatacgcgatcaagccaaaaaaaggcgaatctgcgcttgagaccattcgtcgctatctttccacccagttctggaaagatcatatgaagatgtacaaaaagcggccaatctactggctattcagctccggcaaagagaaagcctttgagtgtctgatgtatctgcatcgctataacgacgccacgctgccgagaatgcgtaccgaatatgtggtaccgctgctggcgcgttatcaggccaatatcgatcgcctgaacgatcaactcgatgaagcttctggcggtgaagccacacgcctgaaacgcgaacgcgacagcctgatcaaaaaattcagcgaactgcgcagttatgacgaccgcctgcgtcactatgctgatatgagaatcagtattgatctcgacgatggcgttaaggttaactacggcaagtttggcgatctgctggcagatgtcaaagccatcaccggcaatgccccagaggtgatctaa

SEQ ID NO: 2633 - DNA, 1908 bp, Escherichia coli
atgaataccaataacattaaaaaatatgccccacaggcccgtaacgatttccgcgatgcggtgattcagaagctaacgacgcttgggatcgctgcagataaaaaaggcaatttgcagattgccgaggccgaaaccattggcgagaccgtgcgttacggtcagtttgattatccgttatcgacccttccccgccgcgaacggctggtaaaacgcgcccgtgagcagggttttgaggtgctggttgagcactgcgcctacacctggtttaaccgcttatgtgcaattcgctatatggagctgcacggttatcttgatcacggcttccgtatgttgtctcacccggagaccccggccgcgtttgaggtgctggatcatgtgccggaagtggcagaagcactgctgccggaaagtaaggcgcaactggttgagatgaagctttccggtaatcaggatgaagctctgtaccgtgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcggaaaagaaagatgctgtgattggcaaagtggtgaagagcgaagatattcctgccgccacccagctgtttacgccgaactggattgtgcagtatctggtacagaactccgttggtcgccagtggttgcaaacctaccccgactcgccgctgaaagacaaaatggagtactacattgagcctgcggagcaaacaccggaagtgcaggcgcagctggcggcgattaccccagccagcattgaacccgaaagtattaaagtgctcgacccggcctgcggttccggtcatattttgattgaagcctataatgtgctgaaaaatatctacgaagagcgtggttatcgcgggcgtgatattccacaactgattctggaaaataatatttttggtcttgatatcgacgaccgagcggcacagctttccggctttgtattattaatgatggcacgtcaggatgaccgcagaatatttacccgtgatgtgcgtctgaatattgtctctttgcaagaaagcctgcatctggatatcgccaaactctggcagcaactgaatttccaccagcaggtacaaaccggcagtatgggggatatgtttgctgaaaataacgcgttaacccaaaccgacagcgcagaatatcagctgctgatgcgcacgttgaaacgctttgtgaatgcaaaaacgctgggatcgctgattcaggtgccgcaggaagaagaggcggaactgaaggtattcctggacgcgctgtatcgcctggaacaggaaggcgatttccagcagaaagccgcagcgaaagcgtttattccgtttattcagcaggcgtggattctggcgcagcgatatgatgcggtggtggcgaatccgccgtatatgggcggtaaaggaatgaatggtgagctgaaagagtttgctaaaaataatttcccggatagtaagtctgatttgattgcgatgtttatgcagcgtgctttttccttgcttaaagaaaatgggttcaatgctcaagtaaatatgcaggcctggatgttcttgtccagtttcgaatcattccgcgaatggctgttggataacaagacgttaatcacaatggctcatctaggttcaagagcttttagtcaaatttctggtgaggttgtgcaaaccacgtcatggattataaaaaataatcatattaaagattacttaccagttttcttccgcttgacagacggcaatgaagaacagaaaaagaaaaatctttaa

SEQ ID NO: 2634 - DNA, 3678 bp, Salmonella enterica; identical to SEQ ID NO: 2365

SEQ ID NO: 2635 - DNA, 3756 bp, Glaciecola polaris
atgaaattagctgaccacgtagaccatttaagagagctgattgaagccgccttcgataagcaatttgctagactgggttttagtaagaccaagcaaatggacgccatccaggtagaaaaactaccagaggaagttaaagctaagcgtgagcgcttcgccgtgatgctggataatcatattggtgaaaccggtggctatgacagtgccagagaaaagctactggatgaattaacgtttacgttattcaaccgccttgccgccataaaggtgatggaggcagcaagcttatttccgcccatattaacaaagcagaaggagcatggtgatcgttcatttggccataaggcttggttagaaatgaatccgcacatgcgtgatgaagagctggaaggtattcgcgattatttaaaatcagcgtttgatgaacttggtcaaacgttgccgctgtatagcaaaacttacccttatgcgcttttacctgatgccataagcttaaacgatattattgacgcttttaatacggttgatactgacgcgcaagctaatgaatcatcagaagagaccatctggcaaagtgatgatgttctcggttggatgtacgaaagctacaataacgccaagaaaaaggcccacaaagacagcggtgataaaaccgaatataacaaggtatcactgcaatcacaggtgtatacgccgcgttgggtggtacaattcttggtcgaaaactctctgggtaaaatgtacctggagatgtacccgcactccgaaataaaacagcgctataaaattgccaatgcaccaacaacgcaaacgcgcacacctaagcctttacatgaagtacgcacgatagatccggcctgtggctcgggcaactttttgttgtatgcctttgacttttattacgagctttatttggatcaaattgaaaactatggcgcagactatgatgaaaaagacatccctaaactcatcattgaaaataacctgcatggcatagacttagacgatcgcgctatccaattagcacagcttggcttatttatcaaagccaagaaaaagcgccgtacagtcggcgagttgcatttcaaagtggtatcgtccgatttctatctgcctgagtatgaagcagtaaaacacatcttcgaacagggcaatttggtgtcagctcagcaacgagagtttatagagaaagtatgggctgatctaatgcaagcctataagtttggctcgctgattcatattgataaagagttaaaagaacagctatctcaggttaaagagcttgcccttggtgaaacgtttgattcgacgcaaaagttaaaaaagaaaattgttgaaggggatctttttgcagcggcagactatgccgagcaccaagaatttgcagaaaacttctttgcaaacttatttgctgcggtagagcagtatgcccgaacagaacgcaatactttcttaagtggcaaaacgcgagatgcgattacattcttagagctgttaaccactgaatatgatgtggcgactgctaatccgccgtatacagatagtggtgactttgggcctgatttaagggtatttgtcgatacaaattttaaaaaaacatccaaattccatacaaatctttacagtgcttttatgaaacggtgtttcgaattaaccagtcgtgatggatatattgcaatggttcatccgaatacgtttatgtttattaagacatttgatggcgtacgtaagtttatcattaataatttgcatctggagatcttggtcgactacggtttggatagagtgaatttgtttggtggtgatgttctacttgactcgaattgtttctacgtacttagtaaaaataatagaaatgataaaaaatcgatatttattgatgtggatactagaattcaagaaaaacacaaaaaagaaagtttcaccaacgctttatcagatattgttcgcgatgtcgagaatagtcaggtattcaagatttttcaaagtgagtttctattaattgaaagtttgccatttatctattggataagtgaagatctcagagaaaaattcacaaaatctccgcttcataaagttgctgatgttgtttctggtgttaaaacaggaaataacaatggagccttaagattatggtgggaagttgatagaaaagatatttatgatggaattggtgacaaaaaatgggttttgtacactaaaggagggaaatttaaaaagtggcaaggaaacaattggttatgcgtagactggaataataactgcagttacattaagaaacaaaatagttacaacattcctccagaaaatatatccttcagtgaaggcattaattattctggaagtggacaaaagggcgtttgtttccgttttttagaaaaaaatgtgctttttgatatggggtcttcagctgtatttccgaagttcgatgtcttttatgcgctatccgttttaaattcgaagctagctttttatatggctgattgtcttaatcctactgttaacaaacagccaaatgatgtaaagagaattcctcttgcgccgccaacgagtgagtctattggatatcttaagtctttaagtgaaagtaatatttcaatctatcaacatttagagcgtttttcactacttgaaatgcgttattcaaattcacctatcgatatgtttttccaaggaacaataagaaatagcattaaagacttcctaaattatgaaaatgcaatcttgtctagggtcttggttcaggaagctatggtcgatgaggaagttttcaaattatacaatttgactgaaaatgacaaaaagatggttctagctaagcaaggtcatagcgtggggggattgcctgtttgttctaaagctagagaagaattcatatcgaagactaatgagttagaaaacttcactgtcacaattacaagcgagtttatccattcactccctgtcattgatttttctcctgaaaaacgtgaagttattgaaagtcattttgccggtctttaccagaagaacaatgatttggaagagttttgcattcgtcaccaaatcaaccctatcaacgtctggtattggtttaaacaaagcaaagtcatccctaagcaacgtatgcaaactttagccatggaatttttggctgatattatccgtgaaatcctgatggaagacgaagatggcatcattcctcttgtgcctaatgccggtgagaaagtgcttcttgatcgaatcgaagagaagtttctcgagaaagggtttagtactgctcaatactcaagctttgaatctgtgctagggcggccaatcaatgactatctaaacaaaaatttctttgcagagctgtcagatcacttaaatctgtttatgtatttgcctaaaaccccatttatctggcacttaactagcggccctgaacaaggcttcgattgctatatcatcatctacaaatggaatcgcgataacttgctgcgcttacgctcggtatatatcgaaaaccgtgaacgcgctttgcaaaaccgccagagtgatattgctggcaatgaaagcgctgaagcgcaaaacgagaaagagcgcatctttaagcaattgaaagaaatcgacgcctttaaaaagaaaatcgacgaactattggctgaaggttacaacccgattcttgatgatggtgttggcaaaaatattgcgcctttacagaaaaagaaaatactggcttatgacgtattgaatgcaggccagctaaaaaaatacttgaacgctgattggtaa

SEQ ID NO: 2636 - DNA, 1137 bp, Escherichia coli; identical to SEQ ID NO: 2632

SEQ ID NO: 2637 - DNA, 1908 bp, Escherichia coli; identical to SEQ ID NO: 2633

SEQ ID NO: 2638 - DNA, 738 bp, Escherichia coli
atgatgggccgctactccctcgatcgcgaaggccttgtctacgcccatgaaggtaacaaaggcttcgccgatctcgtcgccgaaggtgcgtacaaaaccttcccggctgacagtgacggtatcctgccgctgatggatgacgagtggtttgacgacgacgtcacctctcgcgtcaaagagtttgtccgcaccgtctggggtgaaaagcacctgcaggaaaacctcgaatttatcgccgaaagtctctgtttatacgcgatcaagccaaaaaaaggcgaatctgcgcttgagaccattcgtcgctatctttccacccagttctggaaagatcatatgaagatgtacaaaaagcggccaatctactggctattcagctccggcaaagagaaagcctttgagtgtctgatgtatctgcatcgctataacgacgccacgctgccgagaatgcgtaccgaatatgtggtaccgctgctggcgcgttatcaggccaatatcgatcgcctgaacgatcaactcgatgaagcttctggcggtgaagccacacgcctgaaacgcgaacgcgacagcctgatcaaaaaattcagcgaactgcgcagttatgacgaccgcctgcgtcactatgctgatatgagaatcagtattgatctcgacgatggcgttaaggttaactacggcaagtttggcgatctgctggcagatgtcaaagccatcaccggcaatgccccagaggtgatctaa

SEQ ID NO: 2639 - DNA, 1908 bp, Escherichia coli; identical to SEQ ID NO: 2633

SEQ ID NO: 2640 - DNA, 3678 bp, Escherichia coli; identical to SEQ ID NO: 2624

SEQ ID NO: 2641 - DNA, 3567 bp, Microcystis aeruginosa
atggatacatcaagacttaaaaaattcgctcagtatgcccgttgttatctcagagaacagatgacgactaagttagaagtggtcttagctgaaaatagcgccgcaagacgagaaaatcccaaagctatcagcaagttagccgaaaaaatcgaatttttaggcaaagaacagcttattgaacaggttgcctatacttggtttaaccgtttttgtgccttgcggtttatggatagtaaccgctatcactccattagggttgtgtccgctgctgaggggcagtttcagccagaaatcttggctgaggcgaaaacgggacacattgacgaggaaatgctcaataaacaggtcagaaagcagatttttgatttattaagcggaactgcaccgagttatgatgctcaaggggaagcctatcgtttattaattgtaggagtgtgtaattattatcatcagttgatgccctatttatttgaacgaattgatgattataccgagttattgatgcccgatgatttattatctggtaattcaattttagcctatactcgcgaggcaatgactccagaaaattgtgagagtgtggaggtgattgggtggttatatcagttttatatctctgagaaaaaagacgaagtttttgagggactaaaaaataataaaaaaatcactccccagaatattccagcggcaactcagttatttactcctcattggattgtccgttatttagtagaaaattccctggggcgtttatggatgttaaaccgtcctcagtctcggttagttgagtcaatgtcctattatgtggatagtgggaagtgggaagtgggagatgggtacttaaaaatcaactcgcctgaagatataaaaatctgtgatcctgcttgtggttcgggacatattttagtctatgcttttgatttactttatgcaatatatgaggaagaaggttatacagcaaatgagattcctagcaagattttaacccataatctctatggcatagaaattgatgaacgggcgggaagtttggcagcatttgcattaaccatgaaagcgagggaaaaggaaagacgattttttcgtaaacccatccagcctaatatttgtgtgttgaaaaaagttgagttttctgaaaaagagctacagctttatctagattttgtcgggcgcgatttgtttactgcgcctttattagaaacactacatgagtttaaggaggcggataattttggggcgttaattcgtcctacggtgacggatgtacaggggatgatagggttattaaatgagcgcaatgttgctagtcagttattgttatataaaacccacgagaaggtaatggatgtgttaaatatggcggattttttaagtcctaagtatcacattgttgtggcgaatcccccctatatgggtaacaaggggatgaataatcggttaaaggcttttttacaggataattatagtgaggtaaaatcggatctattttctgcttttatggtgcgttgtttagaattatgtaaaaataacgggtttacaggatttatgactccttttacttggatgtttttaagttcctatgaaaagttaagaaaacatattttagacaattgtactttaacgtctttagtaaaaccctcttatactgcttttttcgattcagctattgttgctatttgtgcttttacgataaataaacaccataatgataattataaaggggcattttttgatcttgattatttaggaactgctgaagaacaatcacctagatttttacaaagaaaaagagagaatcaatattaccgcgcttctgctagtgattttaagaagattccaggaagtgcgatcgcttattgggtgagtgatagagtcttagaaatttttgctacttcagaaaagttagaaaatattgctaaagcagttgtggggttacaaactggtgataatgatcgatttttgcgtttatggtttgaagttgagtatcaaaatattggttttaatttagaaaatagaaaacaagctcaagagtctcagaaaaaatggtttccctataacaaaggtggtgagtttagaaaatggtatggtaatcaagagtatttagtcaattgggaaaatgatggacaagaaatagcaaattttaaaccaagagcagttattagaaatcctagttattattttcaagaaagtataacatggtcttttgttagttcatcctgttttggtgttaggttttctcctaaaggctttatttttgatgttggtggatcatcattatttactgagcaagaaaatatgatgtttttaacttctcttttatgttcaaaaattgcctttgatttgatgaaaattatgaatcctaccttaaattttcaagtaggaaatgttgctagtattcccattgtaaaaaataataactctttaatagaaactgtggggtttaaaagtattagtttaagtcgccaagactggaactcatacgaaacctcgtgggattttaccacccttccacttttgagagtgggaagtgaaaacctagaacaaaatccccgctttccactttccacttccctgaaagaaacctatcaaaacctacgccagaaatggcaagaaatgaccttagaaatgcagaaactagaggaggaaaataacagtatatttatcgaagcttatggactacaagacgaattaacccccgaagttctcttaaaagaaatcaccttaacctgtaacccccattatcgttataagaaagaggtgggaagtgagaagtgggaagtgagaaataaagaggaaaatattacccactttcccatagatgaagacttagaaaaacgattattagcagatactatcaaagaatttatctcctactcagtgggttgtatgtttggacgttattctcttgataaagaaggcttaattttagccaaccaaggggaaaccttgcaagactaccttaaacagattccaaaccccacctttcccccaacagaaaccaacgttatccccatccttgagggggactggtttagtgatgatataaccgaaaaattctggcaatttctgcggctcacatttggggagaaaaactatcaacaaaacctcaactttatcgaagaagcgatcgggaaatccctagaaaaatactttctcaaagacttttatgatgaccacactaaacgctataaaaaacgtcccatatattggttatttagtagcccaaaaggaacatttaacgccctaatttatctccatcgttatcgccctgataccgttaatatcgtccttaatagctatctgcgggaatttcggcttaaactagaagtaaaactagacaccttccaacaaatagaaattagtacaagtgcaactaaaaccgaaaaaaccaaagccctacgagaaagcgaacaaatcaaaaaaatgatcggagaattagaaacctacgaacaagaaaccctctatcctttagccatcgcccagaaggaaatagatcttgatgatggggtaaaagtcaactatactaaattaggtaaagccctgaaaaatataacaggattaggttaa

SEQ ID NO: 2642 - DNA, 3741 bp, Vibrio cholerae; identical to SEQ ID NO: 2398

SEQ ID NO: 2643 - DNA, 3741 bp, Vibrio cholerae; identical to SEQ ID NO: 2398

SEQ ID NO: 2644 - DNA, 3606 bp, Enterobacter hormaechei
atgaatacgtcaaacatcaaaaaatacgccccggtggcacgtaaacagttccgcgatgcggtcatgcaaaaactgaccacgctgggtattgaggccgataaaaaaggtaatgtacagattgcgcaggcaaccgatcttggagacctggttcgctatggccagttctcgctggacaaatccctaatctcacgtcgtgaacgtctggtaaaacgtgccgaaaagcaaggctacgaggtgttggtagagcacatcgcttacacctggtttaaccgcttctgcgccattcgctatatggaattgcacggttatcttgatcacggtttccgtatgctgtctcacccgacgctggcaggtggttttgaggttctggaccatgtgcctgaagtggctgatgcacttgggctggacacatcgcgtttggttgagatgaagctggcgggcgatcgtgacgaagagctgtatcgtgaactgttgcttgcccagtgtcatgcgctgcacggtgcaatgcctttcctgttcgaagcagtcaatgatgaaattgagctggtgctgccggataacctgacccgtactgactccattctgcgtgggctggtggacattattcctgaagaagactgggaacaggtcgaagtgatcggctggctgtatcagtcctacatctccgagaaaaaagacgatgtaatcggcaaggtggtgaagagcgaagatattcctgccgcgacccaactgtttaccccgaactggattgtgcagtatctggtgcagaactcggtgggtcgccagtggctgcaaacctatccggtttccaacctgaaaggcaaaatgccatattacatcgagccagcggagcaaacgccggaagtgcaggcgcagctggcagccatcaccccatcaagcattgaacctgaaagcattaaagtgctggacccagcctgcggctccgggcatatcctgaccgaagcctataacgtgctgaaagcgatttatgaagaacgaggctaccgcacccgtgatattccgcagctgattctggaaaacaatattttcggcctggacatcgatgaccgcgccgcacagctctcaggctttgcgatgttgatgctggcgcgtcaggacgatcgccgcatcctgggccgtggtgtgcggctgaatattgtctccctgcaggaaagtaagctggatatcgctgagctatggaccaagctgaacttccaccagcaggtgcagcgtggcactactagccagatgttccctgaagagatgacactagccaacaccgacagcgcggaatacaagctgctgatgcgaacgctggcgttatttaccagcgcaaaaacgctgggttcgctgattcaggttccacatgaagatgaagtggcgttaaaagggcttcttgatgagttgtatcgtctggctgtcgagggtgatatcccgcagaaagaagcggcggcggagctgattccgtatattcagcaggcgtggattttggcgcagcgttacgatgcggttgtggcgaacccgccatatatgggcgggaaagggatgaatggcgagctaaaagaatttgctaaaaaacaattcccggacagcaagtcagatttgtttgcgatgtttatgcagcatgcattttctttactcaaagagaatggtttcaatgcgcaagtgaatatgcagtcatggatgttcctgtcgagctatgaagcgcttcgcggttggctgctggataataaaacttttatcactatggcacatttaggggcgcgggcgtttgggcagatttctggagaagtggtccagactactgcatgggtgatgagtaataaccattttgaacgctaccagccggtatttttccgtttgattgaaggaaatgaggaactgaagaagacggttttgctcgagcgggaaaatcgatttgataatactctacaagaagactttaaaaaaataccaagcgcacctgttgcgtattggctaacaccatcaataatagatgttttttttagaggggaagctttgaggaatatatccattcctcgacagggaaatactacaacaaacaatgaaaaatttgttcgctcttggtttgaagttaattttgataaaattgggcttggatactcatcagcaaaagatttttcagagcataagaaaaaatggtgtccatacaataaaggtggtggttcgttaaaatggtatgggttgaatgaaagcattgttaactgggaagacggtggtgagcaaataaaagccataccacactcagtggtagcaaacgaaagtaactatttcaagcctggaataacattttctacggtctcaagctctggttatggatttcgtctatttgataatgggtttatctttgataacaaaggagcttcaattttcatcgatggagaaaagcgactttacctattagctatacttaattcgaaaatatttgaattaaccgttcattctattaccccaacaatttcactgcagccgggcgacgtcgctaagttacctgtaatcgagggtgatagcactcaaatggaaaaggttatatctctcagtaaagaagccgttatgaaatccaaacagagctgggatgataaagaattatcttgggattttaaaagaccaaattttatatctaatactgcattagatgaagtgctatctaactctataaataaatatattatctcatgtcaaaatcatgcggattgtatttccgatattgagaatgaaataaacattgagttaattaatatttatgacattagagaggatgttatatctaatgttgttagtggttctgattatattaatttaaccgcaatgattggggagctgatttcttacatcatcggctgccaaatgggccgctactctctcgatcgcgaaggtttagtctacgctcacgaaggcaacaaaggttttgccgaattagtcgccgaaggtgcttacaaaaccttcccagccgatgaagatggcatcctgccattaatggattccgactggttcgacgacgatgtcaccgctcgtgtaaaagagtttgtccaaaccgtatggggtgaagagcacctacaggaaaacctcgatttcattgccgaaagcctctgcttgtacgccatcaaaccgaaaaaaggcgaatcatcactcgataccattcgccgctatctttccacgcagttctggaaagatcatatgaagatgtacaagaagcgcccaatttactggctgttcagctccggtaaagagaaggcgtttgagtgtctggtctatctgcaccgctataatgacgccaccctgtcgcgtatgcgtaccgaatacgtggttccgctgctggcgcgctatcagggcaatatcgacctggttaacgatcagcttaagagtgctgaatcgggagctgccaccacgcgcctgaaaaaagagctggatgggtttaccaagaagttcaacgaactgcgcaattttgacgatcgcttgcgtcactatgctgatagacgtatcactattgatctggatgacggcgttaaggttaactacggcaaatttggcgatctactggcagatgtgaaggcgatcaccggtagcactccacaggaggcataa

SEQ ID NO: 2645 - DNA, 3516 bp, Marinobacter sp.
atggaaaccgcaaaactcaaaaagttcgcccagttcgcccgtcgcagcctgattgaacaggtcagcgccaaactcaaactggtgctggcggaagaaaaccccgcccggcgggagcgcccacaggtcattaaaaagctggaagaagcggttgcggagcagggcaaggagcaagtcatagaacgggttgcctatatttggttcaaccgattctgcgctctacgctttatggatgtgaaccgctataaccgccttggcatcgtttcacccgcagaagggcagtttcagcctgagattctggctgacgctaagatgggccagattgatgaagagatggtagcggaagcgatccggcgacgaatttttgcttttctggatggaaaaacgcccagccaagacccacaaggtgaagcctatcgcctgctggtggttgccgcctgtaactactggcacggtgccatgccgttcctgtttgaacgcatcgacgactacaccgaactattgatgccgggtgacctactttcgggcaactctattctcgcccacacccgtgaggccatgacgccagacgcctgtcaggatgtggaggtgatcggctggctgtaccagttctatatatctgagaggaaagataaggtttttgaagggctgaagaagaacactaagattacggccgaaaacatccccgcggctacccagctttttacgccacactggattgtgcgttatctggtggaaaactctctgggccgtctctggatgctcaaccggccgaattccaggctggtcgagcagatggattattacattaagccagcgcctgcggcggatggtagcgatcaaccggaaaccgacttcctgcgcataaataaaccggaagagatcaagatctgcgatccatcctgcggctcgggccatatgctgacctacgccttcgatttgctttatgccatctacgaagaggaaggatacgagcccactgatatcccgactaagatcctgactaacaatctatttggtatcgagatcgacgagcgcgccggggagctggcagcatttgcgctgattatgaaggcgcgggctaagcagcggcgttttttccgcaatccgatacagcctcatatctgcgtgctggaaaacgttcactttgatgaaggtgaactcaatgaatatatggatgtgatcgggcatgacttattcacgaacgagctgcgcgatacgctggaccagttcgagcaggccaagaacttcggctcgctgatcgtgccgaagctgagcgatccggcagagacgctgcggttggttgaagcgcgtgatttttccggtgatctgctgttgaacgacgtgcaggcgcgcgtggtggccgtgctgcgcatggccgaggccctctcaccgaagtatcatgtggtggtagccaacccgccgtatatgggcggcaaagggatgaatgggaagcttcaggacttcgccaaggaatgttgtcctgatagcaaatctgacctgtttgcgatgtttattgaacgtgggttcaaccttgtgccacgccttggctatagtgcgatggtcacaatgcagtcttggatgttcttgtcttcctatgaaaaacttcgtgtgaagttggcagaaaattcttcaattaacgccatgatccacatgggaaatatggtgatgggtattgcgttcggtacagctggaaccgtttggaagtcgcgaggaatggtgtcagacaagggagcattctgtttcgtcgactacgaagaccttgatggtgagggcaagccgcttgtatttccgccacataatgagcgcaactctgtcgctgcgaacgatggctggctttatcgcgcttcagcggaagattttgagaaaattccagcgagcccgattgcatactgggtaagtgatgaagttcgtgacattttctacgacaacaaagcgctcaaagaaataatcgcacctaaacagggaacctctactggtgatgacgaaacatacgttcgattttggcatgaagtggatgaaaccttaattgggtttaattattctacactcaccgcagcgctcaattcagaaaagagatattttcctttagataagggaggtgagtttagacgctggtatggcaacaacgagaaagttattaaacttggaagaaagtcctatcatgagttgcttgagctgggaaaccatcttccatcacgtgacaagtattttttaagtgggataacctggtccaaaattacatctttcaaaattagtgttcgctacgatgatgttggttttgttttcagctctgttggcttaaaaggatttccaactctgaaagatgaacatagatctatcgcatatatgaattcgaaacttgtttcagtttttactgagattctgtcgccaacattaagtattgttagcggcgacatcgaaaagttgccatataaatttgtatccgataaccttttacccacgaacacttcaaacctcattgcattggccaaatcagactgggatgcctatgaaacatcttgggatttcaccacactcccgctgctccaacccgactaccgcgccgagacgctggagctaacctacaccgccctgcacactcactggcagggcaagacaggcgacatgcagcggttggaggaagagaacaaccgcatcttcatcgacgcctacggtctgcaagatgaactgacccccgaagtgccgctggaagagatcactctcacttgcaaccccgcctatcgctacggcggcaaggcctcggttgcagaccgagagacccgtctgcgtgccgataccgtggccgagtttctgtcctacgccgtgggctgcatgttcggtcgctacgcgctagacaaaccggggctaatcctggccaaccagggcgataccatcgaggactatctgaagcagatcccggagccgagtttccctgctgatgacgacaatgtgattcctatgctcgacggcgactggttcaacgacgacatttccgaacgcttccgcgagtttcttcgaatcaccttcggcgaggagcactacgaagagaacctccgcttcgtagagcaggcgctgggcaaggatattcgcaagtacttcctgaaagatttctacaacgaccatgtgcggcgctacaagaaacgtcccatttactggctgttctcatcccccaagggctcgttcaatgcgttgatttatatgcaccgctaccgcccggatacagtcagcgtggtgctcaacgattacctgcgcgagttccgcaccaaactgacgtcccgccgggaccatctggaagcggtcagcatcagcgccagtgcctcttcggcggaaaagacaaaagcgataaaagacatcgaaaaaatcagcaagatcattgttgagctgggtgactacgagcgtgacgtgctttacccgctggctaccaggcaggtagaaatcgatctggatgacggtgtaaaagtgaattacccgaagtttggcgacgccctgaagaaaataaccggcctgtccggctag

SEQ ID NO: 2646 - DNA, 3666 bp, Escherichia coli; identical to SEQ ID NO: 2443

SEQ ID NO: 2647 - DNA, 2151 bp, Lactobacillus casei
gtgccgcgggatgattttgacgtggagaaggaggggcaggtcgagatcattgggtggttgtaccaatactataatgaagaaccccatgatcaagtggtgaacatcaatggcggaccggtaaaaactgatgacattcctgcagccacgcagttatttaccaccgactgggtcgtccgctacatggtggacaattcactgggtaagaaatatctggagcattatccagattcaccggttaaggggaaactcaagtacttactacctggcgacataacaccagatcagtcagactttgacatcaccagaattcaagtgatggataatgccatgggctcgggtcatattttggcctatgcgtttgatgtgctgatggccatgtacgaggatcaaggctatgccaaacgtgaagcagccaatagcatcatccagaacaacctatttggtctggaaattgaccaacgggccttccagctctcgtacttctcactgatgatgaaattgcgtcaatatgatcgtcaagcattgaatggtggtgtgatgcctaatatccatgtcttcgtcgctgctccgacagtaacggaagaattcttacatgccttgaaagcaagttcagaagtggttgacgagatcaaagacattgccgcccactttatggatgccaagacacttggctcgattattgagttgccagctaattatgactatgctggcatgcggaatgcgctagaaccagttgcgacagctcaaaagatcagcctctttggcaaccagcagacagcccagcaattgctggaaatcattgccactgcggaaacgatgacccaacgatacgatgttgtggtaaccaatccgccgtacttgaacaagatgaacagtaccctgaagaagtacgtgaagaagcactataaggattattctgcggatctgttctctgttttcatttggcacaatatcaatatgacgaaggttaacggctacgccggctatatgacgccttttgtctggatgttcatcaagagttatgaaaaattgcgtacagcactcctatccaatgtgaaaatcgacagcctaattcagcttgaatattcggcttttgaagaagcaacggtacccatcaacacttttgtcttgaagaacactaagaacgatgaaactggcacgtatttacgcttgtctgatttcacgggtggtatggaggtacaacgtcaaaaggtcacggcggcaatcgtagatccgtctgtaaactacctttatcgaactaaccaaacgaactttaataaaattcctggggaaaagatcgcctactgggcaacgacaacaatttattctgcataccaacatggcactctgcaaaaggttgccacaccacggttagggatggccacagctgacaacactcgcttcctgcgttactggtatgaaattgatagtcgagatatttgtttctctgctcaatcaagaaaggatgcagtagcaactaagaagaaatggttctcttatgaaaagggtggcgagtatcgaaaatggtatggcaataatcaatatgtggtaaattggaaaaatgatggctatcaaattcgtcattttgctggggaagagggcaaaattaggtctcacaactacaatctcgattatatattcaatcccggaataacgtggaatgcactgtcttctggatctttttcttctcgaattgttcttgagggacatctgtttgataacgcgggctcaatgatgtttctcaaaaatccgcaagatatttggtatctacaagggcttctttcaacaccggttgtggcccaattactaacactcttaaacccaacgatgaattatcagccaggaactttatctgaacttgcagttattaaagatgccaataaatacggtattatttcagacaaatcccacgcctgttaccaattgtcaaaagaagattgggcatatcaggaatccgtgccagacttttcgacattattccttcttgctcacatcgctgagcatacggtattggtaatttgccatatccatcggcgcatttcaaaaatccgcgtcacagctaagcatccattcaaaaagttggccacctggtggcataaaatacagaatgtgccaaaaaagtgccaagcatttggattaggaggacattaa

SEQ ID NO: 2648 - DNA, 3624 bp, Lactobacillus casei
atggataaaaagaagattcatgatttcgcggtgaaagcccgccgcgagctcatcgagagtgttgagttaaagctgacccaagtgggaatcaccagagacggtgtaaaagagaaactgccaacatcgacggctgagattgccttctatgtgccaaacgacacggaaggggtcagtgggcgggatacgtcgcgccgggtcagcttagttcagctgttgcagaccgcggcggccaaggatgattggcataccgcctatgataatctcgtggaagaagcgtcatacacctggttcaaccggatcatcgcattgcgattcatggaagtgaaccattatttgccaagccgggttgccgtgctttcttccgaagaaggacgggcagaaccggatattttggcgcatgcactggaaattgaagacgatcttggcggcttttctgatgagcagcgagatctcattcaacatgcgcaagaaactcaagagccagcggcgatggataatgcgtatcgactactgtttttgaagcaggccaacgccttgaacgccaatttaccccatttgtttgagaaaacaactgatgccttccaattattgttcactcccagctatcagaacggggtgattaaggagcttgtaactgaagtgccgcgggatgattttgatgtggagaaggaggggcaggtcgagatcattgggtggttgtaccaatactataatgaagaacccaaagacgttgcctttaagaaaagtaagtacgctgtgtcagacattccagccgttactcagttgttcactccagattggatcgtcaagtatctggttgaaaactcgctgggccgctattggatcgatgtgctccatacacgcggcaatcaacgttctgaacaggacattgcccagagtttcggttggcgctatttcatgcccgctgctcagcaaactgaggatgttcagcagcaactgttggcgatcaacagtcatctgtcagacaagaagcttcaacagatcaccttcttagatcctgccatgggttctggccacatcctgatctatgcattcgatgtcttcatgcagttatatcaaagcgaaggctattcagcacgagaagccgccaatagcatcgttaccaacaacctgtttggtctagacatcgatcggcgcgcctaccagctcgcctactttgcagtgatgatgaagctccggcaatacgaccggcgcgcactgactcagtccgttgaaccgcaactgtcggatattccgaaaactaatattctcaatgatgatctcaacgagttaaccagagcctatgctaatcagttgtcacagcaacaagccaagtcctttcagggcacagtgaaggagttcaaccggggcgatgttctcggttccttgatcaaacccatccttgaccaagaaatactgtctgaactccaagcaagtgcagccacagagccagaatcaacacagctttcctttgcgacgacaaatttcaattttgaagagatgtcccgcatcacccgtgtgcttactatcttggctgcccagtacacaatcgtagtaacaaatccaccctatatggggtctggcaaaatgacaccgagcctttcaaagtttgtcaaaagggaatacccggacagtaaagcagacttatttgctgtctttatggaattggcacagaagttgaatgtccagaatggatatcacgcactcattacccaacatcagtggatgtttctgtctagcttcgaaaagctgcgagttaagttgcgtaagaatgtactcgtcaatatggcccacttgggtacccatgcgtttgaagacattggcggtgaggtggtccaatccactgcatttgtgatgaaaaatgcctctataccgagttatgttgggacatacgagagattagtgagtgctccttctcagacggctaaagaggactcatatttagagatggtgaaggatcccacctgcaggggtctctatcgaactaaccaaacgaattttcaacaaatttcaggtaaccccatatcatactgggcaagtaccaaggactttcagaatttttataacttgccagcgctgtccagtctttcattggttaaaaagggaatgttcaccggaaataattcgatgtttattcgacaatggacagagataagttatccacggctgtgttttcaacttgaggctgttgcggaagttcccacaaacggatatgtcccgttaaataaaggcggcgcatacagaaaatggtatggaaatcatacagattgtatcagattcgattctgatgcgtacaatcgaatccagaaaaacggaggacatcgttcgccagatctgtatttccgtcccaatctgacttggacgaaaataacaagtggagccccttcgtttcgatattcaaagaagggctatattaacaacgatgcaagcatgatcgtatatcagcaaggcgcgatcacactatttcagatattgagtgtagtaaacagcaaaattgcgagtcactacctttcactcctaaacgaaagcatgaactacactgcaggagatattgctagaatacctttaacttcaaaaattccagaccgagctgttcaaatcgtccgtgaatgtatccaacaatcaactgatgattggaattcacaggaaatttcttggagttttttatgtgttccgtttttgtgcaacatcgctgagcataatcgaaattggactgtggaagcagctttcaatcagtggaaacaggaggcccaagatcgttttgatcaactgaagaagaacgaagaagaactgaacaagatctttattgatctgtacggtttgcaggacgaattgtcaccagaagagtccgacaaagaggtttccgtacgtaaagcagaccgtaaagcagacttaggacgggacatccgcgccttcatgtcctactttatcggagtcacatttggccggtactcgctagatacgccaggattggcatttgctggtggcgattgggatgcttcgaagtacacgagctatcaacccaatgcggatgatgtgattgtgctgactgactctgattattttggcgatgatcgagatatcatgcaccgcttccgggagtttttgacggttacttttggcaaagaacacttggaagagaatctcacgttcattgccaaggcactgggtaaagcgggcgacacagcagaagatcaaattcggagttatctgttcaacgacttctacaagaaccatctgactatctatcagaaacgaccgatctattggcaactggactccggtcggcaaggtggcttcaaagcattgatgtacctgcatcggtacgacggcgacacgatggcgatgattcgcacgtcgtatttacacaccctgcaggctgcttatgaaaagcgggtgaccacgttggacaccttcatcgcctcagagaccaacacgcgccagaagaaccagttgattaaacagcgggaccacacccgcaaacagttagaagaattggtgaagtatgacgctcaactccaacacgtcgccaacatgcatattgcgattgatctggatgacggcgtcgtggtgaaccaccagaaagtacaagcagacgtcaagctattgacgcccataaaatag

SEQ ID NO: 2649 - DNA, 3633 bp, Enterococcus faecium; identical to SEQ ID NO: 2445

SEQ ID NO: 2650 - DNA, 3762 bp, Glaciecola lipolytica
atgaaattagctgaccacgtagaccatttaagagagctgattgaagccgccttcgataagcaattttctagactgggttttagtaagaccaagcaaatggacgccatccaggtagaaaaactaccagaggaagttaaaaccaagcgcgagcgcttcgccgtgatgctggagaaccatatcggtgaaaccggtggctatgaaagtgcccgtgaaaagctactggatgaattaacgtttaccttattcaaccgtcttgctgccataaaggtgatggaggcagccagcttatttccgcccatattaacaaagcaaaaggagcatggtgatcgttcattcggccataaagcctggctagaaatgaatccgcacatgcgtgatgaagagctggaaggtattcgcgattatttaaaatcagcgtttgacgaacttggtcaaacgttgccgttgtatagcaaagcctacccttatgcgcttttacctgatgctattagtttaaatgatattattgacgcctttaatgtggttgatactgacgcgcaagctaatgactcatcagaagagaccatctggcaaagtgatgatgttctcggttggatgtacgaaagctacaataacgccaagaaaaaggcccacaaagacagcggtgataaaaccgaatataacaaggtatcactgcaatcacaggtgtatacgccgcgctgggtggtacaattcttggtcgaaaactctctgggtaaaatgtacctcgagatgtacccgcactctgagataaaacagcgttataaaattgccaacgcaccaacaacacaaatacgagcacctaagcctttacatgaagtgcgcaccattgatccagcttgcggctcgggcaactttttattgtatgcctttgacttctattacgagctttatctggaccaaattgaaaactatggtgcagactatgatgaaaaagacatccctaaactcatcattgaaaataacctgcatggcatagacttagacgatcgtgctatccagttagcacagcttggcttatttatcaaagctaagaaaaagcgccgtacagtcggcgagttgcatttcaaagtggtatcgtccgatttctatttgcctgagtatgcggcagtaaagcacatcttcgaacagggcaatttggtgtcggctcagcagcgggagtttatagagaaggtatggggtgatctcatgcaagcctataagtttggctcgctgattcatattgataaagagttaaaagaacagctatctcaagtaaaagaacgtgcgcttggtgaaacgtttgattcgacacaaaagttaaaaaagaaaattgttgaaggggatctcttcgcagcagcagactatgccgagcaccaagaattcgcagaaaacttctttgcaaacttattcgctgcggtagagcagtatgctcgaacagaacgcaatactttcttaagcggaaaaacgcgagatgcgattacattcttagagctgttaacctctgaatatgatctggcgactgctaatccgccgtacacggatagtgcggactttgggccagacctaaaagaattcatagaagacaactataaaaaacctcacaaatttaataccaacttatatgccacctttatcaagcgttgctgcgaacttacagataaggacggtaaggtcgccatggttcatccgccaacatttatgtatatcaagacattcgaagatgtccgaaagtatatgattgagaaaacgagcatcgatctattcgtggagtggggctatttaggaatgttccatcagtcagctcgagttgatgctgcgatgtatgtccttgataaaaataaacaagagaaagactcaacctttataaagttgaaccacatttatgaaggcaaacgttacaacgcttttgttgaggcctatgataatttgattgatggtgtagcttaccaaaataattacaccatcccacaatccaaactaaaaatcatcaaatcatggccatttatctattggatttccgatgattttaggcagaagtttaagagtgagtcagtaaaagatcttttgaaaaactgtcaagggttagcgacagcaaacaataatcgttttctaagattttggtgggagctttcttcgtcagattttaatattgatggtaatgattgggtttactacgccaaaggaggaccatataagaagtggtctggtaatttgtggctaatggtcaactggaaatcaagtgggcaggatgtaaaaaattatactgatgataaaggaaaacaaaaatctaggcctcaaaatgaagctgtttactttaaagaaggtataacatattcagcatctggttctaagggcccctcttacagaatattgccaaaaggatgtatttttgatgttggtggtagttcaatatttcccattaagaaatacaaaaacactcactacatattggcattttttaattctgtactttcgaattatataattgagtgtctaaatcctacagtgaacaagcaggtcggtgacattgaacgaattccattcgtaatcccagataaaactcaagaaaccctgatagagtttttatcacaaagaaatgtttcaatatcgagggaaatacgagcaactgaattgtttgatggagaatacgataagagcccgttgttgtcatttcatagcggagactggagatcggcgattactagtttactaaatcgtgaaaatcattttagaactcagatcctcattaatgaggccattattaatgagacgatctttgaaatctataacctaactgagcatgataaagcgatggtgcttgccaaagaaggtgtaagcatcggtggtctgccggttacctccgaagcccgaaaagattatctggcagaaacggaggcgacaaaaacatttccactggacgctactcgtgagtttatcgaagcgctacctatcaaagagtttagagtcgaagaacgtgaagccattgaaagtggatttggaagcctttaccagagcaacaacgatctagaggagttctgcatccgacatcaggtcaacccgattaacgtttggtattggttcaaacaaagcaaagtaatccctaagcaacgtatgcaaactttagccatggaatttttggctgatatggttcgtgaaattctaatggaagatgaagatggcattatcccgctagtgcctaatgccggtgagaaagtgcttcttgatcgtatcgaggagaagtttctcgaaaaagggtttagtactgctcaatactcaagctttgattctgttttagggcggcaaatccatgactacctaaacaaatatttctttgcagagctgtcagatcacttaaatctgtttatgtatttgcccaaaaccccatttatctggcacttaaccagtggcccagagcaaggcttcgattgctatatcatcatatacaaatggaatcgcgataacttgctgcgcttacgctcggtatatatcgaaaaccgtgaacgcgctttgcaaaaccgccagagtgatattgctggcaatgaaagcgctgaagcgcaaaacgagaaagagcgtatctttaagcaattgaaagaaatcgacgcctttaaaaagaaaatcgacgaactattggctgaaggttacaacccgattcttgatgatggtgtaggcaaaaatattgcgcctttacagaaaaagaaaatactggcttatgacgtattgaatgcaggccagctaaaaaaatacttgaacgctgattggtaa

SEQ ID NO: 2651 - DNA, 1008 bp, Oribacterium sp.
atggggaaactaatttctaataaatatgcagcgtggaagcaggaatgcgaagaccgcttccagcagctcaaagccaatgaagaagaactcaaccgtatcttcatcgacatttacggtttgcagaacgagctaacaccggaggtggcggataaggacgtcaccgtgcatcgtgtgtttgacagtaaggaaaatatgccggagtctatgaagggtagcaactatgtccgcaccatgcgtgacgagatcgtctccctcatctcctatgcagttggctgtatgtttggccgatactcgctggatgtggaaggattggcctatgcaggcggtgagtgggatagtagcaaatatcagagctttatccctgatgccgacaatgtcatccccatcacggatgaagaatatctggacgatgatatcgtatcgcgcctgtgtgactggctgaaggtggtgtatggtgctgatacgctggaagcaaacttcgattatatcgcaaaagcccttggcaataagggcagcaccagccgggagatcatccgcaactactttttgaacgatttctttaaggatcactgccagacctattctgtcaccggctccggcaaacgtccgatctactggctgtttgatagtggcaagcagaatggcttcaaggcactggtctatctgcaccactacacgccagatactatcggtaacctgcgtgtagactatcttcataagatgcagcgtatctatgagagtgaaatcaaccgtatgcaggatatgattgatcatagtacaaattctcgtgaagtagcagccgctaccaagcgaaaagaaaaactccaaaagcagttaaaagaatgccgtgaatatgatgagaagattggacacttagcactgagccgtatcgaattggatctggatgatggagtgaagaaaaactatcgaaaagtccagacagcaagtgatggcaagttctacgaggtccttgcagattctaataatatcatggcaaaggaaaaataa

SEQ ID NO: 2652 - DNA, 2667 bp, Oribacterium sp.
atgaataaatcatccatcaaaaactttgcgatctgggctagaaataagctcattgcagatatcagttaccgtgcaggattgataggtattacggcagatggtattaaaaatgctctgcctcagtccataggtacaactgaattttatgatattggaaccgcagaaccttattccatcagtggagatgcggtgaagcagagaagaaaactggtagaggtgatccgacaaaaggaaaaggataccgactatcagactgcttataaatatatcattgaagaggttgcctatacctggttcaaccgcctgattgcgatccgtttcatggaagtaaatgattatcttccttcccacatgcgtgttctttcttcggatacagggaaattggaaccggatattgtcacaaatccttttgatgctgagttggattttacaggagacgaagagcatatcatcatgcagttgaaaaatgataatcagctggatgatcttttccgtatgcttttcatcaagcagtgtaattcgctaaatgcgttgttgccggcgctgtttgaaaagacacaggattatacagaaatacttctgaatctctcagttattgatcaggaaggtgttgtctacaagcttgttcacgatattgacgaggatgacttcaatattgaaaaaggtggccaggtggagatcatcggttggctttaccagtactacaacacggaaccgaaagccgctgcctttgccaaaaacggcaagattaccaaagaggaaatccctgccgtaactcagctgttcaccccgaactggattgttcgctacatggtggagaacagcttggggcgcctgtggttggaaggacacccggactgcggcctgaaagaaaactggaaatactatctggaagaggcagagcaggagccggaagtgcagaagaagcttgcggagattagacgggaatattctgtccttaacccggaagatatcaagatgatcgacctatgtatgggttctggccatatcctcgtatacgcctttgatgtgttgatgcagatttacgagagtgcaggttacagccagcgtgatgctacaaagagcatactggaacacaatatctacggtctagatattgacgaccgcgcctatcagctggcgtacttcgccgtgatgatgaaggcgcggcagtacaaccgccgtatcttaaacggtgagaacagctgccatgtctataccattcaggagagcaacggcatcaatcgtgcgcacctaaaatttttcggtgcggagatggatgatatcgagaagaacgccgccaagatgcagctggaaggcttgctggacaactttactgatgccaaggaatacggctccatcctgaatgtggagagctacaactgggatttgttgcgccgatttgtggcagcggaagatactgccggtcagatcagtatggatagcgttggcgtagaagataccgccgaacagctgaaccggctcattgatattggcgagatgatggcgcggaagtattggataactgttacgaatccgccgtatgcccgaatcagcaatctgagcgcaaaggtcaacaattttgtaaagaagaattatccggacagcaaagctgatttgtttgctgtgtttattgagcgttgccgtcagatgactgctgacaatggctatcaggcaatgattacccagcatagttggatgttcctgtccagctttgaaaagttgcgggaaaagatgatgctcaccgaaaccgtcaacatggcacatctcggcgcaagagcctttgaagaaattggcggcgaagtggtgcagactaccgcttttgtacgttgcgcaaaccatattgacggctacaaaggcacctattgccgtctgattgatccgacctctcaacaagggaaagaagatatgttccttgcggggaagaatcgctatgtagccatccagtctaactttgccaaaattccgagcagcccggtggcatattgggtgtccagagaactgtttgattgttttgatggaaaaactatttctcaaattggaacattggcacaggggttaatcacaggagatgtcaatcgattcacgcggttttggtatgaagtcaatattcaatcttttattggctctgcaactaaaacatctgatgttattgaacttaaaagaaagtgggtcccatataataagggcggtgcatatcgaaaatggcgtggaaatgatgaatatattgttaactgggcaaatgacggatttgaaattaagcattttgtagacgatgaaggaaaactaagatctcgtccccagggcgtagatcactatttcaaggaagtaattacatggtccaaaattaccagcgcaaaaatatcttttcgattcaaaccgcatgggcaaatatcatcagaagccggaatgaccataattgtccctcagaaatatgaagcctatattctctcgttctgtaactcatgtgttgctgagagtatattaaaaatagtgtctccaactcttaattgtgaacttggagatattggatgtctgcctgtacatattgtggatgaccaattacctcaaattgataaatgtgtattaggctgtgaaaccatttctaagagcgattgggattcctatgaaacctcgttggatttcaagcggaacccgctggtttag

SEQ ID NO: 2653 - DNA, 3741 bp, Vibrio cholerae; identical to SEQ ID NO: 2398

SEQ ID NO: 2654 - DNA, 1593 bp, Escherichia coli; identical to SEQ ID NO: 2464

SEQ ID NO: 2655 - DNA, 1905 bp, Escherichia coli; identical to SEQ ID NO: 2465

SEQ ID NO: 2656 - DNA, 804 bp, Escherichia coli; identical to SEQ ID NO: 2457

SEQ ID NO: 2657 - DNA, 2082 bp, Escherichia coli
gtgatccagaagctaacgacgcttgggatcgctgcagataaaaaaggcaatctgcagattgccgaggccgaaaccattggcgagaccgtgcgttacggtcagtttgattatccgttatcgacccttccccgccgcgaacggctggtaaaacgcgcccgtgagcagggttttgaggtgctggttgagcactgcgcctacacctggtttaaccgcttatgtgcaattcgctatatggagctacacggttatcttgagcacggcttccgtatgttgtcccacccggagacgccgaccgcgtttgaggtgctggatcatgtgccggaagtggcagaagccctgctgccggaaagtaaagcgcagctggttgagatgaagctttccggtaatcaggatgaagctctgtaccgcgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcggaaaagaaagatgccgtgattggcaaagtggtgaagagcgaagatattcctgccgccacccagctgtttacgccaaactggattgtgcagtatctggtgcagaactccgttggccgccagtggttgcagacctacccggactcgccgctgaaagacaaaatggagtactacatcgagcctgcggaacaaacgccggaagtgcaggcgcagctggcggcgattaccccagccagcattgaacccgaaagcattaaagtgctcgacccggcctgcggttccggtcatattttgattgaagcctataatgtgctgaaaaatatctacgaagagcgtggttatcgcgggcgtgatattccacaactgattctggaaaataatatttttggtcttgatatcgacgatcgggcagcacaactttccggttttgcattattaatgatggcgcgtcaggatgaccgcagaatatttacccgcgatgtacgtctgaatattgtctctttgcaggaaagtctgcatctggatatcgccaaactctggcagcagctcaatttccaccagcaggtacaaaccggcagtatgggggatatgtttgctgaaaataccgcgttaacccaaaccgacagcgcagaatatcagctgctaatgcgctcgttgaaacgctttgtgaatgcaaaaacgctgggctcactgattcaggtaccgcaggaagaagaagcggaactgaaggcgtttctcgatgcactgtatcaactggaacaggaaggcgatttccaacagaaagcggcagcgaaggcgtttattccgtttattcagcaggcgtggattctggcgcagcgatatgatgcggtggtggcgaatccgccgtatatggggggaaaatacttagctccggcggttaaaaatcatctgaaagaaaattattctggatatgataaagatctattttcagcctttattataagaaatttacaactttccaaaaatggtgcacaacttgggttcatgacgccatttgtctggatgtttatttcaagctatgaagaactacgtctccaactaattaataatgaaacaatcatttcattaatacagttagagtactcaggttttgatggtgccaccgttcctatttgtactttcacattgcaaaaaaatcatatttcaaatttttcaggtagttatattcgactttctgattttcgcggagcggcaaatcagggaccacgagcacttgaagcaataaataataaagattgttcttggcgctatcaaaccaatcaagaaagcttcaaaaaaatacctagcaatcctattgtatattggataaaaccccaaacctcaatcctttttacaaataaaaaattggtgaactctatgaggttaaagaaggtcttggtacacgtgatgatgatatatttttgcgtagacactgggaagtatcaagaaaaaaaacaaaaactgacaagagtttaa

SEQ ID NO: 2658 - DNA, 3756 bp, Vibrio cholerae
atgaaattagctgaccacgtagaccatttaagagagctgattgaagccgccttcgataagcaatttgctagactgggttttagcaagactaagcaaatggacgccacccaggtagaaaaactaccagaggaagttaaagctaagcgtgagcgcttcgccgtgatgctggataatcatattggtgaaaccggtggctatgaaagtgcccgtgaaaagctactggatgaattaacgtttaccttattcaaccgccttgccgccataaaagtgatggaggcagccagcttatttccgcccatcttaacaaagcaaaaggagcatggtgatcgttcattcggccataaagcttggttagaaatgaatccgcacatgcgtgatgaagagctggaaggtattcgcgaatatttgaaatcagcgtttgacgaacttggtcaaacgttgccactgtatagcaaaacttacccttatgcgcttttacctgatgccataagcttaaacgatattattgacgcctttaatgcggttgatactgacgcgcaagctaatgaatcatcagaagagactatttggcaaagtgatgatgttcttggttggatgtacgaaagctacaacaacaagaaaaaggcagaattcaaagacgaacagaaaaataacaaagcaaaaaccgaatacaacaaggtatcactgcaatcgcaggtgtacacgccacgttgggtggtgcagttcttggtagaaaactcactgggtaaaatgtacctcgagatgtacccgtactctgagattaaacagcgctataaaattgccaatgcaccaacaacgcaaatacgatcacctaagtctttacatgaagtgcgcactattgatccagcttgtggttcgggcaactttttattgtatgcctttgacttctattatgagttgtatcttgaccaaattgaaaattatggtgcagcctatgatgaaaaagacatccctaaactcatcattgaaaataacctgcatggcatagacttagacgatcgcgctatccagttagcacagcttggcttatttatcaaagccaagaaaaagcgccgtacagtcggcgagttgcatttcaaagtggtatcgtccgatttctatctgcctgagtatgaagcagtaaaacacatcttcgaacagggcaatttggtgtcagctcagcaacgggagtttatagagaaagtatgggctgatctaatgcaagcctataagtttggctcgctgattcatattgataaagagttaaaggaacagctatctcaggttaaagagcttgcccttggtgaaacatttgattcgacgcaaaagttaaaaaagaaaattgttgaaggggatctttttgcagcggcagactatgccgagcaccaagaatttgcagaaaacttctttgcaaacttatttgctgcggtggagcaatatactcgaacagagcgcaatactttcttaagtggcaaaacgcgtgatgcaattacattcttagagctgttaaccactgaatacgatgtagcaaccgctaatccgccgtacacagacagtgcggactttgggccagacctgaagcaatttatcgaagacaactataaaaaaccatataaatttaacaccaacttatacgccacctttatcaagcgttgctgcgaacttacagataaggacggtaaggtcgccatggttcatccgccaacatttatgtatatcaagacattcgaagatgtccgaaaatatatgattgagaaaacgagcatcgatctattcgtggagtggggctatttgggaatgttccatcagtcagctcgagttgatgccgcgatgtatgtccttgataaaaataaacaagagaaagactcaacctttatcaagttgaaccacatttatgaaggtaaacgttacaacgcttttgttgaggcatatgataatttgatcaatggtgtagcttaccataataattacaccatcccgcaatcgaagctgaagatcatcaaatcttggccatttatttactggatctccgatgagtttcgtgaaaaatttgagcatagtagcttcgatgatacggcgatggttgtttcaggggtaaaaactggcgataacgatagattgttaagattttggtgggaagttgacccttctgatatttcagttgcctatttggaagacaagaaaacatgggtgccatactcaaaaggtggcgacttcaataaatggtttggtaatatttggttgtgtgttaattataaaaatgacggacaggaaataaagaagagcaaaaactataaccttttactgccaagtaaatcttttaaaaaaggaattacatattctgctacatcaaccaaaggcgtttctttcaggcttttagaagagcattgtctctttgatatgaaaggttcgtcaattattttcgccgactcaactaaaacagaatatggtcttgccttattaaattcgaaacttagctcatacattgctaactgtttaaatggtaccgtagaaacgcaagtgggcgatataaagcgcataccttatgcggaaaaaaataaaaataagatagagaagctgtcaactgacagcatcaatattaagaagcatctacaacaatattcgctggttgagtatttatttaaagctagtccactcgatatttacgcaagagacttagattataaaaattcaatattttcctacctaatctatgaaaatcacttgttagcacaggttctaatcaacgaagctatcatgaatgagttgatctttcaggtttataatctaacagagcaagacaaacttatggtgctggcaaaagaaggtcaaagtataggaagccttccagtttcgaacgaagcgagagatgcctttctggcggaagaagctaccatagagtttcctatggatacgattcgagattttgtagggtcacttcaaaccagagagttttctgacgaagagcgagagttggttgaaagtgaattcttaaacctttaccaagacaataacgatttggaagcgttttgtattcgacatcagatcaatccaataaatgtttgttattggtttaagcagagcaataaaattcctcttcagcggatgcgtaagctggctatggagtttcttgcaaacatgatacgcgaaattctaactgaagatgaagatggaatcattccgctggtacctaatgctggtgagaaagtcctgcttgatcgcatcgaagaaaagtttttagaaaaaggctttagttctgctcaatattcgagctttgacacgctaattagtcgtcccatacatgagtacctgaacagaagtttttttacggaactatctaatcacttgaatatgttcccgaacctaccaaaaactccattcatttggcacttaaccagcggccctgaacaaggcttcgattgctatatcatcatatacaaatggaatcgcgataacttactgcgtttacgctcggtatatatcgaaaaccgtgagcgcgctttgcaaaaccgccagagtgatattgccggtaatgagagtgcggaagcgcaaaacgagaaagagcgtatctttaagcaattaaaggaaatcgacgcttttaaaaagaaaatcgacgaactattggctgaaggttacaacccgattcttgatgatggtgtaggcaaaaatattgcgcctttacagaaaaagaaaatgctggcttatgacgtgttgaacgcgggtcagctgaaaaaatacttgaacgccgattggtaa

SEQ ID NO: 2659 - DNA, 1767 bp, Methanoplanus limicola
atgacatctgaaaataaaataatagcagaatcggaatccaaatccagatccagcaaccctgtcccgaacttctaccgggcctctgccgaggatttcaggaaaattcccgggagtcccattgcatactctttgagcaataatattagaaatattttttgtgcaaaaccaccattagggaatatcgttccaacaagggtaggtctgatgacttcggataatgacaaattcatgagatttttttgggaagtcaccttaaattcaatctgttttaatgcactaaataaagaagaggtatttagaagtaaaaaaaagtgggttccacataataaaggagggcaatttcgtaaatggtcaggcaaccaagaatatttattgtcatatgataaaaaaagcagagaccttttaaaaagaattggtaaccacttaccttctgaaaaattatatttcaaaccagcagtatcttggtcagaaataacctcaagtagtacagcttttagatattaccccaatggttttactttcaatattaaaggcatgtgtgcatttcctgacttaaaatgtacaattgagcaaatattagtattaggtaattgtaaattcacaaatcatatcatcaaaattataaatcctacaattagttttggagcaggtaactttaattctctaccatcagcgtttattgaaaatagcaaaattgaagaaaatgcccaatccttaatttgttatgcaaaaaacgactgggactcctatgaaacgtcatgggactttgaaaatttgcctttgctcagagcggaatttaagtgtctgactgttgaggaatcttattcgcgggttcgtgcacactggcaggagatgactgatgagatgcagaaacttgaggaggagaataacaggatttttattgaggcatatggtcttgaggatgaactgactccggatgttcctctgtctgagattacgttaacctgcaatccatactacaggtacaaaggagataagtctgaagaagaacttgaggcactgctgcttgctgatacgatgaaggaactcatatcatatgcagtcgggtgcatgttcgggcggtattctgtcgataagccgggccttattcttgcaaatcagggagaggccataaaggattatcttgaaaaagtccctgtgccgtcattcatgccggatgatgacaatatcatccctgttctggatgatgaatacttcacagatgacattgtgacaaggtttaaggaattcttaaaagttgcattcggaccggaaaatctgtcacagaattttgatttcattgccggaggactgtccggaaagggcagtcttaatcaggctcatggctccggttcaggatcagcatcatctgagagtgttatccggaattacttcatcaaagacttttacagagaccatctcaaaagatacaaaaagaggccgatatactggatgttctcatccggaaagagtcagggattcaatgccctcatttacatgcacagatatgataaatccactctggcaaagatgaggacagactatctccttgaacttgaatcaaaactgatttcagagagaggaatgctttcagatacttcagcaggcaataagaagagaatagataagataaataaacagattgctgaaataaaagaatatgacgaactcctgaacaacagggcactggcaatgattgaaattgaccttgatgacggggttgcagtaaactacgccggatttgaaggactggtacagaagatctga

SEQ ID NO: 2660 - DNA, 1836 bp, Methanoplanus limicola
atggataaagctaaggtactggcattttccggaacactccggaatagtcttttagaggagactaagaagcgtgccgcccattttggcatttttccgggtgagacgttagaggttgagagggagtttgaggattcggttataatcggcgggaagatcttcagtgtaaagattaaaaagcagagggaagttttagtcagggagatcaggcagaagggctatatgcaggttattgaggagatcacttatatctggtttaaccgttttgttgccatccggtttatggaggcgaacgggtatatgcctgtcagggttttttcttcaaaggatgaggggaggaatgaaccggaaattttaacgaaggccctcaatcttaaatttctgcaccttgaccgggattatgtgctggatctgaagtctgaaggtgaggatgaggagttatacaggtatctgataatgaggctgtgtaattacctgcatattacaatgccctttatgtttgagaatattgaggattattctgagcttctgtttcctgaaaggctgcttcataccgattccctgcttggctgcctgaatgatatcatcagtgaggatgactggagggaggctgagatcatcggctggatttatcaggattatattgctgataagaaggatgagctgatgaaggcgaagaaggcttatgcaccgaatcagattccggctgtgacacagctttttactccgaagtggattgtgcagtacctggttgagaattcgcttggccgcctctggatgcttaaccgtccggattcagggctttgtgaagagatggagtattatattattccggaggagaaggagaaggattttctccggatcttttctccggaggagattaaggtctgtgatccggcctgtggttcggggcatatgctggtgtatgcctttgatcttctctgctccatatatgaggaggagggttactcagagtctgaaattccggagattatcctgaagaataatctctatggcattgagattgacgggcgtgcaggttctcttgcggcttttgccctggttatgaaggcaaggaagaggaataagaagttctttgacagcccggttcagccaaatatctgtgtccttgaaaatattgagtttgatgatgaagagcttaaagattatatggcttcagtgggaaacaatctcttctccaccggactaaaagagactcttcttcagtttaaggagactgacaatttcggatcactcatccgcccggctgcaacgggaacagatccctctgaaacactccggatgcttaaggagaagaatctctcatcctctcttactctgtttgccacccataaaaaggtcaaaagagcacttgagcaggctgattatctgagccggaagtatcatgtggttgttgccaatccgccatatatgggcaataagggcatgaatagcgacctaaaaaagtttgcaaaggacaattatccggagagcaaatcagatctctttgccatgtttattgaacggaatcttgatctctccgtgaagaaagggcttattgctatgattaccatgcagagctggatgtttttatcgtcatatgaaaaactgcgggacagaattttagacaatgaaactatccttactatggcgcatctcggtccgagagcttttgacagtattggcggagaagtagtttcaacaactgcatttgtcattgagaataatcataagccggattataaaggtgcatacatacggcttgttgatggcagaaatgaagacgagaaaaaaagatctcttcgtgaggcagttgttcagtccgggaaaataatttag

SEQ ID NO: 2661 - DNA, 3339 bp, Methanoplanus limicola
atgactgttcttactgatactgagaggaagggccttgaaaagtctgttcttgatgcccacaggaaggctgaagccggtgctgttaatgccctgaattatcttggcgttgaagcggataagaagccttttcatctgagtgatgctgaggcagagcttagaaggagattgcgttctgagatgaggaggcttgggagttatgatgtccttatctcttcggttgcctatgagcagtggcacaggatgctttttgcccgttttctgcttgaaaatgatctgctgattcatccgaaatttaaggttcctgtctctttttctgatataactgagattgcggatgagaaaggaagtgaggcctgggaggttgcagcggaatttgcttctcatatgctgcccggaattttcaggcaggatgacccttttctgatggttaagtttagtcctgaggacaggatttcacttcagggtgtgcttgacggtatttcatctgagagttttatggctgaggatgcacttggctggacttatcagttctggcagagtgagaagaaaaaggaggtcaatgattcggagaggaagatcgaaggttatgacatctgtgctgtgactcagctttttactgagccgtatatggttaagtttctgcttgagaatactcttggtgcatggtggctttctttgcatccggattcaggtcttaagtctgagtgggagttttacaggtctgaggttgagcatgacttttccgggtggccaagtgatattgatgagttaaaggtccttgatccatgctgtggttcggggcattttttagtccgggcttttcatatgcttctttctatgaggagggagaagggcgaggaggacgaggcggctatttctgcgataatttcaaagaatcttcacgggcttgagcttgacccccgctgtatccagattgcaacctttgcccttgcccttgaggcatggaaggagggtttttccccgactgattcctatctgcctgttccaaatcttgcctgcaccggaattccgattaaggctgagaaggaggactggcttaagcttgccggcggtgacggtatgcttgagtctgcccttgagaactattatgagttatttaagaacgccgattctttaggcagtctaatccagcttgacaccagtcaaaataacaaatccggcaaaaccggtaaatcaggaaagcacaacatttcagacaaatccggcaaaaagttcagttccggaacagataactcctttacccagagccttatcgatcaggataccctgatggaaaaacttgagcaggctttaaagaaagaaacagcagccggagatcccgttgcagaaaccttcggagaaaccgccaacgccatcatgaaggctgcccatctcctaaactccagatacgactatgttgtgacgaatgttccttatcttgcaagaggaaaacagagtgaaataataagaaatttctgtgatttaaattatcccctttccaaaatagacatatctactgtatttttagaaaggtgtttatcattagtaaaaaagagaggaagagttagtatcgtacttcctcagaattggctgtttttaacaaggtacagaaaattcagagaaaatctattgaaaaatgagatttgtgagatgatcggcaagcttggttcaggggcttttgaaacaatatctggtgaaattgtgaaagcaattctcataaatctgatacacatttctcctcctaaggatcagatattgtttggatttgatgtgtctaataaaatttgtgcttctgataaagcagcttctctgatttcagaaaatattatgcatattgaacaggcaaaacagttggaaaatcctgattcaagaattgtattgtgtgaaaaatctacaactggtaaattactttctgaatatgcagaatcctattctggattgtttaatggtgattctccccattttttgaagtttttttgggaaatatatcaattaaatgaattgtggtgctttcagcaaacaacagtaaataaaaatgtaacatttggtggattaaatttgataatttatttcaattttgctgaaggtcatcttagggaagaagcatggattcgaagagaaaaattacatgatagtgacaaaaggggaaataaagtatggggaaagattggcattacaataagccaaatgaataaattaccaatttcgctatatattggtacaactttcgattcgaatagtgcagtaatttgcccatttaatcaagatcttgttttgcctatttggacatattgtcagacagaagattattataatgaggttcggaaaatcgatcaggctttaaaagttaccaatcagacacttgccaaagtccccttcgatcttgaatactggcagaaggtggctgctgaaaagtatccggatggacttcctgaaccatattcagatgatcctacacagtggctgtttcacgggcatccaaaaccgtcagaaagtccgcttcatgtggcagttgcacggctgcttggttacagatggccggctgaaaccgatactgagatggaactctcctctgaggcacgggactggataaaagagagtgagaagcttctatcgtttgcagatgatgacgggattgtctgtattccttctgtccgtggtgaagggcggatggatgagagggtacgtgaagtgcttaaggctgcttttggcagtgaatggtctgcgaggcatgaagagaagatgcttgctgaccttggttatgtaaagaaggacggcagtctgaaaggagaccttgagaagttcctccgggatgagttctttaaatcacactgtaagttattccataaccgtccgtttatctggcatatctgggacggggagaaggacggtttttctgttcttgtcaattatcataagcttgatcgccggaatcttgagcggcttatatattcatatcttggcccctggatttcacagcaggagagggagaaggcagacaataaagccggtgctgaaaagaggcttgttgcagccaaagagcttaagagaagacttgagcttattcttgaaggtgaggctccttatgatatttacgtccggtggaagcctctgcatgagcaggctgtcggctgggagccggacattaatgacggagtgaggcttaatatccggccttttgtcgaagctgaagttttgaggtccaaaattactgcgattaagtggggcaaggacaggggtaaagatgcagtgcctaactgttccggaacggtagaaaggcataacgatctgcactttactcttgaggagaagaggaaagcgagaaaagaggcagagtga

SEQ ID NO: 2662 - DNA, 3741 bp, Vibrio cholerae; identical to SEQ ID NO: 2398

SEQ ID NO: 2663 - DNA, 3675 bp, Escherichia coli; identical to SEQ ID NO: 2305

SEQ ID NO: 2664 - DNA, 3741 bp, Vibrio cholerae; identical to SEQ ID NO: 2398

SEQ ID NO: 2665 - DNA, 3741 bp, Vibrio cholerae; identical to SEQ ID NO: 2398

SEQ ID NO: 2666 - DNA, 3540 bp, Bacillus cereus
atgaataaaactgcaatcaaaaactttgcagtatcagctcgtatgaaattaattgacgctgtaaagcaaaaagcgtatgagcttggtattacagaaactgaaattaaagaaccagaaacatatgaagatggcttccgaattaataataaattctttagaagttatgaattagaacaacgtaaaaaactaattcagaaaatcgaagaaaaagactataaacaagtaattgaagaagtttcctacacgtggtttaaccgttttattgctattcgtttcatggaagtaaatgaatatttgccaacaggtgtacgagttctttcctcaacacaagaggggaaaaacgaaccagatgtaattggtgaagtaacgaatattgctgaagatttagacttaaacttagacatcgtgtatcgattgcaagatgaaaacaaaactgaagatttatttaaatatattttaattaaacaatgtaacaaactcggtgaaattatgccgatgatgtttgaaacaattcaagattatacggaattattactaccagataatttacttggggaaggatcagttgtacgtaatttagtttcgatgattgacgaagaagactggaaagaacaagttgagattattggatggttatatcaatactatatttctgagaagaaagatgaagtatttgctgatttgaagaaaaataaaaaaatcacaaaagaaaacattccagctgcaacacagctctttacaccaaaatggatcgtaaaatacatggtggaaaattcattaggacgcttatggcttgaatctcatccaaatgaagatgtacaacagcaatggaaatattacttagaagaagcagagcaggaacccaatgtacaagagcaactagaaaaattgaaaaataatgaactaagcccagaagatattacagtattagatccgtgtatggggtcaggtcatattcttgtttatgcatttgatgtattatataacatttatcaacatgcaggttactctgagcgagaaattccgcaattaattttagagaagaacttatatggactcgatattgatgatcgtgcagcacagcttgcttattttgcgttaatgatgaaggcgcgtagttataaccgccgtattttccgtaggccgcttgaattaaatgtatgttctattcaggaaagtaatgggatcccacaagaggcgattgattattttgtgggagattcgttggatagggatgagataacgtacttaattagagtttttgaagattcgaaagaatatggctctattcttgaagtgttatcaattgattttgtatcaatagaaaaaagaatgatagagattcaagaaatgcaagaggttaaggatattttttctcttcaatatagtgatattttacttattaaaatacctcagttaattaaacaagcaaaaataatgagcagtaagtaccatgtagttctaacgaatccaccgtatatgggcagtaaaggtatgaatgaacaacttaaaaagtattgtacaaaattctttaaaaaaggtaaaagagatttatttgctgttcttatgttaaaatgttttaatttcacaaaagaaggcggatatatttcgaacatcaatcaacagtcgtggatgtttttatctagttatgaagaaattagaaagtatttcttatctgaaagtactatatgctctatgattcatttgggatctggcagttttgaagaaataaatggcgaggtagttcaatcgacatcatttgtattaaaaaaacaggtggttaaaaattatcaaactccatttattaggcttgtagaatataatgattctcaagaaaaaaaactatcttttcttgagaaaaaagaaaggtatatagtagcggcagatttatttttaaatgtgccaggatatcaaattgcatattgggctacgcaaaaaatgttagttgcattttctgaaaataaagttttaggtgatttatacgatcctagacaaggattggcaacaggagataacgatagatttttacgtttatggcatgaagtagataaggtacgtataaattggggtgctttatcaatctcagatgctcacgaaagtaaaataaagtggtttccacacaataagggggggagatttaggaaatggtatgggaataatgaatatttaatttctttcaacatagaaagttacaataccttagcgaaacaaggtaattgtcttccttctaaacaactatattttaaaagtggtattacttggtctagaactactagtaatttattgggggtaagattgcacaatcaaggaacaatatttgattgtgaaggttgttttttaagtgctgggaataccagagatgattattatttaatggcattcttaaatagtaacgtagcatttgtttttttagaaaaaatcaatccaactttgcattttcaagtaggtgatgttcggaaaattccattgatgacatttaataatttattggaagctaaaatggacttaatcacaagttgtataagtatttcgaaaagagattgggatagttttgaaacttcttggggattcattcgtcaccctatgcttactcataaaaatagttctcgaaggttatcagaagtattagattattggagcgtattcgctgaacaacaatttaatcaattaaaagcaaatgaggaagaattaaatcgtatttttattgaaatctatgatctacaggatgatttaacaccagaagtaaaagaaaaagacatagtcattcggaaagcagacaaagaacgcgacatcaaatcctttatctcctacgccgtaggctgtatgcttggtcgatattcactagaccaagaaggactagtatttgctggtggtgagtttgacgagagtaaatataaaacatttaaagcagatacggataatatcattccaattacggatgatgagtattttgaagacgatattgtaagtcgctttattgaatttgttcgtgttacgtttagtgaagagacgctagaagagaatcttgattttattgcagaagcattaaataagaaggcgaatgaaacatctcgtcaatgtattcgtcgttatttcttgaaagatttctttaaggatcatgtgaagatgtatcaaaaacgtccaatttattggttgtttgatagtggtaaaaatgatgggtttaaagctctcgtttatatgcatcgttatgatgttggtacagttgcggaggttcgtactgattatcttcatacgcttcaacgtaagtatgaagcggaaattgcacgtcgtgatgtattacttgagtctgatgcttcaacaaaggataagacgcgtgcaaaaaaagaaaaagaaaagttacaaaaacaacttcttgagtgccaacaatatgatcaagtaattgctcatattgcaaatcaaaaaataacaattgatttagatgatggtgtaaaagtaaactatgcgaagttccaaaatgttgagcttccgcaaggagaaggcaaaaagccacttaaggctaatctattagcaaagatttaa

SEQ ID NO: 2667 - DNA, 3741 bp, Vibrio cholerae; identical to SEQ ID NO: 2398

SEQ ID NO: 2668 - DNA, 1611 bp, Salmonella enterica
atgcaaagtggggataatgaaaaattctatagactttggcatgaagttaataactcagaaatagtaagaaatatttctgcgcttaccaatacaaagggtaagaaggcatgggttccacttcaacgaggaggagatgcaaggaaatggtatggaaacaacctatacatagtaaatttaagcgatgaaggagctgatattaagaggacaaaaaatgcatcattgaggaatgccgatcactattttaacatttctgcaacctggaatagattaagccaaactcgcttctatgttaggcatgttgaacaaggttatgcttttgatgatttaagtccatttgcaaactcatatttagctgaaaaacattatgagcatctgggtttattggcatctagcgcggctagatatttaatatcatttatatctacaggtcgcaaaactgaagtgggacatgtatctcaaattcctttaccaactacctttaatagcggtgaagcagtatcaactatttgcaaaaaattaattgagttatcaaaaaatgactggaattcctatgaagaatcagcaggcttcataaagccatccctattggataacgtagacaaaattaactcattatgcaacttgtataaaaaacaatgtgcttcttggcagcgtagtatctttgaaatgcaacgtcttgaagaagaaaataatcgcctattcatagaagcgtatagtctgcagactgaactaacaccagaagtatcgatcaacgagattaccctgacatgcaatccgtattatcgttacggtggaaatagaaccgatgaagagctcaaagccatgttacaaagcgatactgtcgctgagcttatttcttacacaatcggctgcattatggggcgttattcattagatcgcgaaggattagtttatgctcatgccggtaacgaagactttaaagcgctagtagaagaaggtgcttatgcccgttttcctgcagacagtgacggtattctgccgctaactgtcgaagcttggtttgaagatgatattgctgctcgggttgtagaatttgtccgcacagtctggggagttgagcatctggaagaaaatctgcaatttattgccgatagcctgtgcttagctgcgatcaagccagtgaaaaaaggaggagaaacctcccgtgagactattcgccgctacctctcgactcagttctttaaagatcacttgaagacctacaaaaaacgcccaatttactggctattcagttctggtaaagagaaagcctttgaatgcttggtctacttgcatcgctacaatgagacaactctcccgcgcatgcgcaccgagtatgtcactcctctgctcggccaaatggacagccgtattgagcgcctgcgcctgcagcagaatgaagcagaaacagccgaagccaaacgcatcggtaaagagatcgatagcctgaccaaacagcttaccgagctgcgttcttttgacgaccagctcaaacactatgctgatatgaagatccagctcgatctcgacgatggtgttaaggtcaactacggcaagttcggtactttattagctgaagtgaaagctatcactggcgataaagccgagtaa

SEQ ID NO: 2669 - DNA, 2028 bp, Salmonella enterica
atgaacactgccaatttaaaaaaaatagcccctcgggctcgtacagcatttatcacagcgatcaaagcacgcgctgctgaatttggaatcactgccaagggccatattgagccggtaattagcggtgaagttttgcaagttgctggatttacccatccatccagttgtgcctctgcccttaagcgcctgcaacaacggctggcaaacgatagttatgagactttaatagagcatgtcgcatacacttggtttaaccgcttctgtgccatccgctttatggagctgaaaagcgaagagggatatttagaacacggtgtgcgtctgctatcacacccgtcccagccactgggttttgaggtgttggatcgtgcacctgaggtgatcgataacctgataacagaaggtgtggctttggataagtccgctctgttggacttgttactggcaggtaatgagcaggaggctctcttccgtgagctacttctaggtcaatgtcaccgactgcatcaagcaatgccatttttgttcgaagccattgatgatgaaacggagctcctgttacctgcaggccttactcgcaccgatgccttttggcgtgaactggtagataagatcccagaagctgactggcagcaagtagaggttatcggttggctttaccaattttacattcttgatgaaaaagagagggtggataaaaaagtaaaagccgggaaagtagttaaccctactgaaattccagctaaaactcagctttttaccccaaactggatcgtacagtatttagtgcaaaactcaattgggcgctactggctgcaaacctacccaaattctcgcttgcaacaaagcatgcactactatgtagtacatggaaatcaatccacagaattaaaggataaattatcttattttgctcctgatagtatcgatccggagtcaatcaaggtactagatccagcttgtggctctggtcatatcttggtggaatcttataacctcctttatcgcatctatgaggaacgcggctatcgtagtcgcgagattcccgagctaattctcaaacacaacttgtttggcctcgatatagatgaacgcgcagcacaacttgcaggttttgctctgttaatgcgtgctcgtcaggatgatcgtcgcctgtttactcgcggaattagaccgcacatacacgctctgcaggaaagtcgccacttgaatatatccaatctatggcagatgctgaaccttaatactgactggactgccggccaagtgcaagatatgtttaccgtgctcccccaatccctcgtagccagcaatccacactttagcctgctgaatgatttgtacctgcgtttccttgatgctaaaaccctaggctctctaatcgagttaccaactgagcaaaagcagatcatccacgagttctatgccatcttgcaagatttaagtatcagtggtgatgcaatgcaaaaaactgcagccaaagcactactacccttgctggcacaagctgatgtgctatgccgacattacgatgcagtcattgctaacccaccctacatgggaggcaatagtatgaattatggtttgaaaaaatttgccgaagaaaagtttccggatagcaaactggacatgtttacaatgtttattgagcgggggtttaaattagtaggcgaaggtggttttaacgctatggttacgatggaaacatggatgttcttatcgtcatataaaaaattcagattaaatatctcatcatgttcgtctatagttacattaactcatcttgaaaaaatgctgatgggcattgcttttaggactgttgctacagtatggaagaatataaaaggcgataaaactcctggtatattttcttttgtaggcaaagatgacgttaataaaaatggcattccattccatttttatttccgcctaagaataatggcattccatttttatttccgcctaagaataagcgattatcatatatttccagttatagttttgagaatatccctggagcaccaatag

SEQ ID NO: 2670 - DNA, 3756 bp, Vibrio cholerae; identical to SEQ ID NO: 2658

SEQ ID NO: 2671 - DNA, 2493 bp, Collinsella aerofaciens
atgaacgattctgctcttaagagcttctgcacctgggcccgcacggagctcatcaaaggcgttgaggcgcagatggtgcgctacggcatcaccgaacctgcacctgcgcccgctgggtccgagaccgtcaacagcctgcccctaagtccggctgagattgagcaacgcgacgaactgctgcgcatgcaggcagaggtgggtcacgaggcgctgcgcgaccgtgcggcctacacctggttcaaccgcatcgtggccattcgcttcatggatgcatacggatggcttcccagccgtatgcgcatgctaagtcgtgcggacggcagccatggcagcgaggccgtggagaacgcactggacgtggaaataacgacggccgataccgatcgcatagccgagctcaagatggcgggcttggatgaaccgttgtggcgctacctgtttgttgctcagtgcgaggagcttgccgattgcctgccgggcgtctttgaacgcgtgggcggagccatggagctgctgttgccccagggcctcatgatggctgacagcgtggtgggcaaactcaatgccgtcctcactgacgaggactggcgcgagggcgtgaccgttctgggctggatgtatcagtactacaatgccgacgttaaagacgagttcttcaagtccaagcgcaaggcagcggcggcggacatcgcgcccgccacgcagctcttcacccccgagtggattgtgcgctatatggtcgagaactcgctcggccgtctgtggatgctcaacaatccggggagttcgctacgcgagcgcatggagtattacatcgagcccgatgctgagcacgaggacttcattcgcatttcgagtcccgaggagataaccctctgcgaccccgcatgcggctcgggccatatcttggtctatgcgtttgagctgctcttccatatgtacgaggagcgcggctatcgtgagcgcgagattcccgagctcattcttactaaaaaccttgcaggtatggaaatcgattcccgcgcggcacagatcgcggagctggcgcttgccatgtgcgcccgcgagcacgaccgtcgcttctttgggcggggcgttcgcgccgacgttaccgtgctctcgagcatcccgctaggggaggacgagctgccgggtaacaagaagctcgccgaggagctgagtcatttgggcgagatcggttcgctgctcaatccctcagaggacgagatcgacgagctcaaggctgccgccgcgagttgttccgatgacctttttgcttctgcgaccaaaactaagctcgaaagcgccgtcgccatttgcgagaaactgtcccgtcgttttatctgcgtcgtggcgaatcctccgtatatgggcagcagcagctttaatccattcatgagcaagtggatcaagaagaactaccccgacgtgaagagcgacctctgcacgtgctttatcgagcgcggttttaaccttgtcgaggataagggctacgccgcaatggttaccatgcagagttggatgttcctgggcagctttgagaagatgcgcgccaaggttatcgacaacaagacaatcgtttccatggcccatctgggacctcgcgcgtttgatgctatcggcggcgaggtcgtcaacgttacagctgacgtgatctacaaccagcattcggacgccgagggcgcctatgtgcgccttgttgatatcaacggctctgaggccaagaggctcaaactggtcgaggccatccaaaaccccgattgcggctggttctaccgctgcgacgccggcaccttcaagcaaatccccggcacccccatagcctactgggccagtgacgctcttctggatgcgtttggaaacgcaaaacagctcagtgagtatggcaagccgcgccaagggcttgctactggcgagaacgctcgtttcgttcgcgagtggtgggaagtcgatgattgcaagagcgtctattcctgtggatctattcaagagtcgattgaaaacgcttgcaaatggttcccctacaacaagggaggcgattttcgtaaatggtacggtaataatgaatgcgttatcaattgggagagcaatggccacctagttcgagagttcgcgggttcggtgattcgaaatcccgactgtttttttatgccttcgattacatggtcaaaaatctcgagcgggtctattgcgtttcgttttaagcctgctgggcatatctttgatgtggcgggcacgagcgtttttagcgacgaggagtcactcaagtatctccagggagcttgtaacagctccgtgattatgcgtgtcgcaagcatgctctcgccgacgcttaatttcgaggtaggccaaatcgcaacctacccgatcattcagaacaaggaacaggagccgttggtcaacgacatggtcgactcgtgccgcgaactatcaaaaaccgattgggattcgtttgaaacctcttgggatttcaaacataaccctttggtgtag

SEQ ID NO: 2672 - DNA, 969 bp, Collinsella aerofaciens
atggccactttacttcaagataaatacgaggctcgcaaggccgaggtcaatgctcgctttgagcagcttcgcgctaacgaggaagagctcaaccgaatctttgccaagatctacaacatggagggggaggtgcccatcgaggtcgaggataagtacgtttcggtggcgcgcatctttgataccgccgatgagatccccgagagctataagggcaacaaatacgtgcgcactaagcgcgatgagatcacctcgctcctaagctatgccgtgggctgcatgtttggccgctattcgctggatgtggatggcctggtcctggccgatcagggcaccacggtcgacgactatctggccaagatgcccgatcccgcccatgtgacctttatgcccgatgccgacaacgtgctgcccatcaccgacgacgagtactttgacgacgacatcgtgcgttactttatcgactttgtgcgcaccgtgtacggcgaggagacactcgaacggaacctggcctttattgccgaggcgctcggcggcaagggcacctcgcgcgaggtgattcgcacctgctttttgaaggacttctataaggaccactgccagacctataagaagcgccccatctactggctgttcgacagcggcaagaagaacggcttcaagtgccttgtttacatgcatcgctaccagcctgacctgttggctcgcatccgcaccgactatgtgcatgagcagcaggagcgctaccgtgcccagatcgggtatgccaacgatgcccttgtcagtgccgagcgcggcgagcgcgtgcgcttggataagcgcatcaaaaagctcaacgaccagctcaaagagaccattgcctacgaggagaaactgcaccacttggcagaccagatgattaagatcgatctggatgacggtgtcaaggtcaactacgccaagtttcaggatgtgctggcgaagattaagtaa

SEQ ID NO: 2673 - DNA, 3633 bp, Enterococcus faecium; identical to SEQ ID NO: 2506

SEQ ID NO: 2674 - DNA, 3741 bp, Vibrio cholerae; identical to SEQ ID NO: 2398

SEQ ID NO: 2675 - DNA, 3603 bp, Bacteroides sp.; identical to SEQ ID NO: 2486

SEQ ID NO: 2676 - DNA, 3669 bp, Vibrio cholerae
atgaatacgaacaacattaaaaaatacgcaccaaaagcgcgccgcgaatttatggatgcggtagctaaacgattaaatacctttggtatcaccgcgaataaaaagggcgagctacaaattgcagaagcgaatctacaaggttctgtgcttcaaatcgccggtaacagttttgacggtaaactggccgagcccagaaaacgcatagtagccagaagccagaaacttgggtatgcacaacttattgaacaagtagcttatacctggttcaaccgtctgtgtgctattcgctatatggaaatccatgactatctaggtcacggttttcgtgttctttcccatccagcgtcgcacccagacaactcccaaggcgctggcgcaacgaacaaagggcgctttgaaattatcgaccatgcccaagacgctgcggatgaactcggattagatagagctcgcattgttgaactcaagcttgcgggcaacaaagacgaagagctgtatcgtgaactgctgctaggccagtgccataagcttcatgaggctatgccttttttatttgacgcattggacgatgaaacagaacttctgctaccagataacctaacacgtaccgactcaattctacgtggattggtagatggcatccctgaagaggactggcaacaagtcgaagttattggttggctttaccagttctacatttctgaaaagaaagatcaggtaatgggcaaggtggtcaaaagtgaagacatccctgccgctacccaactatttacacccaactggattgtgaagtacctggtacaaaactcagtcggtcgtcaatggctgcaaacctacccagactctgccattaaaacgcagatggaatactacattgagcctgcgcagcaatctgacgaagttaaccaacagctaaaggctattacgccagaatctattgaacctgaaaccatcaaagtacttgacccagcttgtggttcgggccacatattgattgaagcctataacgtgctaaaagccatctacgaagagcgaggtttccgctctcgtgacattccaaagatgattctggagaacaacctctacggcctagacatagatgatcgtgcagcacagctatctggctttgcgttgatgatgatggctagagatgacgataagcgtatttttacccgtaatgtgcgactcaatgtactgtcattgcaggaaagtaaccatattgacctgccgaccttatggaaagcactcaatctatcgggaagttggcaaagcggcacatcacaaggcttgttctcagatgatgagcaagatttaagctcgttcaatgcagacaaccgctaccaactgctgacgcgaacgttagcaagatttacccaggccaagaccttcggttctttgattgatgttccaagcgatgattatgaacacttaaaagagctactaagcactcttgtcgagcttcaagagtcaggcgactcaatgcaaaagccagcagcgaagcaattgatagaatttgttcatcaggctttggttctgtccattcgttacgatgctgtaattgctaatcctccgtatatgggcggtaaaggcatgaatgcagatcttaaagattttgcaaggaaatactatccaaatagtaaatctgatttgtttgcgatatttatggagcgtgcatttaaattgctatcgcaatatggatttaatgctcaaatcaatatgcagtcttggatgtttctatccagttatgagcaattaagaaacaatttattggaagatcatacatttattaccatggctcacttgggtgctcgtgcctttagtcagattagtggagaggtagtgcaaactacagcttgggtaattagacagcagcatctgaagcaatatcaaccaaagttctttagattggttgatggtaatgaagaagagaagaaaaaagcattactagatagagaaaatgaatttgaggctacagcccaggatgatttcaaaaaaatccctggaagtcctttagcctattggttaactacggaagaaataaaactatttagtgaatacgaacagatcggaagtattgctacagcacgacaaggaatggcgacaggcgacaatgaaaaattcgttcgttattggcatgaggtatcacatttagaatgtaattttaatgccaaaaataaatcagaacattggagtacatttaaacgctgggttccatttaataaaggtggaactttacgaaagtggtatggaaaccatgagaatattcttgctttttcacaagaagactattccgaattaaagaaaatgggaaaccactgtccttcggaagacctctactttaaaccgtctgttagctggtcgaaagtatcatcagataatttttcagtacgttattaccctgaaggttttatctttgctgatgcaggtatgtctattttttctgaggataaattaaattcaattgcaggagtgctgaactcaaaaatcacaaaaattttggcttctgccatttctcctacattaaattacgaggttggtgttataaggcaactaccgatcattagtattaatgattctctcgttttgaaagccataaatatttctaaaagagactgggatgaatatgagttttcatgggggtttaagatgaatccattattgaagtataagggtgatcttattcgtcaggcttgtgagttcctagtaggtgaaaacaaaaaaatcacggaagatttgtttaatgtggaagtcgaaataaaccaggctttagaaatcggcactaatattaaggtttcgcctgtcgaactgaacgagattacattatttgcgaacccgttatttaggtttaatagaactaatcattctgaaagtttaaatctgcttgtttcatctataactactgagttagtaagttattccatcggctgcatgatgggacgttactctctcgatctcgaaggtttagtttattctaattcgagtaacgaaggtttcgataagctcgtggcagaaggcgcatattcgaccttcccagccgacgaagatggtatcattccattaaccgaccaagaatggttcaaagatgatgctaccaaccggttccgtgagtttgttcaagtcgtttggggtgaagaacatctacaagagaatcttgattttgtcgccgagtcactgtgcttaaatgcgataaagcccaagaaatcagaatcagcgctggagacgatccgccgttatttatcgactcagttctataaagaccacctgaagacttacaaaaaacgccctatttattggctgtttagctcaggcaaacagaaggcttttgactgcctggtttacctgcaccgttacaatgagggcacgctttctcgtatgcgtaccgagtatgtcaccccgttactaggcaaatacgatgcgtatgcagagcagcttgagaagcagattgaaacggcagactcgaccagtgaagcgaaccgcttcaagaaagagttagatgctttaatcaagaaacaggtcgagctacgagagtttgatgacaagctaaaacactacgccgatatgcgtatttcactggatcttgatgatggcgtgaaagtgaattacggcaagtttggtgatctgttggctgatgttaaggccattaccggttcggccccggaggttaactaa

SEQ ID NO: 2677 - DNA, 3573 bp, Vibrio cholerae; identical to SEQ ID NO: 2440

SEQ ID NO: 2678 - DNA, 3741 bp, Vibrio cholerae; identical to SEQ ID NO: 2398

SEQ ID NO: 2679 - DNA, 3633 bp, Enterococcus faecium; identical to SEQ ID NO: 2506

SEQ ID NO: 2680 - DNA, 3603 bp, Fusobacterium sp.
atgaataaaagtaatttaaaactttttgcaatagaagccagaaatgaattaatggaaaaaatgagaacaaggcttgatattcttggaataactaaaaagggaatagaaaaagctaaagttgtaggaagagaagtagaaataaatggctctctttaccctaaggaaagttacaatagtttagtaagaaaatataaacaaataggctatgaagaacttgttgaagaaagtgcatatacttggtttaacagactaacagctctggcatttatggaggcaaatgaatatatagaagaaaaaatgatattcaataatggtcttaaaaatgaacctggaataattgataactattatgactttgaattttttaagaatttagatagtgaattacaaaaagaattacataatttaagagatgaaaatacagcaaactcaatagaaaaactgtattctattttagttgaagagaaatgtgaagaattatcagctattatgccatttatgtttaagaaaaaagggacttattcagatattctatttccaacaggtctattattagaaaactctctattaataagaatcagagaagaaataggaaaagaagctccaatagaattaataggttggctttatcaattctataattcagaaaaaaaagatgaaatttttgctaaaaaagaaaaaatatcaaaagagaatgtacctgcagtaacacagttatttactccagattggatagtaaaatatatggtagaaaactcattaggaaaactcgctctagaatcaactggaataaatgaaagcctaaagactaattggaaatactatatagaatcagaattagatgaaagttcagaaaaaataaagatagaagatgtaaagatattggatccagcaatgggtagtggacatattctagtttatgcttttgacttactatttgaaatatatgaaaatcttggttggagtacaaaagatagtgtgctatcaatattaaaaaataatctatatggtttagaaatagatgaaagagcaggacaattagcatcatttgcgcttatgatgaaagcaagagaaaaattctcaagactattctcagtattgaaaagagaagaaacttttaaattgaatactttaataattgaagagagtaataatttatctgaaaaaattaaaaataaggtaaaagataataacttaaataatcttagtaaaataatagaagattttgaagatgcaaaagaatatggaagtatcttaaaattagaaactatagataaagaaacattagaaaaagaatttaatctattaaaagaaagcctagataatgagcaaggaacattgatatttaatgaagatgaattagatatcaatatagaagaggacttagaacttattgaaagtttaatagtgcagcatatagcactgacaaatcaatatgaagcagtagtaactaatcctccatatatgggaggaaaaggttttagtacaaaacttaaagcttatactgaaaagaattataaagatagtaaaagtgatttatttgcagtatttattgaaagatgtaatgaatttacaaagaaaaattgctatacttctataataacaatgcaatcttggatgtttttatcatcatttgaaactttaagaaaaaatattattgagaaaactgaaattaaaagtttaaatcatttaggaacaagagcattttcagaaataggtggagaagttgtatctacagttgcttggataagccaaaagaaaagtccaaagaatgatggaatatatctaagattggttgattacaataatgctgacttaaaggaagaagaattttttaataaagctaattattttcaagctaaacaaaaagattttgaaaaaataccaggaagcccaatagcttattgggtaagtgataaagttagagaaatatttgaaaaaaatcaaaaactaggagaagttggagaagttatatctggaatgacaattgggaagaatgacttatacttaagaaaatggtatgaagtaaataattataaaattaatttgagaaaattaaaaatagatgaaattaatttggagaaaaatccatggattccatatagtaagggtggagaaataagaagatggtatggaaataatgaatggattgttaattggaggtgttctaacaaatttaatagagcaaaaacaactttaaaacatttatatttaaaagaagctttagcttggaatttcatatcctcaagtaatttttctatgaaatatttagaaaatggatatttatgggatattgctggttctccttgtttttttaaaaaagaattagtaaattatgttttaggtttcttattgacaaatttttcacaaaatatattaaatataatgaatccaactataaattatcaagcagtagacattcaaaatatgccatttttatatgctgaaaataaggctaatgaaattaataatctagttcaacaaaatatagatatctctaaagaagaatgggactcaagagaaacttcttgggattttgaaaaattatctttagttgatggaaaagatttaagaactgcttttgaaaattattgttctcattggagagataattttgttcaacttcataaaaatgaagaagagttaaatagactttttatagaaatttatgaattacaagatgaaatggatgaaaaagtttcttttgatgatattactattttaaagaaagaagctaaaattgttgagatagacaatagtaaggctagggaattttctagtgagtcagaaagatatctatatgatagaggagtcagtttagaatttaataaagatgaacttgtaaaacaattcttatcttatgctattggatgtattatgggaagatattcaacaaataagccagatcttattatggcaaatagtgatgatgtattagaattatcttcaaataaattccttgttaaagatactaatggagatataagacaagaagttgaaactgaatttcttcctgatgaatttggaattctaccaataacagctgaaaaagatttctcaaatgatatagttgaaagagtaaaagaatttgtaaaatttgtttatggagaagaaagtttaaaagataaccttaactttatagcagaagccctaggaaataaggataataagagcgctgaagaaattctgagggcatattttataacggctttttataaagatcatttacaaagatatcaaaatagacctatctattggttgatgaatagtggaaagaaaaatgctttctcttgtctattctatatgcatagatatgaacctttaacagttgcaagagtgagagcagattatctgattcactatcaagaaatgcttgaaaacaaaagaaaatttatagaaagacagttatatgctgaagacataactgcaaaagaaaagaaaaatgttgaaaaagaattaaaagatcttgatgttttactaaaagaattaagagaatatgctaatgaagtaaaacatattgctgaacaaaagatagtattagatttagatgatggagtcaatgtcaactatgaaagattaggggctattcttaaaaagaggtag

SEQ ID NO: 2681 - DNA, 3756 bp, Vibrio cholerae; identical to SEQ ID NO: 2658

SEQ ID NO: 2682 - DNA, 3546 bp, Aurantimonas manganoxydans
atgagcgttgatctttcccgcctgaaggcatacgcaccgcaggcacgcaaggacttccgcaaggccgtcatggagcgggcggctcgaatcggaatcaccgccggcggcatcgtcgaggcgcagcggcagggcgacgtcttcgtcgtaggcggtacggcctacgacaagacgttcgggaagcagcgcgacgccctcatctccaaggtgaaaaccgaaggtttcgatcaagcgattgaggggatcgcctacacatggttcaatcgccttgtcgcgcttcgattcatggagctgcacgaatatctcgatcatggtttccagatcgtcgggcccggcacggccggcggaacgctccctgaggctcttgtcaacgccgagctgttgaacctgccgcggcttccgatcaacagcgtccgcgagatgaagatcgccggtgactacgaagaaaagctttatcgagcgatcctgatcgcccagtgcaatgccctcagcgagaccatgggcttcatgttcgagaagatcggcgatgcaaccgaacttctgctgcctgacaatctgctcgcgacagacggcctcatccgcaagctcgtgcagaactcggacacagcctcttggcaggatgtcgaggtcatcggctggctgtaccagttctacatctccgaaaagaaagatgacgttttcgacaagctgaagaagaaaaacatcaagatcactgcggcaaacatcccggccgccacgcagcttttcacgccccactggatcgtgcgatatctggtcgagaactcactcggtcggctctggcttctgaacaatccatcttcgaggctcgccgagaagatggactattacatcgcgcctgaggagcctgagaccgatttcctgaagatcggttctcccgaggagattaaggtctgcgatcccgcctgcggctctggccacatgctgacttacgccttcgacctcctgtacatgatctacgaagaggccggttaccgggctcgcgacatcccggcgcttattatcgagaagaaccttcagggtatcgagatcgatgaccgcgctggggcgcttgcagccttttcgctgacgatgaaagctcgagtgcaggacagccggttcttcacacgttcagcagagccgcagatttgcgttttggaggacattgtcttcaccgaaacggagatgcgggacgtctccgccgtggtgggcaataacttatttacggacgagctgggcgagacgctgggtcagttcgagcaggcgaagaactttggctcgctgatcgtgccgaagctgcgcgatccggccgagacgctgcgggtggtcgaggcgcgggaattcggcggcgatctgctgctgaaagaggtgcaggagcgcgtcgtggccgtgctgcgcatggccgaggcgctgtcgccgaagtatcatgtggtggtggccaacccgccgtatatgggcgggaagggaatgaatgggaagctggttaactgggccaaggaacactatcccaaccactattccgatctcatgacgtgtttcatggaccgagcgtcgatcctttgtttagaaaatggtaaatgggggatgatcaatcttccgtcttggatgttcctaagttcatttgaagacactcgacgccaactgataaaccacctaacagttgaatcgcttttgcagcttggtcgaggcatctttggctccgacttcggcagcgttgcatttgtagtgtcgaaaaggcagcattttccaggacacaagggcacgtaccgccgtcttttcgaaagacatgtcgacgttcgcaaacccgaaacaattcgtgacctcttcttagatcgggatgttggctatttccccctatcgcaggaggagtttcgcaagatcccgggccttattttcgcatattggattagcgaaaaggaacgtgatctttattccagcggcgaactcttaaaggacatttctgcgccgaggaaaggaatggatacgggcgagaatgaacatttcctgagattctggcacgaagtctcccaagaccgcgctgatctaacgggaggacaggaacaaggccgcaggtgggtcccctataataaaggtggagagtttcgtcgctggtatggcaatagggacattgtcctaaactgggagggcaacggatcggaagtcaagagccgcctcacttggaaaaagaaaaagccgaccattcggaatagcaagcacttctttgaagaaggtttcacctggactaccgtttcgtcgggtggattttctgctcgatattcaccgaagggtgcagtcttcgacaacggcggctgcacacttttcgctgattctgatctttggaaattcggagctttcttaaattccactgtgatgagcaggtatcttgagttcctgtcgccaactctcaactttcagccgggcgatatcggagcggcactttttcccaaggctgtgttgccgaaagttgcaccggcaacggctctcgtttcatatgcccgcgccgactgggacgcctacgaaacctcctgggatttcaccacgctcccgctgctctcactcgctcaccgcggcgagacgatggaggacagctacgcaacgctccgcgaccattggcagtccatgactgacgagatgcagcggttggaggaagagaacaatcgcatcttcattgacgcttacggactgcaggacgagctgactgccgaagtgccgatcgaggagatcacgctcacctgtaaccccgcctatcgctatggcgttaaggggacggaagatgagcggaaggacctccagcagcgggacacgatccgcgaactcatctcttatgccgtcggctgcatgatgggacgatactcggtggccgagccggggctcgtttacgccaatgccggaaacgtcggatttgatccgagtaggtacggcggttttcatgctgacgacgatggcatcgttccggtcaccgacgtcgagtggttccctgatgacgcaacaacgcgcttcatcgatttccttcgactgacgttcggcgaagagaggctcggcggggacctcgatttcgtcgcagactcgctcgaaccgaaaagcaagacgtccgcttcggagacgatccgaaaatatatttcccgagcattctttaaggaccatctgagaacatacaagaaccggccgatctattggctattttcgtccgggaaggagcgcgctttcgagtgtctcgtctatctgcatcggtacaacgaaagtaccctcggccgcatgcgggccgaatatgtcattccacttcaaaccaagatgcagaatcgaatccagacgatcgagggcgaaatttctcggggagatctgtcgagcgctcaaatgaaagctcgcacgaaggaacttgccgttcttgaagccaagaaggctgaactcgatcgtttcgaagccaatcttcggcacgtggccgaagaacggatcgcgctcgatctcgatgacggcgtgaaggtcaattacagcaggtttggcgacctcctcgccgcgacgaagctggtctgtggcacgaaggacgagggctga

SEQ ID NO: 2683 - DNA, 3480 bp, Sinorhizobium meliloti
atggacaccacgaagctcaagaagtttgcacagtttgcccgccgcacattgatagcgcaggtcagcgccaagctggactccgtcctcgcgccagatgcagccgcgcggcgcgagcatccggaagcgctgaagaagctcgacgcggccatcgcccgggacggcaaggggcaggtgatcgagcgggtggcctatacctggttcaaccgcttctcggctttgcgttacatggacgtgaatgaggttaaccccgttcgcatcgtctcgcctctgtccggtcagtttcagcctgaaattcttgccgaggccaaagccgggaacatcgatgaggagcgtatccctgaaaagattcgggccaaggtccgcgctcttctggacggacgcatcccgagccccgacgcgcaggccgaggcctatcggctgctgctcgtcgcgatctgcaacgactggtacagggccatgccgttcttgttcgagcggatcgatgactacacggagctgctgctgcccgaagatctgctgtcgaacgcctcgatccttacctatttgcgcgaggcgatgacgccggacgtctgccaggatgtagaggttatcggctggctctatcagttttacatctccgagaagaaagacgacgtcttcgctggcctgaagaagaatttgaagatcacggccgaaaatatcccggccgcgacgcagctctttaccccgcactggatcgtccgctacctggtcgaaaactcgctgggccggctctggctgctgaatcggccaggatccaagctcgccgagcggatggattactacatcgcgccggaagagccggaaacggatttcctgacgttcggcaagcccgaggagatcagggtctgcgatccggcctgcggttccgggcacatgctgacttatgccttcgatctcctctacgccatctatgaggaggagggatacgacccaccccagatcccggtgttgatcctgaagcacaatctgaccggtctggagatcgacgatcgagccggggcgctggcggccttcgcgctggcgatgaaggcggcggcgcggctggggcgacgccgattcctgcggatggaggctaagcccgagatcgtcgtgttgcagaatgtgactttcgccgcggccgagatggcggacgtggctgcagtggtggggcgcgacctgttcacggataacctgcgcgatacactcatgcagttcgagcaggcgaaaaacttcggttcactgatcgtgccgaagctgcgcgtctctgccgatacgctgcgcgtggtggaggggcgggacttcagcagcgatttgctgctgaaggaggtgcaagacagagttttggctgtgctgcagatggctgaggcgctgtcgccgaagtatcatgtggtggtagccaacccgccgtatatgaacgtaaacggtatgaatccgaagttaaagtcttacctccagacggcttatcctaactcgaagtccgacttgatgacggccttcatggagagagctattgccgcgcttttgcctgacggcatttacggaatgatcaaccttccatcttggatgttccttggatcatttgaaaagctaagacttgcgcttgttgaaagaacttccattgttgggcttctccaccttggaagaggaatttttggttctgattttggcagcgttgcctttctcgttaggaagacgactccaactgagaacacaatcggactgtacagacgactttttgaaaagcatgttcaagtccgaacaccatccgagatcgaggccctgtttctggaccctagttatggcggcttcaccttcaagcaaactgaccttctctcaatccccgggaatccaattgcgtattggctttccgaagaaatgcttcatgccttcaaagagaatgaacgtcttggcgagcattgcgacatctgtgtcgggttacagactggagataatagcaaattcctgagatactggcatgaaaccgatcaaagactgcgcaaaggcgcgacgaatttaggatggaagtgggttccctacactaagggcggagaatttcgtaaatggtatggaaacaaagactacgttctgaactggtccaatgacggtcaagaaatccgcgctcatccaagtgcggtcttgcgcaatcatcgtcgatacttcgaaaacggtatcacttacacaaacctgagctctggttcgttttccgcgcgtctcaaagacgacttcgggattttcgatcaaaagggtagcgttttcttgccgcacgatgcagacgaaaccaattcgatcctcgcctttctccttagcaagccttgcgccaagattcttgagatcctctgcccgacactcgatttcaatccgggcagcctggtgaacttaccaattcgtgatgaaattcgtgacgccagggtccaacgcaacgcctcagcagctatccaacttggaaaatccgactgggacgcctacgaaacctcctgggagttcaccacgcttccgctgctctcgcccgatcaccgggccgagacgctggagggcacttatgcccgcctgcgcgcccattggcaaagcatgacggacgaaatgcagcgactagaggaagagagcaaccggatcctcataaacgcctatggtctgcaagacgagttgacccccgaggtgccgatcgaggagatcacactcacctgcaacccagcctatcgctacggcgtgaaaggcgcggaagcggagcgtgaggcgcgtttactttccgacactatggccgaattcctgcattatgccgtaggctgtatgttcggccgctacagtctcgatatgcccggcctgattctcgccaaccagggcgacggtatggaggattatcgcgccaaggtgtcaaaccctacctttgagccggacgtcgataacgtgattcccgtgctcgatggcgagtggttcgctgatgacatcgccgcgcgtttccgccgcttcctgcgtgtcacattcggcgatgagcatttccaggagaacctcgcctttctcgaggaggcgctgggaaaggacatccgcaagtacttcacccgtgactttttcaacgatcatgtgaagtggtacaaaaagcggcccgtctactggctgttctctagcccgaagggcaccttcaacgcgctgatgtacatgcaccgctaccgccccgacacggtgagcgtggtgctgaacgactatcttcgtgaattccggtccaaacttgaagcgcatcgccgggcgcaggaagcacttagcatcagcggggatgcttcgcccgcgcaaaagaccaaggccctgaaggagatcgaggctaccgccagggagatcgaggagcttgatgcctgggagcgtgatgttctatttccacttgcgacccaaaagatcgaaatcgacctcgatgagggggtgaaggccaattacccgaagtttggcgccgccctaaagcccatcaaggggcttagcgattcggacgattga

SEQ ID NO: 2684 - DNA, 3504 bp, Sphingobium yanoikuyae
atggataccaacgccctgaagaaatttgcgcaaagcgcacgcaacctgctgatcgatcaggtcactgcccggctggacatggtgctagccgcaggcgcggcggcgcgccgtgaacaccccaaggcgattgccaagctggaagccgccgccaacagcaaccgcgcccacgtgatcgagcaagcggcatacacctggttcaaccgcttcaccgcgctacgctttatggatgtcacgggcctgaccaacccgcgcgtcgtatcgcctgcggatggcgccacccggccggaaattctggccgaggcgatggcaggcaacctgccggatcgcgcccggcccgaaatcgccgaatatctgaatggcacccgccccgcccatgatgggcaggcggaggcttatcggctgctgctgatccatgcctgcaacgaatggcacggcgcgatgccctatatgtttgagcgtgccgatatgctcgaccgggccgaagattataccgagctgctaatacccgacgatcttctgtcgccgaacagcatccttgcccgactgcgcgaggtgatgacggaagaggcctgccaggatgtcgagatcattggttggctttaccagttctatatcagcgaaaagaaggatcaggtttttgccggcctgaaaaagaaccagaagatcacggcggaaaatatccccgccgcaacgcagctgttcactccgcattggattgttcgctatctggtggaaaactcgctggggcggctttggctgctcaaccggccggggtcgaagctggccgaaaggatggactattacatcgcgccggaagagcccgagacggatttcctgaaagtcggcaagcccgaggagatcaaggtctgcgacccggcctgcgggtcggggcacatgctgacctatgccttcgacctgctctacgccatctatgaggaggaagggtatgaggcggacaagattccggcgttaatcctagcgaataacctgaccggggtggagattgacgaccgcgcgggggcgctggcggcctttgcactggcaatgaaggcggcggccaagctggggcggcggcggttcctgcggatggaggccaagcccgacatctgcgtgttgcaggacgtgaagttcaccgaagctgagttgcaggacgtggctgctgtggtcggcaaggacctgctcaccgacgagctgcgagagacgctggggcagttcgaagaagccaagaacttcggctcgctgatcttgccgaaactgcgcaatgcggctgagacactgcgggtgcttgaggcgcgggacttcggcggcgacctgctgctgaatgaggtgcaggagcgggtagtggccgtgctgcgcatggcagaggctctgtcgccgaagtatcatgtggttgtggctaacccgccgtacatgaatgcaaaaggcatgaacccctctctcaaaacatggaccaacgtggcctatgcttccagcaaagccgacctgatgacgatgttcatggaccgcgcggagcagttagtgctccggggcgggtactggagcatgatcaacatcccgacttggatgttcttggattcgtttgctgaattacgtcatggtttggttaagaagcagagcatcaagacgctcctgcatctggggcgaggcatatttggatcagacttcggaacagtggcattcactgtccgaaacagcgcaccgtctggcggcgttgcaaccttcaggcgcctatttgagcgccacgtcgatgtacgttccaagcaggaaatcgaggagctatttctcgacaaagagtataatagatttgaaatcgaccctcaaaaattccaaaaaattcctggaacgcctttcgcatattgggcaagcgaacaggtgttcaatgcatttagtgactacccaagcgtcaagagcattgccaaggcatttaggggcatctcgacgggggataacgagcgcttttctcggttctggcacgaagtgtcttctcttgaactgaaaacggatgcttcatcacgagaagaagcttctcagtcaggaaagcggtggttcccttacaaccgtggcggttcatttcggaaatggttcggtctcggcgccgagatcattgactatgaagacggcggcaagaatatgatctctgcgaacgagcggggcgagacaccggggtttcgccacgacggggcacaaggttacttccttaatactgttacatggggtgctctcacggcaggaacgacctcattcagacgcctgcctcacggatatgtgcttggacacaaggggccgggtatagtcgcagaccccgagttcgatcacatcctcttacagttcttgaacagtcgtgctgccgaaaagctcttgggctacgttagcccgacactagacacaaacatctctcacattctaggacttccattcaagggcatcgttaacacttcggtcgaagaagctgatctgatcgcgctctccaaatctgactgggacgcctacgaaacctcttgggatttcaccacgcttccactgctctcgcccgatcatagcggcgcgacgctggaggacagctacgctactctccgcaaccattggcagtccacgacagacgagatgcagcggctggaggaagagaacaatcgcatgttcatcgacgcctatggcttgcaggacgaactgacccccgaggtgccgatcgaggagatcacgctcacctgcaatcccgcctatcgctatggcgtgaaggcctctaaagaggaccgcgaggcgcgcttgcgcgaagatacggtggctgaactcctccactacgccgtaggctgcatgttcggtcgttacagtctcgacgcgcccggcctgatcctcgccaatcagggcgaagggatcgaggactatctcgcccgcgtgccagagccgacattcgcgcccgaccgcgataacgtcatcccagtgctggatgctgactggtttgccgatgacatcgtcacccgcgcccgcgatttcctgcgcgtcacctttggcgaggcgaagttccgcgaaaacctcgccttcatcgaagccgccctcggcaaggatctgcgcaagtggttcacgaaggatttcttcgactatcatgtgcgccgctacaagaagcgcccgatctactggatgttctccagccccaagggcagcttcaatgcactgatctatatgcaccgctaccggcctgacaccgtctcggtcgtgctgaaccaatatgtgcgtgaattcatccataagctggaagtcgagcgcgcgcggctggaaaagctggctgtcgatcctgcggctacgcccgcccagcaaacaaaggcgcaaaaggaaacagctacggtcatcaagcagattgccgagctgaccgaatgggagcgcgaaaccgtctatcctatggcgcagcaaaagatggccatcgatttggatgacggcgtgaagcgaaactatccgctgtttgccggtgcgctgaagccgatcaaggggctggaggctgcggatgactga

SEQ ID NO: 2685 - DNA, 3561 bp, Pseudomonas fragi
atgaacaccaacaacatcaaaagctacgcccccaaggcgcgcaccgcctttatcgctgcaatgaccaagcaggccgcgctgtttggaatccgcgagtcaaaaatcaccgggatctgcatcgcaccgctcgagaagaaaggtgatctggcgctagtcggcgagcatgcctttccagccagcatcatccgtcccagggcggcactggtgaaaaaggttgagcaaatcggctttgcccctaccatggagcaggccgcatacagctggttcaaccgtctttgcgccatccgctttatggaactcaaggactatctcgatcatggcttgcgggtactcagtcatcccgagcagcaaggcagcttccaaatccttgacgactgcctggatatcgatctcccaggcctggacaagcagcgcattaccgagctcaagctcgatggtaataaggacgaagtactctaccgcgagctcctcctggcgcaatgtcacgcactgcatcaggccatgccgtttctcttcgaggcggtagatgacgccaccgagttgttgctgcctgacaatctgaccaagaccgattctctaatccgcgagttggtcagcgccattcccgaagaagactgggccagcatcgaaatcatcggctggctctaccagttctacatctcggagaagaaagaccaagtcatcggcaaggtggttaagtcggaagacatcccagcagcgacgcagctgttcacgcccaactggatcgtcaagtacatggtgcagaactcactgggcgctcagtggctggcgacctcccccgactcgccactaaaggcgcagatggagtactacatcgaacccgcggagcaaacccacgaagttaagatgcagcttgcggcaatcacccccgatagcctcaaccccgaagagctcaccctgatcgatccagccagcggctctggacacatcctggtggaagcctacgacctgttcaaagccatctacctggagcgcggttaccgccagcgcgacgtggcgcagctgatcctgcagaagaacctattcggcctcgacatcgacggccgcgccgcccagctgaccggctttgccctgatgatgaagggcagagccgatgaccggaggctgttcgagcgtggggtaaagctcaatgtcatggcactggtggatagcgcaggctttgatgcagaggtcgtggctaacggcgtaacgctggcggactacgggttacaaatgggtgacatcacagaactgaagagattgttcgagctcgccacgacatttggcgcattgattcaagtgccggacgggttggcgaagaagctgccggggctgaagcagttgtgtgaggcgtccagtcaggatctgtttgtggcggatgagttgatgcaattgcgaccgcttgtgctgcaggcccagttgttggcggcgcaatatgaggcggtggttgccaatccgccgtacatggggagtaagtttttcacgtccattctcaagaacttcgtgaacgacgtatatccagagggaaaggccgacctctatgctgcattcactctgcgcaacatcgagctagcacgagagaacggccacgtgggaatgatcacgattccgaactggatgtccctctcgtcatttgagcagctgcgctcagccatccacagggacgcaccaattctcaatctcgtccataacggcaggggtgtttggggctcggattttggtagctgctcatacgtattgaaaaagtgctctccgcgaaaccttgcaggtcgcttccttcgcctgtttgagaagcaggggagtgtctcaagcaatgaagagctggaacacagatttcatgagtatcctcgatacagtgcgtcgaacgcgagtttcagaggaattcccggcggagtaatcggcttcaccctgtctgcacgcgcgctcgcaacctttacgaatgaaccgccgctctgcgcaagcttcacacctcggcaaggcctcattaccggggacaacgaacgattcttgcgattttggcaggaggtcgatctcgggcgctttgctcagccagaagatgcagtccatcgaaaatggtacgcctaccaaaagggtggcccctataggaagtggtacggaaatcatgagtatgtagtcgattgggagaatgaagggagggcgataaagacgcttttcgatgaaaacggcaagctgcgctctcgcccgcagaatactcagttcttcttcttggatggtgcaagttggacgagcgtaactatcggcgcgttcgcgctccgccacgtgcctcgtggatatatattcgatcagaaggggccgatgtgcttcccgcttggaaacctgccggtcgaagggctgctcggcttcggaaattcggtggtgatgcaaaggctcctgattgagatcgcgccaacggtcgattactcccagggaccagtgggaaacgtgccatttaatccagcggcggcacagtcggcagtcgcgaccgctgctcgggcagtaattcagtgcaagagagactgggacgcctacgaacgctcctgggacttccaatccctcccgctcctaacggcctcctctgaccccacgcccaccctcgagtccagctacgccgcctggacacgtaaaaaccgggacaccatcgccgaaatgcagcgcctcgaagaggagaacaaccgcctatttatcgacgcctacggtctggcggacgaactcacccccgacgtacctatcgagcagatcaccctgacggtgaacccggcctaccgctacggcggcaagctcagcgaagccgagctgtggacgcgctttcgtgaggacacctgtgcggagctggtttcctacgccatcggctgcatgctcggtcgctacagcctggatgagcccggcctgatctatgcccactgcggcaaccagggtttcgaccccagccgctacacaacccttccagccgacgccgacggtatcctgccgctaaccgataaagagtggttcgccgacgatgcggccaatcgcctgatcgagtttgtctcagtggcttgggacaaggcccacctcgaagcaaatctgcgcttcctcgccgacaatctgtcaccgaaaaagagtgagtcgagccgcgagaccctgcgccgctatctgtgcgacaacttcttcaaggatcacctgaaaacctacaaaaagcgcccgatctactggctgttcagcagcggcaagcaaaaggccttccagtgcttggtctacctgcaccgctacaacgaaagtaccctggcgcgtatgcgtaccgagtacgttattccgctgactgccaagctcaacacccatgctaagaaacttgagcaggacatcgaagccagtaccagcaccgccgagaaaaagcgcctggaaaaagagctcgccaccctacacaaccaacaagccgaactcgccagctttgacgaaaaactccgtcaccacgccgaccagcgcatcagcttagacctggatgacggcgtaaaggtgaactacggcaagttcggcgatttgttggctgaagtgaaatcaatcactggcgagcaggcggagtag

SEQ ID NO: 2686 - DNA, 3462 bp, Lactobacillus helveticus
atggataagaataagattaaaaaatatgcgattaatgcaagaacagaattaattaatgctattaaagttaaactatcaactttaggcattgatgaaaatgagattcaagacaaattgtcgatttcaaccccagacaaggaatactatgttgatgataatgaagctaatgcattaaccggtgcacaaattggctggcgcaaagatattgtagcagaattaaatcgccacggatatcaagaagactctaagactgcatataaggattttgtagaagaagtagcttacacttggttcaaccgaataattgctattcgttttatggaagttaataattacttgccaagtagagtgcgggttctttctagtgaagaaggtagaaatgaacctgacattatcaatgaagcaatggaaattggtgatgatcttggtggctatagtattgaagaaaaagaactaatcactactgcattaacagaaaagactcctgaattaatggatagtttgtataccatgctatttattaagcaaagtgatgcattaagtgagattcttcctggattgtttgaagagacatctaattatttgaagttgttgttcactccacattatgatcgtggcgtcattaaagaattggttaatgaaattccagaagaatattttgatgtcaaaagggaaggacaagtccagattattggttggctttaccagtattacaataatgcacctcatgaagaagtagtgaatatgaacggtaaggctattcaaaaagacgagattcctgcggctacacagttatttactccagattggattgtcagatatatgatagataattcattgggaaaatactatcttgaaagacaccctgatagcacagttaaacatgaattaaagtatttattaccagatgaaataaaagctattaatgaaaatcaagatattattgactataaattactggataatgcaatgggatcaggtcatatcttggtatatgcatttgatcttttcatgaagatgtatattgagcaaggatattcaatgagggatgctgctcaaaaaattattgagaataatctttttggattagaaatcgataaacgtgcatttcagttagcttacttttctatcatgatgaaggggagagagtatgatcgacgctttttaagaaggaatccaactacaaatctttattattttgaagatcttcatgtatctgatgaattttataattttatttcagataaagtggttagagccaacttaaagaaagtagttaaggatttttctgacgcaacagaattaggatcaattatcaaaattgacgaaagcattgatttggattctattgaagaagtagttgctggattagattttgaaagtggtcttgatgtttttggttataagaaaatacaacagcagattcttaagaccttaaagataattaaagtgatggctactaaatatgaaactgttgttactaatccaccttatatgaataagttcgataaaaccttgaagaagtatttgagagatagttataagaattactctaaggatctgttctctgtttttatttaccataatgtacatcaattagttaaaggcggctatgcaggctatatgacacctttggtttggatgtttattaagacatatgaaccattaagacatgatattatcaataattttaagatcgatagtttaattcagatggaatattcagcttttgaagaagctacagttcctattgatacatttgtgttgaaaaattcagatgatgataaagttggtacttatttacgattaagtaactttaagggtggaatgattgttcaagagcaaaaagttttggaagctattggtgatccaaaagttaagtacttgtattatactgatcaatcaaattttgataagatacctggcagtcctatagcttattggataagtcaaaaatcttttaagcttttcagcaaagagaaattaggagacatatctcaaacaagattagggatggcaacttccgataataagaaatttgtaagattttggtatgaaatagacttaaataacattggttttaattataagaaccgacaagtagctgaagaatcagctaagaaatggttcccgtatgataaaggcggcgaattcagaaaatggtttggcaataattatttagttgtaaattgggaaaaagatggaatcgaaatacgaaattttaaaaataagaatggaaaggtaaggtcacataattataatttagattatatatttaaaagtggacttacatggagcgctttgacatcgggaaatctttcaataagatatactatggtaggacatttatttgataatgcagggtctaaattattcactaacgattctaatatttttagaattttagggtatttgggaagtgtagtttctaattattatgtaagtatccttaatcctactatgaatatacaaccgggcacaatttctgaacttccttatataaataatgatgatatagcaatagataaattagtaaatttaaatataagattaagtaaattggattgggatgcctttgaaacttcatgggattttaaaaagagtccatttctaacacaaaatgctgcatccctccaccaagcctacaatagctggtccaatgaagcactcacacgtttcaaccaattaaaatccaacgaagaagtatccgttcgtaaagcagatcaagttcgcgacatcaaagcatttttgtcttactttatcggctgtgtctttggtcgttattcattagatcaagatggtttagtctatgctggtggcgactgggatgattcaaaatatacgacattcaagcctaacaaagaaaacattattctgttaactgatcgtcagtatttcgatgatgatcgtgatattattgtccgtttgaaagaattcctaactaaaacctttgaccctgaaacattgacagaaaacatggacttcattgctcaaacattagaacctaaaaagtttgaacgaggtacaagtgcagaagatattattagaacctatttcttaaatgatttctataaggatcatgctaagatctatcagaagcgtccaatttactgggaatttaattcaggcagaaataaaggcttcaaggcattgatgtatctacatcgttacaacactgaacagcttccaatggtgcgtcattatctgcatgagcttcagcctgcaatgaatgatctaattgaagttgatcagaacttgctcgatcaagaaacaacagctagtgctaagagtaaatatcgtaagacaattgctactcttaataagcagatgaacgagatcatgaaatatgatcaaattttagatcacttgtcacaaaatccggttgaccttgatctggatgatggtgtgcttgtcaaccatgataaattgcaacaaggcgagaagctgttatcgaagttataa

SEQ ID NO: 2687 - DNA, 3741 bp, Vibrio cholerae; identical to SEQ ID NO: 2398

SEQ ID NO: 2688 - DNA, 3540 bp, Faecalibacterium prausnitzii
atggataaaaacgccatcaagaaatatgcggtctgggcgcggaaagaactgatttcccgcgtggcgcagaaagcccagcagtacggcattacggaaacggaaatggtggacgccggtgctgatagcgtcaacggcaaagtgttgtctgcagaagagatgcagcagcgcagggcactgatcgcacagatcaatgaaaagggctaccagcaggttatggaagaggtggcgtatacatggttcaaccgcttctcggcactgcggttcatggaggtcaacggctatctgcccagccatgtgcgcgtgtttacggatgaaaacaatgcgttcaagccccagattctggccgaagccctgcatctggaattggataagctggataaggacaaggtctacgccctgaaagagaccgagcagaccgaagaactgtacaaatacctgctcatcgtgcaatgcaacgcgctgaacagcattctgcccggaatgttccagaccattgcggactacactgagttgcttctgccggacaacttgctccgggagggcagcgtcatcgagcagatgatctcccagatcccggaggacaactggcaggatgccgtccagatcattggctggctgtatcagtactacaacagtgagaaaaaggacgacgtgtttgccgccctcaagaaaaatgtcaagatcaccaaggagaatatcccggcggcgacccagctgtttaccccggactggatcgtgcggtacatggtggaaaacagccttggacgcctgtgggtggagggtcacccggacgcaaaagcacagctgctacccacaccggaggagcaagcagcttatactgtcgggaaccgtgacccggaggacaccaagtggcactattatctggaggaagcccagcaggagccgcaggtacaggcccagctggccgagatccgtaaacagtatgccgacctgaccccggaacagatcaaggtcatcgacccttgctgcggcagcggccatattctggcgtatctgttcgatgtactgatgcagatctacgagaactacggctacacgccccgcgatgccgtgaccagcattttgcagaacaacctctatggtctggatattgacgaccgcgccgcccagctggcctattttgcggtgatgatgaaggcccgccggtacgaccgccgctttttcagccacaccacccagcctcatgtgtatgccattgaggaaagcaaccgcatcgaaaagccggatgtagagtatttctgcaacggcaagctggaattgaaagatgctatgcacattatcctcacccagttgtatgatgccaaggagtatggctccatcctcaccatccccccgcaggactgggatgccctctatgcccggtttgacgaggtggcagacgagtcctcgttccatcgagagagtattcgcaaaaaattactctctctggtgcaggtggcgcagacgctggcacagaaatacgatgtggtcgtcaccaatccaccctatatgggcagttccggcatgggcgcaaagttggctgagtatgtgaagaagaattatcccgacagcaagagcgacctgtttgctgtgtttattgaggtctgttcccggatggcaaaacagaatggccatcaggcaatgatcacccaacacgcatggatgttcctgtccagctttgaaaaactgcgagagaagatgatgctaactgaaaccgtcaacatggcacatcttggcgcacgagcatttgaggaaatcggcggcgaagtggtgcagacgacctcgtttgtgcgtgtgcggacgcatattgataattataaaggtgtgtattgccgcctgattgagcctaccacccagcagggcaaagaggatatgttccttgcctgtgaaaatcgttatattgcaaatcaagataactttgcaaaaattccgggaagcccggtggcatactggattggacaggatgtttttcgtgtcttttcagaaaagtcagttcgtgattatgcagagcctcgccatggaatgtcaacggggaataatgatgtatgtcttaagctatggtttgaaattaacagaagaaagatttgctttgatgcaagtagtttggaggaatttgattcctccaattgtaaatttgcgccgtataaaaaaggtggctcttttaggctttggtatggaaataatgattatgtgattgcgtatgacaagaaatctcgccaaattatggaaagccttccaggatatcgttcatcgagtacaggctttttctttaagccttctataaattggtctgatgttagtacatccgcttttggaatgagggtgtcccctaggggatttgcttttgatggtcgtggtgcatcaatgttttgcaacaatgatgtaatgatgtatattgctgcgctattggcatcaaaatttacgacgtacatcttgaatattttgaacccaacattaacattcaatattgaaaacgtcgcagccattcctgtgataatagataaaaacaaaaagaaacaaattgaatttacagcagcagacaacattcgactttcaaaaactgattgggattcctttgaaacctcttgggactttacccgccacccctttatcaaggccattaccaaataccccaacatgatggatattggcaacatttaccttgctgagtgctatgacatttgggctggcgaatgtgaagaacgctttgagaagttgaaagccaacgaggaagaactgaaccgcatttttattgatatttacggcttgcaggatgaactgaccccggaagtggaagataaggatgtgaccgtgcgcaaagcggaccttggccgggatgtgcgctcctttatctcctacgctgtgggctgtatgtttggccgctactctcccacctatgatggtcttgcgtatgcaggcggtacatgggatgatggcaaatacaatatctataagccggatgcagacggcattattcccatctgtgacgacgaatactttgaagatgacatgatgggccgttttgtggagtttgtgcgggtggtatacggtgatggctcgctggaggataatctgcgctttattgcaaacgcactgggcggcaaaggccagccgaaagaggtcatccgcaactacttcctgaacgatttctatgccgaccactgcaagatttatcagaagcgccccatctactggctgtttgacagcggtaagaaaaatggcttcaagtgcctgatttacctgcaccgctaccagccggataccattgcacgcatccgtaccgattatgtgcatgagcagcaggcacgctaccgtactgccatcgaaggtttggaaaaacaggtggccgctgccaccagcaccagcgagcgtgtcaagctgactaagcaactgaacaaagtgcaggcgcaggacactgagctgcatcagtatgaggaaaaagttcacgcgctggcggatcagatgattaagattgatctggacgatggtgtgaagcataactatgagatctttaaggacgtgctggcgaagattaagtga

SEQ ID NO: 2689 - DNA, 3540 bp, Acinetobacter sp.
atgaataccagtaatattaaaaaatacgcaccgcaagcacgtaacgattttatcgcagcgatgcgcaagcaggccgccaaatatggcatcaccgcagacagcattttaccggctgaacagaaaggcgacttgctgctgattggcgatcaggtttttccgctatccgtcatgaaaccacgtgataagctgatcaaacgcattcaaaccagcagttttgagcagacgattgattatatcgcttacagttggtttaaccgtctctgtgcgattcgctacatggaatgcaaaggcttactggatcatggtcgccgtgtactgagtagtgccgatggcagtgctgggttaccgcagattctggaagaatgtctggatattgacttaccgggtttagatgccagccgtgtggctgagttaaagctggatggcaataaagacgaagagctgtatcgtgagctgttactggctcagtgtcatgcgttgaatcaggtgatgccactcctgtttgaacaggtttctgatgagtctgaactactgttaccggataatcttaccaaaaccgattcgttgatccgtgatttagtgagcagcattccggaagaagactggtcggatgtgcaaattattggctggttgtatcaattctatatttctgaaaagaaagatcaagtgattggtaaagtcgtcaagagtgaagacattcctgcagcgacacagttattcaccccaaactggattgtaaaatacctggtacagaacagtgtcggccgtctatggatgatggcacagcctgatagtacgcttgccagtgaatgggaatactatattcagccagcggaacagaccgatgaggtcaatgcccagttaaaacaactgattgatgtgcgcatcagtgaagatggtgatactttaaatcctgaaagtattaccgtactggatccggcctgtggttcggggcatattctggtggaagcttatgactgtttgaaagcgatttatttggaacgtggttaccgtagccgtgatattccacgtttgattctggaaaataacctgtacggcattgatattgatacccgtgcggcacagctcgccagttttgcgctgttgatgaaagcgcgtgaggatgaccgccgtttatttagtaatccaccgaagttaaatattattgcgttacaggatagtcagccagaacgactagaagcattttctcaggatttagccagtactggtattgcccagacagatttaaaagagctgctggagctatttgaacatgcttctacctttggttctttgattcaaattcctcaagcattcgctaagaaactacctgatttagaaagcaagctgaataaagcattagagtcaggggatatttttgcgcagcagtcggcacaagaattattacctttagtccaacaggctaaattactcgctaaacaatatgatgctgtgattgccaatccgccgtatatgggcggcaagggtatgaatacagccctgaaagattttgctaagaagaaattccctgacagtaagtcagacttattcgcaatgtttattgaacgtgggtttgcttggtgtaaagacagtggctttaatagtatggtcactatgcaaagctggatgttcttgtcgtcttatgaagcaatgcgtgaaaagctattacaagatcgtacgattcaaactatggcacatttaggtgcacgagcattccctgaaatttcaggtgaagttgtacaaacgactgcttttgtgatgcaagggcaacattttaatggttttaaaccagtatttttcaggctcgtagatttagcacaagattctaaagaggttgcattaaaagatggattctgcagatttgacaataatattcaggatgattttaaaaatgtatccggtagtccaatagcttattgggtgagtaataatatttatagttttttcaaagaatcacctaatatttgtaagttttctgatccacgacaagggatggctactacggacaatgctacttatcttcgaagttggcatgaaattacttttgagaaaatgggtattaattgtaaaagtgctgtttatggcaataaagaaggtctctactggttcccttacaataagggtggagaagtgcggagatggtatggtaatcagcatcatgtagttcgctatgaaaatgatggacaggatctgattgatttggttacagataaatatcctaagattagtgatcctgagtttgtaatcaaaaatcgaaaatattatttcaatgagtcaataacttggacggatttaactagtactatattatctgcacgttatcagccacctggagccatatttgatgtttctggccattctacgtttataagtaataagaaaactcaaaaagttatattaggatttttaaattctaagcttggtcacgatctctcaagaatgcttaatgactcattccattttcaagttggtgactataaaaaactaccatatccagagaaagttgaagaaagctttaatgaggataatatttctgaattaatagaaattgcaaaaattgattgggactcctatgaaacatcatgggactttactcaaaacccaattattcgtactaaccaatcaaccttagaacaagcctttaatacgtggcaacagcaaaatgctgacgccgtgggtgaaatgaaacggttggaagaagaaaataataagctatttattgatgcctatggcttgcagaatgaactcacgccagatgtaccagatgagcaaattacccttacccgtgccgaccgtgaaaaagacagtcagcgtttagtgtcttatgcactgggttgtatgatgggacgttatagcctagatgaacccggcttgatctatgctcatacaggcaatcaagactttgatgccagccgttataaaacattcccagccgatgctgacggcattattccactcaccgaaatgcactggttcgaagacgatgccacccatcgtcttcgagagttcctaactgctgtttggggtaaagacacactggataccaatatgctgtggctggcagaaagcttggacaaaaaagccagtgaaacagctgaagacaccatccgccgttacctcgccagcaagttctataaagaccacatgcagacctataaaaagcgtccaatttactggttattcagcagtggaaaacagggggctttccaggcattggtgtacttgcatcgttataacgaaagtaccttggcgcgtatgcgtactgaatacgtgatgccactgatttcaaaaatgacagcgatggttaactctttgcaaagtgaaatcgaaaacagtgattctgctgctgaaatcaaacgtaaagaaaaagaactacaaaacttgcataagcaacaggctgaactgagtagctttgaagaaaaactgcgtcactttgccgatcagcgtattcacttagatctggatgatggggtgaaagtgaactatggcaagtttggcgacttgttggctgaagtcaaagcgattacgggggagaaatga

SEQ ID NO: 2690 - DNA, 3516 bp, Bacteroides sp.
atggataccaatagattaaagaaatttgctattgaagcacgcaatatattaaaagcgggtattgccgccaaactcaccagcttgggcttcgacaacaaaggcgaagtggctgagaatttacgtccgcaactcttgcagggcggtacgctttggaacggacggactctttccgaaggattctttcaccaatggatgcgcctctacgaggaggtgcaggctaaaggtgtgaatgaggtgtacgagcaagcagcttacacatggtttaatcgtctggtagccattcgtatcttacagaagaacggactttgcgaaccggtaagtacatatgccgactctgcacataccccgcagattgtaaaccaagcccggcaagggctcttcccaccaatggaggaggcgagcaaacgtcacctcttggaactccttgatgacgatacgaaagttactgaacagtttgctgtgcttttggtggcatggtgccatgccaatcctatcctgcaacgctgctttggcactatggaggactatactgaactgttgcttcccgccaatattttggcggagaatggttttatcgatctcttaaaccacaccgagtttattaccgacgaagagtttcgctcgccggaactgattggctggctctaccaattctacatcagtgagcgcaaagatgaggtatttgccaagaaaggcaagtttgaggctgatgagattcctgccgccacacagatctttacacctaactggattgtgaagtacatggtacagaatacggtggggcgcatctatctcgataacaatccctatactattttgacttataaggagaaatggcaatacctcgtggagcctgcagagccgactcctgctgaagctattcttcattacaatgaactgaccgatctgaaagtagctgatcttgcttgtggttcgggacacatccttaatgagtgcttcgatttactctacgatctttatatcactgagggttatactcgtgtcgaagccataacacatatcttccaagataaccttacgggtatcgatctcgatcctcgtgcacagcaactttcgctttttgcgttgacgctgaaggcttgccaacgtgatcatagctttgcagatgcacattgcttgccacgggtgctgacgatgccgaaggtacaattgtcattgcctactgatactcgattagcggttgagattgatgcagtcaatactttgttgaaggatgctgattctttaggtagcattatgaagtttgaccttacatctgttgctcgtgaatgggtagcttctttagttgctgagaatgaggcggctgctttggttatagcgttgacagagcagtatgatgcgttggtgatgaatccgccgtatatgggtagtagtaagatgaataagaacttgtataactatattcaaagtaaatatcctgatggcaagactgacctatgtaatacttttatgtttgttggaatgaattctctttctccaaatggtaagatgggaatgattaatatgcaatcttggatgttccaatcatcttttcttaatttaagaaaatattttttgaatagttataattttgatagtcttttacatttagaaaaacatttcttcgaagagctaagtggagatgttgtgaaagttgtatcttttatttgttcaaagcatccacctttatataatggtgtatatttccgattaactgatggcaagtgcgaagataagcgtttaaattttctgtcaaaatctaatgtgtttactaatgtttcacaatttgggtttgaatcaataccgggtattcctatggggtattgggctacttcaaagatgttgaaatgttgggataaatatacccaaatatcaactaagatggttacgcgagaaggcatggcaccggctagtagtgatagatttattcgactatggcatgaggtatctaagagaaaaacagactttgtattatcagataataaatcaacctcacaaaaaaaatggttcccttataataaaggtggagagaaaagaaaatggtatggaaattttgaatatttagttgaatatgaaaatgatggatacaatatcaagcataactatgacataaaaacagggagacttagatctcataattacaacggggatttagcatttaaagaaggcatcacttggtcagttctttgcgatgcagcttttgctgtaagatatacgccatgtggtttcctctgggattctgcgggagcaatgggctttactgaggaaaatcttgtatattatttaggtttgctaaatagtaatgttattgataaatttttaagggtgttagctcctggtttaaaatttaatgttggtgatataaatcgtcttccactcatagaaaaaacttctgctgtaatagaatatgccgtacaacattctgtatatatcagcaagctcgactgggactctcacgaaacctcttgggattttcagcagaatggtcttatctcccttatagattttgccgagcaagaccttacaacagagtcacttattgccttgtgtagtactactgcacacagtgatgcagtaacacagcaagcagataaaaatcttcgtgcagttcgtttgcaagacttgatggaacgttatcatcagaaatggagtaccctctttatgcagctacatgccaatgaagaagaactcaaccgtcagttcatcgacatctacggtctgcaagatgagcttactcccgatgtgcctttgaacgaaattaccatcttgcaacaagacgaggtgagcattgagggcaatgccttgaagtggcacgatgaagtaatattgaagcaactcttcagttacgccgccggtgtatggatgggccgttaccgtcttgataaatctagtctgcatatcgctcaccccaaccccacagctgaggaattagctccttatacctataacggtcacaccatcgagatagatgatgatggcattttccccttgatggctgccgatagtggcttcacagataatgcctgcctacgtactgctcaattcgtgagcgatgtgtttggtgcggagtatcaggtggagaaccttaactacattgagcataccctcggcaagaccatagagcagtattggcaaaaggatttttggaaagaccataagaagatgtatcagaatcgtcccatctattggctgtttgcgagcaaaaaaggcagcttccagtgtattgcctacctgcatcgcatgacaccttatacccccgaacgcatccgcagtaaatatcttctgcctttcattgaaacgctaggtcgcaagattgccgatctcacaactcgcgctgccgacctcagcacagctgagcgcaagaagcttgatacgctgaataaacaacttgaagagtgccgtgaatatcatgaccgcctcgctgtagtagctgagcaagctatcccgcttgatcttgacgatggcgtggtggtgaactatgcgaaacttggggatgtagtaagtaaattaaaataa

SEQ ID NO: 2691 - DNA, 3642 bp, Proteus mirabilis
atgaatacgaacaacattaaaaaatacgcaccaaaagcgcgccgcgaatttatggatgcggtagcgaaacgattaaatacctttggtatcaccgcgaataaaaagggcgagctacaaattacagaagcgaatctacaaggttctgtgcttcaaatcgccggtaacagttttgacggtaaactggcggagcccagaaaacgcatagtggccagaagccagaaacttggatatgcacaacttattgaacaagtagcttatacctggttcaaccgtctgtgtgctattcgctatatggaaatccatgactatctaggccacggtttccgtgttttgtcgcacccagacaaccctaaaggctttgaaattatcgaccatgcgcaagatgctgcggatgaactcgggttagatagagctcgcattatcgaactcaagcttgcgggcaacaaagacgaagagctgtatcgtgaactgctgttgggccagtgccataagcttcatgaggcgatgcctttcttatttgatgcattggatgatgaaacagagcttctgctaccagataacctaatgcgtaccgactccattctgcgtggattggtagacggcatccctgaagaggactggcaacaagtcgaagtgattggctggctataccaattctacatttctgaaaagaaagatcaggtaatgggtaaggtggtcaaaagtgaagacatccctgccgctactcagctatttacacctaactggattgtaaagtacctggtacaaaactcagtcggtcgtcaatggctgcaaacctacccagactctgccattaaaagccagatggaatactacattgagcctgcgcagcaatctgacgaagttaaccaacagctaaaggctattacgccagaaactattgaacctgaaaccatcaaagtacttgaccccgcttgtggttcgggccacatattgattgaagcctataacgtgctaaaagccatctacgaagagcgtggtttccgctcacgtgatattccaaagatgatcctggagaacaacctctacggcctagacatagatgatcgtgcagcacagctatctggctttgcgctgatgatgatggcgagagatgacgacaagcgtatttttacccgtaatgtgcgactcaatgtactgtcattgcaggaaagtaaccatattgatctgccgaccttatggaaagcactcaacctatcgggaagttggcaaaacggcacatcacaaggcttgttctcagatgaagaacaagatttaagctcgttcaatgcagacaaccgctaccaactgttgacgcgaacattggcaagatttactcaagccaagacctttggttctttgattgatgttccaagcgatgagtatgagcagctaaaagagctattgagcacgcttgtagagcttcaagagtcaggcgactcaatgcaaaagccagcagcgaagcaattgatagaatttgttcatcagtcattggtactgtcgattcgttacgatgcggttattgctaatcctccctatatgggagcaaaaggaatgaatgcagatttgaaagagtttgctaagaaacaatacccaaatagtaaatcagacttgtttgccatttttatggagcgagcatttaaattgctttctcaatatggatttaatgctcaaataaatatgcagtcatggatgtttttgtcaagttatgagcagctaagaagcaatttattggaagaccatacatttattacaatggcgcatttaggtgctcgggcttttggtcaaatcagtggtgaggttgttcaaactaccgcatggattattcgaaataagcacattaagaaataccagcctactttttacaggcttattgaaggcaatgaggaagaaaaacaaaaagcattattaagtcgagattttgaattttcaattacaaaacaagatgattttaaaaggattccgggaagcccgattgcttattgggtgtcagataatgcaaaaataagcttctcttggggaacattggtaagctgtaactatgagttaattcaaggaatgataactgggaacaatgagcagtttgtcaggtcatgggtcgagatatcaaagagtaagtttagctatttttccaataatactgattgctgggttccgtacaataaaggcggcgaagcacggaagtggtatggaaatcatgagcttgttgttgactggagagatgaaggactatcatttaccagaaatcgtggaactaacagtcacttgtactttagagagtacgcttcttggagctacttaaattcaggatttcctgctgcaagactatacccagatggctttctatgggatgttcatggctctggtgcgttccctctaaatggagttaatcctaaaaagctagtggcattactttgttcaaaagttggagcctatttgctatcagttcttaacccaacgatgagcttccaagtcgaaaatatatccgcattaccttggaatgaagaaaaactggaaggtattagcacttgtgatttagaagaggctgtaaaaataagtaaagaagattgggattctcatgaggtttcttgggcattctgtaatttgaaaattgtttctatagataataactcaaagaaagttgaagaatcagttgatgcggtattttcttactgggaacaaaaaacgcaaactttaaggcttatcgaagaacgtataaatacatcactcattaaaatctataaccttgagagtgaactcagcccagatgttccacttgaatctgtcactcttacttggaatcctgcttatgtatacggcccgaaaaaagtaaatgaagaaattatgaagcaacatgtttcgggcaccatgacagagctagtttcgtactcaatcggcaatatgatggggcgctactctcttgacagagaagggttaatatacgctcactctgctaacgaaggattcgacaaactcgttgcagaagaagtttataaaaccttcccagctgatgaagatggaatcattccgttaactgaccaagaatggttcaaagacgacgcaaccaatcgtttccgtgagtttgtccaagttgtttggggtgaggaatacttacaagaaaacctcgattttgtcgctgaatcactgtgcttaaacgccataaaaccaaaaaaatctgaatcagcactggagacgattcgccgttatttatcgactcagttctataaagatcacctgaagacttacaaaaagcgccctatttattggctgtttagctcaggcaaacagaaggcttttgagtgcttggtgtatttgcatcgttacaacgagggcacgctttctcgtatgcgtaccgagtatgttaccccgttactcggcaaatacgatgcgtatgcagagcagcttgagaagcagattgaaacggccgactcgaccagtgaagcgaaccgcttcaagaaagagttggatgccttaatcaagaaacaggtcgaactacgagagtttgatgataagctaaaacactacgccgatatgcgtatttcactggatctggatgatggcgtgaaagtgaattacggcaagtttggtgatctgttggctgatgttaaggccattaccggttcggccccggaggttaactaa

SEQ ID NO: 2692 - DNA, 3399 bp, Bacteroides sp.
atggaagacagggaacttttcccggaagtaatccgtcgccgtgtggagcatggaaacctttcgtatgcgcataaacaatggctggaagaacatacagatgaaagaaatatggaacgtatgggcttgaagcatttcctagaagataaatttcaggaactttccggaaattataaaattcctttgtatagtcccgattatgcatacgccatgctgcctacagccgatgaattgtttgaaattattacggctttcaatgagatagaacaggatgcggattgcggtgcggatatttggaaaggtgatgatatattgggctggttatacgaaaactttaatacagtagagaaacttgcgttgaaagattccggtgataaaacggaatatgacaaggtttctttgcagagccaggtctatactcctcagtgggtagtaaagtttttggtggacaatacattgggtaagatgtatttggaaatgtatccggacagtaattttatttacgatgaaaatggtaaggtgaaatacttgattgccaatgcgcccatttcacaaatgcgtcatccaaagaaactggaagaactcaagctgattgatccggcttgcggtagcggaaactttttgatttatgcatttttgctgttctatgatttgtatttgaaccagatagatcagtatgatgccgattattcacgcagggatataccgaaactgattgtggaaaacaacctttatggtgtagatttggatgaacgagccgtacagcttacccaaatagctttgtttatcaaggctatgcaactgaaaggacgaaggggagctatgcctgcctatacgcatgtggtaagtacccattttgaacttcctgaatataatcaggtagaagctgctttcatgttgggctcagactggaatgagaaacaacaaaagaccatccgttctatttgggaagatttacgtgctgcttataaatttggctctctgattcgtgtggaagaacagttggatgccctgctgccggtagactcttctgatatgtttgctaatcaatggaaagcgaatatgtttgatttcaagcatcagatgattacaaccttgcgcaatcaggttcatcagtggacgggtgaaggcagtaatgagtattcattggcaaaggcgaacgatgccattacatttttggatattctaagtatgaaatttgatgtggctgtagccaatcctccttatacggatagtggagattttggagctgaattgaaagagtttgtgggtgcgaattattccaagcccttgaagtttaatactaatctttatgcttgttttatcaaaagatgctgtgaactggcaggtgatgatggtaaggtggggatgataaatcctcctactttcatgtatattaagacatttgaagatgtgcgtaaatatattgttgaaaaaacttttatttctttatttgttgaatgggggtatttaggcttattttctcagtccgctcgtgtggatagtgctatctttattttggataaatctgttagacaagaggaatctacatttattaaattgaatgatttgtatgaaatgaaacgtaaggaagttttgtttgatgcatattatgatttttgtaatggaatacagaatccccgtgtctatcaactacctcaatcaaaattaaaagaaataaaatcttatccttttatttattggatttcagatgagtttagagagtcatttaatacttgttcttttaatgaaataagtaatgttgtagaaggatgtaaaacggctaataattataaatttctacgattctggtgggagagaaatgaaagacatattgtttctaggacatatcctatatatgctaaaggtggagaattctgtaaatggtatggaaatttatggctagttttattgtggggagaaaatggaacatatctaaaaggtgatattaaagcaactcctaataatgagcaatattattttagcgaaggaataacatttacaggcgctggatctaagggagtcagttttaggtatcttccaaaggattctgtgtttgatactggttctaggtctatattctcagataaggtgagtgtttatattcttttatctattttaaattcttcattagggagttatgtattagattgtctgaatcctactgtaaatacaacagttggagatataaaacgaatgccctataaatcacctgatgtttgtcatggtggaattctgaattcattaagtgaatcttgtgtaaatataaaaagacatttatgtaagtataatataagggaatttaattatgaaggttccccgatagcaaatttgaagaatataaatgatagtatagcaatcttttataaaaatgagagtgctttattaacgcttgtacttttaaatgagtctgttatagatgtggtcgtttttgatgtttatgaactatcagtccatgaccgtcaaatggtcattgataaagaaggaattcctgtaggtgattacagcgtttcctcacaagccaaagaagcctataaagaatggttgtcaaccaatacagaattcccagcttcttcagaagttctggagcatattgactctttagagataaacgaagatcaaccgcatatagatgatttcgagtcgctctatcagaataacaacggatgggaagaattctgcatcaaacatgagatgaatccgatagaagtatggtaccagtttaagaatgccagtatattgccgccgcaacgtacacaggtattggcttttgaactgataacagatgtaatccggagtgtattggcaaaagatgatgatggggtaatccctttgacggagcgtatgggtgaagaacagctagccggtcgtatagagcaggaattggtggagcgcggatataactcggcgcagatttcacagattattcagttgcttggaacaccattggacaaatatttgcaggataagttcttcaaacaactgagcgatcatctgaatctctttatgtatctgccaaagactccgtttatctggcatctgacaagtggtccacaccatgccatagaactgtatattagtatctataaatggagccgtgataccgtgtttcgcataaagagtgtctatatagccaatagggggacagccttgaacgaccgtctttcgggtatagatgttagtaccgccaatggccagcttgaagcagcagaactgaaagagcagctgaaagagctgaaagtgtttgccgaaaagatagatgaactgttggcaagcggttacgatccgaaattggatgacggtgtaggcaagaacattgctcctttgcagaaggcaggcttgttgagctatgaggtgctgaatgccggacagctcaaaaaatacttgaatgctgactggtaa

SEQ ID NO: 2693 - DNA, 3678 bp, Salmonella enterica; identical to SEQ ID NO: 2365

SEQ ID NO: 2694 - DNA, 3585 bp, Pseudomonas fuscovaginae
atgaacaccattaacgtaaaaaactacgcccccaaggcacgtacggcctttatcgccgccatgaccaagcgcgctgcgttgtttggcatccgcgagtccaacatccccgccatgggcattgccccactggagcaaaagggtgatctagccctgatcggcgacagcgcctttccggccagcatcatccgcccgcgcgctgcgctggtgaaaaaagtcgagcaactgggcttttcccaggccattgagcaggccgcttacagctggttcaaccgcctttgcgccattcgttacatggagctcaaggactacctcgtccacggtcgtcgcgtacttagcgcagccgacgggagcgctaccgcaccgcagattttagacgactgcctggacattgacctgccgggcctcgacaaacagcacataaccgagttgaaactcgacggcaataaggacgaagagctctaccgcgaactgctgctggcccaatgtcacgccctgcatcaggccatgccgtttctctttgagacggtagatgacgccaccgagttgctcctaccggacaacctgaccaagaccgactcgctgatccgcgagctggtgagcgccattcccgaagaggactgggccaatatcgagatcatcggctggctctaccaattctacatctcggagaagaaggatcaggtcatcggcaaggtggtcaagtccgaggacattcccgccgccacccagctgtttacgcccaactggatcgtcaagtacatggtccagaactcgctgggcgcgcagtggatagcgacctatcctgactcgccgctcaaggcgcagatggagtactacatcgaacctgccgagcagatcgacgaggtcaaaacgctgctcgccgctctcactcctggaagcctaaaccctgaagagctgacactgattgacccagccagtggctccggtcacatcctggtcgaggcctatgacctgttcaaggccatctattttgagcgtggctaccggcagcgcgatgtggcgcagctgatcctagaaaagaatctgttcggcctcgacatcgacggccgtgctgcccagctgaccggctttgccctgatgatgaagggccgcgccgatgacagacggctgttcgagcgcggggtaaagctaaacgtcatggcactggtggatagcaagggcttcgatgctgaggtgttggctaacggcgcaaggctggcggactacggtctgcaacttggggatatcacggagttaaagcggctgttcgagcatgcgacgaccttcgggtcgttgattcaagtaccggaagggttgacgaagaagttgccgggactaaagcaactgagcgaggcgaccagccaggatctttttgtgacggatgagttcatgagcttgaggctgcttgtccggcaggccgagttactggcggagaaatacgacgcggtagtcgcaaacccgccgtatatggggggcaagttctattgcacagcactcaaaaatctcgtgaatgaatcttttaaagcaggaaaggcagacctctatagcgccttcaccctcagaaatatcgagttggccaagcaaaacggtcatatcgggatgatcacaattccaaactggatgtttctgtcttcatttgagtcactgagggatgccatcttaaataatgcgcctatcgtaagccttgttcataacggcagaggtgtctgggggtcagatttcggaagctgctcatacatcctacgccgttcatctcttcaaagtctccatgggcgattcctccgtctctttgataagcagggcagtgtgtccagcgttaatgaattggagcgccgctttcatgtcaatcgacgttatagcacatcgaatgccgacttcaagaagattccagggaacccgattggttattggttaagtgataaagcacgaagcacatttgaaagaagcaaatcacttagtgtgattgcaccagctaagcagggactcgcgacagccaacaacgaccgtttcgtgaggaactggtctgaagtcagcctggcctcagttgacttctgtagccgctcgctggatgaggctcagcaatcttcagccaagtggtttccttataataagggtggtgaatttaggcgctggtatggaaaccaagaacacttagtaaactgggctaataatggtgccgaaattcgaggattcaccgatgtcgacggaaaacagcggtcgcgaccacaaaacactcaatgttacttccgcacatccgtaagctggtccgacatcacgtctggaattccatcatttcgctattttccagaagggttcatctatgacgttactggaatgtccgctcaaccagaaagcaaagcccaaacactttctgtacttgcgtatgcaaatacgcccatagtcacgtggttcatcaagacacttaatccgacattacactttcaggtcggaaacttctcatcgttgcctttcttagaaacagcatttgagtcgcgtgattttcaatttgtcgagaagttgattaacgcagccaagtctgactggaacgcctacgaacgctcctggaacttccaatctcccccgatcctgactgcatctcccgagcatgcgtccacccttgaatccagttacaccgcctggatcacccaaaatcgcgacaccatcgccgagatgcagcgcctcgaagaggagaataacggcctctttatcgacgcctacggcctggccgacgagctcacccctgatgtacccatcgagcagatcaccctcacggtcaacccagcctaccgctacggtggcaagctcagcgaagacgagctgtggacgcgctttcgtgaagacagcatgcgggagctggtgtcctacgccataggttgcgtgcttggccgttacagcctggatgagcctgggctgatctacgcccacagcggcaaccaaggcttcgaccccagtcgctacggcagcttcccagctgacgccgacggaatcctgccgctcacagataaagagtggtttgccgacgatgcggccaaccgcctgatcgaatttatctctgcggtctgggacacgccccagctcgaagccaacctgcgctttctcgccgacaacctctcgccgaaaaagaccgagtccagccgcgagaccctgcgtcgttacctctgcgacaacttcttcaaagaccaccagcaaacctacaaaaagcgcccgatctactggttgttcagcagtggcaaacaaaaggccttccagtgcttggtgtacctgcaccgctataacgaaggcaccttggcgcgcatgcgtaccgagtacgtcattccgctgaccgcaaagctcaacacctatgccaacaagcttgagcaggatatcgaagccagcaccagcaccgccgagaaaaagcgtctggaaaaagagcttgcaaccctgcacaaccagcaagctgaactcgccaccttcgacgagaaactacgccactatgccgaccagcgcatcagcctcgatctagatgagggagtgaaggtgaactatggcaaatttggtgatttgctagcggaagtgaaggccgtaaccggagataaggcggagtaa

SEQ ID NO: 2695 - DNA, 3705 bp, Lachnospiraceae bacterium
atggataagacatccataaaaaactttgcgatttgggcgaggaataagctgattgcggatatcggctataaggcttcattgatgggaataaccgaggatggaatcagtgaggcgctgtcacagtctacaccaagtacagagttttatgatatcgggacagacaatccttatgctataagcacaaatcagataaagcaaagaaaaagacttgtagaagtaatcagaaaaaaggaagcagatacagactataaaaccgcatataaatatataattgaagaggttgcctatacatggtttaacagacttattgccatacgatttatggaggtaaatgactatttgccttctcgtatgcgagtactttcatcagtatcgggaaagcatgagcctgatatagtaacaaatccttttgaggcggagcttgagcttagtgatgatgacagagaaaaaataaacacgtataagagcgacaacaatattgatgagctttttaacctcctgtttataaagcagtgtaatgctctaaataccatattgccggcactttttgaaaagactgacgactatacagagctgcttttgaatctgtccgttatagacagagacggcgtagtgtataagcttgtaacagatatcgcggaagatgatttcaatatagaaaagggcggtcaggtagagattataggatggctgtaccaatattataacagtgagccgaaggccgccgcatttgcaaaaaaaggtaagataagtaaggaagagatccctgcggttacacagcttttcactcctgactggatagtgcgctatatggtggaaaacagccttggcagactgtgggtagagggacatactgatgaagagcttaaggcaaattggaagtactatcttgatgaagcggctcaggaagcagaggttaaaaagcagcttacaaaaatcagaaaagagtattctaagctctcgcctgaggatatcaagataatagatccttgtgtaggctccggacatattttggtatatgcctttgatgtgctgatacaaatatatgagagtgcaggttacagcactcgtgacgccgcaaaatacatcttggagcataatatctacgggcttgatatagatgacagagcctttcagctggcatactttgctataatgatgaaggcaaggcagtacaacagaagaatattaaacggagagtacaagccgaatatctattctatcaaggagagcaacggtataaacagagagcagcttaactacctcagaagcggatgcagtgaagatgaaagaaataaggcattagagcagataggtatcttgttggatacatttaaagacgccaaggagtacggttcaatacttaatgtggaagaatttgacgcagagctgcttgaaaggtttatttcacaaagtgagcctgacggacagataagtatgcacaacatgggtatagaagaaacggtacaagagcttagacagataattgcagtgggtaaggtgctttcagataagtatcatactgtggttacaaatccgccgtatgcaggaacaagtaatctaagtcttaagctgaatgcctatatcaaggaaaattatcctgacagcaaatctgatttgtttgcggtatttatagagcgttgcagtgagatgacaggagagaacggttatcaggcaatgataacgcagcattcatggatgttcttatcaagctttgaaaagcttagaaagaagatgatgcaaagtgaaattataaatatggcacatcttggagcaagggcttttgaagaaatcggcggtgaagtggtgcaggtgactgcatttgtacgatgtatagagcatataaaagactataggggaacttactgcagacttatagagccgacttcacagcaaggcaaagagaagatgtttttggacggagaaaacagatatgtcactgtgcaggataactttaaaaagataccgggtgaaccggtggcgtattggagcagttataatcttattgataaatttatattagggtataaattatctgatttatgtgagacaagaaaaggattggcaacatctgataataatagatttttaagactatggtacgaacctattttttcaaaggtaggattttctcttttagataatagagaaactatagaatcagcctttaagtggttcccaataaataagggtggagaataccatagatggtatggaaataaagagtatgtaatcaattggcaaaatgatggttatgaaattagaaattttcgtaataataatgggaagctactttctagaccacaaaacactaaatataattttaaaagtgcattaacttggtcaaaaataaccacatctgttttcagtgcaaggtttagtgaaagaggcttcttatttgatgatgctgcagctatatgttttcataaagatacacaaaggcttaagtatatattaggctttttaaattcaaagtgctgtcaattggttttaaatatattaaatcctacaattaacattcaaattggagatattggaaatataccaataatagaatctcatcaagagcctgttattaggttaagtgaatgttgcattgacatctccaagtccgactgggattcctatgaaacctcatgggattttgtaactcacccccttataaagccggctcttgcagagaataattctaaccgctcacaaactcttattgccgactgctacagtgcatgggtagatgagtgtgaagctcgatttaataagctgaaagccaatgaagaggagctgaaccgtatatttatagatatctacggtctgcaggatgaacttgatgccgatgtggcggataaggatattacagtgcatcgcatatttgataccaaggaggatatactcgagtctatgaaaggctcaaactatgttcgtaccaagcgtgatgaagtaatatcactgctttcatatgctgtaggatgtatgttcggacgctactcacttgatgtagaggggttggcatacgcaggcggagagtgggatgattcaaaatatatttcctttaagcctgatgataacaatattattccgattacagatgaagaataccttgatgatgatatagtcacaaggctttgtacatggcttaaggcagtctatagtgagtccacacttgaagccaatcttgactttattgcggatgcacttggaggtaaggacaatacaagccgtgaaattataagaaattactttttaaatgatttctttaaagatcattgcagtacctactcagtaacaggttcaggtaagcgaccgatttactggctctttgatgcaggaaagaaaaacggctttaaggcgcttatatatttgcacagatacaatgcagacactatcggaaatctgcgtatcgactatttgcatttgttacaacgtatctatgagagcgagagtaagcgtatgcaaagtacgattgacagtgcaaacagccctcgcgaggtggcgcttgcctcaaagagaaaggaaaaacttcaaaagcagctgaaggaatgtcatgagtacgatgagaaaattgcccatcttgcacttagtcgtatagagcttgaccttgacgacggtgtgaaggtaaactacagaaagatacagacagatagagacggcaaattttatgatgtgctggcagattcaaagaatatcatgtctaaggaaaaatag

SEQ ID NO: 2696 - DNA, 3741 bp, Vibrio cholerae; identical to SEQ ID NO: 2398

SEQ ID NO: 2697 - DNA, 3627 bp, Roseburia inulinivorans
atgaacaaagcagccataaagaattttgcgatctgggcgcggaataagctgattgcagatgtcagctatgatgcccgcctgatcggtattacggaggacggcattgcaaagccgttgccgcagagcttcggcggcactcagttcttcgatatcggcactgcagaaccgtattcgatttccggcgaggccgtgcgccagcgtgacaagctgatagaggtcatccagcagaaggaaaaggataccgactacaaaaccgcatatcagtatgtgatcgaggaggttgcctatacatggtttaaccgcctgatcgccatccgtttcatggaggtcaatgactatctgccttcccatattcgagtgctttcttccgagagcggaaagttggagccagatctggtcacgacaccgtttgacgcagagcttcccttcactgcggaggaagaagctcagattttccagctgaagcaggacaataagctggacgaagtgttccgcatcctgttcctgaaacagtgcaacgccctgaacgagattttgccagcgctgtttgaaaagacaaagaactacaccgagctgctgctcagcttgtccgttattgaccaggatggtgtagtctatcacctgattcacgatatcccggaggatgacttcaacatcgagcgcggcggtcaggtggagatcatcggctggctgtaccagtattacaacactgagccgaaggccgctgcctttgccaaaagcggcaagatcaccaaagaggaaatccctgccgtgacccagctgtttaccccggactggatcgttcgttacatggtggaaaacagccttggccgtctgtgggtggaaggacacccggaatgcgacctgaaagaaaactggaaatactatctggaagaagcacagcaggagccggaggtgcaggtaaaactggcagaaattcgcaaagagtacgctgccctgaacccagaagatatcaagctcattgacccctgcatgggttccggtcatatcctggtatatgcttttgatgtgctgatgcagatttacgagagtgccggctacagccagcgtgatgctgcaaagagcattctggaacataacatctacggtctggatattgatgatcgtgcctatcagttggcgtactttgccgtgatgatgaaagcacggcagtacaaccgccgtatcttaaacggtgagaacacctgccatgtctatgccattcaggagagcaacagcatcaaccgtgcacacctgaaatatttcggcgcaggaatggacgatatcgagaagaacgcggccaaaatgcagctggaaggtttgctggacaccctgaccgatgccaaggaatacggctctatcctgaatgtggagagctataactgggatttgctgcgtcggtttgtggcagcggaagataccgacggtcagatcagcatggacagcgtgggcgtggaagataccgccgagcagctgaaccgactcattgatatcggtgagacgatggcacggaagtattgggttacctgcacgaatccgccctatgctggaaccagcaaattggataaaagagtaaatgcttttctgaaagacaattatgtggacagcaaagctgacctatacgctgtttttattgaacattgcaaggaaatgatcgtagccaatggatttcaagcaatgataacacaacattcttggatgttcctagcaacatttgagaaattgcgcaagaagatgcttcagatggatatagttaatatggcgcatttgggagctcgtgcgtttgaagaaattggtggtgaagttgttcagactgtggcatttgtacagagagaaagttatgtgccagagtataatggtagttattgtcggttaatcagtgcaactacaccaaaaggaaaagaagaattatttataaaaaaagatacgctgtatactgctaaccaagcagatttcaaaaatatcgctggaagccctattgcatactggacaagttctcacgtgttcaaattgttttcagaggattgcttgagaagccatattgatgcgcgaaatggtatgtctactacagataataataggtttctacgattttggccggaatgcagctttgaaaagattggattctcgtctaaatcggctgagcaggcaaaagtaagtcaaaagaaatggtttccttataataaaggtggagagtttagaagatggtatggtaacaattcgtatgttgttaattggtttaacgacggcgaggaaatgaagaaatgcgtaacggaaaattatggaagctacagcaaggaactgagaagtgaagataaatattttgcagagggaatttcttggtctgcattaagctctggtaacatatcaatgcgttattcggaaccgggatacatttttgatagtaagggctctaaagcatttatgcgtgatgaaacgaatgtttttttgattctatcatatttgaattcttgcgtagcacaacattttttgggaattttatccccaaccttagactacaataacgggaacattgaaaaacttccatatatttccactaaaaacgatgatgttattattgacttgggaattgatgcagaagagcaaagcaaagccgattgggattcttttgaagtctcttgggactttaagaagcacccattactccgcaacgtttccacgatttacgaagcctttaccctgtggcagtcagaatgtgaagaccgctttaaccagctaaaaaccaacgaggaagagctgaaccgcatttttattgacatttacggcttacaggacgagctgaccccggaagtggaagataaagatgtgacggtgcgtaaggccgacttgcagcgggatatcaagagtctgctcagctacgccgtgggctgcatgtttggccgctactcgctggatgtagaaggattggcctatgcaggcggcgagtgggatagcagcaaataccagagctatattccggacgaagataatgttatccctatcaccgatgaagaatatctggacgatgatatcgtatcgcgcctgtgtgcatggctgaaagcggtgtatggtgcagatacgctggaagaaaacctcgattatatcgcaaaagcccttggcaataagggcagcaccagccgggagattatccgtaactacttcctgaacgatttcttcaaggatcactgccagacctattctgttaccggttccggcaagcgtccgatctactggctgtttgacagtggcaagcagaacggctttaaggcactggtttacctgcaccgctatacgccggataccatcggcaacctgcgtatcgactacctgcacaaaatgcagcgcgtgtacgaatctgagattaaccggatgcaggatatgatggatcacagcgggaatgcccgcgaggtggcagcagcctccaagcgcaaggataaacttgccaagcagctgaaggaatgccgggaatacgatgagaagatcagccatctggcactttcccgtatcgagcttgaccttgatgacggcgtaaaggtcaactaccgtaagctccagaccgcccaggacggcaagttctatgaggtgctggcagacagtaagaatatcatggtgaaagaaaagaaataa

SEQ ID NO: 2698 - DNA, 3618 bp, Salmonella enterica
atgaataccaataacatcaaaaaatacgctccacaggcccgtaaccagttccgcgatgcggtgatccagaagctaaccacgctggggatttccgctgataaaaaaggcaatctgcaaattgcggatgccgagctcgtcggcgaaaccgtgcgctatggtcagttcgactaccccaagtccaccctcacccgccgcgatcgtctggtaaaacgcgcccacgagcagggctttgatgtgctggttgagcactgtgcctacacctggttcaaccgcctgtgcgccattcgttatatggaaatccacggttatcttgaccacggcttccgtatgctctcgcacccggataacccgacaggctttgaagtgctggaccatgtgccggaagtcgcggaagcattactaccagaaaaaaaggcgcagttggtcgagatgaagctttccggcaaccaggacgaagccatctatcgtgaactgctgctggcccagtgccacgccctgcaccgcgcgatgccgttcctgtttgaagctgtggacgatgaagctgaactactgctgccggataacctgacccgcaccgactccattctacgcggtctggtggacggtattccggaagaagactggcaagaagttgaggttatcggctggctatatcagttctatatctctgagaaaaaagatgcggttatcggtaaggtggtgaagagcgaagatattcctgccgccacccagctgttcaccccaaactggattgtgcagtacctggtgcagaactccgtcggtcgccagtggttgcagacctacccggactcgccgctgaaaggcaaaatggactactacattgagccagccgaacagacgccagaagtgcaggcgcagctggctgccattacgcctgccagcattgaaccagaaagcatcaaggtactcgacccggcctgcggctccgggcatattttgattgaagcttataatgtgctgaaaaatatctacgaagagcggggttatcgcgcccgcgatattccacagctgattctggaaaataatatttttggtctcgacattgacgaccgtgctgcccaactttctggctttgccttattaatgatggcacgccaggatgaccgccggatattcacccgtgatgtgcgtctgaatattgtctccctgcaggaaagcctgcatctggatattgccaagctgtggcaacagctgaatttccaccagcagagccagaccggcagtatgggagatatgtttgccgaaaatacagcattagcgcataccgacagcgcggaatataagctcttaatgcgcacgctgaagctgtttgtgaacgccaaaacgctgggctcgctaattcaggtgccgcaggaagaagaagcggagttgaaggcgtttctcgatacgttgtaccgtctggagctggaaggcgattttcagcagaaggctgcggcgaaagcgtttattccgtatattcagcaggcgtggatactggcgcagcggtatgatgcggtagtggcgaacccgccgtacatgggggggaattatatggaggcagaacttaagaattatgtgtctactaaatatcctcaaggtaaagctgacctatattcttcatttatgattagattaatacaccaaactaaaaaaaatggtgctttaagtctaatgactccattcacttggatgaatttatcttcatttgaagaagctagaaaagaaattctaacaacatgttgcttgcattctttggtacaaccagaatatcattcgttctttgaatcagcttatgtccctatatgtgcctttaccatttttaaattccaatccagctggaatgcaacattctttgatctttctgaattttatggagaaagaaatcaagcacctaattttcattatgcaatacataataatgattgtaactggaaatataaaagatctacccatgactttctgagcacaccaggttacattattgcgtactctctaccaaattcagcattacactgtttcaaaacatcgccaaaactaaacagtgtgagcaatctaaagcaaggacttataactggagataatgatagttttttgagatattggcatgaaataagcttaaatttatttagctataatatcaataatattaagcccaaatggtttccatatcaaaaaggcgggacttatcgaaagtggtatggtaataatgagtatgttgttgactgggaaaatgaaggatataaaataagaaatttctataatgacaaagggaaattacgttccagacctcaaaatatacaattttattgtaaggaagggcttacatggacaagcttaacaatatcatccttatcaatgagatacgttccaaatggatatatttttgatgctaaaggaccgatgtgtttcccaattaacgcagcggatatttgggatatccttggttatacaaacagtaaaataataaatatttttctcaaacatttagctccaactatggattactctcaaggacccgtgggcaatgttccattcaaatcacctactagaaatataacaaacattataaaagagctcgtaactattcacaagaatgattgggataccaatgagatctcttttgaattccaaaccaatattttggttaagttagctaacgactataaaaaaattagtgatggatatacatttagagaaaatgaaaacaaaaaaataatttatcgtgttaaagaacttgaagaatataataactctagtttcattgatctttttgaattaaatgatattttatctccagaagtaaacctaagtgatattacattagatcgagcggcgcaagaaaatgacattataaaaatgatttcttattcaatcggctgcatgatgggtcgctactccctcgatcgtgaaggcctggtctacgctcacgaaggcaacaaaggctttgccgaactggtcgctgaaggtgcttataaaactttccccgccgataacgacggcatcctgccgctgatggatgaagagtggtttgacgacgacgtcacctctcgggtcaaagagtttgtccgcaccgtctggggcgaagaacacttgcaggaaaacctcgaatttatcgccgaaagtctctgtttatacgcgatcagccccaaaaaaggcgaacctgcgttggataccattcgtcgctatctttccactcagttctggaaagagcatatgaagatgtataaaaaacgcccgatctactggctgttcagctctggtaaaacaaaagcgtttgagtgcctggtctatctgcatcgctacaacgacgcgacgctggcgagaatgcgtactgaatacgtggtgccgctgctggcgcgctaccaggctaatatcgaccgcctgaacgaactggtcgatggtgcctctggcggagaagccacgcgtctgaaacgtgagcgtgatagtctgagtaagaaattcaacgaactgcgcagcttcgacgatcgcctgcgccactatgctgatatgagaatcagtattgatctcgacgacggcgttaaggttaactacggtaagtttggcgatctgctggcagatgtaaaagccattaccggcaatgcgcctgaggtgatttaa

SEQ ID NO: 2699 - DNA, 3564 bp, Acidovorax sp.
atgaacaagtccaacctcaagtcctacgccccccaggcccgcaaagacttcatcgccgcagtcaccgcccgcgccaacctgctgggcctttccgacaaggtcggcacgctggaagtagcccccgcccaaacacagggcgacgttaccgtcatcgccggacaagcttggcccgccaaggtcaacgcccagcgcaacaagctgatcgagcgcatccgcaaagacggctttgcccacaccatggaagccgtggcctacacctggttcaaccgctttgccgcgctgcgctacatggagctacacgactacctgggccacggccaccgggcgctgtccagcacctcgggggggcttccagacattctcacccacgccacagatctgaccagtgaactgcctggcctgaacgcggtgcgagtcaccgaactcaaactcgcaggcaaccgcgatggcgagctgtaccgcatgctgctggtcgcgcagtgcaacgccttgtcccgcgccatgccctttttgtttgagcgcattgacgacgactccgagctgctgctacccgacaacctgctgcgcagcgactccgtcattgccaagctggtggccgagatccccgaagaagactgggccgaggtcgaaatcatcggctggctgtaccagttctacatcagcgaaaagaaggaccaggtcattggcaaggtcgtcaaaagcgaagacatccccgccgccacccagctcttcacgcccaactggatcgtgcaatacctggtgcaaaacagcgtgggccgcctgtggctcatggccaacccgcaaagcaccttggccaaagagtggccgtactacatcacccccgccgagcaaacgcccgaggtgcaggcccagctcgatgcccttatccagacccgcgtgcgcgaagacggtgacaccctcaaccccgaatccatcaccgtgctggacccggcctgtggcagtggccacatcctggtggtggcctatgacgtgctcaaggccatctacctggagcgcggctaccagcccagagccatcccgcgcctgattctggaaaagaacctctacggcctggatattgacgatcgtgctgcccagatggccggctttgcgttgctgatgaaagcccgcgccgacgaccgccgcctgttcactgccacggataacgccggcaacctgcagccgcccaagctcaatgtgctgagcctgcaggagagcaaaggcctgagcgtggacgaactcgccacccacctggccccgttcaaggtgcagcgcgccaccatcgccgcgttggtggaaacctttgaacacgcaaaaacctttggctcgctgatccagattccccacgcgctcaagacgcatctggccgttttgccggaggcgatgacctcagcaaagcatagcgaggatatgtatgccagcgcagcggcggatgatttgttgccgctggtgcagcaggcgcaggtactgacgatgcagtttgatgcggtggtggcgaatccgccttatatgggcggccgaaacggtatgaacgatgcgctgaaaagcttttcagaggcaaattttccgagtggaaaggccgacatttatgcagcattcatagacaggggaatggttgctttaaggcctggacatggttcacttgccttcataacgatggaaggatggatgtttttaccctcctttgaagaattaaggaaaaaaattcaaaaagaatcgtcaattgcaactctattgcatcttgggccaagagcatttgagaccatctctggtgaaatcgtaagggtagttgcttttactgttactcaaaaatctttggcaggggatggagtgatcgactgttttaggctggtaaaaccaaaaacagagacagagaagcgggatgcctttttgagtgaaaggtcctcgatcaagttcgttcaaaagaatttttcaagaatcccagagggacgaatggcctactggctatcaccatctgtcattgcctgcttcgacaaggggcggaatattgaatctattgcgccagttcgtcaagggtttcaaactgggaataacgataaattcatgcgcttttggtacgagataagccaaagcaagatgatgttcgacgcgagttgcaaagaggatgttttttccagcggacgtaagtgggtgccttacaacaagggaggagaattcagaaagtggtttggcaataatgactatgtggtcgcttttgacaaaaaaaactatgagacgctagccatatctggaaattgcttgccatcacgaaatttctactttcaacaaggcattacttggtccgcgatgggcgggacttttggagcgcgtctgagccctaaagggttcacgttcagtgcgaaaggcgcgagtgcttttccgagcgcggtcgacagcccgctggttttaagtctactcaattcaaaggtcgctaacgcgatgtttgagtttttggcaccgactttggactttaatgttggggcaatacgacttatcccgatccctgatttgtcaaccgattcaattgccgaaattgggaaaagggttcaagctcttatttcgattgctgagagtgaatgggattcatcagagacttcctggaatttcaaatgtcctgaattaattagagatcgtctggcgtctgcccggttggcttgggaagcattacaagacagacggtgtgctgaaattcgacaggcggatcaactaacaagtgaagtggatagtttcctgattgctgcctatgggcttggagaggaatcgtccttggcaggatcgaagagtgatttcgcttacctggcgcctgtggaggcgacacaaactgaaaaactaatctcctacgccatcggctgcatgatgggccgctacagcctcgacgagcccggcctgatctacgcccacgcgggcaacgtcggcttcgagcctgcccgctacgccaccttccccgctgatgccgacggcatcgtccccatcaccgacgaactctggtttgccgacgacgcacccagccgcatccgcgaattcctgcgcgcagtctgggggccagacaccctggaagaaaacatggcctggctggccgagagtctgggcaccaaggcgtctgagaccccagacgagaccatccgccgctacatcgccgacaagttcttcaaagaccacctgcagacctacaaaaagcgccccatctactggctcttcagcagcggcaaacaaggcgccttccaggccctggtctatttgcaccgctaccacgagggcacactcgcccgcctgcgcgccgaatacgtcgtgcccctcaccggcaagatccaaagccgcatcgagatgctgcaaaaagacgcagcagccgccagcagcaccaccgcgcgcaacaagctgaacaaggaaatcgaaaagctcaccaaaaagcacgctgagctgctggcctacgacgaaaaactccgccactacgccgacatgcgcatcaagctcgacctagacgatggcgtgaaggtgaactatggcaagtttggggatttgctggagggggtgaaaatcgtcaccggagggagcagcgatgattaa

SEQ ID NO: 2700 - DNA, 3534 bp, Desulfonatronospira thiodismutans
atgcaccctctggaaaaagccttgcgcagcaggctggaaagaaccattgagcgggccaggcaggaagccgaggccggagctgtatctgctctggagcagcttggggtccaggaagctgccccttataaacacctgagcaaagaagaccgtgtgctgcgtcgcaagctgcgggcgcacgccaggcacctgggcaatgggcgcaacgccaagggagagcaggagatagaccgcctcattgaagaagttgcatatgagcactggcaccgtatgctctttgcccgctacctggcggaaaacaacctgcttatatatccggacccggtggaaccggtgtccatcacccttgaagagtgccaggacctggctgcggacgaaggtgccaccaacggctgggagctggcttcccgctatgccgcccgcatgctgcctcagatatttcgtcccgactctccggtattcgaattgaccctgcccccggaaaaccagcaaaggctggagcgcctggtggaggacttgccccgggaggtttttacagcttctgattccctgggttgggtttatcagttctggcagtcccgcaagaaagaggaggtcaatgcctcagaggtcaaaataggtgccaaagagcttccggctgtcacccagctttttactgaaccgtacatggtcgcctttctcctggataactccttgggggcctggtgggttaaaatgtgctcagagggcagtgaccagccagcagtggaagctcgtaacatgctccagaatgctcaaagcgaggatgagctgcgggtctttttcagccgcccgggatttactctttcctatctgcgttttgtaaaagatgacgagagctcctggactccggcaggaggcacttttgataactggccggataccctcaaaggattcaaaaccctggatccatgctgtgggtccggtcacttcctaatagcccagtttcttatgcttgtgcccatgcgcatggaactggagggcctttcagcccgggaagccgtggacaaggtgcttgccgaaaacatccacggcctggaaatcgatcagcgctgcgtccagctggcagccttctccctggccctggctgcctggacttatcccggtgcaggcggataccggccactgccagagctcaacctggcctgctccggcctggccattaatgcccggaaagaggagtggttgaacctggcaaatggggatgtgaaactgcgttataccctggatcagatgtatgacatgtttaaaaacgctccggtcctgggttcacttctcaatccaacaagaatcgccgaacaaagctactggacccgggaaaactaccagcgagctcttgaactggttcaaaaaatcatgagccgggaaaagggcgactacgagaagttcgaaatgggagttgtggctcagggcattgccaaggctacaacccttctggctgaaaaatatcattttgtggtgactaatgtgccttatctggccagaggcaaacaggatgaggctcttaaggaattctgccaggaatactacaaggaagccaagaacgacctggccactgtatttctggatagatgtcttgaattctgcatcaacaataatttagtcaatcaaggccaggatagaagacaaggtgtcagcagcggcaatgtttccgctgtatttcctcaaaattggctttttctgaccagctataaaaaattccgggaaaagctgctaaaacaggatgtttggcagttgatagccaggctggggccaggggcttttgaaaccatcagcggggaggtagttaaggcgatacttctaagcatcagcagaagcctgaagattgaaaagccttccaccctcatgctcaaaaaagatatgctacaggacgcacattccaatatgattagaggcctggatgtaagtgattttcacccagcccaggaaaaggccaagcagatttatgagatggatattaactctgttgagcaagtaaagcaactagataatcctgacgcgacaataaagcttggaaatagatctagatttgggattgttagggatttcgcaaattgcttccagggtttaacaacaggagatgatttacgtttaaagagattgttttgggagtttattcagaattcagataattatacatattggcaactgcttcaagcgccgagtcatggtagatctttatatgggggtaggcacaacttggtcgatgtccgaattacaacgggtgagcttaaaactggagcattaagaggtaaagatgcttgggggaaatggggtatagcaattgatcgggttggatcgctctctccagcaatatattgtggagactattttcatagtttagtgccagtaataatacccaaattcaaagttaacttatcattttttttgtcttttgcaaagtccagcactctgaaaaaagtagctgaagaaactaatcaagctttgagcgttgataatggttattttgaaaagtttgaatttgacctcaaccactggtccaaagtagcccaggaagagtacccacatggcctgcctcagccctattctgatgaccccacccagtggatattccatggccatccctgcggttctgtgatctgggatgaggacaagaagtggaccgctcatggccccctgcgcattgaagcaaatgtcctgcatgtcgctgtagccagacttctgggttaccgctggccggctgagctggatccggaaatggaactggctgatgaacagcgctggtgggtgcagaaagcaggtgagcttttgcccttggctgatgaagacggcattgtctgcatacctcctgtgcgcggagaggcggcagcagcagacaggctttttgaaatcctggtcagatcttacggcagtgaatggtccaacaatatcctgaaccagctcctgactgaggctggtaacgccggaaagaccctggaaagctggctcagggataagttttttgcccagcattgccggcttttccatcaccgcccctttatctggcatatctgggatggcctgcgcgacggattttccgccctggtcaactaccaccggctggacttcaaaaacctggaaaccctgacctatacctatctgggcgactggatcgcccgtcagaaacaggccgtgtccgagggtgtggacgcagcagaggaaaagctggctgcggcagagagtctgaaaaagaaacttgagctgatactcgagggagaaaatccatacgatatatttgtccgctggaaacctattgagaagcagcccataggctggaacccggacctcaacgatggtgtccgtctgaacatccggcccttcatgactgtaggcgacgtcagcaaaaagggggcaggcattctccgggacaaaccaaatatcaagtggaacaaagaccggggcaaggatgtccagtccgctccctggtatcatttattcaaaggcgaacgtatcaatgatcaccatttgaacctgcaggaaaaattcaagtccaggggaaataataatgagtacaactaa

SEQ ID NO: 2701 - DNA, 3651 bp, Oribacterium sp.; identical to SEQ ID NO: 2456

SEQ ID NO: 2702 - DNA, 3675 bp, Escherichia coli; identical to SEQ ID NO: 2305

SEQ ID NO: 2703 - DNA, 3741 bp, Vibrio cholerae; identical to SEQ ID NO: 2398

SEQ ID NO: 2704 - DNA, 3531 bp, Acinetobacter baumannii
atgaataccagtaatattaaaaaatacgcaccgcaagcacgtaatgattttatcgcagcgatgcgcaagcaggcggccaaatatggcatcactgcagaccgcattttaccggcagaacagaaaggcgacttgctgctgattggcgatcaggtttttccgctatccgtcatgaaaccacgtgacaagctgatcaagcgcattcaaaccagcagttttgagcagacggttgattatatcgcttacagctggtttaaccgtctctgtgcgattcgctatatggaatgcaaaggcttactggatcatggtcgccgtgtactgagtagtgctgatggcagtgcaggcttgccacagattctggaagaatgtctggatatcgacctgccgggtttagatgccagtcgtgtggctgaactcaaactggatggcaataaagacgaagaactctatcgtgagctattactggcccaatgccatgcattgaatcaggtcatgccactcttgtttgaacaggtttctgatgagtcagaactgttacttcctgacaatttaaccaaaaccgattccttgatccgtgatttggtgagcagcattccggaagaagactggtccgatgtacagattattggctggctgtatcagttctatatttctgaaaagaaagatcaagtcattggtaaagtcgtcaaaagtgaagacattcctgcagcgacacagttattcaccccaaactggattgtaaagtatttggtgcagaatagtgttggtcgtctatggatgatggcacagccggacagtacgctagcgagtagttgggaatattacattcagccggctgagcaaagcgacgaagtcaatgcacagctaaaacagttgattgatgtgcggatcagtgaagatggcgatactttaaaccctgaaagcattacggtactcgatccggcttgtggttcggggcacattttggtggaagcttatgattgcttaaaagcgatttacttagaacgtggttaccgtagccgtgatattccacgtttgattttagaaaagaacctgtacgggattgatattgatacccgtgcagcacaattagctagttttgcattgttaatgaaagcgcatgaggatgaccgccgtttatttagcaatccaccgaagctgaatattattgcgttacaggacagtcagccggaacgtttagaagcattcagtcaggatttggcaagtaccggtattgcgcagacagatttaaaagaattattagacctatttgaacatgcttcaacctttggttccttgattcaaatccctcaagcattcgctaagaaactacctgatttagaaagcaagctgaataaagcattagcgtcaggggatatttttgcacagcagtcagcgcaggagctgttaccgctcgtccagcaagctaaattattgaccaagcaatacgatgctgtgattgcgaatccgccgtatatgggtggtaaaggcatgaatgcagcactgaaagactttgctaaaaagaaattccctgacagtaaatctgacctgtttgccatgtttattgaacgtggttttggatggtgtaaggacagtggcttcaatagtatggtcaccatgcaaagctggatgtttttatcctcttatgaagcgatgcgtgaaaagctattaaaggatcgaacattgtctaatatggtgcatatgggtaatggggtaatgggtattgctttcggtacagctgcaactgtgatgctgaataagcatattagtgattacgaaggtagcttttcttattgtgaaaatgatgatgtaaatgaagatagggttccaaaacaatttcctgttcaaaatgagcgattaaaaacggcaaaaccagatgattttaagaaaattccaggaagtcctttagcatattgggtgagtgacaggattagttttagttttgaaaaaggtcctttaataaaagatattgcacaagcgagacaaggattaattacagcagattcagatagattcctaagattatggacagaaataaatattcaaaagttaggtctatgtattaaggatagagttgaagcaaaaaactctagaaaaaaatggtttccatacaataaaggaggagagtttagaaaatggtatggaaatcaagaatacgttgttaattgggaaaatgatggagttgaagttagaaataatatagatgcaaatggaaaacaaaagtctagacctcaaaatacagaattttattttcttccatcgttaagctggacagctattacttcttcaagattttcagtgagaagagattttggaggggctatttcttcaaatgcaggtatgagtgtatatgctgatgataatattctaaaaaagcttagtgtattaatgaatagtgctttatgtgattatttcttgcaaattatcagtccaacacttaattttggtgctggggatattggaaaagtgcccgcattaataaatttaatcgatgatgaggacaagatttatttacaccatgatgaattgatcaatataagtaaaaaagattgggattcctacgaaacatcgtgggatttcactcaaaatccaattattcgtaccaaccaatcaaatctagagcaagcctttaacacatggcaacagcaaaatgctgacgccgtggctgaaatgaaacgtttggaagaagaaaacaacaagctgtttattgaggcttatggtttacaggatgaactcacaccagatgtaccggatgaacaaatcaccctgacccgtgctgaccgtgaaaaagactgccagcgtttagtgtcttatgctattggttgcatgatgggacgttatagcctggatgaaccaggtctgatctatgcccatgcaggcaatcaagactttgatgccagtcgttatcaaacattcccagccgatgcagatggcattattccactgaccgaaatgcactggtttgaagatgacgcaacacatcgtatccaagagttcttaactgcggtttggggtaaagacaaattagacgctaatatgctgtggttggcagaaagtttggataaaaaagccagtgaaaccgcggaagataccattcgccgttacttagcaagcaagttctataaagaccacatgcaaacttataaaaagcgtccgatctactggttatttagcagtggtaaacagggggctttccaggcgttggtgtacttgcatcgttataacgaaagcaccttggcgcgtatgcgtactgaatacgtcatgccactgatttccaaaatggctgcctatgctaattctctagaaacagcaaaagaaagcagtgactctgcggctgaaatcaaacgcatcgagaaaaaactgcaagatttacataagcaacaagctgaactgagtagctttgaagaaaaactgcgccattatgccgatcagcgtatttcactggatctagatgatggggtgaaagtgaactatggcaagtttgggaacttgttggctgaagtgaaagctgtgacggggggcagtggggaataa

SEQ ID NO: 2705 - DNA, 3534 bp, Acinetobacter baumannii; identical to SEQ ID NO: 2261

SEQ ID NO: 2706 - DNA, 708 bp, Magnetospirillum sp.
atgatgggtcgctacagcctggatgaaccaggactgatttacgccaatagcgggaatgtcggattcgatcccagccgctacaccgccttccccgccgacgacgacggaatcgtgccgatcatgcagaccgattggttcgatgacgatgccaccaaccgcgttgtcgagttcatcaaggtcgcatggtcgcccgagacgctggccgagaacctgaaattcgttgccgatagtctggggggcaagagtggcgaactgcccattgacaccatccgccgctacctcagcacggatttcttcaaggatcacctgaagacctacaagaagcgtccaatctactggctgttcagcagcggcaaggaaaaagctttcgaggcgttggtctacctgcaccggtacaacgaaggcaccctgtcgcggatgcggatggaatacgtcacccccctccaggggcgaatcgcatcaaagattgatcagcttggtcgcgacattgatgccgccgccagcaccgccgcccaaaacaagctgaggaaggagcaggagaagctgaaaaagcagcaggccgaactggtcaagttcgatgaggaactgcgtcactatgccgacatgcggatcaagcttgatctcgatgacggtgtgaaggtgaactatgggaaattcggcaacctgcttgccgagacgaaggccataacgggcggatcggatgaatga

SEQ ID NO: 2707 - DNA, 3675 bp, Escherichia coli; identical to SEQ ID NO: 2305

SEQ ID NO: 2708 - DNA, 3741 bp, Vibrio cholerae; identical to SEQ ID NO: 2398

SEQ ID NO: 2709 - DNA, 3891 bp, Bacteroides sp.
atgatttcacaaggtggtaagaaaatattggaacgatttgtcagcacagccaagaatttgctaatgcaaaatatcacagaattattgcaacagcattatggtatttgggctgacggacataccattgccgtagagaaactggccaatcaagatacagacatcgtacatacagcacgtatgcttcgtgaacgtctgaagcacttgcaagctgcgcttccggaaacagaagaagacaaagatagattggctgttggtcaattgatagccgagcaggcatttacccagctcaaccgattctgtgcacttcgcatgtgcgaggaacgtgacctaatattggaaagcatacgtggtggttatgatgcggtaggattccaaagctatgatgccattgctcagacgataggtgtatctaaatacaacagatacagatggtaccttcatagtatcttcgatgaactgagcattgaattgccagccgtgttcgaccgttattcgccctacggattagtgtttcccgatgaaagcactttgttgaaattgatagagttgattaacgacagccaactatccgattggtatgacgaacagaacggaaccactgtcaacttctggaaggaagacgaaacattggggtggatgttccaatactacaattcattggaagaacgtcgcaagatgcgtgatgagagcaacaaacctcgcaatagtcgtgaaatggcggtacgcaaccaattctttacaccggaatatgtggtgcgtttcctaaccgacaactctttaggacgcatttggtatgaaatgacaggcggacaaagccgtattggcgaagaacaatgccaatatatggtgcgccgtcccaatgaagaaatgaaggaacgtgccatcaaggaaccgacagaaatactttcacttgaccctacgtgtggtagtatgcatttcggactttatctttatgaggtttatgaatatatctataccgacgcatgggataattaccctgagctattgcataaatatagagagttacatacccgtgagagtttcttgcgagaagtgcctcgtctgattctgacccacaacatttatggttgtgagattgatccacgtgcccttcagatagctgcacttagtctttggctccgcgcccagcgcagttatggtgaaatgggaattgatgccaccgaacgaccactcattaccaaaagtaatctcgtgttggctgaagcaatgcctggcaacaaacgtttgctaaaggggttgatggaagagttggatgcacctatgcagcgtcttatcaccaagatatgggataagatgaagttcgtgggtgaagctggtttgcttttcaaaatggagaaggaaatagaagaggacatcgagtatttgcgtaagaactggagcaaagtaaaccaaagtcgcaatgccgacctctttgccaccgaagaagaacgagcacgtatcgatgcggagaatgaagctcgcaaattgcttcgtcagaacaaatcggcattcttcgaagagataaccgaccgtcttaaagaggcattggaacaattgtcagctaaattgagtgaagaagaaggttacgaaaatgcgctctttagcgaagacgccacccgtggtttcgcatttattgagctttgccaaaagcggttcgattgtattgtgatgaatccaccgtttggtgaaggtagtgagaacaccagtagttatctggataataactatccggcttggtgtcgcaatttggtttgtgcattctttgaccgtatgcaggaaatgcttgatgcagatgggcgattgggagcaatctttgaccgcaccgtaatgataaagtcaagctatgaggatttccgtaaacgtaatctttgtggatacatcaccaactgtgcagatatcggctggggagtgcttgatgcgagtgtagaaacatctactttagttctcaataaacactcttcagatgttgaaggagtatttatggatattcttgatgttaatgcagaagaaaagaatgcccaacttattgctttgattcatgcaatgtgtgatggagatgaagttaagtggagctatatagcatcatctaaagattttgcgaacttgccgaacgctataataggttattatttcgatgtaaacatattaagtgttttcaaaatgcaaaatatggaagaacggaatctggtttctaaaaaaggtcatgatttggctgcaaatatttaccctagattatactacgaaataacaaatacccttggattctctttaatgtataatggaggtgctttttctatgttttattttccttataacgatgttgtattttggaatgaagagattataagaaataattctctttgtaatcttagaagtcttcatctccaaaaacttggaactgtcggatatggaaagagaggtgacatattagatgcacatgttttaaaaaaaggattcatttttacacgtgaaggtattggcgttcccaatttatcaatatctgatggttatagtgctcttgcttatttaaattcgatagtagcacaatatacaattaatttatattgtgcacaacataagggtaatggatatgtgaatatacttcctatgcccgattacgacaaaagtctgtctgatattgaaagtatagttaattccatcattgatattaaacgccattggtttagccttgatgaaaccaatttggaatatcatggacttattgcacagatgagtatcagcgatagtattgaagatagcatcaatcgaatgcaagaaggcatcactgctgattatcaacactatcaagagcttgtgaaagagaatgataacctctggatggatttagcaaacatagaccgcgaaagtgaattccgccagacattaaatgaatataagaaccgtcgtccatacgaggaattgctctctattgataatgccagcaaccagaacatcatcgacaaaaaggtgatagcacaagagattgtacaagaattggtgggtatggcatttggcagatgggacacagcatacgcccaaaaagtaaagcagatacctgagttcggtgatgtgtttgacgcattgccttttatgccaaccgtaagcctaagcgaaataccttcggattatgcgttgcaaatccctgaagacggcattttgaataaccaagcagatagtcctgatagtcttgtcaatcgtgttcgcgatgtgatgcaacatatttggggaaagcatgccgacgaactggaatacgaattgtgccaattgataggatgcaagaacctgcaagtctattttgaagcaccaaccggtttcttcgactaccatttcaaacgatacaccaaaagtcgtcgcaaggctcctatctattggccgttatcaagtgaagatggttcatatacttattgggtatattatccaaagttgtcaagaaatacactaccttcgctcttgattaagctccgcagtgaggatgaacaattgcgtagtggcatcaatgcagcaatggcaggtcatgacaaggcgcaagaatcctcccttcgggccaaacaagcgcaggtggaaggcatgatggaagaaatcaaccagattcttgcatccggttacgagccaaatcatgatgatggagtgcccgtaacatcagcaccaatgcttaagctggtagcacaccgaggatggaacaacgaatgtaaggacaatttggaaaaactcacaaaaggagaatacgactggagccaccttgccatgagtatgtttccagcccgtgtcacccaaaaagccaagaaagactggtgtcttgcccttactcacggtttggaacatctttgtgaaaacaagcctaaggaaaagaaagcgagaaagaaaaaagataataatcaaactttattttaa

SEQ ID NO: 2710 - DNA, 3741 bp, Vibrio cholerae; identical to SEQ ID NO: 2398

SEQ ID NO: 2711 - DNA, 3675 bp, Escherichia coli; identical to SEQ ID NO: 2305

SEQ ID NO: 2712 - DNA, 3756 bp, Vibrio cholerae; identical to SEQ ID NO: 2658

SEQ ID NO: 2713 - DNA, 3543 bp, Methylophaga aminisulfidivorans
atggaaacaggaaagctaaagaaatttgcccagcaggcacgccgcagtttgattgaacaaatcactgctaagctcaagttagtattggctggtgaaagtgcagctcgacgtgaagcctcagaagccgttggtagacttgaagtggctatcgatacacagggcaaagaacaggttattgagcgtgtggcctacatctggttcaaccgattctgtgccctgcgtttcatggatgtgaaccgctacacccgtattggtgttgtctcaccctctgaaggccagtcacagccggaaatattggctgaagccaagatggggcatattgacgatgacgttgtcagtgacgccactagacaacaggtttcagctttattaagtggtaaaagcaccagtcatgacccacaaggtgaagcgtatcgcttattagttgttgcagcctgcaactactggaatcaggcgatgccatttctgttcgagcgtatcgatgactacaccgaactgttaatgcccgatgacttactgtctgacaattctattctggaacagacgcgtcaggctatgacagaagaagtctgccaggatgtcgaagttatcggttggctgtatcagttctatatctcagagaagaaagacctggtctttgaagggctgaaaaagaacaagaaagtcacaccagaaaatatcccggctgcgacacagctttttactcctcactggattgttcgttacctggtagagaactcattaggcagactctggctgcttaaccgacctcattccaaactggctgaagaaatggactacttcatcaagccacaagagccagaaactgactttctgaagattaatagcccagaagacatcaaaatctgcgacccggcctgtggctcaggccatatgctcacctacgcctttgacctgctgtatgccatctatgaagaagaaggttatcagccttctgacatcccagaaaaaattctgacccataatctgtttggtattgaaatcgatgagcgagcaggggaactggctgcgtttgccttgacgatgaaagccagagccaaacaacgtcgctttttcagcaaaggcattaagcccaagatttgcgtacttgaaaacattcactttgaagaacaagagctggatgagtacatcgactttattgggcgagacctgttcaacgcgccgctgcagaccaccctgcgccagttcgaagaggccgacaatttcggctccctgatccgtcccgatgtcaccgaggtggacggcatgctcaggattctggagtcaaagaacgtctccgggcagttgtttatcagcatgacccatcagaaggtgctgcaagccctgcggcaggccgattacctgagtcccaaataccatgtggtgcttgccaatccgccgtatatgggtggtaaggggatgaatgggcggttgggtgcatggcttaaagacaactacgaggatgtaaagtcagacctcttctctgcctttatcgttcgcaacactgagatgacgttgccaaaaggccagcttggcttcatgtcgccatttacatggatgtttattactacctatgaaaagttacgtgattttttaattaacagtagaaccatcacctcgttggtgcagcttgaatactcaggtttcgatggcgccacagtaccaatttgcacctttacggttgagaacgcgcatcatcctaagttcaaaggcggatatgtacggctttccgattttaggggctcagaaaaccaggggtcacgggcccttgaggctattaaaaatcctggctgtggctggttctaccgcgcatccgctgctaccttccagaagatacccagcagtccaattgcctattgggctacagaatcacaaattcgaatgtttgaaacatgcccgagcctttccgaggtggcaaagatagctgagggcacaacaacaggcgatgttaatagatttctgaaaatgtggcatgaagtgtctaacctaaaaattggttttgggtttaaggaatcgcagtcagctgcagattccgaattcaagtggttcccgtacaataagggtggagaatatcgaaagtggtatgggaataatgaatttttagttaattgggaaaataatggacaggcgcttaaatcatatggtggctcattcattcgtggtgaaaagtattattttttacctggcgtaacatggtctaaagtaagcagtggagctttgagctttagatttttcagcgagggtttcctgttcgataccggtggactatgtttgttttctgaaaaaattagctactgcttatctattttaaattcaaaggcgtccctagcaataatgaagttgttggctccgactttgaattttactgtcggtacagtttcaagcattccggttcttcaatctgtatcgggtgtagagtccctttcatcaacgctgatagaacatgccaagtccgattgggactcatacgaaacctcttgggacttcaccagcattccgctgctgaatcccgattatcgtcagccaaccctgaaagctacctaccagaaactccgtgcccactggcgggagatgacgctggaaatgcagcggctggagcaagagaacaaccgcatcttcatcgaagcctacggcctacaggacgagctaacacccgaggttccgctcaacgaaatcactctaacctgcaacccccactattgctacggcaaggacaagagcgagggcgagttggaggcactgctgcgggccgacaccatgcatgaactggtctcctatgcggtgggctgcatgttcggccgctatgcactggacatgccggggctgatcctggccaaccagggcgagacaatcgaggactactacgaaaagattattgaccacaaaaaacaggaatcacacgaaaagaaaggcaaagaaaactttcgtgattttcgtgcctttcgtggttcctgtcttttccctgccgatgaagacaatgtcatccccatgctcgacggcgactggtttaccgatgatattgtcgaccgtttccgagaatttctccatgtggcatttggcgatgagcattacgaagaaaacctaaaatttgttgaatatgctctgggtaaggacattcgtaaatacttcctcaaagacttttataacgaccatgtgaagcgttacaaaaagcgtcctatctattggttattctctagtcccaaaggcagtttcaacgcactggtctacatgcaccgttatcgcccagatacggtgagtgtggtccttaatgactacctgcgtgaattccgtaccaagttgacgtctcagaaaacacatcttgaagccatcagcatcagtgccagcgcctcacaaagtgagaagactaaggcgctgaaagacatagaaaacctcagcaagatgattgctgaattagaagagtacgagcgtgatgtactttacccacttgccactgaacaggttgagattgacctagacgatggtgtgaaagttaattatccaaaatttggacaggctctgaaaaaagttactggcctatcgtaa

SEQ ID NO: 2714 - DNA, 3675 bp, Escherichia coli; identical to SEQ ID NO: 2305

SEQ ID NO: 2715 - DNA, 3741 bp, Vibrio cholerae; identical to SEQ ID NO: 2398

SEQ ID NO: 2716 - DNA, 3534 bp, Photobacterium sp.
atggatacatctagacttaaaaagttcgcccaatacgcccgccgtagcttaatcgaccaggtcgaaagtaaactcaagttagttttagctgatgagagtcaagctcgccgtgaatcccctagtgctgtagcggaattagagaagaaacttaaacagcacgggcaagatgacaaggcaagagagcagctcgtagaacaagtggcctacacctggtttaaccgtttctgtgcactgcgctttatggatgttaatcaatacaaccgtattatggtgctatcgcctttacctggtcagttccagccagaaatattgactgaggccaaggcggggcatattgatgaaggcatcgtcaataaagctactcaagaaaaaacatttggcctgcttggtggctctatcgccagtcgtgatggccagtcagaagcttttcgcttattgattgttgccgtatgtaatgacctgcaccgcatcatgccctatctgtttgagcgtatagaggactacactgaactgctgatgccggatgacctgttatctggtaactctattcttgcttatacccgtgaggcgatgacaccagaggcttgtgaatcggttgagtctattggttggctgtaccagttctatatctctgagaaaaaagaccaagtctttgatggcctgaagaagaacaagaaaatcacccctgagaatatccccgcagccactcagttgtttacccctcactggatagtacgctaccttgtggagaactctctaggcagactgtggatgttaaataatcctgactcgaaagtgattgatcagatggattattatatcaagcctgccgaagtggaaacggattttttacgtatcagcagtccagaagatattaaggtgtgtgaccctgcctgtggttctggacacatgctgacctattcatatgacctactatatgcaatttattcctcaactggtgaatacgatgattctgagataccagagttaattctcactaaaaacctttatggcattgagattgatgagcgtgctgctgagttggcggcttttgcattaacgatgaaagcacttaaaggcgatcctttagggaaaagcaataatcgacgtcgtttttttcgcaaccccgttaagcctaatatctgtcgtttagagaaggtgattttctccgatgatgagctgaatagttatatcgactttgcaggtaaagatctctttagtcaggaactaaggttaacgctaaaggagtttgaagaggcagataatttgggttctctaattcagccaaccttgaaaatgccagctgatactcttgctatttttgaggggaaagatgtttcgggtgaactctttttagcggatacgcatcagtctattttaacagtgttgcagcaggcggattacttgagtccgaagtataatgtagtagttgccaatccgccttatatgggcagtaaaggaatgaataaccgcttgtctaaatgggcgaaagataattaccctgacagcagatctgacttattttcgatgtttattgaacgagatttaaagcttgtagttaaatcaggctattctgcaatgataaatatgcagagctggatgtttttgtcatcttttgagaagcttaggttaaagttacttgaagaatctacaatagtatcaatgtgccatctaggaactcgggcatttgatagtatcggcggtgaagttgtatcaactacagcctatgtgctgcgtaatggaatagatattagctttaaaggtgattatatccgattagttgaagggcgatcagagaaagaaaaagaacaatcacttctagaggctgttgcgaataagacatgtgactatctttttcaggtatctgcaaatcattttaatgctatacctggctctccgattgcctattgggtagaaactaaaattattgaaacattctcttccgctcagccatttggtcgcgtgggtaagactcgacgagggctacagacgggtgactctgatagattcattcgtcgttggtatgaggtttctttagacaatataggaagaggccttactaaggaagctgctgagaaaagtggttgtaattggtttttatttaattcaggtggaacatttaggaagtggtatgggaatattgaagatgttgttaattgggggaaagatggccaagagataaaggcatcagggaaggctattattcctagtgaagatctatattttaagaaggctattacttggccaaaagttagcggtgggagatgtagtttccgctggtttcctgatgggattattcctggcgatgccgggccatgcttttatgatgagtcatcgtcggaagatgcagtactatgtttttccaattcaaaagtagcactatcgtttcttcaatttctttctccaacattgaattttgaagttggtgtgatggcaaaaatgccgttaatagtgcctgccacagatgagttaaaattaaccagaaatgagtcaataaagattcataaggaagactgggactcaagtgaaatgtcttgtgactttactttttctccagttgcagcttatcgtcaccgtcaaaccaggttagaggactcttatcaacaactacgaacaaactggaatgatgtaactctgcgtatgaaaaggattgaagaggataataatcggctttttattaatctctacggtttatctgatacattgacaccagatgttcccttaagtgagataacattaagttttaatcctcattatagatttggtactgacaagactgaacttgaactagagtccttaattaagaaggatactctaattgcatttatctcttatgcggtaggctgtatttttggccgttattcgttagacaaagaaggtttaatcttagctaaccagagcgatacgcttgaatgttatctaaaacaagtcccccaaccatcctttatgcccgacaaggataacgtcatcccattaatcgattttgatggtgactggtttgaagatgatatcaccgaacgctttaatgagtttttgaaggtcactttcggcgaagaacattttaccgaaaacttaacatttatcgaagacgctatcggtaaggatatcaagaagttcttcttgaaagatttctataccgatcatgttaaatgttataaaaagcgccctatttactggatgttctctagccctaaaggttcattcaatgccttgatctatatgcaccgctaccgcaccgatacggtgagtgtggtgctgaatgattacctgcgtgaattccgtactaagctgcaggctcgtaaagagagctatgagcaaatagagatcagtgcatcggcctcaccgggggagaaaactaaggctataaaagccatccagaatgtcaacaaggtgctagacgagattaacgactatgagcatgagaccttgtatccgttagctggtaagccaccagaaattgatttggatgatggggtgaagcataactacccgctatttggtaaagcacttaaaaaagtgacaggattgtcttaa

SEQ ID NO: 2717 - DNA, 3741 bp, Vibrio cholerae; identical to SEQ ID NO: 2398

SEQ ID NO: 2718 - DNA, 2496 bp, Fusobacterium sp.
tttgaagatgcaaaagaatatgggagtattttaaaattagaatctattgataaagaattattagaaagagaatttaatctattaaaagaaagttttaataataatgagcaagaaacattaatatttaatgaagatgaaataattatagatattaatgaggaattagaacttattggaaatctaataaaacaacatataactttggtaaatcaatatgaaacagtagtaactaatcctccatatatgggaggaaaaggttttagtccaaaacttaaaacttatgttgagaagaattataaggatagtaaaagtgatttatttgcaatctttattgaaagatgtaatgaatttacaaaaaaagattgctatacttctatgataactatgccatcttggttatttctatcatcatttgaaagtactagaagctatataataagtaatttaaagattcaatctttgttacatatgggaaggggaatatttggaatagattttggttcagttgcatttaccctaaaaaaagaacttcctaataaagaaaaaggaagttattatagattacacaaaagaaattttcaacatatatattataatgatattgaaaaaatctttttaaattcaaaagaagattttaattataaatataattttgatttgtatagagatgatgagggagtaaatataattcctaatttttcaatagaaaatggacaacaaataaaatttcaagctaaacaaaaagattttgaaaagataccaggaagtccaatagcttattgggtaagtgataaagtaagagaaatatttgaaaaaaatcaaaaattaggtgaagttggtgaggcaaaagttggattacaaacaggagataataataaatttttaagattatggaatgaagttaattataataaaattggctataatatgtcaaactcagaagaagcattagaaagcaaaaagaaatggtttccatataataaaggtggagaatttagaaaatggtatggaaatcaagaatatttagttaattgggaaaatgatggatatgagattaaaaatttttatgatggaaaaggaaaattaagatcaagacctcaaaatactgaatattattttaaagaatcagtgacttgttctgcaatttcttcttcacaaaattcaattagatactgtccaaatggaagtatatttgatgttaatttaagagtttattttttagaaagagataaaaatttaaaattattgagtattttaaattcaaaaatttttcaaaagtttggagagatattatctcctactcttgctttaaatgcaaatgatttggatagaattccagttatttttaatagtgataccaatttagtagaagaaaatatatctatctcaaaagaagaatgggattcaagagaaacttcttgggattttgaaaaactatctttaattgatggtagtatagatttaaaaactgcttatgaaaattattgtaatcattggagagataactttgttcaactacataaaaatgaagaagaattaaatagactttttatagaaatttatgatttgcaagatgaaatagatgaaaaagtagcttttgaagatattactatattaaagaaagaagctaagattattgaaattgataatagtgttcctaaggatttttttagtgaatcagaaaaatatttatatgatagaggagttagtttagaatttaacaaagatgaattagtaaaacaattcttatcttatgctgttggttgtattatgggtagatattcaataaataaatctggacttattatgacaaatagtgatgatatattagaattatcagaaaataaatttatagttaaaagtactggtggagaaataagacaagaagttgaaagtaaatttttacctgatgaatttggaattattccaataacagatgaaaaagatttttcaaatgatatagttgaaaaattaaaagaatttataaagtgtgtttatggagaggaaaatttaaaagataatcttaattttatagcagaagcattaggaaataaagataataaatctgctgaagaaattattagaacatattttataaaagatttctattcagaccatttacaaagatatcaaaaaagaccaatttattggctaatgaatagtggaaagaaaaatgctttttcttgtttattctatatgcaaagatacgaacctttaacagttgcaagagtgagagcagattatttgataccttatcaagaaatgttagaaaataagagaaaatttatagaaagacagttatcagatgacgatatatcagcaaaagaaaagaaaaatattgaaaaacaattaaaagaattggatacattattaaaggaattaagagaatatgctaatgaggtaaaacatattgctgaacaaaaaattccattggatttagacgatggagttaatgttaattatgaaaaattgggggctattcttaaaaaaaggtag

SEQ ID NO: 2719 - DNA, 3672 bp, Clostridium perfringens
atggataaaagtaagataaagtcttttgctatatgggcaagaagaagattaatagaatccgtaagtgataaggcttctaagataggaatctttgaaaatgagattaaggatgtagtagcagttcaagggggatttaaaatagtggggagtgaagaaattcttcccctttcaaaagaacatagagatgctttagtaagtcaaattaaggataaaggctttgaacaggttatggaagaggttgcatacacttggttcaatagatttatggggcttagatacatggaggttaatgaatatcttccttcaggaataagaatactttcttcagaagtagaaggaaaatcagaaccagatgtattaagcaaagtatcagaaattattgatgaattagaattaaatggagaagaaatatacgctcttttagattcaggaaaaaatcaggatagggagaaggcttacagaaaaattcttgtaaaacaatgtaatgaattaggtaagataattcctcaaatgtttgaaaaaataagcgattacactgaacttttattaccagataatcttttagaagagggttctgtaataaaaagaatggttagtgatatagaggaagaagactggaaagaagaagtagagataataggatggatgtatcaatactatatttctgagaaaaaagatgaagtctttgcaggattaaagaaaaatataaagataacaaaggagaacattccagcagccactcagttattcacaccaaaatggatagttaaatatatggtagaaaactcattaggaagactatggcttgaaggtcatccaaatgaagaacttcaaagacattggaaatattacttagaagaagcagagcaagagccagaagttcaagaagaattaaataaaataagagaagagcatagtaaactaacaccagaggatttaaaagtgttagatccatgtatgggttcaggtcatatcctagtttatgcttttgatgttctatatgaaatatacaaaacggcaggatactcagaaagagaaattccaagaaaaatacttcaaaacaatctatatggattagatatagatgatagagcagcacaattagcaagctttgcattaataatgaaagcaagacattataacagaagattatttagagaaatacaaagagaagaactagatttaaatctttgttcaatacaagaaagtaatggaataggaaaagaagcaatagaatacttctcaaatggaaacaaagaacttcaagaagatgtagaatacctagtaaaagttttcacagatgcaaaagaatatggttcaatcctagaagtagaaaaagtaaattttgaagcaataaaagaaagattaaaagaaataggacaagaagataacttaatgtttggtgactatagaaaaatgcttttagaaaaacttcctactttagtaaaacaagctgagataataagtagaaagtatgaagtttgtgtgactaatccaccatatatgggaagtaaaggtatgaataagcaaataaatgattatgttagaaaaacatatccaaaatcaaaaagtgacttatatactgtaatgttagaaagatgccttaagctttctaggaaaaatggttttatatctaatattactcagcagtcatggatgttcttgactagttatgaatcattaagaaagagcattattacatctaaggttattcaaaatatgatacacttaggaccaagagcatttgaagaaattggaggagaggtagttcaaacaacaacttttgtaataaggaatttttatactagaaattttgaatctaagtttattagggcaattgaggttttagatgctaaggaaaaagagaggtatgtatcaaatattattatcaacaataataaaaagatatttgaagtatctaataatgtttttataaatatccccaataacattatagcttattggatttcaaaaaaattatttgaaattttagaaaatgaaaagtccttaagtgaatttgctaatgtaagaaaaggattaataacatcagataatgatagatttttgaggttatggcacgagatagataatattagtttaggaattggatttaaaagtgacgaaaaagcaaaagaaagtaaaagaaaatggtttccttatgtaaaaggtggaaaatttaagaaatggtatggaaattatgagtatgttttaaattattataacgatggagaggagttaaaagcttgggtagaggaattaacaaaaactaaaccaggaggaagaataataaataaggaatattattttaaacctgggattacgtggagttctataggaacaagtaaaacttcgtttagatatgtagattatgggtcaatttatagtaatacaggaatgggtatttttagtgaaagtatagggtatgagtacttaatttctttattaaatagcaaagtttgtgaaagtttattaaatataatttcgccaacaatgggatttgaagcaatttatctatcaagaattcctattaaagaatcaattaatataaatatcaagtataaatctgaaagttgttatcaactatcaaaaaatgattgggattcatttgaaacatcatgggattttgaaaaacatcctttattaaaagatttaggcaatattaatgataataaaataagttctgctttttctaagtgggaagaagagtgtgaaaataattttaatcaattaaagagtaatgaagaagagttaaatagaatgtttattgatatttatggacttcaagatgaacttactccagatgttgaggataaggatgttactattagaaaagctgatagggaaagagatattaagtcatttatttcttatgctgtaggatgtattttaggtagatattctattgatgcagatggtcttatttatgctggtggagagtttaaggataaatgggatttagaaaataagaaggttagaaagatagagaaggatgaagatggtaacataatatctgattcatgggtagatgctactttcattcctgatagtgataatattattccaattactgaggatgagtattttgaggatgatatggtttctagatttgttgattttgttagaactgtttatggagaggataccttagaggaaaacttagattttattgcagattctattggaagaaaaggaaatgaaacatctagagctactattagaagatacttcttaaaagacttctacaaagatcacttaaaagtatatcaaaagagacctatttactggatgtttgaatcaggtaagaataatggtttcaaagctttaatttatatgcatagatatgatgagcaaatagtagctaaggttagaacagactatcttcatacacttcaaagaaaatatgaagcagagatagaaagattaagattaacaatggattcaagtgaagcaacagcaaaagaaaaaacagcttctaaaaagaaaatagataaaataatgaaacaaatagaagaatgtaaagaatatgatgaagttgttgcatacttagcaaatgaacaaataaatatagacctagatgatggtgtgaaaattaattacgctaaattccaaggagtaaaaattataaattcaaaaaacaaagaaactaagatgaatttattggctaaaatttaa

SEQ ID NO: 2720 - DNA, 1878 bp, Actinomyces neuii
atgcgtaccggaagatttttcgatgcgctaaaaggaaaaaaccgcgatcgcgtataccaaaaaagagtagatgacctcgaggcaattcctggctcgccgattgtgtattggctccccgacgcactcctggacgcgttccgcaatggcaccccactaggagagatagcttcccccaggcagggactggcaaccgcggacaacgacaggttccttcgcctgtggtgggaggtaggccaggccaactcctacctgcacgccaaagacaagcaggacgccatagactcgggaaagaaatggttcccccacaacaagggcggatcattccgcaaatggtacggcaaccaggactacgtagttaactgggaaaatgacggcgaagaaattataaactttgttgacgaagccggagaacaaaggtcccgtccacaaaatacagagttctacttcaaaccatgcatttcctggagcgatgtatcttccggaacaatagccttcagagcatatcctgaaggttatgttttcgacgccgcaggcccatctattttccctgacagggaagagcaactaacgttgatttcattccttaattcaggtgtagcttccgaattgctaactgctttttcttccgggctacacttcagcgtcggacacgtatcgaaagtgccaatcccaaaggaatcaatacctaataccaagattatcgatgagctaatatccctgttcaaatctgatttgatggaaaccgaaacagccaattcattttctgcgaatctatcgcatatccatcaggatctatcgagaaccttcgagatagacttccagagagctatcgaaaacactaattacgcaagattactcgagttacaaaacaataatcattgggcgaatgtcgtaggaattgagagacccgaagaatcgctttctctgaaccaagtctccctactccagaatccttattttgcttttgcgcctgaaaaggggcagacgcgctcggaggaggaatataggtggttgttcttccagcgagcggcgcaggagctaatctcgtacatcatcgggctgtggtttggccgctactcgctggacaagccgggactgatcctggctgaccagggggcaagcctgcaggattacctggcccaggtgccagagccgacgcttattccggatgacgatgggatcattcccttcaccgacggctatttcgccgacgacgcgctgctgcgcgtgcaggaagccatcaaggcgatatatggggaggagaacttggaagagaacctggccttcctggtgcagtgtttgaacgtgaagagctcgggcaagaagagtgaattcaccgcgcccaccctccccactaactaccgggaggggctatttaagtacctggacaaggagttcctcaaaacccacgaggcgatgtattccaaccggccgatctactggatgttccaatccccaaagggctatttcaaggcgcttatctaccagcacaggtacaccgccgccaccgcgggccaggtgctcgccaagtatgcggtcccctaccgcaatgcgctcaccaccgaggtaaaagacctgcaggcccagctggactccgctgccaggtcgcagcaggccgccctcaggaaacgcctcaaatgggtggaaaccgccctggcagacgtaaccgcctacattgacgactcgctctaccccctctccatccgaaaggtcagcatcgacctggatgacggggtgcgagtcaactacaacaaggttgcctacggaatcagcggcaacagggaacagctgaaaaagagcgctctgcgccctcaaaaaggctttagcgactggtacaaaaagcgcaaaaaagctggaacccaattctggcaggagtag

SEQ ID NO: 2721 - DNA, 1776 bp, Actinomyces neuii
gtgagtgttttgtccttagaatctttggctacttctgcccggactagtttgaccgaccaggtggctgtgcgcctgtctagcctgcttgccagcccagacacggacgcgcatgtgcgcacctcgctgacaaatgcgatcaccgggtttggccaagatggggtggtagagcgggccgcctattcgtggttcaaccggctgactgccgcccggttcatggatgcgcacgcctattcgggcacctaccaggtggtgactcccccgccaggatccaaccagccagaatgtctggtgcaggccaggcagggcagcttcgactacaagattgatccgcaggtgcagtcgcaggtaacagacctgctgctggccggtaaagaccggcaggcttacgtcaccttactgactgcttacttccagctgtggtctaaggccatgcccgcggtattcccgcatgcgaatagttgggtgaactatttggcccctggcgatcttttgtcagctacttccgtgcgcttggatattgtgcaggcgatggaccaggatgcctgcaaggatgtggaagttattggctggttgtaccagtactacatttcgcaggtaaaggccgaaattaacgactcaaagaagaagattaccgctaaggagctagcccctgtcacccagctgtttaccccacactggatcgtgcggtatttggttgagaacacggtgggcaagcagtggctgcgcgcccacccctcttcccctttgcgcgagcagatggagtatttggtcccctccgcccaggggcaagaagatgccgggttggccattggggatcctaccgagttccgaattgttgatcctgcttgcggttctgcgcacatgctgacgtacacgttcgacctgctgtggcagatgtacgtcgaggccggctattcttcctccaagatcgccaatttgattttcacccacaacctgacgggtatcgagattgaccgccgcgcggtacagttggcttctttcgccttggccatgaaggcacaggagcacgacagacgctacttggaacgctccggggtggccagcccaaacattgtgcatatccgctcggtggcgatcccgcccatctcccccgagcaataccagcgcatttgcgaccagctagccggcagcgccgagcagctgccttccctaaaggagctaaacaagctgatcgaccagctgggcgaggcctccaccttcggctccctaattcaaccccccgccggagcgtacgaagtactgcaacagctgaccaacgttgccgatccagcacttatgggcaccgaccctgacgagctagcagcagccgcaacaatagttaaagccctgcataacagccagtacaccgccgtggtagctaatcccccgtacctagggagcaaacatcattctccgttattgaagaaatttctcggtaaaaagtacactgcacacaaggcagatctcattacgtgttttatgaccagaggccgaactctagttcaagacgctggcgcttggggaatgcttacgctaaataactggatgttcttgagttcgtttgaaaattcaagaaaacaattgcttaacgagaacacgatttccacttttaaatgctcggcagaggcatatgtggtgtcgctatggatttttgcgtttttacgtgtatcaacacgcctccctctgaaagaacagaaatacaattcatccatcttgcagatcgtgctgaaactccctcggacgaaatgcgtaccggaagatttttcgatgcgctaa

SEQ ID NO: 2722 - DNA, 3633 bp, Enterococcus faecium; identical to SEQ ID NO: 2445

SEQ ID NO: 2723 - DNA, 3606 bp, Escherichia coli
atgaataccaataacattaaaaaatatgccccacaggcccgtaacgacttccgcgatgcggtgatccagaagctaacgacgcttgggatcgctgcagataaaaaaggcaatttgcagattgccgaggccgaaaccattggcgagaccgtgcgttacggtcagtttgattacccgttatcgacccttccccgccgcgaacggctggtaaaacgcgcccgtgagcagggttttgaggtgctggttgagcactgcgcctacacctggtttaaccgcttatgtgcaattcgctatatggagctacacggttatcttgagcacggcttccgtatgttgtcccacccggagacgccgaccgcgtttgaggtgctggatcatgtgccggaagtggcagaagccctgctgccggaaaataaggcgcagctggttgaaatgaagctttccggtaatcaggacgaagccctgtaccgcgaactgctgctggggcagtgccacgccctgcaccacgcgatgccgttcctgtttgaagcggtagatgacgaagcggaactgctgttgccggataacctgacccgtaccgactctattctgcgtgggctggttgatgatattccggaagaagactgggagcaggtagaggttatcggctggctgtatcagttctatatttcggaaaagaaagatgccgtgattggcaaagtggtgaagagcgaagatattcctgccgccacccagctgtttacgccaaactggattgtgcagtatctggtacaaaactccgttggccgccagtggttgcagacctacccggactcgccgctgaaagacaaaatggagtactacatcgagcctgcggaacaaacgccggaagtgcaggcgcagctggcggcgattaccccagccagcattgaacccgaaagtattaaagtgctcgacccagcctgcggctccggtcatattttgattgaagcctataatgtgctgaaaaatatctacgaagagcgtggttatcgcgggcgtgatattccacaactgattctggaaaataatatttttggtcttgatatcgacgaccgcgcggcacagctttccggctttgcattattaatgatggcgcgtcaggatgaccgcagaatatttacccgcgatgtacgtctgaatattgtctctttgcaggaaagcctgcatctggatatcgccaaactctggcagcaactgaatttccaccagcaggtacaaaccggcagtatgggggatatgtttgctgaaaataacgcgttaacccaaactgacagcgcagaatatcagctgctgatgcgcacgctgaaacgctttgtgaatgcaaaaacgctgggctcactgattcaggtgccgcaggaagaagaagcggaactgaaggtattcctggacgcgttgtatcgcctggaacaggaaggcgatttccagcagaagacggcggcaaaagcgtttattccgtttattcagcaggcgtggattttagcgcagcgatatgatgcggtagtggcgaatccgccgtatatggggggtaattatatggagacagaacttaagaatttcgtctcttcttactaccctcaaggaaaggcggatctttattcttcatttatggtcagattacttttacaattaaaagataatcgcactttaagcctaatgaccccctttacttggatgaatttatcatcatttgaagagctccgaaaaattatacttacaaatttcagcattcagtcattagtacagcctgaatatcattcattttttgagtcagcttatgtcccaatttgtgcttttagcatttcaaataccccattaagctggaatgcaaaattttttgatttatcagatttttatggagaaaaaaatcaagctccaaattttcagtatgcaattaaaaatgacaataaatgtcattggaaatataacagaatcaccacggactttctatgtactcccggatatatcattgcttactctctgcctgattctgcgttatcttgcttcaaaacatccaaaaaacttcatgatgtttgcaatctaaaacaaggattaattactggtgataatgaaagatacctaagattctggcatgaaatcagctataactctttcagtctcaatgaaaaaagaaaaaaaacaaaatggttcccatatcaaaaaggtggtgcataccgtaaatggtatggtaataatgattatgttgttgactgggagaatgatggttattccattaaaaacttttataatgacaaaggtaaattacgctcacgccctcaaaacatacaattttattgtaaagagggtttaacatggacaagtttaactatttcgtcactatcgatgagatatgtaccaaatggatatatttttgatgcaaaaggacctatgtgttttccgaaatcctctttggatatctggaatattcttggctatgcgaatagcaaagtaatagatatatttctcaaacaattagcgcccaccatggattattctcaagggcctgttggaaatgtcccattcaaatttaacgatggtgatttgaacgagataataaaagaactcgtaaacattcacaaacgtgactgggatgaaaatgaaacatcttttgagtttaagagagatatgttggttcatttttcaagagatattaacactattaagggtagttttacactaaggcaaggggaaaataaaaaagcgattaacagaacaaaatttttagaagaaatgaataactctttctttataaattgctttaatctaactgatattttatctccagaaattgaactaaacaaaatcacgttaacgcatgcaactattgaaattgatattcaaaaaataatttcatatgcaataggctgccaaatgggacgttactcccttgatcgcgaaggtctggtatacgctcatgaaggcaataatggcttcgccgatcttgtcgccgaaggtgcttataaaagcttcccggctgatagtgacggcattctgccgctaatggatgaagagtggtttgacgatgacgtcacctctcgcgtcaaggagtttatccgcaccgtttggggcgaagaatatttgcgcgaaaacctcgattttatagccgaagttctcaagcccaaaaaaggcgaatctgcgctggagaccattcgtcgctatctttccacccagttctggaaagatcatctgaaaatgtataaaaagcgtccaatctactggctattcagctccggtaaagagaaagcgtttgagtgcttggtgtatctgcatcgctataacgatgccacgctgtcgagaatgcgtaccgaatatgtggtgccgctgctggcgcgttatcaggccaatattgatcgcctgaacgatcaacttgatgaggcttctggcggtgaagccacacgtctgaaacgcgaacgcgacagcctgatcaaaaaattcagcgaactgcgcagctatgacgatcgcctgcgtcactatgctgatatgagaatcagtattgatctcgacgatggcgttaaggttaactacggcaagtttggcgatctgctggcagatgtcaaagccatcaccggcaatgccccagaggtgatctaa

SEQ ID NO: 2724 - DNA, 3741 bp, Vibrio cholerae; identical to SEQ ID NO: 2398

SEQ ID NO: 2725 - DNA, 3741 bp, Vibrio cholerae; identical to SEQ ID NO: 2398

SEQ ID NO: 2726 - DNA, 3642 bp, Fusobacterium necrophorum
atgaataaaagcaatttgaaaaaatttgccatagaagcaagacaggaattgagagagaaaacaaaagctcaattaaaacgactaggaatcgaagaaaagaaaatagaagaaggaaaagatatgggatctcaggtagaaatctatgggaaactatattctaaatccagttatcaacatcttcttgtaaaatatcattctttaggatatgaagaattggtagaagaaagtgcctatctttggtttaatcgtttgacagctttagcttatatggaacttcatgattgttttacagagcatatgattttttcgaaaggaaataaaggggaaccggatattctggatgaatactttcaagctgatttttttcaaaagatgcctttagaaaagcaggaagaacttcatcagctacgagataaaaatacttcagactctttggaaacactttattctattttgatggaagaaaaatgtgaggaactttctaaaattatgccttttctattctcaaaaaaaggaaagtatgcagatattttgtttccaagcggcttattgatgcaggattctgttctaaaaaaattgcaagtcattttacttgaaatacaggaagaagaccaaagtattccggtagaaattttaggttggttgtatcaatattataactctgaacgaagagaagttgtgtatgatggtagtatgaaaaaatctaaaattaaaagagaatttattccggcagcgacacaattatttaccccagattggattgtgcgatatattgtggataacactgtgggaagattagcagaagaacagttttcaatttctaaggatattatcaaaaaatggcaatattatatagctcctgaaatagtatccaagaatgaaaaaatgcaaatagaaagtctcaaaattttagatcctgcaatgggtagtggacatatgttaacctatgcttttgatattctttttgatgtgtatcaagaattgggttggagcaaaaaagagtcggttctttctattttacaaaacaatttgtatggattggaaatagatgatagagccggacaacttgctgcttttgcattgcttatgaaaggaaaagagaaatttccaagattgtttcaagttttggaacgagaagaaaattttgaaatgcctgtcatttctttacaagaaagcaatgctatttccaaaagaatgtatacaatgttagaagaatgtcctactttacaagacttgttaaaaggctttgaagatacgaaagaatatggaagtattctaaaaatagattctttcgaagaaagtatactgcaagaggaatatcacaagttgcaagaaaagattcaaaatcaaggacaattttctctgttaaataataatgaattcttagaaggagatttagaagaagacttagaacgattagaacatattatccgacaatacaagattatgatacaaaaatatgatgttgtcattaccaatcctccttatatgggaaatgcaaggatgaatcctaaattgaaaacatatattgaaaaatactatcccaatgtgaaaacagatttattttccgttttttttataaaatgttgtgaaatgacaacagaaaaaggatacttagggtttatgtcaccctttgtttggatgtttattaaatcctatgaggaattgagaacactttttatccatagtaaaacaattatcagtttagtacaattagaatattccggatttgaagatgcaacagttcctatttgtacttttatattacaaaatactgtaataaaaaaaataggggaatatattaaactttcagactttaaaggggtcaaaaatcaacctattaagacattggaagctattcaaaatgaaaattgtacttggaggtatcaagccaatcaaaaagactttacaaaaattccgggaagtcccattgcgtattgggtgagtgatagaattagggagatttttgagaaagaaaaaaaattaggagaagttggagatgcaaaagtaggattacaaacaggagataataataaatttgttagactttggcatgaaattaattttaataaaataggttttggtatgcaaaattccgaagaagccttaaaaagtaaaaagaaatggtttccttataacaagggcggagaaaaaagaaaatggtatggaaatcaagagtatgttgtgaattgggaaagagatggatatgagattaaacatttctgtgataccaatgggaaattaagatcaagaccacaaaatacagaatattattttaaaaaatcaatttcttgggggttaattacttcttcaggctcatcgtttcgtttctatcctgaagggtttatttatgatgttagtggaatgagctattttattgaggataagtttcttacgtatttaggaatattaaatacaaaaatttattctaaattaacaaaactaataaacccaacaattaatttacaaattggagatattcttaatttacctgttgcaaatatacaaaatcctttatttgagcaattggttagcttaattctttggatttcttttgaggagtgggcatctcgagaaacttcatgggattttgagagattgacattgttaaacggagaaaatctatccaaagcatataaaaaatattgtacttattgggagagtaaattttttagtgtacattcttctgaggaagatttgaatcgtattttattggaaagttatagcttacaagaagaaatggatgaaaaagtagatttctctgacattactttattgaagaaagaagcttccattgtagagaatacagatagtgctgcttcttgcggatatttggaaaatcgtggagtaagattggaatttcattcgttagagttggtaaaacaatttttgtcctatgcaataggttgcattatggggagatattctttggacaagcccggtttgattatggcaaatagtgatgatgtgttaactatgagttctaataaaataacagtgagtggagtgaatggagcaattcgccatgaaattttaaatcctagttttttcccggaagaatttgggattctttccgtaacaacagaagaacgatttgaaaatgatgttgtaagtcgtgtgattgcttttatttctgctgcctatggaaaggaacatttagcggaaaatctagaatttattacagaagttttaggaaagaaagcgggagaatctcatgaggaagtattacgaaattactttatcaaagatttttacacagaccattgccaacgttatcaaaaaagaccaatttattggatgttacatagtggaaagaaaaatggattttctgctctcatctatttacatcgctatgaaaaagataccatagcacgaatgcgaagtgattatttacttccttaccaagagtttatggaacaacaggaagctcattatagtaaaattgcttctgatgagatttctactccaaaagaaaaaaaagatgctcaaaagaaagtgaaagaattacatgatattctgaaagagttgaaagactatgcaaataaagtgaaacatattgcagaacaaagaatttctttggacttggatgatggagtaaaagtcaattatgaaaaattgggaagtattttgaagaagatatag

SEQ ID NO: 2727 - DNA, 3741 bp, Vibrio cholerae; identical to SEQ ID NO: 2398

SEQ ID NO: 2728 - DNA, 3357 bp, Xanthomonas vesicatoria
atgatgcaagcactcgacaaagacctgcgcagcgcgctggaaaagaccgtcaaagcggcccgcacggtggcggagacggctgcgaacgcggccgtggagcaactgggtgtcgggcacgacaagcccgaagctttcctgagcaatgacgagaaggcgctgcgcaaccgcctgcgcacccacggtaagcagcttggtgacgcccgcgactcgaagagcaccaacccaacttacggcaagcaagccgtgcagcacctggtgcaagaagtggcctaccagcactggcaccgcatgctgttcgcgcgcttcctggccgacaacaatctgctgatgtacgacagcgtggccgtcaccatcgaagagtgcgatgagctggcgcccgacgaaggcgccaagagcggctgggagctagccggcaggctggccgcccgcatgctgccgcaggtgttcaagcccggctcaccagtgtttgagctgacctttgcgcccgagcaccagagcgaactggaacgcctgctcaagcacttgcccgatgccgtgttcaaggccagcgacagcctgggctgggtgtatcagttctggcaagccgacaacaaggaacgcatcaacaagtcggaagtgaagatcggcgccgacgagttgcccgccgtcacccagctcttcactgagccgtacatggtggctttcttgctgcacaactcgctcggcgcttggtgggccacccggcatccgtgcaagccatgtccggtgaacctcgactatttccgcaccctggaagacggcaccccggccgcaggcaagttcgagggctggcccgactcgctggccgacttcaagttgctcgacccatgctgcggttcgggtcacttcctggttgccgccttcctgatgctggtgccgatgcgcatggctgcggagggtctgacggccaaggaggcggtgaatcgcgtgctggccgagaacatccatgggctggagctggacccgcgctgcgtggagatcgccgtgttcgcggtggcgttggaggcatggcgttatccggatgcatctggcaggccgctcggtgttggagagattccggcccccaacatcgcgtgctgtggcctcaaggttgcggcgaaggcgcaagactgggaagcgctggttccagacgaagcccccaacgctgaatacgtgcgtcaagagttgcgccaactgcacgccagcttttctgatgcgccactgcttggcagtctgctggacccggcacgtagcctgaagaatgacctcgccacctccagttatgagacgttgagggcgttgttgcggaaagccttggccactgaacgcccagccaacctgctggctgaggacgatgaccggtgggatctggcgctaagtgctcaaggattgcttgaagctgcgcgtcttttggatgcgcgctatcacttggtgataacgaacgtcccatacctctcacgggccaaacaatctgacgttctaaaggactattgcgaacggcactatcaggaggcaaagaacgatctcgccaatgtttttctggagcgctgtttggagttggcgcgagacgcgggcgtaactcagattgttatgccgcagaactggctatttctcgcaggatacaaaaagcagcgagaaaaattgctcaagacgaccctctggaatctattggttcggcttggaccgggcgcattcgaaacaattggcggggaggttgtaaacgtcattctcatgacccatacgcggaagcagcccactcccaatttcatgctcaggggaatagatgtcagtacgtctaggccggcacaacagaaggcaaaaaaccttgtaactgagccattggcatctgtgtctcaatccaaccaattgagcaatcccgactcgcgagttgcactttctgatattcaatcgggaagcctcctcgccgatattggcgattttggcaaaggaagcacaacaggcgatagtccgaggttcttgattgagttttggcagattgcgcgactgcaaccctcaaatgtgccctgggtcgattcaccaacccctagagcaccttggtcgggcaggtcgcttgttaccaccgtgtgtctagacgatccgaacctgaacgcccagttaggctgttggctacggggtaacgcagtgtgggggaggcgtggtgttgctgtaaataaaatgaaggaattggagccattcctttattcgggtgaagtttttgacgataacgtttgcccaattgttccaggagacgaatcgctcataccagccatctgggcgttcgtgtcggacccaagctatcgggaagctgttcgcgaagttgatcgggccctgaaggttactgccggaacgcttaccaaagttcccttcgacgcgacctattggagccaagtagcaaaggaaaaataccctactggtttgtcaaaaccgtattcggacgatccgacccaatggctgtttcacggccatccacgatcagcttccgacccgctgcaagtcgcagtcgctcgcctagtcggttacacctggccagccgaatctgacgacaagatggagttgtcagatgaggcgcggggatgggtctcgcgcagcaagacgctcgcgagtcatgccgacaaagacggcatcgtctgcattccgcccgtgggccgggaggcatcagccagcgaccgtctgctgaatctgctggtggatgcctacgatgcagactggagcaacgacgtcctggcacagctgctgacggccgccgaccacgccggcaagtcgctcgaaacctggttgcgcgacaagttcttcacccagcactgcgcactgttcggcaatcgcccgtttgtgtggcacatctgggacggcctgcgcgatggctttgccgccttggtcagctaccacaagcttgactacaagacgcttgaagccctgatctacacctacttgggtgactggatcagccgccagaagcgcgatgctgagagcggcgtcgacggagctcaggaaaagttggcggcggctgatgcactgaagaagcgcctggagttgatcctggccggtgaggcgccctacgacatcttcgtccgctggaagcccattgagcagcagcccattggctggaaccccgatctcaacgatggtgtgcgcctcaacatccgccccttcctttctgttgctgatgtcggaaaaaagggtgccggtgttctgcgagacaaaccaaagagtctgcattgggaaaaggaccgtggcagtgatgtgccgtctgcaccttggtacgagcttggcctgcagtacggcggcaaggtgggcgaccgcatcaacgaccaccacttgagcttggccgacaagcgcaaggcgcgggagaaggccaaatga

SEQ ID NO: 2729 - DNA, 2199 bp, Lactobacillus zeae
ttgttcactccaaactataatcagagcgtcatcaagaacctggtaacgatgatttctgaggaggatttcgacgtatccaaggaggggcaggtcgaaattattgggtggttgtatcagtattacaatagtgaaccaaaggacgaggcattcaaaaagaagaagtacgactcttccgagattccagccgttacgcaactttttacgcctgactggatcgttaaatatctagttgaaaattctctcggacgatactggatccgagtcttacatgctcgaggagataagcgatccgcttcagaaatagcttctaattttgcctggaaatacttcatgcccgaagctaagcaggaacaagacttggcacaaccagaatttgccgaaaaaaaagtcgaggctattacgtttgatgatccagcaatgggatcaggtcacatactgatctatgcctttgaagttttcttacagatttatgaatcggaaggttactcacgtcgagacgctgccaaaagcgtagtagagaacaatcttcatggttttgacattgatcgtcgggcatttcagcttacctactttgcggtcatgatgaagttccgtgctgagaatcgtcgtgctctaagattagatttgcgaccaaacgtttttgaggtgccaacaaccggtctgacattagccgactttggtattgagaaagatacaaacaagcaaataactaaaaatctagctgagctactggcaaattttaaaaatgcaaaagaattaggctcacttctagatttttcgacagttcaactaaacgacgaattaattaattcgattgttagtactaaaagagtaggacaattatcttttgatgagtctcagagcttggaacatcacaatgagctttctaagctaattgctgtgggcacagcattacagaatcgctacgtgataaatgttacgaatcctccctatatgggatctggaaagatgccatccatattatcaaggtttgtaagtaaacactatccagcaagtaaatcagatttatttgcagcctttattgaacgtcttcatggtatgacagatgaagatgggctgtttgcgatgatcacacaacatcaatggatgtttctctccagcttcaaggcgcttcgtgaacgcatgatgaattggccaattattaacatggcacaccttggcacacgagcgtttgaagaaattggcggtgaagtggtacaaaccacggcatttgttatacagaagcatcctgaaagtgaatacgttggcacttatgaacgcttggtcaactttgattctcagtcaaagaaacaaaaggcgtatcttgaagcggtcaagactccttctcttaactatgtttatcgtactaatcaaacgaattttgagaagattccgggaagccctattgcttattgggcaagtaaaaatctaattattgattttgaaaaaggtgttaatttagatacgattgttgaccctaaggcggggcttacgacaggggataatgctctatttcttcggcagtggtttgaagttagttctgagaacattttttttaatgctcactcaaatgaagaagccactaaatcaagtgccaggtggttcccctacaacaaaggaggttcctacagaaaatggagcggaaattatgatttcgtagttgattggaaaaacaatggagttgcaattagaaactttaccagaggaacaacacaaatcaagtctcgcgttatgagttctgatacgtattttcattcagcaattacctggtctctcataacaagtggcggattcagcatccgttaccgtcgttcagggagtattcatgatagtgctggcaaagaggcttttggatcggaatctaacttacttttagttttagggttacttaattcaaaactcggagactatatttttaagttattgaacccgacaataaatatgcagattggcgattttagaaactttccagtattgaaaataaactctcaattgaatatatgtggaatcataaaacaaaatattgaattatctgatttggattggaatgttgatgaaacttcatgggattttttaacaaacccgttaagtgcttctatcgctgagcataatcgagcatctccgacaaaatccttgcatttcaaagtcatttgtgacaaatatgtgccaactatgcaaggaggttgtattaatggttag

SEQ ID NO: 2730 - DNA, 3558 bp, Lactobacillus zeae
atggataaaaaagccattaacaagttcgcggttgaagctcgtcgagaattaatcactgacatttctctgcgtctccgcaatctcggcattacggagtctggtattgccgcgaaggaagaaagatcaaccagccaaattgaattctacggtccggatgtgccgcccgttattggggaagacatcaaacggcgccaagctttggtcaatcgtctaactgcgatggccaaagacaagagtctgaaagatgcaattaaagatctcaccgaagaggttgcctatacatggtttaaccggattattgcaattcgattcatggaagttaatgggtatttacctagtggtgttcgtgtgctttcttcagaaacacaccgcaatgaaccagacattcttcgggacgcatttgatgctgaggacgcgctcggaggctatacgcctgacgaacgcaacctgattagaaaggcacaggaaactgagctacctaaagatatggacagtgcatatgcaatgctgttcactaagcaagcgaatgctttacacaaaaacttgccggagttgttcgaaaaaacggatgacttcatgcaattattgttcactccaaactataatcagagcgtcatcaagaacctggtaacgatgatttctgaggaggatttcgatgtgtccaaggaaggtcaggtcgagattattgggtggttgtatcagtattacaatagtgagccacacgatcaggttgtgaacatcaatggcggcccggtcaaaactagtgacattccagcagcaacacaattatttaccactgattgggtagttcgttacatgattgataattctctgggaaagctttatttagagcattatccaaactcgccaattaaggacgatttgaaatatcttttgccaggacctattgaacgcactgataagcccttagatttagccgatttgaaagttcttgatgacgcgatgggttctggacacatcttggtctatgcttttgatttactgatcaaaatgtatgacgagcaaggttacagtaatcgcgaagctgcagccatgattttggcacataacttgtacggtctggaaattgacaagcgtgcttaccagttggcttactttgcgctcatgatgaaagctcggcaatacaaccgccgaatattgcgcaaaccaattcaacatcatttaaacgtctttgagaatatgcagaaaataccggaagatgtatttgcagagcttaaaggaaactctgaaacgattgccgatattcgtgatcttattcagactttcaaagagggcaagttgttaggttcaattatgcatttcgaaaagaattatgaccttgtagcaattcggcaagctattgatacattaccagagaatactggattagatgtctttggtattcatcaagcaaaaaaggccctaggtcaaatggtctccatagcaagtgttcttcagactaagtttgacgtagttgcgactaatcccccttacttgaaccgaatgaatggcgatctcaaaaagtttgtgaagaagtactacaagccatactcaggtgatctcttttcagtatttatctggaaaaatatcaacatgacgaaacaaaacggatatgcggcattcatgacacctttcgtttggatgtttataaagacttatgaatccttgcgtcgcaacattctcgaaaatcaacaaatatcaagcttaatacaaatggagtattctgcgtttgaagaggcgactgttccgatcaacacttttgttgtcagaaattctcagagccataattttacggggacttacctaaaactctcagattttaagggcggcatggaaatacaacggcagtatgttaaaaaggccattgaagatccgtcagtttcgtatgtttatcgtactaatcaaacgaattttgaaaagattccgggaagcccagttgcttattgggtgccagaaaatgtatttgaaaaatttcagaattctccgtcaattagtgattttctttttgccggagttggtattcaaactggcaataacctgcgttttctcagaagatggtatgaagtttcttttcaaaatataaaatttaatgcatgcgatgcaatagatttcgctcgcacttcaaaaaagtgggctcctatttcaaaggggggaccgtacagaaaatggttcggtaatttagaatatgtcattaattgggaaaacaatggtaatgagatcaagcaacatcttggggcatcaaaacaaaaagcaattgtaccaaatgaacaattctatttccattctggatttacttggtctgacattactagcggaaaattcagcatgcgactcctcttgccaggaatgctattcgaaagcaatgctttatccgctttttcaaagcagaagaatatatccgaccgctatttaatggggtttgcgaattctacggttggaaattatctcctgtcaatcttaaacccaacgatccatatgaaatcaggatattttttaaatctacctgtttcaaggtccgcacaagaaccgaatataaccgagaaggttagacaaaatattgttctttgccatgtcgattggaatttagatgaaagatcttggggatttaaatgggatctgttagtttcatgtatcgctgagcataatcgaaattggacagttgaagctgcgttcaatcagtggaagcgagaagcagaagatcgttttaaccagctgaagtcaaacgaagaggagctaaatcgcatctttatcgatctctatggtttgcaggacgagttgtctcctgaagaagacgataaagaggtatctgttcgcaaagcagacttgacgcgggatattaaagcatttatttcttacttcattggctgtgtctttgggcgttattcgatcgacacaccaggcctcgcttttgcaggagggtcgtgggattctactaagtatgaaacgtttaagcccagtgccgatgactttattttgttaactgatgaagattactttggtgattcgcgggacattattaacagattcaaagagttcttgaccacgacttttggcgaagagcatttggctgaaaacatgaagtttattgctaatgctttgggcaagcgaggtagtacaccagaagaacaaatccgttcatacattcgagatgacttctaccaaaaggatcatctttcaacttaccagaaacgaccaatttattgggaattaaattctggaagaaacggcggatttgttggcttaatgtacctgcatcggtataatactgggacgatggcgatgattcggacgaagtatttacatccgctgcaagaagcatataagcagcgtctcgaacagcttcaaaactttgcagagaaggaaaaagagactcgccagaaaaatgcttataagaagcaaatcagtaaactgacaaaacagatgacagaattagtgaagtatgatgagcagcttcagcacgtagcaaatctaaatatagatttggatctagatgatggcgtgttggtaaaccacgagaaacttcaagcaggaactaaaattctgacaccaattaaatga

SEQ ID NO: 2731 - DNA, 3891 bp, Bacteroides ovatus; identical to SEQ ID NO: 2709

SEQ ID NO: 2732 - DNA, 1137 bp, Escherichia coli; identical to SEQ ID NO: 2632

SEQ ID NO: 2733 - DNA, 1908 bp, Escherichia coli
atgaataccaataacattaaaaaatatgccccacaggcccgtaacgatttccgcgatgcggtgattcagaagctaacgacgcttgggatcgctgcagataaaaaaggcaatttgcagattgccgaggccgaaaccattggcgagaccgtgcgttacggtcagtttgattatccgttatcgacccttccccgccgcgaacggctggtaaaacgcgcccgtgagcagggttttgaggtgctggttgagcactgcgcctacacctggtttaaccgcttatgtgcaattcgctatatggagctgcacggttatcttgatcacggcttccgtatgttgtctcacccggagaccccggccgcgtttgaggtgctggatcatgtgccggaagtggcagaagcactgctgccggaaagtaaggcgcaactggttgagatgaagctttccggtaatcaggatgaagctctgtaccgtgaactgctgctggggcagtgccacgccctgcaccacgcgatgccgttcctgtttgaagcggtagatgacgaagcggaactgctgctgccggataacctgacccgtaccgactccattctgcgtgggctggttgatgatattccggaagaagactgggagcaggtagaggttatcggctggctgtatcagttctatatttcggaaaagaaagatgctgtgattggcaaagtggtgaagagcgaagatattcctgccgccacccagctgtttacgtcgaactggattgtgcagtatctggtacagaactccgttggtcgccagtggttgcaaacctaccccgactcgccgctgaaagacaaaatggagtactacattgagcctgcggagcaaacaccggaagtgcaggcgcagctggcggcgattaccccagccagcattgaacccgaaagtattaaagtgctcgacccggcctgcggttccggtcatattttgattgaagcctataatgtgctgaaaaatatctacgaagagcgtggttatcgcgggcgtgatattccacaactgattctggaaaataatatttttggtcttgatatcgacgaccgagcggcacagctttccggctttgtattattaatgatggcacgtcaggatgaccgcagaatatttacccgtgatgtgcgtctgaatattgtctctttgcaagaaagcctgcatctggatatcgccaaactctggcagcaactgaatttccaccagcaggtacaaaccggcagtatgggggatatgtttgctgaaaataacgcgttaacccaaaccgacagcgcagaatatcagctgctgatgcgcacgttgaaacgctttgtgaatgcaaaaacgctgggatcgctgattcaggtgccgcaggaagaagaggcggaactgaaggtattcctggacgcgctgtatcgcctggaacaggaaggcgatttccagcagaaagccgcagcgaaagcgtttattccgtttattcagcaggcgtggattctggcgcagcgatatgatgcggtggtggcgaatccgccgtatatgggcggtaaaggaatgaatggtgagctgaaagagtttgctaaaaataatttcccggatagtaagtctgatttgattgcgatgtttatgcagcgtgctttttccttgcttaaagaaaatgggttcaatgctcaagtaaatatgcaggcctggatgttcttgtccagtttcgaatcattccgcgaatggctgttggataacaagacgttaatcacaatggctcatctaggttcaagagcttttagtcaaatttctggtgaggttgtgcaaaccacgtcatggattataaaaaataatcatattaaagattacttaccagttttcttccgcttgacagacggcaatgaagaacagaaaaagaaaaatctttaa

SEQ ID NO: 2734 - DNA, 1137 bp, Escherichia coli; identical to SEQ ID NO: 2632

SEQ ID NO: 2735 - DNA, 1908 bp, Escherichia coli; identical to SEQ ID NO: 2633

SEQ ID NO: 2736 - DNA, 3516 bp, Coprobacillus sp.
atgaataaaacagcaataaaaaactatgctgtatgggctcgtaatgaattaattacaagagttacacgtaaagcatttgaatatggtattgataaagataatatcgttgatataaatactgataatataaatggaagaatacttactaaagatgaaaaagaacaaagaaacaaacttataaaagaaataaatgctaaaggttttgaacaagttatagaagaagttgcttatacttggtttaaccgttttatcgcattacgattcatggaagtaaataactacttacctaatagaatacgtatatttactaactttgataatgaatttaaaccacagatactagatgaagctatgaatctagaattagaaggattagataaaaagttagtatatgaattactagatgctaataataaagatgaattatataagcaattattaatagccacttgtaatgatatgggtaattacttaccaggtatgtttactaagatattggattataaagtattattatttcctgataatttattaaaccaagatagtgtattaggacatcttgtaactgatattgatgaagataattttaatgtaaaaaaagaaggacaaattgaaatcatagggtggatgtatcaattttataatattgaacctaaagcaaaagtatttggaaaatccaagggagaaaaaatatcaaaagatgaaatacctgctgctactcaattatttactcctgattggatagttcgatatatggttgaaaattcattgggaagaatatgggttgaaggacatccaaatgaactattaaaagaaaactggaagtattatttagatgaagcaaagcaagagtccgaagtagaactaaaattaaaggaattaagaaatagatacgctgaacttcctcctgaaaagattaatctaattgatccctgtatgggaagcgggcacgtacttgtttatgcttttgaaatacttatgcaaatttacgaaagttatggatatactaaacgagatgctactataagtattttagaaaaaaacttatatggtatagatattgatgagagagcttatcaattagcttatttcgcattaatgatgaaagctagagaataccatagaacaatcttgtcagcaggtattaatttaaatctatcatttattgtaaatagtaaaagtctaaaagaatccgaattagagagattagaagattgtaaaaacattgctgctaaattaataagtgattttaatgatgcagaagaatatggtagtattctaaaagttaattattctgttgaagaccttactaaacttcaaaataaaattagattattagaagaatcaaataaaaacttagtagatatcattgaaattgacaacatctctagtaatttaattccattaattaaacaagcactactcttaagtaataaatatgaagttgttattactaatccaccttatatgcctattagtaatggtagtaaagtgttgcaagaatatgtaaagaaacaatatcctgatagtaaaactgatttgtttgcagtatttatggaaagttgcaaaaacatgttagtggaaaatggatttcaggcaatgataaatatgcattcttggatgttcttatctagttatgaaaatcttagaaaaagaatcttagaaaataacataattattaatatggcacatttaggtgcaagggcatttgaagaaataggtggagaagtagtgcaaactacaacgtttgttttacaaaatacatactacaaaaattatgttagtacttttaaaagattggttgattataatagtcaacaaagtaaagaatatgctttttttgacgataaaaataaatatatagctgaaatgagtaattttaataaaataccaggaagtccaatagcatattgggtcagtacaaagatgattgacgcatttgataatagaaaaattggagatttaggaaatcctagacagggtatgattccggggaatgttaatgaatttttacgtttatggtatgaagtgggatttaatagaatcggattcaatcataataatagcgatgatattgtagaatacaaatataaatggtttccttataataaaggtggtgcttttagacgatggtatggcaatatggaatatattataaacatggaaaataatggatatgatattaaatattctggaaaaaataataattatagactcagagaacctgagttatattttaaagaagctataacttggtcaaaaataagcagtggaagtttttcggcacgatatatgcctgttggaaatttatttgatattgcaggatgttgcatatttgatcttggcactagattatattatatattagggtatacaaattcaaaagttaattctagtttattaagtcttattagcccaacattaaattatgaggtagatcatataaaaaaattacctgtacgaattgataatttaaaagtgaaggaagtaaattccatagttgaatcaagtattttattgtctaaacaagattgggattttttcgaaacttcttgggattatcaaattcacccattagtaaagctaaagatgctaaatggttacagtgatgatagaactggattaaattgtactattaaatctgcttttgctaattggcaaggtgattgcaataaacgatttaatactttgaaatcaaatgaagaacaactaaatcgcatctttattgatatatatggattacaagaagagttaactcctgaagttgaagataaagatgtaacagtaagaaaagctgatttagtgagagatataaaatctttaatttcttatgcagttggctgtatgtttggtagatattctttagatgttgaaggtttggcttatgcaggtgggcaatgggatgatagtagatataaatcatttatacctgatgtagataatattattcctatatgtgatgatgaatactttgatgatgatattgtaggtagatttgttaagtttgttgaagttgtttatggaaaagattctttagaagataatctaacttttattgcaaatgctttgtctaataaaggtaacacatcaagagaagtaatacgaaattattttataaatgatttctttaaagaccattgtaagatatatcaaaaaagaccaatttattggctatttgacagtggtaaaaaaaatgggtttaaagcattaatatacttacatagatatcaaccagatttaattgcacgtatgcgtactaaatatgtattcgaacaacaatctagatataaaaatcaaatcgatttattaggaaatcaattaaataatgacatatcttcttctgaaaagataagattgaataagcaattaaagaaattcaaagaacaaaatgaagaattaagacaatatgaggaaaaagtacatcattacgctgatcaaatgattaacattgatttagatgatggggttaaagttaattatgagaaatttaaagatttattagcaaaaattaaataa

SEQ ID NO: 2737 - DNA, 4263 bp, Haloarcula argentinensis
atggacggacaatctacccacccccgcaaggcgcagctcgacaaggaagaacgcgagcatctcgaagatgtcgttaccgagatgcgcgaccgcgtcgaggcgaacgttcggtaccagctcgaagacgagtacggcctcgacgtaaaacccgacaccgtcggagcaagctccgacgagccctccctcgctgacgctcgcgaggacgacgacgcgtccctgagcgaggcgcaggaaaacctggtcgaggctatcgaactcgaagccgccgatggtcacagttgggaggacgctcacgagcagtatatcacgggcgtcggctacaccattgtcaaccgtctggcggcgctccgttgcatggaagtccgggacttcatcgaggacgaagtgacggccttccgcgacgacggtctcacgcccgccgcagaccggctagtcaccgaggagttcatgctcgaagaggaggccgtcctcgaagcctatcggaacgcgtgcgacgacctcgctgatgaaatagagatcctcttcgaccgctcgacggcttacagccagatcgaccctgacgacgacacctacgaagacctctgcagtctgcttgataaggtgccagatgaggtctggcgggccgacgacgtgctgggctgggtttacgagtactacaaccgacctgtcgtcgaggcacttgacgcgaagaacacgctcgaaccggaggacgtggggccggcgaatcagttctatacgccgcactgggtcgtccggatgctcaccgacaactctcttggcaagctctatctcgaagccacaggacaggaatcgacagtaccggagcccgaggcgctcagtccagaggagcgcaaggaacgcttagtcacgccggaagacagcccgaccgttcccgaactctgtacgtaccttatcccggacgaggaagcgggtgccgcccccgagtttgaccatccctcggaactgcgagtcatcgaccccgcttgcgggagcggccatttcctcttgtacgcgttcgacgtactagagcgcatctggtgggccgagaccgacctcgaccgtgcagaaatcccggcaaaggtgctggagcacaacctctacggcgtcgatatcgacctgcgctcgtgtcagctctcggcgttcaatctgtatctgaaggccagaacacgtaccgaagaggaagacggccagttcgaaatgcccaacgtcgacatcgtctgtgcggacgcccgcgtggcggaggtcgaggaaggcgcagcagtgctggacgacatcaccggcgagggaactgacctacgcgaggcgctaggcgacatcatcgacacgttccagcacacggaagctcttgggagcctccttgacgtgagtgggacgcttgaggaggtgttcgactccagcaagacacagtccgaactcaccgactacaatgagggggctcatcagtcgttacactcctttttgaaggcactccggcgagctgtcgaagaacggacgagcgattcgttcggagaacagaacctcaagagcttcctgaatctactagttgtactgacccaagagtacgatgtttcgcttatgaatccgccatatggagcaagtggaagaatgcccccagatgtgcgggactatgtgcgagaccactataaatacgctgcagagtattatatcaatttctttgaggcttgcaacagagttactaaacaaaatggaagggtgagtatgattgtccctcggacatttatgttcaaaagctcctttgaagagtttagggaggacttcattggagcgcaggggtctttcgatttcttggctgaatacggtaacgacgtacttgataatgcaaccgtccgaactgcaggaacagtcgtccgagttggcaattatgccgatcaggaatctacaggtacgttcttccgacttcatgatgtgaattctcacagaaaggagggtacgttcctaaatacagcattcggagagggagatgacaatatcgagcgtctcttttctcgtcctctgtccgagttcgacaaaattcccggtagtccaatctcatactgggcacccccacaaatcagatccttatatgattcagatactgttctcgatgcagataatggaaggttgaatgataggaagagcttgggcgacgcaaagcagggcttgataacaggtaataacggcagattcgtcagaaaatactgggaggttgacagctacacctattggaaaccctttgctaaaggaggcgaggatgcttggattctcccgcaagtaaatctcacagttgcgtggggagatagtggagaagagatacgcaggtatgagggttctaggccgcagaatacgcagtatttcttcacggaagccctcacatatacgtatatgaaagaaagcggccgaaggtttggttaccttcaccctgaatcaatatttggccgtgcaggctgtgcatatatcccttcccggagcccgtggaatgttctctcatacacaaacagcaatcttgtaacctatcttatggtttgtcaaactcctgatcgtcaatgggaagttggatatgtctcaaaactcccatggcgtgacgaattaggtagcaacaccagacttgagagtctttcgcgtgaaatcgtaggccatttgatctctaaaagacggtatgattttgcgtctccatattacgaatgtccggtcttactgggcgttcttggagaagagacttcaccccagaaattcgaccacccccataaaggacttcgcgaggagttggagcttgatcagcctgatttctccgctaaaaaaggtagccctctgtcgaaattgggcactatagctgcgaagcacctcgaacaagttgaatataacctccaatcatgtgcgggagcaattgatgaggctgtctttgaccagttcgatatttcggctcaaaatcgagaaaccgtccttcaggaaatttcccttcgcacgaacgaagaccctcgtgagcgcaaagatcacgatcctgaatcgatcacggaaccttctgatgacttccccgaacaggtcaaagacctccttctccatttcactctccgagctatccacgacgccgacgacggcatcgtcccgctctcagaaatagaccgaaaagacgatctcctgacccacatcgaggcggagttcgaacgcgtctggggtaattacgcaactgatcgcctcgcggaagccgacgaggtactcggaaaccggagcgcgagtgatgaggcatacccgaatctccgcgcgtggctcgaaaacgacctgttcgagtaccatatctcgaagtttgatcggacgccgatcctctggcgcttctcgactgaacgactcgtctcggatcccgaaggtgaagggttcggctgcctcgtggactaccaccagttagacgcgagtatcttcgaccgtctacagaatcagtacctcgaacctcgacggacgcaccttcgcgagcggcgcgcggccgcgaacagccgccgtaatgatgaatcgctctcggcttctgagcgtgccgacgccgccgaggagtacgaacgctgtgagagcggtctcgaacagctcagcgccttcgaagagcagcttggtgagctttccgaaccctccccacgcgagtggcccgacgagaagcaggaacgcgccgccgaggcagccgaacgcgtggcggagttccgggagcggacagcgtcacggctagacactctcgaaaccctcgccgatctggaggacgtggatatgggagacctgttcagcccctcgttctacgagaccgttcaggggaacaaggacgagtggatcgacgcgctcgacgacctgcagaccgccttcgaggcatacgccgaggctggcaccgaacccgtcgaagctcacctctacgatctcttcgagtactacgacgatctcgtcggctcctcgcactacgcgagcaacgggattctgttcatgacgtactacttcgaccagttcgaggatgccgggcaggcccaaatcggggatgctggtgtctctgaacggcagcggcttctctcggaactcgccgccgacgttgacgagtacacgcaactggctgatgagatatccgaagactgtgacgaggtcgctgcggacatccccaacgattgggaagagcgcgcgctctcagaggtgacgaccaccggctaccagcctgtccacaagcacggcgtcgcgatcaacatcacgccgctcgctgagaagagcatcgtcccagaggttgtcgaagacaaggtgctctga

SEQ ID NO: 2738 - DNA, 3648 bp, Saccharomonospora glauca
atggtcggggcgagtaaaggggagcggcagactgtggcagtgcgtggtgctgacctgggtgagctggtgaaggacctgcgcaggcaggtcaccgtgctcgaagacgatttgcgggcgcgggcccaggaggtgtcggagttccacaccccgctgcgcgccgagtacgacgaggcgcgcaagcgggaacgcacggcggcgacgtgggagtcgtggctcgaccagcgggtgacgcaggtggctgcggcgtgggtgctgggcacggtgttcgtgcggttctgtgaggacaacgggctgatccagtggccgttcctcgcggggccgggggagcggctggcggacgcggaggagcggcacgaggcgtacttccgcgagcacccgcaggacaacgaccgcgactggatcgtcgcggccttcaatcacctggcggaggcgcacccgacggcggcgggactgttcgacgcgcggttcaacccgctgtgggagatcacgccgtcgttcgaggcggcgacggcgctgttgcagttctggcggcggcgcggcgacgacggtgagatccgctacgacttcaccgaccccgaatgggacacgcgcttcctcggcgatctgtaccaggatctgtcggagcacgcgcgcaagacgtatgcgctgctgcagacgccggagttcgtggaggagttcatcctcgacctcacgctcgaaccggccgtcgaggaattcggactcaaaggtctgcgcacgatcgacccggcgtgcgggtcggggcacttcctgctggggctgttccggcgggtgctggcgaagtggcgggaggcggagccgggcacggaccagtgggagctgatccagcgcacgctcggctcggtgcacggctgtgacaagaacccgttcgccgcgtccatcgcccggttccggatgctggtggcggtgctgcgcgaggcgaacgcgatccggctcgaccaggcgccgcggtttccgatcaacatcgcggtcggcgactccctcatgcacggccggggcgcgcccggcatccagggcgagctgttcgcgctggacgagccgcacacctacaccaccgaggacgtcaacgagtacgtgcgctcctgcgacctgcttggtaagggctcgtaccacgtggtggtgggtaacccgccgtacatcacggtgaaggacaaacaggagaaccagaactaccgcgaccgctatgacgcgtgttcgggtaagtacgcgctctcggtgccgttcgcgcagcggctgttccagctcgcgatccgccgcagtggttccgaccgcgacgcgggatacgtcgggcagatcaccgcgaactcgttcatgaaacgcgagttcgggaagaagctgatcgaggacttcttccgaacggtgcagctcacgcacgtcatcgacacgtcgggcgcgtacattcccggccacggcacgcccaccgtgatcctggtggggcgcaatcacgagtaccggcaggacgacccggtacgagcggtcctcgggattcgtggcgagccgagccagcccgaagacccggccaaaggcctggtgtggtcggcgatcgtggagcagatcactcggcccgggagcgagtccgagtggatcactgctgaggacgtcgatcggactgcgtttgctgggcatccgtggagcctaagtggcggtggcgccggagatcttcaggatcgcattcaatccggcggctcgatgcttctgggaaaatgttttgaatcgagtggatttgctgcaataacgggggtcgatgacgcctatgtgcttgcaagccccttgccgcggtggcgagaaaatcaagatgttcagcgacgcgtctatgttgaaggagaccaggttcgcgactgggcatgtggtgcgacagcgaaggttgtgtacccaatcgatctcaatgttgatgagcgttcctatattgagactgtttacttatggtctatgcggtctgtgctaaggcgaactatctacttcggggagacaaaggaagagcgaggctatcattggtctgattacgcgttcttcatgagggagcgtcttaaaagtcggctactgattgcgtttgcattcgttgcaacccataatcactttactttagaccggggcgggaaagtgcacaataagtctgcgccggtgattaagttgccggagggggctggtgaggacgagcatctggagttgcttggggtgctcaactcatccacggcctgcttctggctcaagcaggtgtgccacaacaagggtggtcctggagggggctactcgaaaggtgagaagtggcgagacttctacgagttcaccggcaccaagcttcaggaattccctcttcccgccgttctgccgttggagctgggccgggcattggactcgctggcccaggacctcgccgcgcaggagccgtcggccatcgccgaggcggccacgccgactcgcgagcggcttgacgctgcccgcgctgagcacgcccgcatccggggacggatgatcgcgctgcaggaagagctcgactggaccgtctaccactcctacggcctgctcgacgacaccgaacgcgcccagctcaccgcgcccgacctcgacaccgtgccggaaattcggctcggcgagcgggccttcgagatcgtgctcacccgtaggatgagagcaggtttggaagagacgaggtggttcacagactttggtggacaacctcaaaccgaggttcccgagcactggcccgagtggtaccggcagctcgtccaggcacgcattgatgtcatcgagaagcggcgtgacatcgcgctgatcgagcagcccaactgcaagcgtccatgggaatccgaaacctgggagcgcaaagaagccgacgcgttgcgcacgtggctgctcgaccggtgtgagcggcgagacctgtggttcgggctgcgtgacggcttcgaacaaccccgcaccctcaccgtccaccagcttgccgacgccttccgcgatgacgccgacatgcacgccgtcgccgccctctatgccaacgaccacctcggcaaacccgacctgccactggcgaaggtgctggaaaccatcctcaccgaccaacacgtcccctacctcgccgccctgcgctacaaggactcaggcctgcgcaaacgcgcccagtgggagcaggtgtgggagaagcagcgggaagaagaccgcacgggccagcggctcgacatccccgtgcctccgaaatacacgtccgccgacttccgcaaaaccagctactggacccaccgcggcaaactcgacgtccccaaggagaggttcatctcctaccccgacgcctcacccgacgccgaccccagcctgctgctcggctgggccggctgggaccacaaagaccaagcccaagccctggtcaacctcatcaacgaccgcaccgccgacgccgggtgggaaaccgaacggctcaccccgctcctcgccggcctggccgaagtgatgccctgggtgcggcagtggcacggcgaatacgacgaggaatgggaaggcgtgcccgccgacgaataccaagccttcctcgacgaacaacgcaccaaacaccagctcaccgaagacgacctcaaaaactggcgacccgcccccacccgtcggggccgccgcggcacagcgaaggaaacccagcagtga

SEQ ID NO: 2739 - DNA, 3570 bp, Rhodococcus triatomae
atggcgttggccacgatttccggagccgcgctcaaggacgcactgaagccgcagctgacgctgctggtcgacgacatgcgcaccaagctcaccgccgacgccgacgagctggcgcgttggcgggcaatacaccgtgaggctgtcgccgagcagcggaccgcggtgtcgtggacggactggtccgaggaccagctcacccaggccgccgtcggctggctcctcacctcggtgttcgtgcggttttgtgaggacaacctgctcctcggtgacaccactgtctggatcacccatcccgacccgatgctccgtcaacgcgccgtcgacgctgagcaggcgttctaccgcgccgacaccaacaactcgtaccgcgaatggctggagcagtccttcgacgccctgcggaagtacccggccacccagtcgctggtggacgagcacgcggcgctgaacatcatcgccccgtcctccgatgcggtgcaccaggtgctgtcgttctggcggcaggtcgacgactccggttccctcgcctggactttccgcgacccggaactcaccacccgcttcctcggtgacctgtatcaggacctttcggacttcgcgaagaagaagtacgcgctgttgcagacaccggagttcgtggaggagttcatcctcgaccaaaccctcgaaccggccctgaaggaccgaccgctggaggggttcaaggtcatcgaccccacctgcgggtccggtcacttcctgttgggggcctttgcacgactcgtcgatcgatggaaccgcgaagcacccggattggaactgcggacgcgggtcgacaacgcactgtcgtccgtctacggcgtggacctgaaccccttcgccgtcgccatcgccaagttccggctgatcgtcgctgcgctgaaggcttgcggggaaacgactttggtgaacgcacccaagttcaccctcaacctcgccaacggcgattcactgctgcacggggcagagcagggcggtgcgaaagccttcgacttcggcgacctgtccttcgacaaggacgccgtggtgtcagggttcgcgtactccactgaagacgtggcgctgcttcgccggattctcgcgccggggcagtacgacgtggttgtcgggaatccgccgtacattgtcgtgcgggacaaggcactcaaccagcgatatcgggagatctaccactactgcaagggcccgtacgcgctgaccatcccgttcatggagaagttcttcaatctagctaaacacggtgaccgcgccggctgggtcggtcagatcacctcgaactcattcatgaaacgcgacttcgggaaaccacttgtcgaggagtttttccctggcgtagaccttcggaccctcgttgactccgagggcgcatggattcccggccacaacatggacgggacgccaaccgtcattctagttggacgtaatcgtcgcccctcttccgattccgttcgtgctgtactcagccttggtattcgagagaccccagatgactacgcttccggaaagggcccctattggcgatcgctcgtagatcaccttgacgaccccaattttgagaaccggtgggtctcgatcgtcgatctaagacgcgaaacactgaaaaggcatccctggagcctaagcggtggcggtgccgtcgaaacacttgcatcgattgaaacctcacgtaacctgcaactgcgtgacctcgtcgatgcgattggtcgaaccacccacactggtttagacgatgcgttcttcgtgtctccggcgtcagcgaaaacgcgcggtttcgttggcgacactgccccagtggttcttggagaggacgtacgcgacttcatcgtcggaccagcccagttgaccgttttcccctacgacgaccatggagaaacgcgcgagctgggatcagccgcagcgcatttcctttggctgaatcgtacggcgttgagccgtcgcgtcgacttcgaccagactttggacgagcgcggactccactggttcgagcattcgatgttcttcaagaagaggtaccgcaccccgctgtcgatcccgtttgcgttcgtggcatctcataaccactttgcgctggaccgcggcgggaaggtgttcaaccgctcagcttcagtcataaagcttcctccagactcgactgaggaggactacttacagctcctcggcaccctgaacagttctacggcagggttctggctccgagagaagacacagcccaaaggtggcgcggctgaacacgcttggtcaaggacacgcgagtacacaggtagcgcgctccttgactttccgatcccatcaagttccccgctcgaacgagcccgtcgtatcgacggactctcccagcagctacttgcgcaagaaccctcggctgtcctttcgagagacggcgtcaatcaaggggcaatcaacgatgcaggtgctgagcatgcacgtatccgcgccttgatgatcgctgagcaggacgagcttgactgggaggtctacaggaactatggactcatcgagggatcactgttcctacccgagggtcaggcgcccgggattgcactgggtgagcgggcctttgagatcgcgttggcccgtaaagtcgctacaggggaggccgagacagcctggttcgagcgacacggctccacatcggtcaccaacgttcccacgcactggccagccgagtaccgcgacctggtcgagaagcgcctccaggccatcgagtcaaatccgttcatccgtttgctggagcgaccggagtacaaacgccgttgggccggcgacacatgggaggtgaaactgaagcgcgccctcaaggactggctgctcgatcgcctcgaagaccagtcgctgtggttcaccgcgcagggcacgcctcagatgctgtccgttgccgagctggccgggcatgtggagaaggaccccgaattcatcaccgccctcgacctctggaccggcaagaaggatgcccccgtcaccgacaccctcgtcaaactcctcgccgacgaggcggtgccatacctcgcggcgatgcgctacaaggaatccggcctgcgcaagcgcgcggagtgggagcgcgtgtgggatctgcaacgcgacgaggacgccggactcagaaaggccacggacattccggtcccgccgaagtacaccagcgctgacttcgcgaagacgtcgttctggtcgcatcgcggcaagctggatgtcccgaaggaacgcttcatctcatatcccggcgccggccgcgccaccgacccgaccccattgttgggctgggccggctggaaccacgcccaacagggcctcgcactggcgacgatctacgccctgcgcgagcaggagggcactgcgctcaccgacctggtccccgtggtcgccggcatcgcggagatattgccgtgggtgaagcagtggcacagcggcgtcgaccccaccttcggcatcgacctcgccgactacctgcagggccagctcaacgaaaagtccgcagcagtaggcgtccccgtccccgacctcaccaacttgcgtccacccaagaccacccgcgtccgccagccaaagcagacctag

SEQ ID NO: 2740 - DNA, 3663 bp, Saccharomonospora cyanea
atggtcggggcgagtaaaggggagcggcagactgtggcagtgcgtggtgctgacctgggtgagctggtgaaggacctgcgcaggcaggtcaccgtgctcgaagacgatttgcgggcgcgggcccaggaggtgtcggagttccacaccccgctgcgcgccgaatacgacgaggcgcgcaagcgggaacgcacggcggcgacgtgggagtcgtggctcgaccagcgggtgacgcaggtggctgcggcgtgggtgctgggcacggtgttcgtgcggttctgtgaggacaacgggctgatccagtggccgttcctcgcggggccgggggagcggctggcggacgcggaggagcggcacgaggcgtacttccgcgagcacccgcaggacaacgaccgcgactggatcgtcgcggccttcaatcacctggcggaggcacacccgacggcggcggggctgttcgacgcgcggttcaacccgctgtgggagatcacgccgtcgttcgaggcggcgacggcgctgttgcagttctggcggcggcgcggcgacgacggcgagatccgctacgacttcaccgaccccgaatgggacacgcgcttcctcggcgatctgtaccaggacctgtcggagcacgcgcgcaagacgtatgcgctgctgcagacgccggagttcgtggaggagttcatcctcgacctcacgctcgaaccggccgtcgaggaattcgggctcaaagacctgcgcacgatcgacccggcgtgtgggtcggggcacttcctgctggggctgttccggcgggtgctggcgaagtggcgggaggcggagccgggcacggatgagtgggagctgatccagcgcacgctcggctcggtacacggctgcgacaagaacccgttcgccgcgtccatcgcccggttccggatgctggtggcggtgctgcgcgaggcgaacgcgatccggctcgaccaggcgccgcggttcccgatcaacatcgcggtcggcgactccctcatgcacggccggggcgcgcccggcatccagggcgagctgttcgcgctggaggagccgcacacctacgccaccgaggacatcgacgagtacatacgctcctgcgacctgctcggcaagggctcgtaccacgtggtggtgggcaacccgccgtacatcacggtgaaggacaagcaggagaaccagaactaccgcgaccggtatgacgcctgctcacggcaatatgcattgtctgtgccgttcgcgcagcgcatgttccaactggccttgcgtgctcacggtagtgatcgagacgccggatttgtggggcagattactgcaaactcgttcatgaagcgtgagttcggcaagaacttgatcgagcggttctttcctagtgtccatctcacgcatgttgtcgatacgtctggcgcttacattcctgggcatggaactccaacggtcatcttggttgggcgaaaccatatttcgcgaaacgatgaccctgtccgtgcggtgcttggtgtgcgaggtgaaccggcgcagccgtccgacccgtcgaaagggttggtgtggtcggccattgttgagcaaatatcacgtagtggaagtgaatccgaatgggtgacggctgacgacatcccgcgttcttccttttcgaatcacccttggtctttggcgggagggggagcgagtgatctggtaagaagcctgcatgaggcatcgtcgaggaatttgggcacggtgctgttgctgactgggcgtactacccacaccggaagtgatgaagcctactttgctccggtcggtacgtgggctcgactgggccttccggatgaaagagtagcgaccctggttgaaggagacagtgttcgggactggtctctacctcttgtgacggaggctgttttcccgtatggcgcagaccttcgcgcagatcttaaggacctgcctacttataagcacctatggatgcatcgcgcgcacttgcgtgaacgccgtgagcccggagggactcacgaggaaataggcttgacttggtacgaatggagtcggtggcacccagaaaggttttccgttccccttgggattccattcgcgttcgtggctacgcacaaccacttcgtgttggatcggggtgggaaggtcttcaagcagtcggcgccggtgattaagttgccggagggggctggtgaggacgagcatttggagttgcttggggtgctcaactcgtccacggcctgtttctggctcaagcaggtgagccacaacaaggggcggccgggagctgagcagacaggggccgatgagccttgggagcaccgattcgagttcactggcaccaagcttcaggagtttccccttcctgctgtgctgccgttggagttggggcgggcgctggattcgctggcccaggacctcgccgctcacgaaccctcggccgtcgctgaggtgggtacgccgactcgcgagcggcttgacgctgcccgtgctgagcacgcgcgtatccggggacgcatgatcgcgcttcaggaggaactcgactggaccgtctaccactcctacggcctgctcgacgacaccgagcgcgcccagctcatcgcacccgatctcgacaccgtgcccgagattggtccgagtgagcgagcattcgcgattgtgctcgcccgccgactgcggcaaggggagacggacacaacgtggttctctcaccataaccacaaattcccgcccgtcaccgagatccccgcgcactggcccgactggtgccggcaaatcgtccaggcgcgcatcgacgtcatcgaaaagcggcgcgacatcggcctcatcgagcggcccgagtgcaagcggcggtgggcctccgagacgtgggagcgcaaggaagccgacgcgctgcgcacgtggctgctcgaccggtgtgagcggcgagacctgtggtacgggttgcgcgacgggttctcccagccccgcacgctcaccgtcaaccagctcgccgatcagttccgcgacgacgccgacatgcacgccgtcgccgccctctatgccagcgaccacctcggcaaacccgacctgccgctcgcgcgcgtgctggaaacgatcatcgccgaccagcacgtcccctacctcgccgcgctgcgctacaaggacagcggcctgcgcaaacgcgcccaatgggaagaggtgtgggagaagcagcgcgaagaggaccgcacggggcagcggctcgacatccccgtacccccgaaatacacctccgccgacttccgcaagaccagctactggacccaccgaggcaaactcgacgtgcccaaggaacggttcgtctcctatcctggcgcgtcccccgacgccgaccccagcctgctgctcggctgggccggatgggaccacaaggaccaggcccaagcgctggtcaacctcgtcaacgaccgcaccgccgacgcgggctgggaaaccgaccggctcaccccgctcatcgccggactcgccgaactgatgccgtgggtgcggcagtggcacggcgactacgacgacgaatgggaaggcgtgcccgccgacgaataccaggcgttcctcgacgaacaacgcaccacccaccagctcaccgaagccgacctgaccaactggcgacccgcccccacccgccggggccgccgcagcgcaacgaaggaaacccagcagtga

SEQ ID NO: 2741 - DNA, 3597 bp, Gordonia polyisoprenivorans
atgtccctcgccaccatcgcaggatcgcagctgacggcagacctcaagccacagttggcgttgctggtcgaggacatgcgcgcagaactcgacgccgacgccgatctcaccgccgcgtggaagtccgaacaccaacaggcacgtacacaggaacgcaccgccgcctcgtggaccgacttcgttgaggaccacctcgtacaggccgccgtcggctggctcctcacatcggtatttgtgcgtttctgcgaagacaatctgctgctcggaccgaccgcggtgtggatcgccggacccacaccagcactccggcaacgtgcactcgacgcggaagaccagttctaccgtgaagagcgcggcgccgagcagggcacccgctcgtatcgcgagtggcttgagcagggattcgcggcgcttcgcgccaacccgggtaccgcgtccttggtggacgaccacgccgcgatcggtctcatcgcaccgtcgtcatacgcgatcgagcagcttctcgcctattggcgccgcaccgatgacgacggcgcgcttcgatggagtttcgccgatccggaactctcgacccgcttcctgggtgacctgtatcaggatctctccgactacgcgaagaagaagtacgcgctcctccagacaccggagttcgtcgaggagttcatcctcgaccgcacgatggagcccgcgttgaaagagcgaccgctggaagggttcacgctcatcgacccgacctgcgggtccggccacttcctcctcggtgcgttcacacgcctggtgcagagatgggaagaagccgcgcccggaatggagccgagggctcgggccgacaaagccttggcgtcggtgcacggcgtcgacatcaacccgttcgccgttgccatcgccaagttccggctgatcgtggcggccatgaaagcctccggcgatcgcgatctggtgaacgtcccgaagtacacgttgaatctcgcgaccggggactcgctgttgttcggtcctgaacgcgatggacaacatgccttcgacccagcaggcggcttcgtcgacaaagatgctgtagcaagcggattcgcgtactccaccgaagaccgtgaaaggttgcagtcgttgctgacactggggcagtacgacgtggtggtcggcaacccgccgtacatcaccgtcggcgacaaggcgctcaacgcgcggtaccgggaaatctacagccactgcaagggcgcgtacgcgttgacggtgccgttcatggagcgattctttgcactggccaagcgcagcgaccgacccggttgggtcggccagataacgtcaaacgctttcatgaaaaggaggtacgggatacctctgatcgaagattttttcccacagctcgacttgacgagcgtagtcgattccgaaggtgcctggataccagggcacaatatggatggaaccccgaccgtgatcctcattggccgaaaccgagcaccggtttcaacggtggtgcggacagttcagagcatgggtgtccgggaagttccggaggatgtaggagaaggtggctacgggccctactgggagtcgattgtcgaacacgtcgacgaaccggggttcgaagatcagtggatctcggttgttgatttaccgcgcgtgaacctctcgcaacatccgtggagtctggcgggtggtggtgcggtcgaattgatggcggccgtcgacgcgcatgctggtcggttattgtctgagattgtcgaagaggttggctttggtgcggtcactcgcgaggattcagcatatatggtggggttgggaacccttcgtcgtgcggggattccggcggatcagcgacgccctatggtcctgggagaggatgtccgggactggaacctcaacgatcttatcgagagcatttggccataccacctgcaaacgctcagtgcgttaaaagaccctaacattcagcgatttctgtggccggtaagaactattctcagtgggcgagtggcttatgggagcactcagattgaacggggcttggaatggttcgagtattcaatgttcttcaggaacagatttaggtcaccgttgaccatcaccttcgccgaaatagagagccacaatcatttcgttctcgaccgcggtggcaaggtgttcaatcgtactgcacctgtaatcaaactgccggagagttcaactgaggaagatcacttcggattgctcggagtgctaaacagctcgaccgcgctgttttggctcaaacaaaagacgaaagcgaagggcggtgccgccagtcatgcgtgggcccgtacttaccagttcaacgtaactaccctgctcgactttcccctgccggaaggtttgccagggttctccgcgtcggacctcgatgatcttgcgctcggcgctgctcgggttgaacctgcggcaacgctcgcggctaatggcccctcccgagaagccctgaacgccgcgcgggagcagagcgcggccatccgcgccagcatgattcgcgatcaggagaacctcgactgggaggtctaccagctctacggcctgatcgaccaaaacctgaacccccccgaaggcaatccgggccccggcctcgcgctcggcgagcgcgccttcgagatcgctctggcccgtcggatggcggcaggggaggtcgagaccgcatggtttgaacgacacggctcgactccgatcaccgagatcccctcccactggccgcaggactaccgcaacctcgtgcagcgtcgtctcgacgccattgagaacaacccgtacatccggctgctggagcggcctgagtacaagcgtcgatgggccggcgaatcgtgggacaccaaactgcagcgtgcgctgcgggattggttgctcgacaagatcgagcagccgcagctgtgggtcaatgcgcagggcctgccgcaaccacagtcggtgggtgagctggccggggcactcgggcgtgacgcagagttcgtgcagggactcgacctgtgggccggatacaaagatgcgccggtcaccgaaactctggtgaagttgctcgacgatcaggcggtgccctatctggcggcataccgctacaaagactccggactgcgcaaacgggctgagtgggaacgcgtctgggacatgcagcgcgacgaggatgctggtgtgatctccgcgaccgacatcccggtcccaccgaagtacaccaccgcggacttccgtaagaccgcgtactggtcgcatcgaggcaagctcgacgtgcccaaggagcgattcattctctaccccgacgccggacgcgaaaccgacccgactccgctgctcggttgggctggatgggatcacgcgcagcagggtgtggcactcgccgcgatctacgccatgcgtgagtccgagggcatcgagcgcgagaagctcgtgccgatcgtcgccggcatcgccgagttgctgccgtgggtcaagcaatggcacagcggagtcgacccgaacctgggcatcgacttgcacgagtacctcactagccagttgcaggagaagtcacagacggtcggggtgccggtcagcgaactcgggcagtggcgcgcacccgcaccggttcgtggccgaaagacgaaggcaggtcaatga

SEQ ID NO: 2742 - DNA, 3657 bp, Amycolatopsis azurea
gtggcgaacggaatcgatcagaaggctctactggcagacctgcggaagcagctcacgactctggaagacgacttgcgcgagcgcagcgccgagctggagttcgacggcccgctgcgtgatgagtatcagaaggccgtcgacgccgaccgcaccgccgcgatctacgaaacctggcgtgacgatcgagtcacgcaggccgcggtggcctggctgctcggctgtgtctacgtgcggttctgtgaggacaacggcctgatcccggagccgtttctgtccggcccaggtgatgcgctcgccacagcccacgagcggcaagaggcgttcttccgcgccaacccgcacctcaacgatcgcgactggctcgaggccgcattcacccacctgacggaagctcacccaaccgccgccggcctgttcgatcgccggtacaacccgctgtgggagctgacaccgtcgttcgaggcggcgaccgccctcctctcgttctggcgccgccgcggcccagacggcgaggtcatccacaaattcgccgacgagtcctggaatactcgcttcctcggggacatctatcaagacctgtcagaccatgcgaagaagacttacgcgctactgcagaccccagagttcgtcgaggagttcatcctcgacctgacactgaccccagctttagagaccttcggccttgaccctgtcgtggagatccaccgccacggcggtggcactgagcgaacccgcgagggcttgcgcacgatcgacccagcctgcggctcgggtcacttcctactgggcatcttccaccgcctcctagccgagtggcgccgcacctcgcccggcatcgacgactggatcctgatccgacgctcccttgagtcggtgcacggctgcgacaaaaaccccttcgccgcctcgatcgcccgctttcgcctgctagtcgccgcactcaaagcctccggaacccgcacactcgcctctgcaggcgagttcccaatcaacgtcgccgtcggcgactcactcctgcacggcataggcgtcgcgggcgagcagatagacatgctcgactcgaaagccgacgaggagttcacctatcgcagtgaagacgttaatgaatatatcaactcctgcgacctactcacgtccgcttcgtaccatgtagtcgtcggaaacccaccgtacataacagtaaaagaccggcgggaaaacgagaactaccgcgcacgttggaaaaccgtgtgctctggcaagtacgctctgtcggtccccttcgcagcacgaatgtttcacctcgccacgccaacccaacaaggcggctacgtcggccagattaccgcaaattccttcatgaagcgggagtttggcaagaagctcatcgagaacttccttcgcaacatcgatctgactcacataatcgatacatcgggcgcatacattcccggacacggcactccgacggtcataataatcggccgcaagaaaatatccaatgaacacaaaccgattcgttccgcacttggcattcgcggcgaacccgaaacaccacccgatcccacccaaggccttgtctggcaagcgattatcgagcagatcagcactccaggaagcgaatctgattggatcagtgtcgccgatgtcgatcgacacaccctcagcagtcatccctggtctctgagcggcggcggggcggacgccctactggcgcgtattgaaaattccaccacaaagaagctggaacgcgtcagcgattcaatcggcataactagctttacgctcgaggacgatctatatctgcaaccgaaaagaagtgcgttacgcaagtccgtaagcgaagagtaccttcgagacatgatcactggagaccttctacgtgactggtcgagcggcaatcccgagtctgcactatttccgtatacaacagacttcaagccgattgacgtcgaggggacccctggtctccatcgcgccatgtggccagccagaaccacaatttcaaacaacgtcctcttcggccgaaaaacaaagctcgacgccgagttgaaatggtcggagtatgggagactaactcacagaaagctccttacgccgctttctataacctatgctgaggtctcgacgcataaccattttgttctcgatcgcggcggaaggatttttaagcagactgcgccagtaataaaacttgctagcggaagaactgaaggtgaacacctggcaatactcggcctactaaactcatcaacagcatgcttctggctaaagcaggtatgccacgataaaggtattcgcggcgaagggggcggctttacaagtaacgactgggagcgattctttcagttcaacgctaccaagttgcaacaatttccattgccagccgcggcacctgcacgcgcagccacactactagacgcactgtcgcgacaactcgccgacaccgaaccttcagtgatactcgacaataatattccaagtcgagaatccttagagaacaaacgtatcgaacagatgaagactcgagctcaaatgatctccatccaagaggaatcagattgggaagtatacaaactgtacggcatcacgagcgaaattgagtcatccgaactgcaatactcactcgaggacgtgccagaaattgcgctcggcgagcgcgcgtttgaaatttccatagctcgacgtgcttccatcgacgattctgtagatcttgaatggttcgacagacacggttcgaagccgatcactgagcttcccgagcattggccggaggcgtacaagcaggtcgttgagaagcggatcgagacgatcaatagccgtcgagacattgcactcatcgaacgtcccgagtgcaagcgacgctgggcaaccgagccgtgggagaagaaggagcgcaaggctctcgaaacctggctgctcgacaagtgcgaggacaaggaactctggttcgccctccgcgacggcttgaccggaccacgcacactgaccgtcagccagctcgccgacctcctccgcaccaacgatgacgtcaactctgtcgctgccctgtacgcagccgaccaccttggcaagcgggacctcccgctagccgacgtgctggagcaggtcatcgccaccgagcacgtcccctacctcgcagcgatgcgctacaaggagactggcctgcgcaaacgcgcccagtgggaatccgtctgggaggagcagcgcaaggaggaccgcaccggcaagcggctcgacatcaaggtgccgccgaagtacacctctgcggacttcgccaagacgtcctactggtcacaccgcggcaagctcgacgtgccgaaggaacggttcatctcctaccccggagctggcccagaagctgacccgaccttgctgctcggctgggcaggttgggatcataaggaccaggcgctcgcgctggtcaacgtgatcaatgaccggctcgagcaggaaggatgggagaccgacaagatcgcgccgctgctcgcagggctggccgagctcatgccctgggtcaagcagtggcacgctggctatgacgcagagtggggcgggaaccccgcggaggagttccagaccgtgctcgagcagcagcagaccaagcatgggctgaccgacgaggcgttgagcaagtggcggccggagcagacgcggcgcggccgcaggaagagctag

SEQ ID NO: 2743 - DNA, 2295 bp, Marinobacter sp.
gtgattaaccgcgctgacctactcagcagtcttcagtcgctgctcccccatattgaacaggacattcttgcctacagcgccgccaatgaacgattgcacgaacatctgcaacaacaataccaggccgccgtggccgccgaccgtaccgcagagcactttgtggcctggcgcgaagcgcaaattacccaggccgccgtcgcctgggtgctaacctgcgtgtttgtgcgctttctggaagacaacgggctgttaaccgaaccggtactggcgggccccgtgagcaacgctcaaggtaacaatactctgcagcaggccaaagaacgcatggcggcctacttcaatgacaacccaacccacgaagaacgccattacctgctcgacctgttccagacgctgcagcaatacccggttatcgcccagctgctagaccagcgccacaacccactgtggcagactccggtatccgccgatggtgccaaacgtctgatagacttttttcagcagattgacccgcaaaccggcgacatcaaacaggattttaccgacccagagtgggacacccggtttttgggtgacctgtatcaggatttgtcagaatcggtgcgcaaacgctacgcactgctgcaaaccccggaatttgttgagagctttatactggattacaccctggaaccggcaatcgaaacctttggcctgccgggcttgcggttgattgacccaacctgtggctccggccactttttgctgaccaccttcgagcgtgtgtttgagcgctggctgaaacgtgaaccaggcaccaatacccgtaaactggcccagcgggcgctagatgtggtgcatggcgtggatattaacccttacgccattgcggtctgccgttttcggttgttgatagccgcaatgaaagcggctggcagcgacagagtgaaggatgcgccgaaatttgaatttcatttggcttgtggcgattcgctgctgcacggaagacgccatgaatgggagggtcagggtgaccagcaggattttttaggtaaacaccagcatgtttacgaagttgaagatgaacaaaaactcaatcagattcttggccagcgctatcacgttgtggtgggcaacccgccctatattaccgtgaaagacaaagtgctgaatcaggcgtaccgtagcaagtatctgacctgtcaccgtaagtattcgctgggcgttccctttaccgaacggttttttgatttaactctgtggccggtggacaaccagtcagccggttttatggggatgatcaccaccaacagctttatgaaaagggagtttggtaaaaagctcatcgaggtatatctaccacgtaaaaacctgacccacgtaatcgacacgtctggcgcttatattccaggacatgggacaccaacggtgattttgttcgcccgaaatcagtcgtctaaatcagatgttattcgtgcggttttgggtattcgtggtgaaccaggtacacctgacgatgcggcacagggtaaggtttggtcgtctattgtagagctattgccaaaggcaggcgccgagaacgattacatcagtgtggtcgatcaggcgactgaagcatttgctgctcatccttggagtttgggtggcggcggtatatccgagctcaaagagtttatagaggcagaaaaggcgcgactgggttcaatagtatctttaattggcttcggcgcaatcttgggcgaggatgatgcttttggtgttccacacgaaaaagtaggttcagtatcatttccacttcagaaccgtcctttagtagagggcgatcaggtaagagactgggcgcttgggtctgttacagcagttatatttccatatgatcacgacattaatctgagcattgataggggccagaaaaagtacttgtggccgctcagaactcaattgtggtcaagaaaaacctttggagaaaaaacttacaaagaagcaggtcgtcatttcgctgagtatcatcagattccggtcggacgaaataaagtgccgctttctattacctttgcttttgttgccacacacaaccattttgccttggatcgaggcggtaaggtgttcaagcaaactgctccggttatcaagctgcctcaatgtgcgacagaagctgaccattttgccttcatggggttactgaatagctcaaccgcatgcttctgggggcgtcagacgttttttggacgagggggcttctctgacggtaaatggcaagagcggatggagtgggatggtacaaaattgaagtcttttcctgttgtttcagagtaa

SEQ ID NO: 2744 - DNA, 3657 bp, Saccharopolyspora erythraea; identical to SEQ ID NO: 2430

SEQ ID NO: 2745 - DNA, 3621 bp, Streptomyces turgidiscabies
gtgatcgaccgcaaagctctgttgaacgacctgaagcagcaggtcaaggcggtcgaaaccgacctcggacgccaggtgaaggcgctgggggatgtcggcgcgcggttgagggccgagtacgaccaggcgcgcaagctcgggcgtacggcggcgacgtggacctcgtggctggacgagcgggtcacgcaggttgcggtggcgtgggtgctggggtctgtgttcgtgcggttctgcgaggacaacctgctgattccggagccgtatctgacggggccggacggggatcggcgggagctggcggagtcgcggtacgacgcgtatgtggagtcggacgaggacccgacgtaccgagggtggctggagaaggcgttcgaggaactggggcaggggcaggcgggtcggctgcttttcgaccagcggcacaacccgctgtaccaggttccgctttcgcatgacggtgcgcgggacttggtcgagttctggcgggggagggacgaggcgggcgttctcgttcatgacttcaccgacccgctgaacgaggacggtacggagggatgggatacgcggttcctgggggacctgtaccaggacctgagcgaggctgcgcggaagacgtacgcgctgcttcagacgccggagttcgtcgaggagttcatccttgaccggacgatgaatcctgccgtgcgggagttcgggtacgaggaactaaagatgatcgaccctacgtgtgggtcggggcactttgtgttgggggcgtttcggcggttggtgcggctgtggggggaggggcagccggggcgggatgtgcatgagcgggtgcgggctgcgctggactcggtgcacggggtggacatcaacccgttcgcggtggctgttgctcggttccggttgctggttgcggccatggcggcgggtgaggtgcggacgctggctgaggctgcaaagtatgagtggccggttcatctggcggtgggggattcgctgatcaaggctcggcagcttgagctgatgttgggtggggacgaaaacggcctggatgatccgctggcatctttcgcgtatgtcacggaggacgtgcacgagcatccggggattctccagcagggtcgatatcacgtggtggtcggtaatccgccgtacatcaccgtgaaagataagaatctgaatgcgctgtaccgggaactatatgacgcatgttcgggaaaatatgcactgtcggtgccatttgcgcagcgattcttcgagctagccaaacgaggggatgctgcgggtagtggatacgggatggtgggtcaaatcaccgcgaactctttcacgaagagggagttcggtacgcagctgatcgaggggtactttgttcatcaagttgagctagtagaggttattgacacctcgggtgcttacattccaggacatggaactccgacagtcattttgattggcaagcgccggggggggagtgcgcggtccgaggtgatccgcacggtacgaagtgttcaaggggagccatctgtgcctgataaggccgaggaagggatggtctggagtgcaatcgtcaaacagatcgaccagcctggctcggttagccggtgggtatctgtggacgatttgaatcgaattcgctattttggtaagcaaccgtggattctgtctgatggcggcctcgaaatgttggatcagatcgccgcgcaatcaaccggaaatcttcgggaggtcgcggtggagtccggaatttcatcggtcactggagaggatgacctatatcttctacccctaaatggaagtgtaggcagaaatcgaatcgaatattcacgtccaatggtgacaggggatgtgattcgtgattaccgacttgtgtcgaccttcgaggccgtatgggtttacgattccgatttcaaggtcctgccacttggtcaggttcctggcacggagcggtatttgaagccttatagggcggcgatttcacatcgccgtcgcttcggtacgcctatgcttcagcgtgggctgacctggtacgagtggcaggaactttatcccgccaagcttttgacgccgctaactatcacctttgcattcgttgctacgcacaaccatttcgtgctcgatcgaggtgggaaggtcttcaaacaaaccgctagagtgattaaattgcgggagggggctagcgaggaggagtacctgcggttgctcgggctacttaatagctccacggctgggttctggcttaagcaggtaagtcacaacaagggcagcacggtggactcaaagggggcgcgccagtcgacaattccgttcgaggatttctacgagttcactggcaccaagcttcaggatttccctcttccggcccgttaccccacccaactggccactgccctcgacgccctagcccagcagctttccattacttcgctcgcggccctcgccgggcaggagatccccactgcccccgtcctccgtgaggctacgtcccgctgggggtccacgcgtgcacgcatgatcgccctccaggaagaactggactggcaggtctactccctctacaacctccactccgaagacctccgcgtctctgaggaccccgacgaccccaacatccccgaactcgaccttggtgagcgcgccttcgagattgtcctggcccgtcgcgtagccgcaggcgaggccagcgacgcttggttcaagcggcacgactccacacccatcacggagatccccgctcactggccagtcccctaccgcgaggtcgtccagatgcgcatcgacgccatcgagtccaaccgggccgtcggcatggtcgagcgccccgagtacaaacgccgttgggccaccgagggctgggacgcgctccaggagaaggccctgcgctcctggctgctcgaccggatggagaagcgtgaccactggttcgacgagaacggtcagcccaccattctcaccctggcccgcctcactgacgccctctcccgtgacgaggacttcgtctccgtcgctaagctctacgcgccccgcaaggatctcgcgaaggccgtcgccgagctgatcaccgacgaacacgttccctatctccccgccctgcgctacaagccctccggtctcaagaagcgcgccgactgggaagaggtgtgggacctccagcgcaaggaggacgccgcgtctgatgagcctgccaagcggaagatccgggactccatccctgtgccgccgaagtacacctcggccgacttcctccgcccctcctactggaaggcgcgcggcaagctcgacgtgcccaaggagcggttcgtctcttacgggcagaccaacgccgccacccccgagctgtacgggtgggccggctgggaccagcgggagcaggcgcaggcgctcgccacgtacttcaccaacaccgcgctgtccaccgaggagatcacgccgttcctcgccggcctgctggaactccagccgtggttgtcccagtggcacaacgagttcgacatgaactacagcggctccccggcggacttcttcgccggttaccgccagcagaagcaaggcgagcatggactcacggacgacgatctccgtaactggcagcccctggccgcaacccgaggccgtcgcgcagcagtgaagaagtag

SEQ ID NO: 2746 - DNA, 3804 bp, Gemmata obscuriglobus
atgatcgaccgcaccgcgttcctggccgacgcgcagaagatcgtcgcccggctggagaaggacctgcgcgcccggtgcgacgacatgcccgaagtcgggcgggccgtcgggtccgagtaccgcaccgcgaaagacgccggccgcaccgggcagacgctcgaagagtggcgggccgacgccatcacccagcaggccgtcgcctgggtgctgtcgtgcgtgttcgtgcggttcctggaggacaaccggctcatcgacccgccgaagatcagcgggccggtcccgccggagggcgagaagggtgagaaccggctggcccgtgcccgcgacgagcacgaactgttcttcaccggcgcacgccgggggagcgagttcaccgaccgcgagtacctgctgtccgtgttcgacgagctggcgaagcggccgggcacgaaggacctgtacggcccgcacaacccgatccgggcgatcccgaactggctgtcgccggacgccgcgaaggacatcctgctgccgttcttccagaagatcgacgccgggtccggcctactcgtccacgacttcaccgacccgtcattcgacacccgcttcctcggcgacctgtaccaggacctctcggaggcggcccgcaagaagtacgccctgctccagacgccggtgttcgtggaggagttcatcctcgaccgcaccctgctaccggcgatcgagacgttcggcctcgccacggtgaagatgatcgacccggcctgcggcagtggccacttcctgctcggtgggttcaacaagctgctggaactgtgggtgaaaaaggagccgggcacgccgccgcgggagttggtgcagcgagcactcgacgcgatccacggcgtggacctgaacccctacgcggtggccatcgctcggttccggttgctgctggcggcgtggcaggcggccggggtgacgagcctgaagaacgccccggacttcaagctgaacctggcctgcggcgactcgctgttgcacggcggccggtcggtgcagaagacactcgacgaggaggtattcgggcacacttaccagcccgaagacccggtcgaactggagcgattgctgcgccccggcacctaccacgcggtggtcgccaacccgccatacatcaccccgaaagatcgcgggctttgcgaccagtaccgtgatcggtattccgcctgccaccgtcagtattcgttatccgtaccgttcatgcagcgtctttttgaactagcatgcgcaaatggttttattggccagatcacggccaattcattcatgaagcgggaatttggcaagaagattgtcgaggcatttttccccctgatagacctgacccacatcatcgatagcagtggggcccacattccaggtcacggtattccgacggtgatacttttcggtcgtaaccgccccccggttgccacaacccttcgtgccgtcatggggattcgaggcgaaccgtgcgtgccagctaacccagcgacaggtccagtatggtcttcgattgagcagcaggtcgatcagccagggtctcaggggaagttcgttagcgtttctgatgcagaacgggccgtttttctgaaacatccttggagcatcggaggtggtggggtcgccgacgcaaaagaaaccatcgatcaggtttctaacacttgcctcgcatcaatagttgaatcgcttgggaggacggtatcgacccagggagatgacgtcttcgttgtgcccacggcgcaagcacgtcggagtggcatcgttacgggccactaccgtccacttgtgcgtggcgaagatgtcagggattggcaggctaaagccgatcttgcagtgttgttcccgtacgacacaaacctacttccgatacccgatgacttgtcagcaactgtgctccgctacctgtggcctgctaaagcagtgctggcttcaactttgatgtttggtgacaagacgaaggtgcaaactggattaaggtggtttgagtatggccagttcatcgccgatcgcttgcggaatcgtatcgcccttgtttacagcgaagtagccacgcacaaccacttcgctttcgaccgcgggagcagagtcttcaatcgtactgctcctatcatcctgctttccagttctgtcacggaagacgggcatttcgcccttcttggtttgctgaacagctcggtcgcaggcttttggctccgacaagtctgccacgataaaggcagcagcgggatcactggcggcataaaagtggaagcctgggatcgtttctttgcattcaatgggacaaatactaatcgatttccgctccctgacgcacgcccacgagggcttgcatttcggctcgacgctttcgcgcgcaacatcgcggacaatcagcctgccagtgtcattgctagatgggtcgatggtttatcgctctcgtctttactcgacagttctgaagccacgtgccgccgttgccgagggacaatgatacggctgcaagaagacctcgactgggagtgctaccgcctctatgggctgtccgctgacggcctcaccgactcacaatgggagacccgcgacttgccggtcaagctcggtgagcgggcgttcgagatcgtcctcgcccgcaagatgcgcgatgagggcttggaaacgacgtggttcgcccggcacggctcgaccccgatcaccgagctacccgcgcactggccgccggactaccggaagctggtcgaacgccgcattgaggccatcgcggccaacccgcagatcgccctgatcgagcagccggagtacaagcggcggtggaacgacaccccgtgggccgagaaggtcaccgccgccctgcacgactggctcctcgcccggctggagtcgtacttcgacattgatgggaggatgcgagaagatgagaatctcccgcaaagtcgcaaaggcgcaaagacggaaggttcttctcttggcgactctgcggctttgcgggagattcgtctttatccgctcactcgaatcgccgacgtggcgtcgaaggacgccgagttccgcgaagtgggccgactctaccgcgaggggcggatcgacttcgacgtaacgaagctggtcaccgaactggtcgaggccgagagcgtcccgctcctgccagtgctgcggtacaaaccgacggggttggataagcggctagcctgggagcgaacctgggatctgcaacgccgcgaggacgccatcgacgcccgcgtcgccggcaagtcggtcgatgtcggtgccggcggctggacgcaccagaaagacgacggcaagtcgccgctgaacccggcgcaggcgagcctgctcaagcagtacgtcgtcgacccgaacaccccgcagtcgatcccggtgccgccgaagtacaagtcggcagacttccagaagggcgactactggcgtctccgcggcggcctcgacgtgccgaaggagcggtgggtactattcccgcactgcggcggggccgacgggctgccactggtcgcctgggccgggtacgatcacctgcaactggctaaggcgatcgcgacccactacgtccacgtgcaggagcaggagggcggccgcgacgacccgcggctggtgccgctgctggcggcgatctgccaactgctcccgtggctgaagcagtggcacaacgagatggacgaggagttcggctcccggatgggcgactactacgaggggttcgtctcggaggaggcccgcgggatgggcaagacggtggacgaggtctgcacttggcagcctcctgccggcgggaacggccggagcggccgcggccggagagcaaagtag

SEQ ID NO: 2747 - DNA, 3591 bp, Rhodococcus ruber
atggcggacttttccgcgaccgaattggtgaaggcgctgcgcaagcaggtcaccgtcctcgaggacgatctgcgtgcgcgcgtcgacggtgcggacgtcgacacccggcagcccggggtcgagcagcggtggcgagccgagtacaccgccgcgctgcaggcccagcggacggccgcgtcgtggcaggcgtggcgcgacgaacgggtgacgcaggccgcggtggcgtgggtgctgctgacggtgttcgcgcgctactgcgaagaccacgcactggtgtcgagggcgtggatcggcggtccggacgcggatgcgcggcagcaggcactcgacgcgcgacgcgcgtatttcaccgagttcccggagcacaccgaccgcgagtggctcgaaacgatcgtcgcgcatttcgccaagatggaagccacccgcgggctggtcgacagctactcgccgatgcaccaggtagccccctcgggtgacgcggcgcgcagtcttctcgaattctggtgggacaagaacgcatccggtgacccgctgtggagcttcgccggtgtcgacacccgcttcctgggtgacgtctatcaggatctgtcggagttcgcgaagaagacctatgcgctgctgcagaccccggagttcgtcgaggagttcatcctcgaccagaccctcgaaccggcactgaaagagcgaccgctcgaggggttcacggtgatcgacccgacctgcgggtccggccacttcctgctcggtgcgttccaccgactgttggaacgctgggagaacgaagcgcccgcgctcggccgtcgcgtgctggtacagaaggcactcgcgtcggtattcggcgtggacatcaacccattcgctgtggcgatcgcgcggttccggctgatggtcgcagccttggaagcgagtggggacaagtcgatcgagaagttgatcgacatcgaactgaacctggcggcgggtgactcgttgctgtggggtgcgcggcagcaggcgcttgcggatgacctgtggtcgaccggtgccgagcagatggcgtatgcgacggagaacgcggacgcactgagggcgatcctgcaacgggaacacgatgtggtggtgggtaatccgccgtacatcacagtgaaggatgcggcgctgaacgcgacctatcgtcagctctactcgacgtgtcatcggcagtacgcgctgacggtgccgttcatggaattgttcttcgacctcgccaagagcaactccgagggcaagccagggtgggtcggacagatcacgtccaactcgttcatgaagcgggaattcggatccaagctcatcgaggaattcctgggtacccgcgacttgaagcgcgtcatcgacacgtcaggcgcatacattccgggacatgggacaccgacagtaatcttggtgggacgcaatcggacgcccgttggtgagacggttagagcggtgcttggggtgcgaggggaaccgggtcgaccggaggagtctgcccggggaattgtctggtcaaggatcgtcgctcacatcgacgagcctggattcgacgatggatggatcagtgtcgcggaactggacagatcgctccttcagacacacccgtggagtctttccgggggtggtgccgtcgaattggctcagtcggtgacgagcgctgcagtctcagtgctcgatagtcacgtgagcagcattgggcgtacaactgtcgtgggcgaggacgatgcatggatctacgacgcacacaactcgaagcgcttcatggaaatgctgccgctccgtgagttcgtcgtcggtgaggatgttcgggactttgagatcgctccctctaccctggttgtcaatccgtatgtcgacagcgcaaatgaaactcctgtcagtgagagatcaccggtggttgcgcacttgtggccacagcgaactctgctacagagccgaacggtcttccagaagactctgacggaacgaggacttccgtggtgggttcatcttgagagttactcgtcgaagctacgcaccccgctctccatcaccttcgccttcgtcgcgacgcacaaccatttcgtcctggaccgcggcggcaaggtgttcaacaggtccgcgccggtgatcaagttgccggagggggcgagtgaggacgaccacctgcggctgctcggggtactgaacagttcggtgggttgcttctggctcaagcagaacagccacaataagggcggcggcgggatcgggcgtggtgactcggacgaatcctgggagcagcgctacgagtttactgggacaacccttgatgacttcccgctcccgtcgtcctatcccctggagcgtggccggactctcgacaccctcgcgcgtgtactcgccgcgcaaaccccatctgccgttgccgcgagcggggtgccgaccgccaaggcactggaacacgcacatgacgagtccgagcggattcgcgcactgatgatcgcgcatcaggaggaactcgactgggagtgctaccgcctttacggcctcatcgacgaggacctcacctactccggtgaactgcccggaactacgctgggggagcgggcgttcgagattgctctcgctcgcgccgtcgaatccggcgagcacaccgcgtggttcgaacggcaccgctccaccccgaccaccgagattccttcgcacctaccggccgactaccgcgacctgctccagcgtcgtcttgacgtcatcaagtcgaacccgcacatccgcttgcttgagaagcccgagtacaagcgccgttgggcttcggagccatgggacaagcgcgtcaccgaagcactgcgtgactggctgctggaccgcgtcgagaaccgcgacctgtggttcgaaggcgaccaccccaccccgcgcagcgtcgcacagctcgccgaccgactcgaccgcgacaacgatttccgccaggtactgcggttgtgggccggcaacaatgaggtgtccacctcggcggctctggccaagctccttgacgaagagggtgtcccgtaccttgcggcgctgcggtacaagccgtcgggtctcatcaagcgcgaagcgtgggaacacacgtgggacctgcagcggcgcgaggatgcgggggagaaactcggcacccccattccggtgccgccgaagtacaagcccgccgatttcctcaagacctcgtattggtcgcgacgcggcaagctcgatgtaccgaaggaacggttcatcgcgtatccgaacgcgaaccgcgacaccgacccgtcgatgctgctcggctgggcggggtgggatcacgccgagcaggctctcgcgctcgccggcctcgtcgacgaacgcatcgcggccgagggctgggaccaggcgaatccagacaggctgactccgatgctggccgggctggccgagctgttgccgtgggtacggcagtggcacggcgagatcgacccggagtacggcgagtcggtggccgacaccatcgccgaggtcctgcgttcccacagcaccgacctcggcatcacccctgacgaccttgcggtctggcgacctccggcctccgctcgaggacgccggaccgtcaagaagtccgcaaaggagaacgacgacgcgtga

SEQ ID NO: 2748 - DNA, 3564 bp, Mycobacterium xenopi
atgacttgggccgcagcggatctggtggccgcgctgcgtcgccaggtgtcggagctggaagccgacttgcgagcgcgggtcgacggccacgatcatgacctgcgccagcagggcgtgtacgaggcatggaaacgggactacgacgcggcgttcgcggcgcagcgcacggcgtcgtcgtggcagcagtggcgcaacgatcgggtgacccaggcggcggtggcgtgggtgctggtgacggtgttcgcgcgctactgcgaggacaacgccctggtgacgccccgttggatcggcggtgccaccggtgacgaacgcggccacgcgctggatgcgcgacgtgcctatttccagcagcatcccgagcacaccgaccgcgaatggctgcagcagatcatctcccacttcgggaagttcactgcgacaaagggattggtggacgaatattcaccgctgcacctggtcgcgccatccggtgacgcggcgcggacgctgctggagttctggtggcagcagagcgcgacgggcgagccgctgtatccgttcgccggggtggacacccggttcctcggcgacgtgtaccaggacctgtccgagcacgcgaaaaagacctacgcgctgctgcagaccccggagttcgtcgaggagttcatcctcgatcagacgatggagccagcgctggcggaccggccgttggagggattcacggtcatcgaccctgcctgcggttcggggcacttcctgctcggcgcgttccgccgcctgcatgagcgttggcagcgccacgctccagtgctcggcgcccgcgaactggtggagaaggcgctcgacggggtgtacggcgtggacatcaacccgttcgcggtggcgatcgcgcggttccggctggtggtggcggcgctgcacgcggcgggggacaccagcgtcgaagagcagatccgctacacgccgcacctggctgcgggggacagcctgctatggggcgccaatcagcaggcgctcggcgatcacctggtgacgatcggccaagcggtgcaagcggattcgaccgagaacgccgatgcgctgaaagcgattctgcagcgcgagcacgacgtcgtggtcgggaacccgccgtatgtcacggtgaaagacgctgccctgaacgcgacgtatcggcagctgtacacgacgccgcatcgtcaatacgcgctcacagtgccgttcatggaactgttcttccggctcgcacatccgtcgggccgtgagcgaccagcgggctgggtgggccagatcacgtcgaactcgttcatgaagcgcgagttcggttcgaagctgatcgaggagttcctgcccacgatcgatctgcgagtcgtcattgacacgtccggtgcctacattccgggacatgggacgccgacggtgatcgtggccggccgcaaccaacgaccgtccacggacgctgtccgagccgtcctgggaatccgcggcgagccgggccgtccagctgagccagcccgaggcgtagtttggacttcgattgtcgagcatgtaaaccaacttggctttgagaatagctacatcacagtctgtgacatgctgcggcaaacgctttcaaagcatccttggtcgttgtccggcggaggcgctgtagaactccttaaggttctagagagtcaggcaaatatgcgcctcagcgacgtcgcaggcgagatcggatttggcgctgtcacacgcgaagacgaagccttcatggtcgggcgcggcgctatacggcgtgccgcgattccggatgaacttagtcgtccacttgtagagggtgacaagattcgcgactgggacattcgcaatgtgattgactcaatatggccttacagctcaacgactttgaaggcagtcaccaatcagcatgttgtccgcttcctatggccagctcgcactttactcagttcccgcgtcgcgtatgggagcacgcaaatcgagcgcgggctgaactggttcgagtattcaatgtttttcgtcaaccgttaccggacgcccctctccatcacgttcgcgttcgtcgcgacgcacaaccacttcgtgctcgaccgcggcgggaaggtcttcaacaggtcagccccggtgatcaagctgcccgcgggcgcgacggtcgaggatcacctgcggctgctgggtgtcctgaactcatcggcggcctgcttctggctcaagcagaacagctacccaaagggcggcgacccgatcggcaaggacggcgcccgtgtcagcgcagaaggatggagcgaccgctacgaattcactggcacgactctccaggacttcccgctgccttccaccacaccgctggatcgcgccaagttgctggatgagctcgcgcaagcactgcaacagcagacaccggtggaggtggctgcgcggcagacgcccgcccacgccgtgctggaaacggcgcggtcggagttcacccggcttcgcggcttgatgatcgcccaccaggaggaactcgactgggagtactaccgcatctacgggctgatcgacaacgacctcacctatggcggcgatgtccccgaaatcgctcttagcgaacgggctttcgagatcgccctggcgcggcgcatgaaagacggcgaggaaacggcgtggttcgagcggcacggctccacgccagtcaccgagatccccgagcatcttcccgccgactaccgcgatctgctgcagcgccgcctggatgccatcgagtccaatccgcacatccgcctgctggagcggccggagtacaagcggcgctgggcgatggagccgtgggacaagcaggtgcaggccgcactgaaggattggctgctggaccgcgtcgaggaccgcgccctgtggtatgaccgcgagggccggcccacggtgttgtcggtcgcccagctcgccgacatcctcgaccgcaacgaggagttccgccgcgtgctgcggctgtgggccggcgaccagaacgtccccaccggagccgcgttggcgaaactgcttgccgacgaggcggttccgttcctggccgcctaccgctacaaaccgtccgggctcgacaagcgcgccgcctgggagcacacctgggcactgcagcgccgcgaagacgccggcgagaaaatcgacgcccccatcccggtgccgccgaagtacaccagcgccgatttcgccaagccctcgtactggtcgcaccgcggcaagctcgacgtgcccaaggagcggttcatcagctacccgcatgcgggccgcgaatcggacaccaccgaactgctcggctgggcgggctgggaccacgccgaccaggcgctggcgttggccgcgctgatcagccagcgcatcgaggacggctgggacaccccgcggctgataccgctgctggccgggctgcatgagcttttgccgtgggttcggcagtggcacaacgagatcgaccccgagtacggcgagtcggtggccgacaccatcgacgacgagctgaccgcccggctggccgaacaccacctcaccgtcaccgacctgaccgcgtggcgtcccgagcccacgcgcagaacacgaagggccgcaacgtcatga

SEQ ID NO: 2749 - DNA, 3567 bp, Micromonospora sp.
gtggctgccggaggagtggagcggcgccgcccccgcacaacagcagaggaacgccacccgatgatccccctgaaggccctccaggcccaggtcaccgccctcaccgacgacctgcgcgcggtggtcgccggggactccgaactggagtcttcgctgcgcaaggaacacggccaggcgacagacgcccggcgtacggcggggacgttcgagacctggctggaggacgtcctcgaccaggcggcggtggcatgggtgctcggctgcgtcttcgtgcgcttctgcgaggacaacgcgctggtcgagccgctgtggatcggcggcccggagccgaccgccccggtcgagcgggcggtgcagcaccgacagcaatacctgatcgaccacccccgacgcaacgaccgggagtggctgcgcgaggcgttcacgtacctgcgggggctgcgcgccaccggcaagatcttcgacgagcacaacccggtgtggcggttcgacatctccggcgaggcggccgagaaactgtcggagttcttccggcgcggcccggggctggcgtccctgcgggtggaagacctggacacccgcttcctcggcgacctctaccaggacctgtcggcacacgcgaagaagacgtacgcgctgctgcagacgccggacttcgtggaggagttcatcctcgaccgcacgttcgagccggcggtgaaggagttcggcctgcccgacacgtcggtcatcgacccgacctgcgggtcggggcacttcttgctcggcgcgttcggccggctggtgaagctgtggcgcaagcgggagccggcaggggacatccgagtgctggtcgagcgggcgcttggccaggtgaccggggtggacatcaacccgttcgcggtggcgatcgcccggttccggctgttggtggccgcgatgaaggagtgcgggctcacgtcgctggagcgtacgccggcctggccggtgcgggtggcgaccggcgactcactgctgcgctgggggcgcaagtcgagccaccagggcgaccttctggagtacggcaagggcgagagcggctttgcgtacgcgaccgaggacgccgacgtgctgggcaagtacctgcgcgaggggcagtacacggtggtggtcggtaaccccccgtacatcacggtggcagacgcagccaggaaccagctctacagggagatttaccccgacgtctgccaccggcagtacgcgctgacggtgccgttcgccaagcgcttcttcgacctggccaagcgctcggacgagcacggcgagggcgcgggccacatcgggcagatcaccggcaacgccttcatgaagcgcgagttcggcaagaggctcgtcgaggaatacctggcccaccatgttgaattgactgaggttatcgatgcttcgggtgcatatattcctggccacggaacgccgaccgtaattttggtagggcgagcaaattcgcgtcggcgagtagctggcgtgcgagctgttcttggtgttcggggcgagccgagtcagccggatgagccgtcgatgggactcgtctggcgcgcgatagtggatcaggtcggccagcctggaagtgtttccgattgggtttcggtggctgacctgccgcgtgctgacctttcgcttcatccgtggagcctgtccgcaggtatttcctctcctgtcatgtccaagctccagtccagcgcgcgtgtcttgagtgatgttgtggacaatattggttacaccgggcagacaaacacagactcggcgatgctggcaagtaagaagcagtttgtcagggttggagttgaggcagacgctcatcttcagttcgttactggcgaggcggtccgaaatttcgttgtccatgagggtgatcattcgctctttcttcaccgcgattccgaaaccatcgatattgctggctaccccggggccttgcgtcggctatggccgcttcgagaggcgctgtgggctcgacggacgttcgccaagttgtcctataaggaagaagggcgcccgtggtggggctggcatcaggttgcatcgcagcgtctcggtgcatcgctgaacatctgcttcgccttcgtttccacccacaatcacttcgttctcagtagaagcgagaggcttttcaatcgcagtgctcccacggttaagctgaggaaggacgcgacggaggacgagcacttgcggctgctcggggtgctgaacagctcgaccgcctgtttctggctcaagcaggtgagtcagagtaaggccggcagtggaattggccgaggaattcagcccgaagcatggatggatcggtgggagttcaccgggacgaagttgcaggggtttccgctgccgggggcgtacccgttggggcgggcgcgggcgctggactcgctggcgcagcggctcgccagcctgagcccggcggcggtcgcggattccggggtgccgacccgggagcggctgcgcacagcgcaccgcgactacgacctgacccgggcgcagatgatcgcgctgcaggaggagttggactgggaggtctaccggctctacgggctgcttgacggcgacctgacctgcgccgagccgccggaactcaagctgggcgagcgggcgttcgagatcgtgctggcgcggaagatggcggccggcgaggtggagacgcagtggttcgcgcggcacgggtcgacgccgatcaccgagatgccggcgcactggccggatgattaccgggcgctggtgcagcggcggatcgaggtcatcgagtcggatcgcaacatcgcgctgatcgagcggccggagtgtaagcggcggtgggccagcgacggctgggacgagatgcaggccaaggcgctgcgggactggctgctggatcggttggaggcaccggagctgtggggcgaccggccgacgccgcagtcggtggcgcagctcgcggacaaggtgcgccacgacgacgacttccgctcggtgttggagctgtgggccgggcgcgacgactacgatctgacgaagacgctcgccaagctggtcgcagacgaacacgtgccctacctgcccgctgaccgatacaagccatccggcctgcgcaagcgggtgcagtgggagcgcacctggacgcagcagcggttggaggacgcgggcgagagcgtgcaggtagacgttccgccgaagtacagctcggcggacttcgccaaggcgtcgtactggaaggcgcgcggcaagctcgacgtgccgaaggagcggttcatctcgtacccgaaggcgggccgcgacaacgacggcacggtgctgctcggctgggccgggtgggaccacctcgcccaggcccaggcgctggcgaccgtctacctggaccgcaagctccaggcggcctggccggcggagcgcctgctgccgctgctcgcgggcgtcgcggagctggagccgtggctgcaccagtggcacgccgacgagcggcccgacttccctggctcacccgcccagttcttcacggacctgatcgacgccgagctgtcccagctcggcgcggaccgcgccgagctgaccaagctgcgaggcgtgatgtctgcctga

SEQ ID NO: 2750 - DNA, 3636 bp, Saccharomonospora xinjiangensis
gtggcagtgcgtggggctgacctgggcgagttggtgaaggatctgcgcaggcaggtcacggcgctcgaagacgatctgcgggcgcgggctttggaggtgccggagttccacaccccgctgcgggccgagtacgacgacgcgcgaaagcgggaacgcacggcggcgatgtgggagacgtggcttgatcagcgggtcacgcaggtggcggcggcgtgggtgctcggcacggtgttcgtgcggttctgcgaggacaacggtctgatccagtggccgttcatcgcgggtccgggggagcggctggccgacgcggaggagcggcacgaggcgtacttccgggagcgcccgcaggacaacgaccgcgactggatcgtcgcggccttcactcacctcgcgcaggcgcaccccaccgcggaggggctgttcgagccgaaatacaacccgctgtgggagatcacgccgtcgttcgaggcggcgacggcgctgttgcagttctggcggcggcgcggcgacgacggcgagatccgctacgacttcaccgaccccgactgggacacgcgcttcctcggcgatctgtatcaggacctgtcggagcacgcgcggaaaacgtatgcgctgttgcagacaccggagttcgtggaggagttcatcctcgacctcactctcgaaccggcggtaaaagacttcgggctcaaggatttgcgcagcatcgacccggcgtgtgggtcggggcacttcctgctcgggatgttccggcgggtgctggacaagtggagggcggcggagccgggcaccgatcggtgggagctgatccagcgcacgctcagctcggtgcacggctgcgacaaaaacccgttcgccgtgtccatcgcgcgattccggctgctggtggcggtgctgcgggaggcgaacgcgatccggctcgaccaggcgccacaattcccgatcaacatcgccgtcggtgactccctcatgcacggcaggggcgcgcccggaatccagggcgagttgttcgcgctggacgagccgcacacgtatgcgacggaggacatcaacgagtacgtgcgctcctgcgacctcctcggcaaaggctcgtatcacgtggtggtgggcaacccgccgtatatcacggtgaaagacaagcaggagaacaagaactaccgcgaccggtatgacgcctgctcgggcaagtacgcgctgtcggtgccgttcgcgcagcggctcttccagctcgcgatccggcgcagcggttctgaacgcgatgccggattcgtcgggcagatcaccgcgaactcgttcatgaagcgcgagttcgggaaaaagctgatcgaggacttcttccggacggtgcagttaacgcacgtcatcgacacgtcgggcgcgtacattccgggacacgggacgccgacggtgatcctggtcgggcggaaccacagctatcggaaagacgaccccgtccgggcggtcctcggaatccggggcgagccgagccaacccgaggacccggcaaagggactggtgtggtcggcgatcgtgaaacaacttcaccagcctggtagtgagtcggagtgggtttcggtagaagatttcgaccgccaagggttcagccaacacccgtggagcctcagtgggggtggtgctgcggatctcctggctgcgatcgaaagtacggccagcacgaaactcggtgacctatctgaatcgttgggaattactagtttcacactcgaagatgacttgtatttattgccatcgcgagctgcggtaaggcgatcaatcggggaatgggttcgaccgatggttaccggcgatgcgctacgcgaatggtggcacagcaactatggcgttgccatatttccctattccagcgaattttaccccgttgatgttgaaggcgaggctgccttgctcgccttcatgtggccaggccgcaccatgttatcgaacaatgtgatgttcggtcgtcagaccaagctggatgcagggttggcatggtatgagtatggtcgtctaactgctagtaagctccgcacaccgctctccattgcttttgcgttcgtggctactcacaaccacttcgtgttggatcggggtgggaaggtcttcaagcagtccgcgccggtgattaagttgccggagggggctggtgaggatgagcacttggagttgcttggggtgctcaactcgtccacggcctgcttctggctcaagcaagtgagtcacaacaagggcaatggcgcggacagcaaaggtgcgcgtacgacggctgttccttgggaggacttctacgagttcaccggcaccaagcttcaggagttcccccttcccgctgtgttgccgttggagttggggcgggcgctggattcgctggctcaggatcttgccgcgcgggagccgtccgctgttgccgaccgcgtcacgccgactcgcgagcggcttgatgccgcacgcgccgcgcatgcgcggattcgggcgcggatgatcgcgcttcaggaggaactcgactggaccgtctaccactcctacggcctgctcgacgacgccgagcgggcccggctcgtcgcgcccgacctcgacagcgtgccggaaatccagctcggggaacgggcgttcgagatcgtgctcgcccgcagggtcgccgcaggggaagcggaaacggcgtggttcgagcggcacgggtccacgcccatcaccgagatccccgcgcactggcccgactggtaccggcaaatcgtgcaggcgcggatcgacgtcatctcccagcggcgcgacatcgcgctgatcgagcggcccgaatgcaagcggcggtgggcgtccgagacgtgggagcgcaaggaagccgacgcgctgcgcacctggctgctcgaccgatgtgagcggcgggaactgtggttcgagctccgcgacgggctgcggcatccgcgcaccatgaccgtctaccagctcgccgaccagttccggggcgacaccgacatgcacgccgtcgccgccctctacgccgccgaccacctccgcaaacccgacctgccgctggcgcaggtgctggacaagatcctcgccgaccagcacgtgccctacctcgccgccctccgctacaaggacagcggcctgcgcaaacgcgcccagtgggagcaggtgtgggagaaacagcgggaagaagaccgcaccggcgaacggctcgacatcgccgtgccacccaaatacagctccgccgacttccgcaaaaccagctactggacccatcgcggcaaactcgacgtgcccaaagaacggttcatctcctaccctggcgcctcacccgacgccgaccccagcctgctgctcggctgggcgggctgggaccacaaagaccaggcgcaggcgctggtcaacctcgtcaacgaccgcacaaccgacgcgggctgggacaccgaccggctcaccccgctcatcgccgggctcgccgaactgatgccgtgggtgcggcaatggcacggcgaatacgacgaggaatgggacggcgcgcccgccgacgaattcagcgcctacctgctcgaacaacgcaccaaacaccagctcaccgacgacgacctgaccaactggcgacccacccccgcacggcgcggccgccgcggcacagcgaaggaaacccagcagtga

SEQ ID NO: 2751 - DNA, 3822 bp, Bradyrhizobium sp.
atgagcatcgcgaacttgccgaaactgctgcagcccgcgctcaaggcgctcgagaaggatcttctggcgcgcgcgaagaccgagagcgttgaggccggcctgaggaaggcctgggaggacgagcagaaggccgggcagactggacttagctttgagccctggcgtcgcgagcgcgtcacccagctcgccgtcgcctggatcttgtcggttgtctttgtgcgcacgctcgaggaccgcggttacatcgaaccacgcgtggccggcgtctccgcagatgcgttgcgcaccgccgaagaccgcgaggcgctgtacctccaagtcgcgcctttcctggggccgcgcgagtacttgcttgcggtgttccgcgagctatcaaagctccccggcgcgcatgacgtcttcgacgccaagcataacccggtctgggtgctctcgccgtcgagcgagggcgccaaggcgctgctcgactttttccgcaagcgcggttcgaacggcgcgccggcgttggtcttcacgggcgagaacacccgcttcctcggcgacctgtaccaggatctttccgagacggtccgcaaacgctacgcgctgcttcagacgccggagtttgtcgaggagttcattctcgaccagactctcgaccccgccattgcggagttcgggctcaaggacgtgagccttatcgatccgacctgcggctcgggccacttcctcctcggtgcgtttacccgactcttcgaacggtggcagaaggcagcgccgaccgataacatcgctgacctcgcgcgccgcgcgcttgagcagatccacggcgtcgacatcaacccctacgcggtcgccattgcgcggttccgcctcgtgctcgcgctgctcgacgcggtgggtatcaggcgcctcgagcgcgcgccggacattaaaccgaacgtcgtggtcgcagatagcctgctgcatcgttttggcaacgagtcaaacatgcagatgcggttctccgagcagatttcgatggacgacatctcgtggggtgaccagctcttccggctcgaaaaccgtagtgacgtggagcggctgctgagcagacgcttccacgccgtcgttggtaacccaccgtacatcacagagaaggactccgcgaagaaggcccgctatcgcaacgactatgccgcagcgacgttcgacgtcccgctcggcccccccttcgtcgagcgcttctttcaactcgccgtacaatccgggtacgtgggcgtgatcgtcagcaatgcattcacgaagcgtgattcgggcaaggctctaatcgaagaggtgctgccgaaactcgacctccagaaaatcgtagatacttcgggctgctacctgcccggacacggcacgcctactgtattgctcttcggtcgcaaccgctccgcagactctgacgcggtgaccgccgtcttgggcaaacgtggcgaacaacaggttccgccggaacccagctcggccccggtatggaccgagatcctgcggcaccacgacgccgttggctgggagggcacgtacatctcggtcgagcgaggaactcgtgctgaactgaagaagcatccgtgggtgctgtccggcggcggaggacgtgatctattccgaaaattggctatgggaaccagtcacacacttggagaccttagcgaggtcatcggatccagcgcggtaatgcgtgccgatgacgttttcattctggcaccgcgttggctccgaatgccgacgaagaccgtcattccgtacgtcaccggcagttacatccgggattgggagatcaatacgccgcttcgagcagcctttccctacgacggctcgcgcacgctttcagaagcagagatcggtgagctctacaacttggcttggtgccaccgtacagctctttggcagcgtcgtggaaagggatttaagacgaagttcgaacaaggcggacggttctacgagtactcgatgtactacccggacagattcacggcgccatttcggataccgttcgccttcatcgccacgcacaaccactttttggtggatcgcggtggcaagaccttcaatagaggggccccgattattatccttcgcaacgagcggacggagctcgattatcaagcacttgcgggctacttgaactcctccaccgtcgcgttctggtgccgcctcataatgttcccaaagggaggcgaccaagtcggcgagggcgcgcggctttcgaaaacgccgtggcaagaccgcctcgaatacgccggcaacctgctccaacaattaccggtcccgaagcttgacgacctgcgctccaagcttctcgacttggtcattaccgccgaagaaaccgtgagtcagatggcagagcaggcgcccgagaaggtcgtcgcggcaacgcttgcttcgacgcccaagctcgccgcccttcaggacgcgcgcacgaagaacctctcccaacgcacacgccttcgcggcatcctcacctcgctgcaggaggagatggactggcgcgtatacggcctcttcggcctgccgaccgtcgaggcgtcctcggttgataccgtgcgcgtgcccatcgagccgaaccatcgccccttcgaggtacgcctcgcgcgcaaggtgggggccgatgtctcggcctcggagtggttccgcgtccacaggcgcgaggccccgaaggacgtcggcggaccgctcgccgacctgtatcgccaacggctgcgcctgcttgacgatcccgagcacggcaagcatcttcgcctgctcgagacgcctgagacaaagcggcgctggtcggtgcccgacgaccagaaggcgttctcggaagccgtgcgcacgtggcttctcgcgcgtatcgaagcgtcattccgtgaccagtcgcagccggagctgcgctccgcgcgtcaactcgcgctagagctcgggcgcgacccggcgatcgccgctgcgcacgagctgctcaccgaggagagcggtctcgatctcgcgaagctaatctccgagctcgttgatatcgacggcgttccgttcttggcgggtttccgctacgccgagactggcatggagaagcgcgcgacgtgggaggacacctggcggctacagcgcatcgaagatgaagatcctgaaaaactcgctgccgagctgaagcggctgaaccttaagagcatctcagtgccggacaagtacggcccgaaggactacctacggcacttctggagcctgcgcggaaagctcgacgtgccgaaggagcgattcgtctcattccccggcggcaacaccgacgaggataccacgcccctcgttggctgggcgggctggaaccaccttcaggtggcgcaggcgctctcaggtctctaccagcgccgcaagaccgaagacggctggcagaaggaccgccttgtgccgctgctcgccggcctcgacgagcgcgtgccctggctccttcagtggcacaatgaacccgcggcggaatttggcggcatgaagctcggcgagttcttccgcgacttcgtggcgggcgaggcgcatgcgctcggcgtagctgtaggcgaccttcgcaggtggaccccgccttctgcgccgaagcgtactaccatcgacccggccgaggtgctcgccgcactctcagcatggaaacccgaggtcgaagaagatgacgaggacaacggggaccaggtcgagccgcccgagggaccgagcgacgtcgagctcgccagcgccgtgggcgtcaccaaggcgctcgtgggcaaggcgctgaagaagctcgtcgccgacgggcttgttgagaagctctccgggcgccctgctcggtacttggccatcggggatcaagcatga

SEQ ID NO: 2752 - DNA, 723 bp, Burkholderia thailandensis
ttggacctctatgcaggcagcggcagcgacgctcacgtaaccgttgtcgcactggtgcagcaggccagcgtaccttttttggatgcgctgcgttacagcgagagcggtttgcggaagcgcgcggtgtggcgtaacacatggctgatgcaacggcgcgaggatgcgctcgatgcggaggtggctcgccaactgactgatgagccgatcgaggcgattaaggaggagcaggcaaaacgtaaagccgcggaagtgggcgttgttcctgtcccaccgaaatacaagcaagtggattaccgcgaaggtgtgtattggaagttgcgcggtgcccttgatgtgcccaaggagcgttttgtttgttttccgggcttggagcgtagcaacgacgccggaagcccgatgctgctgtgggctggctacgatgccaaggcccgcgctttagccctgacaggctacctgtatgagatgcttcaacgtgaaggcgctgatgtggcgcgtttgacgcctgcgttggcggggctagacgagctactcccatgggtgcatcaatggcatccggaggccgatgacgacctgggcatgagcactggcgactacttgcagggcctgctcgatgcgcagttggcgcagcacgggctgacgctgagcgcactgcgcgcttggcaacccgaagctccggttcgccgcaaacgcggcaagcggggccagcacgtagcacaagcctaa

SEQ ID NO: 2753 - DNA, 3738 bp, Planctomyces maris
atgattaaccgcagtgctctcctctccgatctgcaaaaactcctcaaacggctcgaagccgatctgctcgaacgcagtgaatcggcggacgtgcctgcggtcggggagacgctgcgcgccgagtatgaacaggcacgtcaggcagagcggaccgcccagaactatgaagactggcggaacgacgccattacgcaggcggcggctgcctgggtgctctcggcggtcttcgtacggtttctggaagacaatcggctcatcgagcccccccgtttctccgggcccggcgatcagctgcagcgggcccgcgatgaacgcgaactctatttccgcacgcatcccaccgaaaccgatcgcgaatacctgctcgccgtcttcgatgaactcgccacgctgcccggcacgcgcgaggttttcagcgaacacaacccgctccgcgaactcccgcagtggctctccggggacgccgcgggcgaactgctcgacttcttccagaaaatcgacgccaacgccggcggactcgtccacgactttaccgacgccgactgggacacccgcttcctgggtgacctctaccaggacctctccgaagcggcccgcaagaaatacgccctgctgcagacccccgagttcgtcgaagaattcatcctcgaccgcaccctcgaacccgcgctcgacgagttcggcctcgacgcgcctcccgtcaatgatccgcagggccatcccgtcacgcaagccggcttccgcatgatcgacccggcctgcggcagcggccactttctgctcggcaccttcccccgcctgctcgaccgctggttccgccagcagcccggcggcaaagtccgcgacctcgtgcagaagaccctcgacagcattcacggcgtcgacgtcaacccctacgccatcgccatcgcccgcttccgcctgctcctcaaagccatgcaggcctgcgacattcaccagctcaaaaacgcccccgccttcacgctccacctggcctgcggcgactcactgctccacagccccctccgcggtggacagcaggtcttcgacttcgaactgacgagcgacgacgccgaatgcgaacacgcctaccagagcgaagacctccccgccctcaaacagacgctccgctccggcatctaccacgccgtcgtcgccaatccaccgtacatcacggtgaaagataaacaactgaatcaacgctatcgctcacgtttcaagtcatgtcaccgtcagtattcgctggccgttcctttcatggaacgcatctttcaactggctgctgagggaggcttcacgggacagatcaccgccaacagcttcatgaaacgggaattcggcaaaaaactgatcgaacagttcctcccgcagatcgatctgacgcacgttatcgacactagcggcgcgtacatcccgggccacggcacccccaccgtgatcctcttcggccgtcaccgcaaaccggtcaccagcacgatccgcactgtcatgggcatccgtggcgaaccgagtacgccaaaaaatccggcccagggattcgtttggtctgccatcgtcaatcaaattgaccacgtcgattcagaaagcgaattcatgagtgtcgcggattcagaccgggaactctttcataaacatccctggtcaatcacaggggggggagcatcagagctaaaagaaataatagagaatagaacttctagtgaattacaaaacttgatttcagagataggtgcaagtgtagtaacaagagaagatgatgtttatcagactggaaaatcaacccttagtagaaaaaggatttcaacatttcaatcacgtgcgcttattgatggtgaacatgttcgggattgggctatcgatggatttgaattaggcatttggccatacaatccagaaacattcaatccctttgaagatcaagaacagcaccgttatctttggccttaccggtcagggttatcaagtcgaattgcatttggtaaatcacaaatagaacatggtaagacctggtatgaatattctatgttcttcaaagatcgtttgagtgggaatttcaggattggtcaagcagaagtggctacacacaatcatttcgctttagaccgaggtgataaagtatttaaacaaaccgcccctgttattaaattatcagaagaagcatccgaagacgaccatctgaccttattagggctgctcaacagttcgactgttggattctggatgaaacaggtatgccatcagaaacaaatgatgggaggcgatggtatccggatcgaatccaaagccaaagtaccttacgcattcaatgccactgccgttggcaaattgccaattcctgaaagctggaccaaaggagcattacgcgaccgactgttagatctaacacaagagatggaccaagccactatgaagttcagcaatttaaaagctgaaacagttctctctgcagacaacctcaccaaggattcacttttaaaaacatgggaagaaaatcagcatcaaagacagaagctgcgttcacgtcagatctttttacaggagcagatcgatttcaccgtctaccgaatgttcgatctcatacccgacagactgattggtgaggagacagatcaaatcgatttcgatcttacggctggagcacgtcccttctgcattcgtgctggtaagaatgaagatggatttgatgtgcctgcatcggttccggaagactggccagaagaaattcaggcactgtggaacgcgcgtctcaaagaactggaatcgaataagtcactgcgacttatcgagagttccatgtacaaacgacgctggattggtcgacaaggtctgttcaatcatcaacgttcagataatgaactacttgatgcagcaaagaactggctgctggatcgtctggagcggtattttgattttgacgggcggatgaatcccgaggggacgccgaccgccgaggtcgacattcagctcatcagcatcgcccagctggccgatatcgcgggccgcgatccgcagttcctggaggtcggcgcggtgtaccgcgatgacgatgcgttcgacgtgcagcggctgatcgccgaactcgtccacgccgaacaggtccccctgctccccatcctccgctacaaacccgccggtctccgcaaacgcgctgagtgggaacagacctgggaactccagcgccgcgaagacgccatcgacgcccgcacacagctccccgaggacgatccgcagtacctgaccgaggcagccgcccgcgatctcaaacaggccgaggtgggcgacatccccgtccccccgaaatataagagcagcgatttcttctccaccggcggcgtccgctactgggcgctccgcggcaagctcgacgtccccaaggaacgctggatcagcttcccccactgcgagggccccgacggcacccccgtcatcgcctgggccggctacgaccatctgcaactcgcccgcgccatcagcgcctacttcgtcgaagtccaggaacagttcggcggccgcgacgatccccgcctgatcccgctgttagcatgtcagatcgaactactcccctggctaaaacagtggcaccacgacctcgaccccgaattcaaccaacgcatggacgaagtcttcgccggcttcatcaccgccgaagccaaagccctcgaaatgacatcagcagaaatcaaaaactggcaaccgcccaaaaaagtgagcaaagccaaacgaaaggccgggaaatga

SEQ ID NO: 2754 - DNA, 3615 bp, Streptomyces gancidicus
gtgatcgaccgcaaggctctgttggacgacctgaagcagcaggtcaaggcggtcgaggccgacctgggcaagcaggtaaaggcgctcgatgaggtcggcgcgcggctgcgggccgagtacgaccaggcgcgcaagctaggacgtacggcggcgacgtggacctcgtggctcgacgagcgggtcacgcaggtcgcggtggcgtgggtgctggggactgtgttcgtacggttctgtgaggacaaccggctgatcccggagccgtacctgacggggccggacggtgaccggcgtgagctggcggaggcccggtacgacgcgtacgtggagtcggacgacgacccgacgtaccgggggtggctggagaaggcgttcgacgagctgggccagggccaggccgggcggctcctcttcgacaagcgtcacaacccgctgtatcaggttccgctgtcgcatgacggtgcgcgcgagctggtcgagttctggcgccggcgtgacgaggcgggcgtcctcgtccacgacttcaccgacccgctgaacgaagacggcacggagggctgggacacgcggttcctgggcgacctgtaccaggacctgagcgaggccgcgcgggaaatgtatgcgttgctccagacgcccgagtttgtggaggagttcatcctcgaccggacaatgaacccggcggtgcgggagttcgggtacgaggaactgaagatgatcgaccctacgtgtgggtcggggcacttcgtactggggatgtttcggcggctggtgcggctgtgggcggaggggcagccggggcgggacacgcacgagcgggtgcgcaaagcgctggagtcggtccacggcgtggacatcaacccgttcgcggtggccatcgcccggtttcggctgctggccgcggctatggcggccagcggggtgcggacgcttgcagaagcagccaagtatgagtggccgatcaacctggcggtcggggattcgcttatcaaggcacgccgttctcagcagggcaaccttttcggaggagtggacgaggagcttacggacgagctggccgagttcaagtacgccaccgaagacgcgcacgagtacccggacatcttgcggccaggtcgttatcacgtggtggtaggaaacccgccctacatcacggtgaaggacaaaaatctcaacgttctttatcgggagctctacccggtgtgtgccggcaagtatgcgctgtcggtgccgttcgctcagcggttctttgaattgtccaagcgtggggatgcccaggggcccggctacggcatggttgggcagattaccgcgaactcttttatgaaacgcgagtttggggcgaagctcatcgaggggtatttcgggcatgcggtcgaactcactgaggtaatcgacgcatccggagcttatattccgggacacagtacgccgacagtaattcttatcggtaggcagcgaggtggtgacgcgcgaatgccagtcattcggaccgttcgtagcatacagggtgagccgtctgcgccagctaacgccgagaagggattggtctggcaggcgatcgtagagcagattgacaagcctggttcggtaagtcagtgggtttctgtaagtgatttggatcgccagaagtacttctctcaacagccgtggattcttgctgacggcggactggaaatggtcgatcagctcaatgcggcttgcacggataaactttcctccttgactagtcggcttggtgtcttcggtatgacgaatgctgatgacatcatgttggcaaccgaggccgcttggaggcggcgcgggggagagagtgagtttggcaaggatctagtgctcggtgatgaactgcgggattggtgtcgagacggtagtacttacagcttctttccgtacacggatgatttgaagattcgtgatttgcctgaggggtcaggggcacacaagtggttgtggccggctagaacctctatggggaatcgagctactttttccaagggtacctatttttcggacggtcgccggtggtatgaatggcatcaaaccacgccgagccctggcgcccacgcttggacgatttgctttgcttttgtagcgacgcataatcactttgtgctggatcggggcggaaaggtgttcaagcagtcggcgccagtgatcaagcttcggcaggatgcgactgaagagaagaatctgcgactggttggattgctcaatagttccaccgctggcttctggctaaaacaggtgagtcacagtaagggtaacgctacggcgtccagcggtatgcctgatcagccgtggtcatggaactacgagttcactgggacgaagttgcaagaattcccacttccttccacttatcctgctgctctcgcgtatgacatagacaaactggcacagcaactcgccgccagcgctccggagtcggtatgttctgcatcaacgcctaatgccagcgtcctccgtgaggcgcgcgtcacctgggaagccactcgcgcccggatgatctcccttcaggaggagctggactgggaagtttatgcgatctatggtctgcactctgagagtttgcatgctttgagttctgacgtacctgaaatttctgctggtcagagagcattcgagatcgtcctcgctaggaagattgagagcggcgagctagccacaaaatggtttacgcaccatggccacacgccaatcacagaaatcccttcccactggcccgctccttaccgtgaggttgtccagaagcgcatcgacgccatcgagtcgaaccgcgctatcgccatggttgagcgccctgagtacaagcgccgctgggccaccgtgggctgggacgtcctccaagagaaggccctgcgctcctggctgctcgaccgcatggagaatcgggaccactggttcgacgagaacgggcagccgaccattctcaccttgccccgcctcactgacgccctctcccacgacgaggactttgtttccgtcgccaggctctacgcgccccgcaaggaccttctcaaggtggtcgcggagctgctcactgacgagcacgtgccgttcctctcagccctgcgctacaagccctccgggctgaagaagcgcgctgactgggaagaggtgtgggacctccagcgcaaggaggatgccgcgcccgacgagcaaaccaagcgaaagatccgggactccatccccgtaccgccgaagtacacctcggccgacttcctgcgcccgtcctactggcgggcgcgcggcaagctcgacgtgcccaaggaacggttcatctcctacgggcagaccaatgccgccacccctgagctatatggctgggccggctgggaccacaaggagcaggcgcaggcgctggcgacgtacttcaccaacaccgcgctgtccaccgaggagatcacgccgttcctcgccggcctgctggaactgcagccgtggctgtaccagtggcacaacgagttcgacatgctctacagcggctccccggcggacttcttcgccggttaccgccagcagaagcagggcgagcacggactcacggacgacgacctccgtggctggcgtcctccggctgcgacccgaggtcgtcgcgcagcagtgaagcagtag

SEQ ID NO: 2755 - DNA, 3621 bp, Gordonia amicalis
atggcgttggccacgatcgcaggcacccagttgacggccgccctgaaacctcagctcacgctcttggtcgacgatatgcgtacgcgtttggacgctgatcccacgagactcgacaaatggaagagcacgcatcgggaagcagtccaggaacaacgcactgcaggatcctggactgattgggccgaagatcaactcaaccaggctgccgttggttggttactgacatcggtgttcgtccgcttctgcgaagacaacctcttgttgggtgaatcggccgtgtggatctccggccccacaccgatgctgcgccagcgggctatcgatgcagagaatgatttctaccgtaaccaccaggatctctcgtaccgagagtggttggcacagtcgttcgaagcgttgcgcgacaatcctgcgactgcggcgctcgtggacgagcatgcagcactgaacatcatggaaccgtcttctgacgcagtgcaacagcttctcgggttctggcgccgaactgacgatcacggtgacctcgtctggtcgttcgcggacaccgagctcacaacacgtttcctcggcgacctctaccaagacctctctgacttcgcgaagaagaagtacgcactcctccaaaccccggagtttgtcgaagagttcattcttgaccgaacgctagaacccgcccttaaggaccggccactcgagggcttcaagatcattgatcccacctgcgggtcgggacacttcctactcggagctttcgagcgactggtcgagcggtggcaccaccacgcacccggtttagaactacgcacccgcgtggacaacgcgttggcatccgtgtatggagtggacctcaacccgtttgctgtcgccatcgcaaagttccggctcattgtcgctgcaatgaaagcctgcaacgagaagtcactcgtaaacgctccgaaattcactttgaatctcgccgccggcgactccctgctgcatggaccggagaaaggtggcgcccacgccatcgatttcggcgacaccgcctacgacaaagacgccgtggtgtcggcactgacctacagtactgaggacgctcggctactccggacgcttcttgctccggggcaatacgacgccgttgtcggcaacccgccgtacatcactgtcagcgacaaagcgttgaacgcgcgctatcgcgagatctaccactactgcaagggcaagtacgcactcaccgtcccgttcatggagaagttcttcaccctcgccaaaggcggcgatagggctggctgggttggccagatcacctcgaactcgtttatgaagcgtgagttcggtgtgccgctgatcgaagacttcctagctggcaaggacctcaggctcgttgctgacacctcgggcgcgtacattcccgggcacggtactccgacagtgatcgttgtagggcgcaaccatacgaagatccacgacgatgtgcgagcggttctcggcatccagggtgaaccgggcgcacccgagaatcctgccaagggcaaggtgtggacgtccatcgtcgcgaacgtcgagaacgctagctacgaagaccagtgggtatcagtgacggatctcccccgcgagaatctgcggcaacacccctggagtctttccggcggtggcgcggtgaacctactacaagcaatcgagtctgcacgcgttttcgagctccatgatgccgcgaaacgaatcggggtatttggtatgaccaactgcgaccccggaatgatcatcgaccggcggacgagtgcacgccgtcaactggagccagaggcgctacgccgattggttttgggtgacgagattcgcgactatctgatcgctgaaggcaatgatgtttggtttccctatcgcggacacagtgaactgcaatccatttcgctgtatcccaatggcgcgatgtacctgtggccgaaccgaacggaactcggcaaccgggtcacatttaacaaggttccctacttcgtcgaagggcgtccgtggtacgagtggcatcaggtgccgaagggggacgatcaaaacaccccgacgattaccttcgccttcgtcgccacacacaaccattttgtgctcgaccgcggcgggaaggtgttcaaacagtctgcgccagtgatcaagctgccggcgggcgcgactgaggatgatcacctacggttgctcggcaccctcaacagttccaccgcatgcttctggctcaagcagaacagtcacgacaagggccggccgggagccgacactgctggagctgacgagccgtgggaacgccgatttgagttcactggcaccactctccaagagtttccattgcctgccacggcaccgctcgaccgcgcgcgttacctcgacactttggcgcaagagcttgcccaacatgaacctgcggcgtctgtcgcaacagacggcccgatagagagcagccttgcttcagcacgcttagcgcacaaacaggttcggatgttgatggtggctgagcaagatgaactggattgggaaacgtatcgcagttacggtcttattgacgatgacctaacactgccagtcggaaactcgccgggaatcgagcccggcgaacgcgcctttgcaatcgtcctagcccgaagagtcgccaacagtgacctcgaaaccagttggttcgaccaccacaaccacaagttcaccccgaccattgagatcccgactcactggcccgatgaataccgcgcgctggttcagaagcgtctcgacgcgatcgagacgaacccgttcgtaagactccttgaacgccccgagtataagcgtcgatgggcgggcgacacgtgggacctcaaacttctacgggcactgcgtgattggttgctagacaagctcgaagagccgagcctctggttcacccagcaaggcaccccgcagccacgatccatcggcgaactcgccggtgagatggaacgcgatcccgagttcctcactgcgctcgatctgtgggccggacagaaggacgcaccggtgacggccaacctggtcaaacttctgtccgtcgaagcggtaccgtaccttgcagccctgcgctacaaggactccggccttcgaaaacgtgccgagtgggaacgcgtgtgggacctgcagcgcaatgaagatgcaggcctgatcaaagccacggacatccccgtgcccccgaaatacacgactgccgacttccgcaagacgtcgtattgggcacaccgagggaagctcgatgtgcccaaggaacggttcattgcatttcccgacgccggcagggcgaccgacccgaccccactgctcggctgggccggttggagccacgcccatcaagggttggcattggcgaccatttacgcgctacgtgaatccgaaggcacaccgctcgaagaactagtcccggtggtcgcgggtatcgctgaggttcttccgtgggtcaagcaatggcattctggcgccgatccccacctgggtgtcgatctcgccgagtacctgactgcacaactcagcgaaaagtcctccagcgtaggggttcccgtcgctgagttgaagaactggcggccagcggccggcactcgggggcgcaaaacagcaagcaagacgtcacaatcgcgaaaggcaggcaactag

SEQ ID NO: 2756 - DNA, 3582 bp, Mycobacterium intracellulare
atgagcccccgtgagacgttgacctccgagctgcgcgcggaggtgctgcggctcgaggatgatcttcgtgcgcgtgtcactgccctgccagacgtgcagaagaactggcgctccgagtacgaggctgcgcgggcagcggagcgcacggcggctgcctgggaggtttgggtcgacgagcgcgtcaccctggccgcggtcgcgtgggtgctaactaccgtctttatccgattctgtgaggacaatggactagtcaagccggtatggatcagcggcccccgcagcagggaggccattgaagcccagcagcagttccttcgcgagactgctcgtaccaacccggacgtcaccgaccgcgagtggttgctacaagcaaccaattacctgcagtcgcttccagcgacagctggccttgtggacgagacatcacctatgtggcttgtcacgccttcaggtgacgccgctacccgcctggtcagcttttggcgcgagcgtgacgagagcggcggccttatccgcgagctcaccgatacgaacttggagactcgtttcctcggggacctctaccaagagatctccgaagacgccaagaagcggtacgccctgcgccagactcccgtcttcgttgaggaattcatcctcgaccgaacgttggagcccgcactgaatgagcgccctctcgagggcttcaagatgattgacccgacctgcgggtctgggcactttctattgggtggcttccagcgattgcttgatcgttggcacaagcagttccctgcactggatgaacgagagcgagtccagggcgcactcgactcggtctacggtgtcgatctcaatccgtttgctgtcgcaatcgcccgattccgactgaccgtggcagcacttaaggcgtctggtttgagcaatttagaagatgctccggcgttcaaataccacctcgctgcgggcgattccctactccacggactggatcagcgcgagttcgagctcggatcggaattttccatcgaccaggtagccgctaatttttcgtatgccacggagaacttccaggcgctcaagataatgctccgtgagggccagtatgactgtgtcgttggtaaccctccgtacatccaggtaaaagatcccggtttgaacgagttgtacaggaatgcgtaccgacattgccgcggaacctatgcacttaccgtgccgttcttgcagcggttcttcgccctagctaagtcaacggctgccggatcaggctgggtcggccaaatcgttggcaacgctttcatgaagcagcagtttggcaagccgctcgtggagaagtacatacccactcgcgacctcaaactgatcgtgaacctcgcaggtgtccccatccccgggcacgggacgccaaccgtgattctcgttgggcgcaaccggaatccgacttccgacttagtgcgcgttgttctgagcgtcaaaggtgagccgggacacccgccggaccccgcacaggggcacgtgtggacgagcatcgcacgccatgtggatgacatcggttggggagacgagtggatcacggtcagagatattgagcgcaagcggctaggcacgcatccgtggtcccttagcggcggcggtgcacttgaactgcttgaaactctcgacagtggcactcgagtgctcgataacctgatcgggcggatcggatatagcggacaaaccaacgccgatccggcgttcgtcgcaccccgggacgcgttcgtccgtcggggggtcgatgatgattggattcgtcagtttgtgccgggtgaggtaattcgcgacttcgaaatccgggacagcgactacgcaatttttccatacgccgatggcaagctccgagacatcgacgagcaccaaggaatctatcgatggttatggcccgttcgcacggtgacctggagtagggcgacgttctcaaaagccacctaccgcgaggatgggaggacctggtgggagtggcatcagatcgccctcgacagggtaggttggccgttttcactagcctatccaaacctcgccacccacaaccacttcgcgctcgataggaagggccgcgtcttcaatccgcacgcgccattcatccagttacgcgttgacgcgtccattgagcgataccaggagttacttggatatctcaacacatcggtcgtgtgcttctggctgaagcagaacagtcacgacaggggcgtaggcggtatcggcggtggcatcggcgacgaggcatgggaacctcggtacgagttcaccggagccacgctgaagcgtttgccaatcccggcttcgcttccttctggtcgaggcgaggtgatcgaccggctatcgcaagaattgagcaaccccgtactgagagcgctcgaagaaaccagtgcgcccacccgggcggcgctcgacgaacgcgccgcgaaatggaaacgaacgctgagtctcctcgtcttcgagcaggaggaacttgactgggagacgtactcgctctggggactcgtcgatgaagatctcacatatcgagaggcagatattccgaccatcgttcccggccaacgcgccttcgagatcgtcctcgcccgccgcatcagagatggcgatgaggagtctgcgtggttcaaccgacatgggtcgacgccgatgaccgaaccaccggaccactggccgccgggttaccgccatctagtggagcgccggatcactcaaatcgaaacacatccatacgttgggctactggaacggcccgaaaacaagcgtcgatgggttactgaagcatggaatgagcaggaggagcgcgccctccgcacgtggctattacggcggctcgaggaatctcgtttctggttcgacgctcaagggcggccgaatccgaaaagccttgcagtcctcgccgatgaggtcgcccgtgatcagcaattcgcatcgactctctcattatgggagggacgtctggatgttccggtcactgccagtctcgccaagctcatcgcgagcgagtgtgtgccttacctcgcggcctttaggtacaaggaatctggcatgaggaagcgggcagcttgggaatccacgtgggaaatccaacgccgtgaggataccggtcgctacaaccctgcaccgacgaaccaaggaggcgacggtcctgtacctgtgcctccgaggtacataagcgctgacttcgcaagacccgagtattggtcgaatcgcggaaaattggacgtgccaaaggagcgatttgtcctgtatcccggcgcaggccgtgacggcgatcagacgcctgtcctgggctgggctggatgggatcacgcacaacaatcccttgcactcgcggcgttgatacagtccggtgagcaacaaggctttccagatgaccgcctgataccgctagtcgccgggctttccgagcttcttccatgggtcgacctgtggcacggcgagcccgatgccctttatggcggcagcagtccagctgagttcttctccgagctgctcgacgggtacatggtgaggttgggggccacccgcgagtcactcgcccactggcgtccacaagcaccgacgcggggtaggaaggccaggccatga

SEQ ID NO: 2757 - DNA, 3600 bp, Phaeospirillum molischianum
atgatcattcccgctgttctcctcaaagacctcaagcgcctcgttcgtgtcctggaagacgatatccgggatggcctgccggggacggcggcggatgcacggctgcacggtgaatggcaggcggcgaaggaggccgggcgcaccgccgccacctatgaatcgtggcgcgaagaggagatcacccaatccgccgtccattgggtgctgggcggcgtgttcctgcgcttcatcgaggacaacggcctggtcgagcgaccgtggctggcggggccgaacccggagcgcatggcgctggctcgtgaccgctacgaggggtatttccgcgcccatccgcatgaatccgaccgcgactacctactggcctgcttcaccgaggcgggacagttgcatggcgcggctgcgctgttcgacacgcgccacaacccggtgtgggaactgccagtctctggcgatggcggtatcgcgctcatgaatttctggaccaaggccgaccccgatagcggccggctggtccacgacttcaccgatccggacctgtccacccgcttcctcggcgacctctatcaggacctgtcggaggcggcgcgcaagcgttatgccctgttgcagacccccgaattcgtcgaggaattcatcctcgaccgcaccctcaccccggccatccaggagttcggcttccgcgaggtgcggctgatcgaccccacctgcggctcgggccacttccttttgggtgctttccaccgattggtgactgagtggagccgcgccgagccaggccgcaacatccgcgatgtggcgcaacgggcgctggacgcggtggccggtgtggacatcaacccattcgccactgccatcgctcgcttccgcctgctggtggcggcgctgaaagtgtgcggcatcggcaggctggccgacgcccccgattttcgtttcgagctagcagccggtgacagcctgctgcacggcaagcggttcatggatatccgaggcgtccaactcagcctcgacccgcatgacggtgtcacccattacttccacaccgaagaccgcgacgaccttgatcgtattctcgggcggcagtaccacgcggtggtggggaatccgccatacatcatcgttaaggataaggcgctgaacgacgcctaccgccagcgctatagcacctgccacatgaaatattcgcttggcgtgccatttaccgagcgcttttttgatcttacccaggctcagaacggccattccgccgggttcgtaggaatgatcaccgccaacagttttatgaagcgagaatttggcagcaaactgattgaggattttctcccgcgtgttgatctgacccatgtggttgacacatctggtgcattcataccgggccatggaacgccaactgtcatcttgtttggtagaaaccgtagacctcttttgggtgacgtcagggttgcaatgtcgatcatcggagaaagcactgagccgtcaaatccggcggaaggacctgtctggctcagcattttaagccagattgatagcgcagggagtgaaggtgcattcgtgtcagtagcggacattgcaaggatatcgctctctagacacccgtggtcactcgggggtggtggggcttctgatttaaaacaagcaatagaatcggctgcgaagtgcaccttaggtgaatatcccgcaaattcaggcgtgatggctctcacgctcgaggatgagccatttattgctgacgacatggtgtttattcggaatggaattccaaaagaattcatcaagccttacctcactggtgcagatgtaagagactacgcctgtggcgaaggcaatagcattgtgtttccatatggccgtgacgtaaatccatttctggatgaaagtatattgcgctggctgtggccacataaggccagtcttgcaaatcgtattatgttcaggagaaatcaattacaaagaggccttcattggtatgagtacgggatgtttgttaaaactcgctttggtgagccggatgcgattaaatttgtatgcgtcgcgacacacaatcatttctctgcggcgaaatttgaagccgtctgcaatagacatgcacccgtaatttccgctccagatcatgattctgctgtctggatgtgcgcggagttgaattcatcgacagcagcattctggatgcgatctgtttttcacaataagggtagccaaggaatctcggagggcttcaaagctgaagtctgggaacgcttcatcgaggttggctctacaggcctgcaatccttccccctcgccgaaccctaccccctcgaccttgcccgcgaactggattccctggcccagcagctttcggcaaccctgcccgctgccctgctagcggtcgccgtgccggctcgcgcccaattggatgcggcccgtgagcgggcgctgtctatccgccgccgcatgatcgcgttgcaggaggaattggactggcgttgttataaactctacggcgtcgtcgatggccacgaggccgaagggctggaattcgggttggaggcaccggaagttgaccttggccagcgcgccttcgaaatcgtcatggcccgcaagatggcggcggaagaattagagaccacttggttcgcccgccacggttccgtccccaccgccgagatccccgaccattggccggtggcgtatcgagccgtggtcgagcgccgcatcgccctaatcgagtcccacagccatatcggcttggtggaaaagccagaatacaagcggcgttggcagtggagcgacggcggcttcgaggccggctgggcggagcgcgagcgggacgcgctggaacgctggctgctcgaccggctggaggatgggtgctattggcagggcggcccggcgctgaaatcggttaatgccctggccgacattgcccgtgccgacgatgatttctgccgcgctgccgccctgtacgaaggccaagaccatcccgatctcgccaccctggtcgcccggctggtggccaaggaatcggtgccgttcctccccagtctccgctatgccgaatcggggcggcgcaagcgcgcccagtgggagcaggtgtgggacctccagcgccgcgaagatgccggccaggatgtgggcaccatcgacgtgccccccaaatacaagcgcgaggacttcctcaaccccgatttctggcgcctgcgcggcggcctcgacgtccccaaggaacgcttcatcagctacccaggcgccgagaaatccgccgatggcgggttgatggtggcttgggccggcttcgaccacctcgcccaagcccgcgccctggccggcttctatcacgagatgaaggatgtggaaggctgggacgcaccccgcctgatccccctgttggccggtctcgccgacctaatcccctggctgaagcagtggcacaacgcctatgacgcggatttcggccaaggccccggcgactggttcaccgccttcctggccgaggaagcccgcaccctgggggtgaccgccgacgacatcaccgcctgggaaccggcggcgaaggtcaaggcgaaacggggacggaaggcgaaggcgaccgaccagattacgttggaggatttgggactttag

SEQ ID NO: 2758 - DNA, 3624 bp, Nitrococcus mobilis
gtgatcgaccccgtaaccctgctcagtgctctgcggacgcaacgcgacaaactcgaaggcgacctgcgccggcaggtcgcggagctacccgaactcaaggcacgcctgcaaaccgattaccgggccgcccatgaggccggccgcaccgccgccaccttcggcacgtggaccgacaatgagatcacccagggcgccgtggcctggctgctggcctgcgtcttcgtgcgctttgccgaggacaacgggctgattgcggctcccctgctgtccggccccaatgatgccctgcgccgcgcccgggatgccgcgcgcgaatacttccgccgccatcccaccgaacacgaccgccactacctgcaccacggcttcgatcagatggcggcgctgccggccgtggccggcctgttcgaccgcgcccacaacccgctgttcggcctgccgctgtcgcccgaaggcgcgcagggattgctgaacttctggcagcaggtcgatcccgacagcggtgcgctgcgccacgatttcaccgaccccggcctcgacacgcgctttctgggcgatctctaccaggacctgtccgaggccgcgcgcaagcgttatgcgctgctgcagacgcccgagttcgtcgaggcgttcattctcgagcgcaccctggagccggccatcgacgcctttgggttagaggacatccgcctgctcgaccccgcctgcggctcggggcatttcctgctcggcgcgttccagtgcctgctggggcactggcaaaaagccgcgcccgggctggacgcgcgcgaacgcgtcatccacgcgctggccggcgtgcatggcgtggatgtgaaccccttcgccgtcgccatcgcccgcttccgcctgctggtggccgcgctgcaggctaccggtatcaagatgctgaaggaagcgcccggctggtgtttcaatctcaccgccggcgactcattgctgcacggccggcgtttcggccagctcgacctggtggggggcaagggcctggatcaacgctacgcccatgcctacgccgccgaggacatcgacgaaatcaaccgcatcctcggccagcaataccacgccgtggtcggcaatccgccctatatcacggcatctgacaaggcgctcaatactctgtatcgcgcgcgttacggctcttgccaccggcagttctcgctcggcgtgccgttcaccgaacgattctttcagttggcggttgaagatgccaatgggccggccggcttcgtcggcctgatcacgaccaactccttcatgaagcgcgagttcggtaagaagctgatcgaggattacctgccgcgccaggatctgacccatgtcatcgacacctccggcgcctacatccccggccacggtactccgaccgtaatcctgttcggccgcaatcgggcgccggttgcggaaaccgtgcgcgccgtgcttggcattcgtggcgaaccgagcacgcccgcgaacccggcgcaggggctggtatggtcgtcgatcgtggagctgctcgatcggccgggcggggagaacgaatacgtcagcgtgtcggatatgacgcgcgagcgactggcgcagcatccgtggagtttgcaaggcggcggtgcgcccgccgttttggaagcgatcgattcagcgcccacaaagctcgccgaagcttcagcctcaattggcttccactgcatcaccaagcaggacgatgttttcagccagcccgagcatgtgttggcaaaggcaaatgtcgagcatgaagcgatccgcggcttcggtattggagagcaggtccgcgattggatggtcgatgacgatggttttgtgatctacccgtacaacacggctgttgaaacggttgagccctctaagctgccgtacgcgattcgcttcatgtggccttttcgcagcacgctattcgagcgcaaggtctttggcgggcaaagctatagggatgccggcaagccttggtacgaatacggccagattccaccgagcaaactcaaaaccccactctccatcaccttcgccttcgtcgccacgcacaaccatttcgtgctcgaccgcggcggcaaggtattcaaacaatcggcgccggtgatcaagctgccggccgcggccggcgaggaccagcatctcggtctgctcggcctgctcaacagctcgacggcgtgcttctggatgaagcaggtactgcatagcaagggtggtggaatcggcggcggcttggcgtccgaagagtgggagaaattctacgaacacactgggacggggatgcagtcattccccctgccagacaaacgccccttgcagttcgctcgccagctcgaccgactcgcccagcaacgcgccgcgagtcttccggccgcgttggcaccgcgcctgccgctcggccgtgccgagctcgacaacgcccgcgacaccgccgtctcactgctggcgcaaatgcttgcccaccaggaagagctggactggtggtgctaccgcgcctacggcctgctcgatacggacctgtgtttcgctgccacgccgcccgaggtccagctcggcgagcgcgccttcgagatcgttctcgcccgccgcatcgaagcgggcgaggtgcaaagcaaatggttcgagcgccacggctcgacgccgatcaccgaggtgccggcgcactggccggacgattatcgagcgctggtcgagcgccgcatcaatctaatcgaatccaacgcctggatcgatctgctggaaagacccgagtacaagcgccgctggaaccagccggactgggccgagctggagcaatccgcgctgcaaggctggctgctcgatcgcctggaaaccgcggattactggccgcagcccgcgcttcgaagcatcgagaccctggccgccagagccgagcgcgatgccgcctggatgcaggtggccgcactctacaccggtcaacccggcttcgacatcgcggctctggtcggagaactggtgcacgatgagtccatgccggcgctgaaggtgctgcgctacaagccctccggcctgcgcaagcgcgccgactgggagcgcacctgggaactgcaacgccgcgaggacgtcatcgacgccgagatcgcccgcgccaatccgcgccgggacggcgaagccgcagccgcctggcgctcgcgcatcaaacccgagcaggacgagcgcaaggccgcggagatcggacccatcccggcgccgccgaaatacacccgcggcgatttcctggccggcacgttatggcgcctgcgcggcggcctggatgtgccgaaagagcgcttcttccgcgtgcccgacccgcaggcgcccggcgagtggctgtatggctgggccggctggaaccccgcgcaacggctgcaggccctggccggcgcctttatcgccgccgagcagggcagcggtgcggagctggcgcggctgatcccgctgctggccgccatcgacgagcagctgccctgggtgcggcagtggcacaacgaggtggaccccgacatggacgtgcgccccggcgactacttcacgagctggctgggcgagcagctcaaccgccacggctggaccggccggacgctcgccgactggcaacccgaatcgatcagccgccgccggcgccgcacctga

SEQ ID NO: 2759 - DNA, 3591 bp, Frankia sp.
gtgatcgaccgggtggcgctgctcaaggacgcgcagcggcaggtgaaggcgctggagaaggacctgcgcgcccaggtggacgacgtcgcagaggtcgggacgcggctgaaagccgagtacgaacgggccttcaaggtggagcgcacggccgcgacctggtcggcgtggctcggcgagcgggtcacccaggcggccgccgcgtggatgctcgggacggtgttcgtccgcttctgcgaggacaacgggctgatcggcgacccgtacctggccggcccgacgaccgcccgcctcaccctcgccgaggagcgcaccgaggacttctaccgccgccacccggaaaggaccgcccgcgactggctgcaggccggcttcggcgagatcgcgaaggtgccggtcggcgccggcctgttcgacaggcagcacaacgccctgttccagatcccgctctcccacgacgccgccaaggaactgctcaccttctggcgccgccgcaccgaggccggcaccctcgtccacgacttcaccgaccccgcgtgggacacccgcttcctcggcgacctctaccaggacctctccgaggacgtgcgcaagaagtacgcgctgctgcagaccccggagttcgtcgaggagttcatcctcgacctgacgctgactccggccatcgaggagttcggctatgacgtcgtcaagctcatcgaccccacctgcggctccggccacttcctcctcggtgccttccaccgcctcctcgccgaatgggagaacaacgcccccgaccgcgacgtcttcgaacgcgtccgcctcgccctggacgcgatccacggcgtcgacatcaacccgtacgcggtggcgattaccagattcaggctggtggttgaggtgttgcgtgcggctggtatccgcacacttgcggccgcagtcggatatcaattggctctgcatgtagctgttggtgactctctgatcaaggggcgccaactcaaaattttcgacgacgcgcgtgataatctggcggaattctcctacgtcacggaggatgtgcgcgagcattcggacctactaaaagaggatcgttatcatgtcgttgtaggaaatccgccatatattacggttaaagatgcgagcctcaacaagatgtaccgaaagctctacggtgcctgtggaggctcctatgcgctgtcggtccccttcatgcagcggttcttcgaactggcgaaggaggccgacaaagaggggcgaggtgcgggtagggtaggtcagatcacggccaattcattcatgaagcgtgagttcggtaaaaaactgatccaagattttctctcttccactgccgagctcactcatgtcattgacacttccggtgcctacattcctggccacggtacaccgaccgtaatagtcctggcgcgacggaatcgatggaatcgctaccgccctgttcgtgctgtactcggcatccgaggggaaccttccgcgcccgtggatccgagaagaggtcgtgtatggcaggcaatcgtcgagggtctgtcgtccccgggaaatggcggagagtgggtgagcgtggttgactggccgcgtagtcgcttcgactcttttccgtggggccttgggggtggcggagcggcggatcttagtacctttcttgtgaatgggaaaaagaagcttaccagcgaaattcgggtgattggtcgaacggcccattctggcgctgacgaagcctattacggccctgtcggggtgtgggcgagattctctattccggacaactactctgtcgctctcgttgagggtgaggttatacgtgactgggttttggctcccggcaaggaggcgatcttcccgtatgggggagacttgaaagcaagcctggatccaggctccactgggcgcatgctttggttaaatcgtacgatcttggtgcgaaggaaggagctcggcggcacgcacgaggaaattggccttacttggtacgagtggagtcgctggcatcctgaacgtttcgcggttccccttggaatcgcttttccgttcgtgtctacgcataccagttttgtgcttgaccgcggcggaaatgttttcaagcagacggctcctgtaatcaagcttccgccggatgcgtccgaggatgatcatctgaggctgttgggggttttgaacagctcggcggcgtgcttctggctcaagcaggtctgctaccccaagggaggggatccggtcggtcaggacggcgctcgtgtcagcgtcgaagcgtggtcggatcgatacgagttcaccgggaccaaactgcaggagtttccgttgccggcggagtatccgttggagctggcgcgggagctggatgggttggcgcagcggctgacggcggtgagcccgacctcggtggcggcgggcggggcgccctcgcgggtccggttggctgaggcacggggcgagtgggggtccacacgggcgcggatgatcgcgttgcaggaggagttggactggcaggtgtatcggcagtacgggttgcttgccgatgagctgatcctgccgatgactgaggtgcctgagatcaggttgggggagcgggcgttcgagatcgtgttggcgcgcaagattgcggcaggcgatgagacatccgagtggttttcccggcacgggtcgacgccgatcaccgagttgccggcgcactggtcggatgagtaccgggcgttggtggagaagcggatcgcggttatcgagagcgatcggaacatcgggctgatcgagcggcctgagtacaagcggcggtgggctaccgagggctgggacaagatgcaggacgccgccctgcgtgactggctgctcgaccggctggagacgcgtgagctgtggttcgccgaagtcgacggcatggtgcagccgcgggcgtggaccaccgggcggctcgccgacgagttggccgccgacgcggatttcgtggcagtcgccgagatctaccggccgggggaggacctgacgaaggtcgtcgcggccctcgtggagaacgagcatgtgccgttcctggccgcgttgcgttacaaggattccgggctggtgaagcgggccgactgggagtcggtgtgggatcagcagcgcgccgaggacgccgccccggacgaagaagccgcgaagcggatccgtgacaggattcccgtgccgccgaagtacgcccaggccgatttccgcaagcccagctactggcgggcccgcggcaagctggacgtcccgaaggagcggttcatctcctacccgcatgccgggccggagaacgatccgacgctgctggtcggctgggctgggtgggatcaccgggagcaggcgcaggcgctggcgacgctggtcgtcgagcgtcaggacaacgacggctggggtgcggagaagctcgccccgctgctggccgggctgcgtgaggtgatgccgtgggtccggcagtggcacaacgacatcgacccgctctacgacggctcgcccgccgaggtgtacgacgcgttcctcgccgattcgatggggcagcacgcgctgaccgccgacgccctcaccgcttggcgcccaccggcggccggtcgcggcggacgacgggcggcgaagtga

SEQ ID NO: 2760 - DNA, 560 bp, Dietzia cinnamea
cgctcaaggactcgggcttgcgaaaattctccgaatggcaggtcacctgggacgcccagcgcgccgaggaccgcggcgagatcaccaccgcccaggtgccggtgccacccaagtacacctccgcggacttccgcaagacctcgtactggcaggcccgcggcaagctcgacgtgcccaaggaacggttcatcgcctaccccggagcctcggggccggacgatcccaccgcgatgctgggctgggcaggctgggaccacgccgaacagggcatcgccctggtgtcgctgtacgacgatcgcaaagacgacaccgaccccgctcagctcgtcccgctcgtcgccgggctggccgagctcatgccgtggattcgccagtggcactccggcatggacgcccactcaggaatcgactgggccgactacctcgccggacagctcaccacgcttgccgaacgctccggcgtcgcgatcgccgacctgcctgactggcgccccgccccagcgacccgcggccgcaggcgcgtcgcagccgcagctactacacccggtaaggaaagctag

SEQ ID NO: 2761 - DNA, 3588 bp, Eubacterium saburreum
atgaacaagacagccataaaaaattttgcgatctgggcgcggaataagctgattgcagatgttagctatgatgcccgactgatcggtattacggaggacggcattgcaaagccgctgccgcagagcttcggcgacacccagttcttcgatatcggcactgcaaaaccgtattcgatttccggcgaggccgtgcgtcagcgtgacaagctgatagaggttattcagcagaaggaaaaggataccgactacaaaaccgcatatcagtatgtgatcgaggaggttgcctatacatggttcaaccgcctgatcgcgatccgtttcatggaggtcaacgactatctgccttcccatatccgagtgctatcttccgagagtggtaagctggagccggatttggttacaacaccgtttgacgcagagctgcccttcactgcggaggaagaggctcagatttttcagtggaaacaggacaacaagctggacgaggtgttccgcatcctgttcctgaaacagtgcaacgcactgaacgaaattctgcctgctctgtttgaaaagacgaagaactacaccgagctgctgctcagcctgtccgtcattgaccgggatggcgtggtctatcacctgattcacgatattccggaggatgacttcaacatcgagtgcggtggtcaggtggagattatcggctggctgtaccagtattacaataccgagccgaaagccgctgcatttgccaagaacggcaagattaccaaagaggaaatccctgccgtaacccagctgttcaccccggactggatcgtccgttacatggtggagaacagcctgggtcgtctgtgggtgggaggtcacccggaccgcggcctgaaagaaaactggaaatactatctggaagaggcacagcaggagccggaagtgcaggtgaaactttcggaaattcgtaaagagtatgccgccctgaacccggaagacatcaagctcattgacccctgcatgggatccggacatatcctcgtatacgcctttgatgtgctgatgcagatttacgagagtgtcggttacagtgaacgcgatgctgcaaagagcattctggaacacaacatctacggtttggacattgatgaccgtgcctatcagttggcgtactttgccgtgatgatgaaagcacggcagtacaaccgacgtatcctcaacggtgagaacacctgtcatttctacgccattcaggagagcaacagcatcaatcgtgcgcacttgaaatatttcggcgcggggttggacgatatcgagaaaaacgctgctaagatgcagctggaaggtctgctggacactctgacggatgccaaggaatacggctctatcctgaatgtggagagctacaactgggatttgctgcgccggtttgtggcagcggaggacaccgacggtcagatcagcatggacagcgttggcgtggaagataccgctgagcagttgaatcggctcattgatattggtgagacaattgcacggaaatattgggttacctgcacgaatccaccctatgcaggaaccaccaacctgagcgcaaaattaaatacatatatcaaaaaatattttcctgacagtaaatcggatatgttcgctgtattgattgaaagatgctaccagtttactttggatagtggatttcaatcaatgattacccagcacgcatggatgtttatcaatagctacgaaaatcttcgtaagaaaatatatgaaaaaagatttatgagccttgttcatcttgggattaaggcgtttgaagaaattggaaatgatgttgttcagacgtgcgcatttgtgattcagggaaaatatattgacggttacagttctcggtttgtaagacttgttgactgtaagaattacaatgaaaaagagcaagaatttttggctgggaactatcgttatatggcggaggttgccaatttcagaaaaattccgggaatgccactggcatattgggtgagcagccaatttataaaaaactttaactctgccaaatatattgagaattatggtgttttaacaggttctcaaaatattacaggtgataatgagaaatatctgaagtgcttctgggaaattgaaaactatcaaataggaaaaagatggcatttctatgctaaaggtggagattatcgccagtattatgggaacttgacatttgttgtagactggtctgatacggcaaggcttttttacgcgaacaataaaacatctaatttgttaagtgaagaattttggttcaagccgggagttacctattcggcaattacaagccgtggaacaggttttagatatttgccggaagggtgtatctttgacaagggcggaccatcaattaacttgagaaagaacattccagaaattttggcgttgctaaatacaaatgttgctaagtactatttctgggtattcaatccatctatcaaccttcaagtgaaagatgtaaagagctttccaattattttgccggaggattcttctctgacagaaatggcaaacacaaatcttaaactttgtgaatatgattggaatgcatttgagacctcatgggaattcaagaaacacccgcttgtttcagagagtgaaaaagaaaaatccaagacaattcagcagtgctttaatcagtggaaggctgattgcgaaattcgttcgactgagttgcgtgaaaatgaggaacgattaaatcaatcctttattgatgcatacggtatgtgggacgaagttgatgcagcagttgaagaacgagacgtgaccgtgcgcaaagctgacttgcagcgggacatcaagagcctgctcagctatgctgtgggttgtatgtttggccgttactcgctggatgtggagggattggcctatgcaggcggcgagtgggatagcagcaaataccagagctatattccggatgctgacgatgttattcccatcaccgatgaggaatatctggacgatgatatcgtatcgcgcctgtgcgactggctgaaggtggtgtacggtgctgatacgctggaagaaaaccttgattacatcgcaaaagcccttggcaataaaggcagcaccagccgggagatcatccgcaactacttcctgaacgatttcttcaaggatcactgccggacttattctgtcaccggctccggcaagcgtccgatctactggctgtttgacagcggcaagcagaacggctttaaggtcttggtctatctgcaccgctacacaccggataccatcggcaacctgcgtatcgactacctgcaccggatgcagcgcgtgtatgaatccgagatcaaccgaatgcaggatatgatggatcacagcgagaatgcccgtgaggtggcagcagccgggaagcgcaaggataaacttgccaagcagctgaaggaatgccgggaatacgatgagaaaatcagccatctggcactttcccgcatcgaacttgaccttgatgacggcgttaaggtcaactaccgcaagctccagaccgcacaggacggcaagttttatgaggtgctggcggatagtaagaacatcatggcgaagcagcgaggaaaagcgtga

SEQ ID NO: 2762 - DNA, 3741 bp, Vibrio cholerae; identical to SEQ ID NO: 2398

SEQ ID NO: 2763 - DNA, 3630 bp, Eubacterium saburreum
atgaacaagacagccataaaaaattttgcgatctgggcgcggaataagttgattgcagatgttagctatgatgcccgactgatcggtattatggaggacggcattgcaaagccgctgccgcagagcttcggcgacacccagttcttcgatatcggcactgcaaaaccgtattcgatttccggcgaggccgtgcgtaagcgtgacaagctgatagaggttattcagcagaaggaaaaggataccgactacaaaaccgcatatcagtatgtgatcaaggaggttgcctatacatggtttaaccgcttgatcgcgatccgtttcatggaggtcaacgactatctgccttcccatatccgagtgctatcttccgagagtggtaagctggagccggatttggttacaacaccgtttgacgcagagctgcccttcactgcggaggaagaggctcagatttttaagtggaaacaggacaacaagctggatgaggtgttccgcatcctgttcctgaaacagtgcaacgcactgaacgaaattctgcctgctctgtttgaaaagacgaagaactacaccgagctgttgctcagcctgtccgtcattgaccaagatggtgtagtctatcacctgatccacgatatcccggaggatgacttcaacatcgagcgcggtggtcaggtagagatcatcggctggctgtaccagtattacaataccgagccgaaggccgctgcatttgccaagaacggcaagatcaccaaagaggaaatccctgctgtaacccagctgttcaccccagactggatcgtccgctacatggtggagaacaacctgggccgtctgtgggtggaaggacacccggactgcggcctgaaagaaaactggaaatactatctggaagaggcacagcaggagccggaagtgcaggtgaaactttcggaaatttgtaaagaatattccgccctgaacccggaggatataaagctcatcgacccctgcatgggttctggccatatcctcgtatacgcctttgatgtgctgatgcagatttacgagagtgccagttacagccagcgtgatgctgcaaagagcattctggaacataatatttacggtttggacattgatgaccgcgcctatcagctggcgtactttgctgtgatgatgaaagccagacagtacaaccgccgtatcttaaacggcgagaacacctgtcatgtctatgccattcaggagagcaacagcatcaaccgtttgcacctgaaatatttcggtgcagggatggacgatatcgagaagaacgccgctaagatgcagatggaaggcctgctggacaccctgacggatgccaaggaatacggctcaatcctgaatgtggagaactataactgggaattgctgcgccaatttgtggcagcagaagataccgcagggcagatcagcatggacagcgtaggcgtggaagaaaccgccgaacagctgaatcggcttattgatattggcgagacgatggcgcggaagtattgggtgacttgtacgaatccgccgtatgccggaaccagtaacctgagcgcaaaggtcaacaattttgtaaagaaaaattatccggacagcaaagctgatttgttcgctgtgtttattgagcgttgccaccagatgaccttagtcaatggttttcaggcaatgattacccagcatagctggatgttcctttccagctttgagaagctgcgtgaaaagatgatgctgagcgagaccgtcaatatggcgcatctgggcgcaagagcctttgaagaaatcggcggtgaggtggtgcagaccaccgcgtttgtgcgctgtgcaaaccatgtggagggatataagggcacctattgccgcctgattgagccgacctcccagcatggaaaagaggagatgttccttgcagggcaaaaccgctataccgcaaatcaggatgattttgcgaagattccgggtagtccactagcctattgggttgcacaagctgtttttaaattgatggcagaagaaaagttagaggggaagttcttatctgctggaagattcaaatcctgtaatgatgaactttatttaaggctttggtgggagccgatatgtaaatcaacacattggcatccctattgtaaaggaggagatggaaggaaatatgtgggcaatgaagtgaggcttattaactggacagaagaaagccaaagatattataaagataatggtggcgttggaaataaagagttttgggaaaaagaaggtattacatgggcgacgataactacgtctaagccgtcgttccgaagaaagccatcgaactatttttggagttcatctgctccaacgatttttcatattcaaggagcggagttaacaggatatttagcgtatttgaactcaaagcctgttgagtatattctgggggtattaaatcccacggcgagtctcactgtggctgatgttttgaaattaccatacaaagaaaactggaacacatcaacaaatcaaaacctcggaaatgagaatgaaagaatttgtcgccaagattgggattcttttgaaacaagctgggactttaaggtacacccccttgtgaacatgagcaaaggtttatgggatgctacggctacggccgctgctatggattacttttatggctacaagccagaagtgagctgcccgctggaaatttgctatttattgtggcagggacagtgcaaggagcgttttgaaaagttgaaagccaacgaagaagagctgaatcgcatttttattgacatttacggcttgcaagacgagctgaacccggaagtggaagagaaagatgtgaccgtgcgcaaggctgacttgcagcgggacatcaagagcctgctaagcttctcggtgggctgtatgtttggccgttactcgctggatgtggaaggactggcctatgcaggcggcgagtgggatagcagcaaatatcagagctttatcccagatgccgacaatgttatccctatcaccgatgaagaatatctggacgatgatatcgtatcgcgcctgtgtgcatggctgaaagcggtttacggcgccgatacactggaagcaaacctcgattatatcgcaaaagccctcgccaataagggcagcaccagccgagagatcatccgtaattacttcctgaacgatttcttcaaggatcactgccagacctattctgttaccggttccggcaagcgtccgatctactggctgtttgacagcggcaagcagaacggctttaaggcactggtttacctgcaccgctatacgccggataccatcggcaacctgcgtatcgactacctgcacaagatgcagcgcgtatatgaatccgagatcaaccggatgcaggatatgatggatcacagcgagaatgcccgtgaggtggcagcagccgggaagcgtaaggataaactcgccaagcagctgaaggaatgtcgggaatacgatgagaagatcagccatctggcactttctcgcatcgagcttgacctcgatgacggcgtaaaggtcaactaccgcaagctccagactgcgcaggacggcaagttctatgaggttctggcagacagcaagaatattatggtgaaagagaagaaataa

SEQ ID NO: 2764 - DNA, 3603 bp, Lachnospiraceae bacterium
atgaataagacagccataaaaaattttgcgatttgggcgcggaacaagctgattgcggatgtcagctatgctgcccgcctgatcggcgtgaccgagggcggcattgcaaagccgctgccgcagagcttcggcgatacgcagttctttgacatcggcaccgcagaaccgtattcgatttccggcgaggccgtgcgtcagcgtgacaagctgatcgaggtcatccggcagaaagaaaaggataccgactataagaccgcatatcggtatgtgatggaggaggttgcctatacatggttcaaccgcctgattgcgatccgtttcatggaggtcaatgattatctgccttctcatatccgggttctctcttccgagagcggtaagctggaaccggatctggtcacgaccccgtttgacgcagagctgcccttcacagcggaggaagaggcgcagattttccggttgaagcaggacaaccggctggatgaagtgtttcgcattctgttcctgaaacagtgcaatgccttgaatgcgattctgcctgcgctgtttgaaacaaccaagaactacaccgagctgctgctaagcctgtccgtcattgaccgggacggcgtggtctatcacctgatacacgatatcccggaggctgacttcaacatcgagcagggcggtcaggtggaaattatcggctggctgtaccagtattacaataccgagctgaaggccgctatttttgccaagaacggcaagattaccaaagaggaaatccctgccgtgacccagctgttcaccccggactggatcgtccgctacatggtggagaacagcctcggccgtctgtgggtggaaggacacccggactgcggactggaagagaactggaaatactatctggaagaggcggaacaggagacagcggtgcaggcgaaactcgcggaaattcgcagagagtacgctgctctgaacccggaagacattaagctcattgacccctgcatgggctccggccatatcctcgtatacgcctttgatgtgctgctgcagatttacgagagtgccggttacagtgaacgcgatgccgcaaagagcattctggaacacaacctctacgggctggacattgacgaccgcgcgtatcagctggcgtactttgccgtgatgatgaaagccagacagtataaccgccgcatcttaaacggcgagaacacctgccatgtctatgccgtgcaggagagtaacagcatcaaccgtgcgcacctgcactatttcggcgcggggatggacaatagcgagaagaaggctgctaaaaatcagctggaaggcctgctggacaccctgaccgatgccaaggagtacggctccatcctgaatgtcgaaaactataactgggatttgctgcgccgctttgtggcagcggcggataccgccaggcagatcagcatggaaagcgtgggcgtggacgataccgccgagcagttgaaccagctgattgacatcggcgagaccctggcgcggaagtatagtgtggttgtaaccaatcctccatatatggcgagcagtggaatgaatgcgaaattaagtaattatcttaaagaaacctatccgtgtagtaaaggtgatctatttgcagtattcattgaaaaatgcagacattttacaaaagagggctgttatttgtcacttataacacagcagtcatggatgttcttatcgagttatgaaaaactgagagaatacttgtccgatatagatgttgcaacaattcttcatttgggtgcacatgcatttgaagaacttggtggtgaagtagttcagacagtttcttttgttataagaaaaacgcatgtgctggactatattacaacatgtgaccggttggtaaatattgataatgcttcccagaaagaaattgctttcttaagtggggattatcgtgtgctcagtaaaaagacagattttgaattgattccggctaaaccgtatgcgtattggataagtgaagcagcactgaaaaacttcaaaaatcctaatcttggatgtttggcggagattgtttcaggcatgacaactgggaataatgaaatctttcttcgagtttggacagaattgaattttgagaaaattgcttttaataaatcaaatatagagaaagtcaaccttcaaaaaacaaaatggattccataccataagggtggaggtatgcggaaatggtatggaaatcaagagtatgttgtaaattggtcacgttcgtcagaattcaatcgagcaaaaactaccatgacccatgtttacctaaagccgtgtatcacttggtctgatatatcaggaaattctttcgcgggtcgttattgtgaaggcggattcatgtttgatgtgaaaggatcatgtgcatttgctgaaaagacaaaattacaactcctgataggaatttttaactcaaaagtaacacctatttatgtggaggcattgaaccctaccactacaacacaggttggtgacctcaagaggattccattagttgaaccgaagcaagatgaagtaggacatattcaaagcaaggttatggggtctgttgacttgtcaaaagcagaatgggattcctttgaatcctcttgggactttaagaagcacccgttgttccggaatgtttccacgatttccgaagcctttaaccagtggaatacagaatgcgatgaccgttttaatcagctgaaagccaacgaagaagagctaaaccgcatttttattgacacttacggcttgcaggacgagttgaccccggaagtggaagataaagatgtgaccgtgcgcaaggctgacttgcagcgggacatcaagagcctgctgggctatgccgtgggctgtatgtttggccgctattcgctggatacggaagggcttgcctatgcgggcggtgcgtgggacagcagtaaataccggcgctttatcccggacgaggacaatgtgattcccatcaccgatgaagaatatctggaggatgatattgtatcgcgccttttggcatggctgaaagcggcgtacggtgccgatacgctggaagagaacctcgatttcatcgcaaaagccctcggcactaagggcagcaccagccgggaaatcatccgcaattacttcctgaacgatttcttcaaggatcactgccagacctactctgtcacaggctccggcaggcgtccgatttactggttgtttgacagcggcaagcagaacggctttaaggcgttgatttatctgcaccgctatacgccggataccatcggcaacctgcggatcgactacctgcataagatgcagcgcgtgtatgaatccgaaattaaccgaatgcaggatatgatggagcacagcgagaatgcccgtgaggtggcggcagccggaaagcgaaaggagaaactgaccaagcagctgaaggaatgccgggaatacgacgagaagatcagccatctggcactttcccgcattgagctggatcttgatgacggcgtaaaggtgaattaccgcaagctccagaccgcacaggacggaaaattctatgaagtgctgtccgacagcaagaacattatggcaaagcagcgaggaaaagcgtga

SEQ ID NO: 2765 - DNA, 3474 bp, Lachnospiraceae bacterium
atggataagaatgcaatcaaaaaatatgccgtatgggcacgccgtgagctgatcagccgtgtgagccagaaagcgctgcaatatggcgtttccgaagaagcttgcggagatgcaagcgccgatacgattaatggacatcttctgaccgctacggagaagcagcagcggcaggcattgattaccaaaatcaagaaggacggctatcagcaggctatggaggaagccgcctatacctggtttaaccgtttttgcgccctgcgctacatggaggtcaacggctatctccctacccatgtgcgcgtattttcggatgagcagaacaacttcaagcctcagatcatcaccgaagcaattcatctggagtttgatggactggacatggagaaggtctatgctctgaaggaagagaataagaccgacgaactgtataaatatctactgattactcaatgcaacgcgctctctgttattctgcccggcatgttccagaagattgcggactacaccgagctgctgtttccggacaatttgctccgcgaaggcagcaccatcgagcagatgattgcgctcattcctgaagaggactggacggatcaggtgcagatcatcggctggctttatcagtattacaacaccgagctgaaggacaaggtgttcgccgacctgaagaagaatatcaagatcagcaaggagaatatccctgccgcaacgcagctcttcacgccggactggatcgtccattatatggtggagaactctctaggccgcctttgggtagaggggcatccaaatgataaaatgaaggcgagctggaaatactatttggaggaagcagagcaggagccggaggtgcagaagcaattagcggagattcgcgcagagtatgtacagctgaagccggaggacatccgtgtcatcgatccctgcgtgggcagcggtcatattttggtcgtgatgttcgacgttttggtgcagatttacgaggcctacggctactccgcccgtgaggcggcatctatgatcgtggaacataacctctacggtttggacatcgatgagcgtgcggcgcagctttcttactttgccgtcatgatgaaggctaggcagtacgaccgacgtttcttctctcgcaaggtacagccccatgtgtacgccatcgtagagagcaacgacgtagatagctttacccttgagtactttgtaaacggcgatgcaaacctcaaaaaaagcatgagcatccttatggatgagctgcgcgatgccaaggaatacggttctattctgaatgtcacaaaggtggatttctctgctctctatgcaaggcttgcggaagttaaggaagatatcagcatacatcgggaaagtgcactgaatatcatcaagccactgattcaggtggcggagatgctggcgcagaagtatagcatcacgtgtacaaatccgccgtatgcttcggccaagggacttgctattaaattaagagaatatttggcgaatatctatccaacagcaaagtatgacctttttggagcatttattgtgagatgtttaaaattcacaaaaaaatgcggatacattggacttgtaacgcctgtatctcttctatacaatcctagttttcaaggcttaagacgtgaggttattggaaatacagagttcacctcacttattgaattggggagcgatgcctttgaatctggttttggaacagctacttattctattgttaggtataagataaaagggtatgttggaagatattttgatgtttcgagtattgtgagtaaggataaatttagaggcacaaaatgcttctattccagtactgattattttccgtcatttgacggagaaaaagtaatgtataaattgaatgatgactatagatccataattacagaagccaaaccattgtctaagataggaaatcctaggataggaatgcaaacaaatgataatagtcgattcctaagattatggcatgaaatcgaatccactaagctttgtacgtctcatacaaaggtagatacttttggtgatgaaaagtggttccccattgttaaaggtggaggatatagaaagtggtatggaaatatagaaaatgtagtaaattggcagcataatggggctgaaatacgagaactgaataaaaatgccgcgggtggaagaattgttgctgaggagttttatttttgcgaaggcttaacatggacacatacaacctataaccagcctttttctatgcggtacatgccagaaggtactttgattaatgtggaaggtccggcaatcttttcattaggaaaaaatcagaactatgtgttggggtgtttaaactcagtggtagcaagagatgtctttcaaaagattgtttcttccatacatttttcagcctctgaattaggctcatttccattaattgtttcagaacaaggtgtgattagtgatatagtaaaagaaaatatactccaaggaatgcaagattggaatgcttacgagatcagctgggatttccagcggcatccgatgctgagccgtggaaagcttgctgatgcttatgctgcatggaaagctgactgcgagtcgcgtttcctccagctgaaagctaacgaggaaaaactgaaccgcatcttcattgacatctatggtttgcaggaagagctgacgccagatgtggcggagaaggatgtgacggtgcaccgcgtgttcgacaccaaggacgctgtgccggagagcatgaaggggtcaaactatgtccgcaccatgcgggacgaggttgtttccctcatttcctacgctgtcggctgcatgttcgggcggtattcgctggatgtagacggccttgcctatgccggtggcgcttgggacggcagcaagtatcagacctttatgccggacaaggacaacattatccctatctgcgacgacgattattttgatgatgacatcaccggttgcttcatcaagtgggtggagacggtctatggtgctaatccgctggaggagaacctgaagtttattgcaaatgctctcggaggcaaaggctccgcaagagaggtcatccgcaattacttcattagtgacttctatgctgaccacctgaagacttaccagaagcgcccgatctactggttgtttgacagcggcaagaagggaggtttcaaggcgctgtcctatatgcaccgctatcagccggataccattgcgcgtatccgcaccgactatgtgcatgagcagcagagccgctaccgcacggcgattgccgatttgcagcagcgcatcaacggtgcttccaccggcgaccgcgtgaagctgactaaacagcttatcaagctggaagcccaggcagaagaaatccgaacctatgaggagaaaatccaccacctcgccgatcagatgattccgattgatctggacgacggagtgaaggtgaactatgccaagtttgcggacgtgctggcgaagattaagtaa

SEQ ID NO: 2766 - protein, 671 aa, Acidiphilium multivorum
MTLFIRAVAAEDKAAAIKRAISGDSADRFAPDLDQFKQLPGTPFAYWVGAGVRAAFQRFQTVEGNGRAVRQGLATADDFRFVRTHWEIDPRDRGKKWFPFAKGGRLSPFYAGIHLVVNWADGGAEIKNNLNEKGNVRSNVWMLRDTAANYFFKGGLTWPLRASKFAPQPLPAGCIFSVRGYSVFLEEMLLLPSLAIFNSKPFDYIFKALLGRFGYPEFIVGVLQKLPWAEPSVEQANDLAALARSAWSLARTADTAVETSLAFTLPAPLNAADSVAAVTSKLAGLQSKIDAISFELFNLDESDRTEIEGAAVFASAEINEDNDESEDDNSEVAAAENAQFYVLSWSVGVAFGRFDIRLATGERSIPPEPEPFDALPDRSPGILPSGAAPFMPCSGIFVDDPGHADDLISRIIAVYERVGQPWPEPAALRRSFAREFFPGHIKMYTKSRRKAPIYWQLATPTGSYSVWLYLHTLNKDTLFRAQTDYIAPKLAHEQRQLDQLRADSGPNPSASQRKAIEAQEAFIGELQALLGEVKRVAPLWNPTLDDGVVIIMAPLWRLVPQNKPWQKELKAKWDELAAGKYDWAHVAMHLWPERVVPKCATDRSLAIAHGLEEVFWKEGDNGDWVSQSSPMRSIEELVHERTSAAVKAALKELSEASAPNGAKTRARRSSS

SEQ ID NO: 2767 - protein, 640 aa, Acidiphilium multivorum
MDKATRNAIERATQQARKLLDEDFSSQLEGTFDVLRSGVIAPAGGAHLTARQKFQRDKIVATIEHKRAAGATAVEAVTDYVRDSAFTTLNRFVALKMLEARQLVQECISKGDQSSGFKEFCGMAPGVALLPDAAGYRLYVESLFDEFSTEIKVLFDRRDAASVLWPKRQTFEALLALLNAPDLSGVWDEDETIGWVYQFFNSGEERKKMRDESQAPRNSRELAVRNQFFTPRYVVQFLVDNTLGRLWLEMHGVQSRLTDLCEYLVRSADDTVQVRPKKDPRDLRILDPACGSGHFLLYSFDLLLAIYEEAWSTEGPAPASDATGRSLRNDYADLADLRRSAPKLIVEHNLHGVDIDPRCAQIAALALWLRAQRAWRDFGVPASDRPRIQRTHIVVAESMPGDAALVDEFAARLDPPLLRDLFKKMVGESRLAGELGTLLRVEAAIAAELRRAREQFVKQRQTTGFLPGMEPVVKQGSLDLSGIDDDRFFHEAEIRIVEALRAFAESATGRASVRRRLFADDAAQGVALIDLTRTRFDVVLMNPPFGACSVAAKTEFDKSYPRTKNDVYAAFVERGIELLHPRGRLGAITSRTGFFLSSFQKWREEVLLPKAPPRIVADLGIGILDGAMVETAAYCLEAVA

SEQ ID NO: 2768 - protein, 607 aa, Acidithiobacillus ferrivorans
METAKLKKFAQQARRLLLEQVGARLGLVLEAGSAARRENPSTVTELEKQIQQSSRAQVIDKVAYIWFNRFCALRFIDVNGYTRIRVVSPAQEDQIQPEILAEAKMGHLDAERIPENTRQQIAALLHHGTPSRDPDQEAYRLLLVAECNSFHRAMPYLFERIADYTELLMPDDLLSANAILAATRNAMTPDACQDVEVIGWLYQFYISEKKDQVFEGLKKNQKITPENIPAATQLFTPHWIVRYLVDNSLGRLWMLNHPDSPLVGKMEYYIKPEARETDFLKVNKPEDIKVCDPACGSGHMLTYAFDLLYAIYEEVGTDPSEIPEKILTHNLYGIEIDERAGELAAFALTMKARARQRRFFNKAIKPHICVLEKIPFNDEELDEYRAAIGRERFTPDMRSTLRQFAEADNFGSLIQPKLANAGTVLALLEEQDFSGELFLKETHNKVLKALHQAATLSPIYHVVIANPPYMGGKGMNARLGAWAKENYPNSKSDLFAMFMERGLELLPKYGYSAMVTMQSWMFLSSYESLRKRILRDTAIECMAHMANMVMGIAFGTAATVCKKGGSPEARGAYCYVEYEDIGSNNKPIAFPPRNERNRKAARQNEAI

SEQ ID NO: 2769 - protein, 590 aa, Acidithiobacillus ferrivorans
MKNDEITLKTEVEGNFAKQDTTHHFYRASANDFKKIPGSPIAYWVSERMRDVFERAQSLEDIAEVKHGLSTGKNEAVVRFWPEVSFIDFGAGFSSRDEALDSNKKWFPYNKGGDFRKWYGNCEFILRYDQCGNELMASFSGHRHDGKSHYFREGVTWTFISSSKFAARYTPKGFVFDVSGSSLFVDNSKRIVAFLCTDLCFGILKALNPTLNFQVGNLKLLPIELAQIIGKSAEIDTIANTAILFSKTDWDAYETSWDFTSLPLLHRDYHDLTLKAANQNLRTRWQEMTQEMQQLEEENNRIFIEAYGLQDELTPEVPLKEITLTCNPHYRYGGDKTEEELEALLLADTMREFLSYATGCMFGRHSLDKPGLILANQGDTLTEYLQQVPEPSFMPNQDNVIPVLDGDWFTDDITERFRQFLRVTFGEAHYEENLVFIETALGKDVRKYFLKDFYNDHVRRYKKRPIYWLFSSPKGTFNALIYLHCYRPDTVSVVLQYLRDFRKKLAARLDYLQQVGISPSANQSEKTRAQKEIDTIKKQLLELDDYERDTLYPLATAQIALDLDDGVKVNYLKLGPALKKIVGLDAKGED

SEQ ID NO: 2770 - protein, 1177 aa, Acinetobacter baumannii
MNTSNIKKYAPQARNDFIAAMRKQSAKYGITADRTLPTEQKGDLLLIGDQVFPLSVMKPREKLIKRIQTSSFEQTIDYIAYSWFNRLCAIRYMECKGLLDHGRRVLSSADGSAGLPQILEECLDIDLPGLDASRVAELKLDGNKDEELYRELLLAQCHALNQVMPLLFEQVSDESELLLPDNLTKTDSLIRDLVSSIPEEDWSDVQIIGWLYQFYISEKKDQVIGKVVKSEDIPAATQLFTPNWIVKYLVQNSVGRLWMMAQPDSTLANNWEYYIQPAEQTDEVNAQLKQLIDVRISEDGDTLNPESITVLDPACGSGHILVEAYDCLKAIYLERGYRSRDIPRLILENNLYGIDIDTRAAQLASFALLMKAREDDRRLFSNPPKLNIIALQDSQPERLDALSQDLANTGIAQADLKELLELFEHASTFGSLIQVPEVFAKKLPDLETKLNIALASGDIFAQQSAQELLPLVQQANLLAKQYDAVIANPPYMGGKGMNTALKDFAKKKFPDSKSDLFAMFIERGFGWCKESGFNSMVTMQSWMFLSSYEAMREKLLQDRTIQTMAHLGARAFPEISGEVVQTTAFVMQGQHINGFKPVFFRLVDTGQDQKESELRSGLNRFDSTIQDDFKKIPGSPIAYWVNIQTRNLFSGNKLLGEISEPRRGLATNDNNKFIRRWAEVSNQKMAFGSINREDAKNSNKKWFPYNKGGEFRKWYGNNEYLVNWENDGEEMFALAKKLYGSPTRTIKNLQYYFRNGISWSMIGSGTFSVRYMDNGYIFDQAADSLFARNNELLEIIGLMNSPVLEFLKIIINPTMNTTAGVISQLPYVPFSASNQARENVEEMIKFARDDWNVYETSWDFTQNPIIRTQQSNLEQAFNTWQQQNADAVAEMKRLEEENNKLFIDAYGLQDELTPDVPDEQITLTRADREKDSQRLVSYVLGCMMGRYSLDEPGLIYAHAGNQDFDANRYLKFPADADGIIPLTEMHWFEDDATHRIREFLTAVWGKDTLDANMQWLAESLDKKANETAEDTIRRYLASKFYKDHMQTYKKRPIYWLFSSGKQGAFQALVYLHRYNESTLARMRTEYVMPLISKMAAYANSLETTKESSDSAAEIKRIEKKLQDLHKQQAELSTFEEKLRHYADQRITLDLDDGVKVNYGKFGDLLAEVKAITGDKTE

SEQ ID NO: 2771 - protein, 1133 aa, Alteromonas macleodii
MRQPLDKALRKKLEETVIKARDIVEAAVKESLQRLGVAESQAPSYLKDNEKVLRNKLRAHARQLGDRLSDGKQEITRLANEMAYEHWHRMLFARFLEQSNLLMYDAQTPVTLEECFELAEEEEDCKDGWELASRLAQKMLPQIFRADSPVFEVKLSMNRIDELESLISKLDTQTYQAQDSLGWCYQFWQTKKKEEVNKSGVRIGAQELSPVTQLFTEPYMVSFLLDNALGAWWANKLLSKDDLIRANSEQELRDLASIHGVPLEYLRFTQDEFGNNIGWKPAAGGFEKWPEHLGELKVLDPCCGSGHFLVAIFLMLVPMRMKLEGLTEKEAVDAVLRDNIHGLELDQRCVELAAFALALEAWRYPNAGGYRVLPELQLACSGMSIAEAQKEWKDLTKGDEALTDAIAWMQYNFKDAPTLGSLIDPIRALEKDQTPPWLLLQNAMNHKIDASNEAKATAQGLAKASSILSTKFEWIATNVPYLGDINQDEKLQKHIKRNYRAGKKDLANAFTLRCAEMLTDIGICSLVLPQNWMFLKTYQTFREQILNKHRFSLIARLGSGAFDTISGEVVKAILWSFQKVQLQDNEFVALDVSESKGAVGKSCSLIASALTYLNQDDQLANPRAALILSELNHDQESLSKYCIPHYGSKPGQTDRVKRYFWELNKITSDWMLLESTPQESMTLSGKSNICYSLEAMKYRQIREFGIRGADAWGSKGVIAARTSKLNAVSYLGKVFDDNCYALIPKNAGDLAAIWLFLTSDLYNIEVRKVNQKLAVDTQSMVNVPFDIEYWRQLASSFYPNGLPTYYSNDARQWLFHGHPCESVVWCEESKTTAISQLRQDDTVLQVTVARLLGYHWPAELDTEMELAPEMREVIKRNADFADLVDDDGIVCIPAVRGEKSAAKRLEAMLIKAYGDAWDSSVETNLLKAVKAKDLESWLRDKFFEQHCKLFQHRPFIWHIWDGLKDGFSALVNYHQLDYKGLERLIYTYLDDWISNQKRQLAEGTDGADIRLTAAENLKIQLEAILAGEEGLDIFVRWKPLEEQPIGWNPDLNDGVRLNIRPFMLAKDVGKKGAGVLRAKPNIHWKKDRGTDVESAPWYNLGLEYGGKQGDRINEHHLSLSVKREARMKLKEAD

SEQ ID NO: 2772 - protein, 1129 aa, Anaeromyxobacter dehalogenans
MASLDRNLRRELEGAVKEARRVAEAGARQAIGQLAVGHHEPWAALSPEQRKLRNRLRAHGRQLGDKLEERKGTQTTERLTRESAYEHWHRLLFARFLAENDLLVEPESGMALSLDECRELAREQGKDWLVLASDFAQRMLPQIFRAGDPVLEVALPPEKRQELEAILERLPRAVFTADDSLGWVYQFWQADQKDAVNASEHKIGADELPAVTQLFTEDYMVLFLLHNTVGAWWAGKVFAAKPELARTAVSEDECRAACAVQGIEWRYLRFVREGDAWRPAPGTFSGWPRAAKGLTVLDPCMGSGHFLAFALPILVALRQAEEKLSIAEAVDAVLRDNLFGLELDPRCTQIAAFNVGLTAWKLAGYRPLPALNLACAGLGINAPVSEWTALAAGDRPAEQAMKQLYELFRQAPTLGSLIDPTRVGGELFVAQFDKIRNLLSSALASEKSEDAELAVVAQGLARAATLLAVKYTLVATNVPYLARGNQSDVLAQHCESHFADAKTDLATCFIERCRSLLAPFGAAALVTPQNWLSQDYYASYRKRLLRDARFELAGQLGPGAFSGISGEVVKPLLIILSGRSHDAAHEFLAIDTTPFASAVDKAAALCADALHKVNQARQLINPKCRISMEEASAEPRLSKFTIYSNGIQTGDSPRYLRSFWELPALDERWAAQQTTVDATTSYGGMSQAILWENGAGSLAKAAENASRQTVLRGKEVWGRRGVLVSAMGSLNVSLYLGTLFDDNTVAVVPASESHLAPIWAFMSDTGYHDAVRRIDKALKVRGPLIEVPFDIGAWSGAVLPVPHALDPTQWIFGGHPRGASNPLQVAVARLVGYRWPRQRQATFLGFPALGPDGLERHVDDDGIVCLPSLRGEAPAAERVRALLADAFGAEWSANKLSELLAAVDFGGKSLDDWLRDGFFEQHCELFERRPFVWQIWDGRKDGFSALVNYHQLAAPNGEGRRILEKLTHTYLGDWLDRQRADQKAGIEGADGRVAAAEHLKRELEKIIEGEPPFDLFVRWKRLQQQPVGWEPDIDDGVRVNIRPFVAARPLTVRARAACILRVTPDIRWGKDKGKEPTRQKADFPWFWGWDESAQDFAGGKEFDGNRWNDLHYTRAAKLAARECAKGGKS

SEQ ID NO: 2773 - protein, 1312 aa, Aromatoleum aromaticum
MLPNERRGDVAIIAGREWPAKVHEQREQLIRRIRRDGFAQTMEAVAYTWFNRFAALRYMELHDYLGHGHRVLSSATAGGLPDIVAHASDLAASRQLPGLGADVVTELKLAGNKDGELYRLLLVAQCNALSAAMPFLFERIDDETELLLPDNLLRTDSVIAKLVAEIAEEDWAEVEIIGWLYQFYISEKKDQVIGKVVKSEDIPAATQLFTPNWIVQYLVQNSVGRLWLMANPASTLKAEWPYYIEPAEQTPEVQAQLDELIRQRCLEGSGQWSVVSGQEGRDGDYALSGTDCLAKGNELGRAGVSGHQGVSERRGLWADESSTSGSGIDSFQHRGRSGAEVTGGVSQFSVDRSGVEGRSGNADPDCRASQVSDAGTGRTDTVTAGGDFEDARRTAGTSSLTTNHWPLTTPPLDPESITVLDPACGSGHILVEAYALLKGIYLERGYRLRDIPRLILEKNLYGLDIDDRAAQLAGFALLMKARADDRRLFNDPPRLNVLSLQESKGLDLDELATHLASFGIQRGTIKALLDTFEHAKTFGSLIQIPDALNAQLPALAEALGKANETGDLYAQAAAQDLLPLVEQAKVLGRKFDAVVANPPYMGGKGMNGALKEFAKAAFPDSKSDLFAMFIERGFAWCKPNGFNSMVTMQSWMFLSSFQSMREKLLEQRTIETMAHLGARAFSEISGEVVQTTAFVLQGQHFFGFKPTFFRLVDGQEADKEAALRSNQCRFDATAQDDFKKIPGSPVAYWVSRALFDVFATLEPLQERAHVRKGLATCDDLRWVRLWHEVDYSLSNTQREPSSEEVGRLGRWFPLLKGGSFRKWYGNTAYLINWENDGRLLKASIVERYGGGSYTKEVRSEDYYFRPCNTWSDITSGSFGARYCPNGFITSTVGGGIYSASDSDEYQFCAMLNSKPTSDWLRIINPTLHANPGDIAQLPLPPHEVLTGVEISRLGRAAVSLTRSDWDAYERSWDFQSFPLLTASADPDSTLESSYTAWVTQNHDTIVEMKRLEEENNRLFIDAYGLQDELTPDVPIEQITLTVNPAYRYGGNLTEVEQWTRFRQDTMEELVSYAIGCMMGRYSLDEPGLIYAHAGNVGFDANRYKTFPADADGIVPITDEFWFEDDAANRVREFLRAVWGADTLDENMAWLAESLGTKANETPDETIRRYLADKFFKDHLQTYKKRPIYWLFSSGKQGAFQALVYLHRYHEGTLARLRAEYVVPLTGKLQARIDMLEKDAAAAPSTATRNKLNKQIEKLRKKHVELLAYDEKLRHYADMRIRLDLDEGVKVNYGKFGDLLAEVKAVTGGAGDE

SEQ ID NO: 2774 - protein, 1141 aa, Arthrobacter sp.
METAPLKSFATWARTSLIKEVTARLAAVLAPGSPERVERPGVVSALEKAIAAAGGEAGKAAIADRVAYTWFNRIIALRFMDANAYTGIGVVSPGADAGGQPEILSAAKGGQIDAAVVTSAQTRDTVLGLLGGTRKSADAQGEAYSILLAEYCRHWNKVMPFMFEREGDYTELLIPSNLLADASVLSRAVSVLTKEVCQDVEVIGWLYQFYISERKQEVFDGFRKNKKAGADEIPAATQLFTPHWIVRYLVENSLGRLWMLNHPASGLVTQMEYYIAPVDEETDFLKITKPEELKVIDPACGSGHMLTYAFDLLYAIYEEEGYTPSEIPGLILTNNLYGTEIDARAGALAAFALTMKARSRQKTFFSKRVEPNICVIDPISFGPEELDFLVTRGGDRDREVAHWNQFARADIFGALVQPSEDLIVSLSAHLAMHPPAAGDLIAADIHDRACQVLRYAQFLSPRYQVVVANPPYMDARNMAPTLYEYLSDKFRAGHTGVDLAFVLRAQSLVPRGGYLGLLSMDSWLGNVECADFRDIVRADLPPQLVLHLGARAFPEIDGEVVQVTATLFQRGANSSSKTTFIGATEGTTVNAKVAQFHDPERRFRHALDWFDVFPGRVLTPYAASEKAHATFGTAPAMNTIAEVRTGLQTGDNVRFLRHWYEVSFEKVRTGTASPGARWVPYVKSSSPTRWFAREDLVVDWANEGAAVRSHQSSVVRNSSYYFRSGLSYGGLAGSLKARLVAADAIFDQKNSMVFPIGRTTTHQLLALMNSSAFETLARLVSPKGFGVGTLAQLPIPAEALVAPRVEELAERAVELTALLFDRSETSRGFEGLSSIFLGQGTKSGLQFAVELTAKTETEVRTELHNLDLENHAFFAEALPATRASEDGHNPTRADAVASSVVVKDLLSYAVGCMFGRYSLDEPGLILADQGSALQDYLAKIPTPTFKPDADNVIPIVEGDWFADDIVARFRQFLRTAFGEEHFEENLHFVTTSLGVKDIRDYFVKSFYKDHWQRYKKRPIYWLFSSPSGAFSAMIYMHRYTPSTVSTVLNEYLREYRAKLEASRQHQEKLAVSGTGRQQATALKEVDRMRKILLELDDYEHKVLYPLATQQVAIDLDDGVRANYPKLGAALRKIPGLEANDD

SEQ ID NO: 2775 - protein, 1162 aa, Azospirillum lipoferum
MASLARDLRRNLETRVREARVLAEVGARKALERLGVHLSASPGYLTDQEKKLRAKLRAHAKRLGDERRSDGSQDIKRLVPEVAYEHWHRMLFARFLAESDLLIDDGLALTLADVQELAREQGKDWLELAAGYAQRMLPEIFRSEDPALALALPPETRSALEDRLKALPPAVFRADDSLGWVYQFWQADEKERVNKSGGPIGADELPAVTQLFTEDYMVLFLLHNTLGAWWAGKILSANPALAAGAADEAELRAACALPGVDWTYLRFVRETREDGGEGDWRPAAGTFPGWPGDVKDITFLDPCMGSGHFLVFTLPILAALRMAEEGLNRKDAVLAVLRDNLHGLEIDFRCTQIAAFNLAFAAWRLIGEYVQLPPLHLACSGLSIGMAKQDFLKLADKVARAADPQARTDLLGAEATLLNAQVDSRIRTGLSRLYDLFEKAPVLGSLIEPRRAGGDLFAADWDLLEPILTQALADGSDEVAEMAVAAQGLAKAAELLANRYVLVATNVPYLGRGKQSDSLRNWIDEHYPRSKNDIATVFMERLLEIIVPNGTFSTVAPDNWLFLPAYRDLRKTSLIKNGLDICALLGPAAFQDMNWWAARTGLFAMSRRSNIVTSHINLIDAGENKSISVKEAILSGQEGGGFTVLPSSTALVGKDSRLDLQGGHKGNIIGHFARASQGLKTGDDDRLVRSFWETPALTENWHPMQSTSQEQKNYGGQSNVIWWADGGSSVARRQGTKAWGNIGVSIGQMRLLPATIYGGEIFDSNVCVLIPNNREHVSALLCFAHSGELTKRVRKIEPGSKVNNGTFELIPFDLAHWQRVAAEKYPDGLPKPHSDDPTQWLFNGHPVGSDDPLQVAVARLLGYRWPRQTGSSFMDCPAITEPDGLEPHADSDGIVCLSPVKGEPAAAERLSALLASAYGADWTPQRLTALLSAAGDGKARDLDAYLRNHFFKRHVELFQNRPFIWHVWDGRQDDGFHALVNYHKLAAPGGEGRRTLEKLVYTYLREWIDRCRTEVKAGADGAEGRLAAAEHLRGRLEAILEGEPPYDIFVRWKPLRRQAIGWEPDVNDGVRMNIRPFLTARPLDAKSATACILRVTPRIKWDKDRGKEPTRPKDDYPWFWNWDQKTANFAGTGDEPDGQRWNDLHYSNDAKRAARERKGGEA

SEQ ID NO: 2776 - protein, 1206 aa, Bifidobacterium animalis
MNTNQLQQFAANARIALMSAIEPRVREALDPNSALHADNTAACKHLAHNAPSSNDRHAIDAYVEELTERYAYRWFNRIIAFRYMDVHGYTVTPVVSSADPTNVNGLPEILAAARRGEYDERVFGPAIRTNEAIRRRVEAILDGDITTADPQGAAYGLLMAAACNYWHSSLPFLFDEPNTIEGAIDVVLMPQNLLADGSPLREAIGVMTPKACGVDELSGNVEIIGWLYQFYIAPRKDDVMAGFKKGKKAGAEEIPAATQLFTPEWIVRYLVQNTVGRLWMENHPDCALADGWEYYIAPTSDDDTAKLTVSSPEELTVCDPACGSGHMLTYAFDLLYEIYEDEGYAPSDIPGLILDHNLFGMEIDERAAQLAAFALTMKARGRSRRFFRKQIQPHIEQIKKLQFSEEETEELNELYDVTLSSETWNTYANANVFGSLIQPDTMLATVCDNNDEPESLALYAADLIERGNRVLEQTRYLSRTYAAVAGNPPYMGGKNMSTQLKKYVEEHYPKGKSDLFAAFMLRCMQLVPQHGMVGMITMQSWMFLTSFEDLRTTLLHAMHIDTMAHLGAGAFDSIGGEVVSTTAFTMSKSNDDHRGAYIRLVDIKGDHEQSEACQATIKHDKALMFEVDQQEFAQIPGSPIVYWLPEAVLNTFNEGKPLSEIAQPRQGLATADNNRFVREWWEVSQNRISLNCDSLQSAAASGAKWFPYNKGGDFRKWYGNQEFVVNWANDGQELRDFRPRSVIRNPSFYFQSAVSWSNVSSGMPSFRYYPEGFIFSHVGDCLFGDKDILQQLQSLCNSSYMKALLSAIAPTLHFEVGQIATIPVHCLSNAVKANLHLLIEASRKDWDGFETAWSFQSNLLIENDTTISSQIQSLGSVWTELSRQQCEHEIENNRLVAEAYGIEDDVPIDVPLERVSLKRNKAFAYPKASPEERDELFTLDLIKELISYAVGCMFGRYSLDEPGLILASQGETMDDFHAKVPDPSFEPDADNVIPMCEGDYFEDDIVARFRKFIAVAFGAEHLEENIAYIEQVLGKSLRKYFLNDFYNDHVKMYSNRPIYWQYASRTDNKGAFKALVYLHRYTPSTTSTVLAYLRDYIARVSGYAEMLERPEEATNTGSAGKRTKAKTAKDLREADRLRKIVNECKAYEDDVLYPLATRNMPIDLDDGVLVNYLRMGKAVRAIPAIEKKRKDVETWEWPVHPLGAER

SEQ ID NO: 2777 - protein, 1129 aa, Burkholderia sp.
MTHSISNQPLPKSLRTQLENTVKAAREAAEKGASAALAQMAVAEAKAPDYLPDESRALRRRLRAHGRALGDVKASDDTQGVQHLVWEVAYEHWHRMLFARFLAENGLLLWEPGAAVSLEDCEALVQETDPEMNLGAKTKWELAGKLAARMLPQVFKPYSPVFELAFAPEYQRELERLMAALSSEMFKASDSLGWVYQFWQAKRKDEVNASEMKIGADELPAVTQLFTEPYMVDFLLHNSLGAWWVTRHPGKTCPVPLTYLRTLEDGTPAAGKFEGWPDRLDEFNLLDPCCGSGHFLVAAFLMLVPMRMAAEGLSARDAVDAVLADNLHGLELDPRCVEIAVFALALAAWRYPDENGDLLGVRADMPAPQVACCGLKVAAKPEDWMALVPDDAPNAAFLRQELRLLHVSFAQAPLLGSLLDPARSLKNDLATSSLDMLRALLEQALATERPATLSGLGSELQDDTWDLALTARGLLDAARLLDTRYHLVVTNVPYLARGKQHDALKDYFETHYPEAKNDLANVFLERCLELAHEPKGSLGAGVVQIVMPQNWLFLSSYTKQRKSLLKRVQWNLLARLGPRAFETINGEVVQAILLTQTRAPAAEGLLLRGLDASRPKVTQEKAELLRTGELAAASQKMQLLNPDARVVLEASDAGELLARFAASPNGMHGGDSPRFRMQHWELPLPSADWRHFQSPVDETVLYGGRDSVFFWPDDGMIHLDNPNARVQGQSSWGSAGVAVRVMKHLPCTIYTGEMFDISCSPVTPYNESHLAAIWCFCSSSEYNEAVRQIDQKLNVTNATLVKVPFNLEHWQQVAAERYPNGLPKPYSDDPTQWLFHGHPQPTSDQLQVAVARLVGYRWPAETDATMKLADEARTWIAHCDKLAEHTDDDGIICLPSVRGELPARERVLKVLIAAWETVQPGSWKPAVLDKLLADADCAGKSLDAWLRDKFFEQHTKRFQHRPFIWHVWDGLKDGFAALVNYHQLDGKNLERLIHTYLGDWIRQQEAGVRDGVDGAQTRLAAAQDLKRRLQLILEGEPPYDIFVRWKKLSEQPIGWNPDLNDGVRLNIRPFMTAEVLRHNKKPKLNISWEKDRGKDVESAPWYPVFKGERINDHHLTVAEKRKARAESGD

SEQ ID NO: 2778 - protein, 1210 aa, Burkholderia gladioli
MNKANLKAYAPQARLDFIAAVSARANLLGISIQGVAPAETRGDVAIIEGREWPKKVLAQRQKLIARIEKEGFSQTIEAVTYTWFNRFVALRFMELHDYLAHGCRVLSNRAGGQPEVLSRAAELDLPGLPVDRIRDMQLAGNQDNELYKLLIVAQCNELSRVMPFLFERIDDESELLLPDNLLRTDSVIARLIAGVPEEDWAQIESIGWLYQFYISERKDEVIGKVVETADIPAATQLFTPNWIVKYLVQNSVGRLWLEANPESALAQGLDYYLPPAAQVPEAQADLDRLVRVRIAEDGVALNPESITIFDPACGSGHMLVEAYELLKAIYLERGYRPRDIPRLILEKNLYGLDIDERAVQLASFALLMKARADDRRLLDAPLKLNICAVQDSVDTDDALIANIILDAAVQIDRGESSGSAHLFGGDGVTDHAHSSGLQAEDLRMLVRFFRHGKAFGSLLIPPVELVEKLSTLSAVLDQVESDGNALAKQYSHELRQYYLRPAQLLAGTYDAVIANPPYMNSGGMNAILKAFAQAEFPDSKLDLFSMFIERGFRWCKETGFNCMVTMQSWMFLSSFETMREKILANRTIASLVQIGFNSFPEINSKVAQACTFCIAAVPIRHHVAQYVDLNTAPQSSDKDEVFRKRTAAMVFSVDQTEFGTIPGSPIAYWASDRFRELFASGRTIEDIAFSKQGLATGENGRFIRLWHEVSIGKIGLSMDSRAEAKASGKKWFPHLKGGAFRRWYGNFETVVNWEDDGREVRAFGTENGGRARSRAQNVEFYFKPGITWSDLTSTFFGSRQVPQGFIINTVGPSLFAKSGHSLDGLLGYTNSRVFQRIVDVSLQGLHYNNGVIGSRPYVPPTHVEKVRALERELVAISRRDWDAYEGSWEFPGHPCASAEARSLDNLEAAWNAWAQAKSADVRAMLALEESNNQFFIDAYGLNDEISPTVSEEHITLVRPDRVKDAQRFVSYAIGCMMGRYSLDEPGLIYAHAGGEGFDPTRYASFAADADGILPTMDLPWFDDDGAQRIREFVGALWGVERADENLEWLAQSLGPKSDEAPEETIRRYVADSFFRDHVQVYKKRPVYWLFSSGRQGAFQALVYMHRYNERTLARLRSEYVVPLSTKLVARLELLDKDAAAASSSSSRSKLQKQIDALRKKHAELLSFDEKLRHYADMRIQIDLDDGVKVNYAKFGELLADSKTVTGGSDD

SEQ ID NO: 2779 - protein, 625 aa, Calditerrivibrio nitroreducens
MPTFIKLTDYNSSEEKEKGFFDPKNRYVAKQEDFGKIPGSPIAYWVSDRVKEIFEKSKKLGEIAEPRQGLITGDNDRFLKFWYEVDIYNIGFGFSNREEAKESGLKWFPYNKGGDFRKWYGNYEYVVNWKNDGNEIKNFIDNKGKQKSRPQNVSYYFREGLTWTALTSGPFNLRYSNKFIFDAKGPMLFSKIGNIKYLLSFTNCIVTNSFLRILAPTMDYNQGPVYKIPIIFPKSDSTKQKIEELTQECIDISKEDWDSRETSWDFRTNELVRIMNYEFLMLNESKKNNSKSKIQNLTLETIYNRYCEYWREKFFKLHSNEEELNRLFIDIYELQDELTPDVPLDEITILKEETKIVDGDLVFNKDAIVKQFISYAVGCMFGRYSLDHEGLHIADMGVSIEEANSKFNIQNSTFTIDDDNIIPVFEFDFFADDIVSRFKEFLKITFSEKTLYENLSFIADALGKKSSESDEDAIRRYFHKEFYVDHVRRYNKRPIYWMFSSNPKGAGAFNVLIYMHRYYPGIVAKIRTDYLHPYIDKIEFEKNRLQQSIDNDVLSGQTLKKAQNTIDKIEKYLIELREYDVKLKYYADKMIKIDLDDGVKVNYCKFQDILVVFDNKLCTESETEE

SEQ ID NO: 2780 - protein, 579 aa, Calditerrivibrio nitroreducens
MDTGEIKKFAVRSRQLFVEQVKVKAALLGFSEKGITEYREVKNEVIVNERVYPRKQWKEIERIVKKGKNSYLNLIDEVAYTWFNRFVALKFMEENGYISHRFVKSSSEKWYPDVLNSPELTGILDKNEIIQLRLNNEYEKLYKKLLIAHCNNLNKAMPFIFEEIDDYTELLLSDLLLSSKSIIAHIDKGLPAEFWKDVEIIGWIYQFYISEKKDQVIGSKKAYKKEDIPAATQLFTPRWIVDYLVQNSVGRIWMESYPKSILKDRMKYYVESDVDVEKKFYLNLNPENLMIIDPACGSGHILIRVFDILMNIYREMGYSDLDAVRNIVEKNLYGLDIDKRAVQLACFAVMMKAREYGGSKVLSQKFDLNIYEIQEVDENLITSTEFIKGLSKEEDGELQEILSIFVEAKNFGSLITIPDRYIEKLDYYLDLLSKQLNDDFDLTRKYASKYYQILKIAKILGQKYDAMIANPPYMGNRFHNDILKKFLQNNYPESKSDLFAAFIERGFEFLKDGGFEAMITMQSWMFLSRYEKLRKKILKKYQIVNMVHLGTRAFPEIGGEVVQNTAFVIRNCNPGDILE

SEQ ID NO: 2781 - protein, 1207 aa, Carboxydothermus hydrogenoformans
MDKSAVKNFAVWARRKLIEDITQKAFEIGITEKGIAKAENVSSDAVKVNGRLLGKHEAKQRGILIARIKEKGFQEVIEEVAYTWFNRIIAIRFMEVNDYLPTGVRVLSSIEEGKAVPDIITNALYVDLGQDPDIVHQYLDNHDDEGLFRYLFIKQCNKLNEILPFLFEKIEDYTELLLPNNMLAEGSVIRRLVSDIKEEDFRDVEIIGWLYQYYISEKKEKVYADLKKNIKITKENIPAATQLFTPDWIVRYMVENSLGRLWLEGHPDEELKSKWKYYLEEAEQEPEVQKQLAEIREKSKNIRPEDIKVLDPCMGSGHILVYAFDVLFDIYKSAGYSERDIPKLILKNNLYGLDIDDRAAQLAYFAVMMKARSKSRRIFNQIKDENIDLNLCAIQESNGISKEALEFFLRGADEKLKADVEYLVKVFHDAKEYGSILEVEPVDFDAIEKRLEEFKNETGDLYEYQYRNVILEKMPALVKQARIMSQKYDVVCTNPPYMGNKGVNSSLKDYISEKFKDVKYDLFSVFIVRNFNYAKQYGHLGYMTPFVWMFISSYEKLREIIIKSKSITSLVQLEYSGFEEATVPICTFTIRNAYIPAKGEYIRLSDFRGTELQPIKTLEAAQNRNVPYRYSVSPHNFEKIPGMPIAYWVSEKVIDCFKKGRPLGEIAEPKLGITTADNSRFLRLWHEVAIDRIGFNYPNREKAAESRFKWFPYNKGGEYRKWYGNNEYVINWENDGFELKNFKPATVRNIDYYFRKSITWSFVSSSYFGVRYSDRGFIFDVGGSSVFPPEKYHLFLTGFLCSKISTLLMKVLNPTLNFQVGNVASLPVILPNDDEKAKIDSLVEENIYISRTDWDSFETSWDFKKHPLLIHKGSSKTIEEAFNNWAKFAEQQFYKLKANEEELNRIFIEIYGLQDELTPEVDEKDVTIRKADRVRDIKSFISYAVGCMFGRYSIDVEGLIYAGGEWKEKWSDGKVRKIEKDEDGNVISDTWVDATYLPDEDNIIPILDDEYFDDDIVSRFIEFLKVTFGEEKLEENINYIAETLGRKPSETPRQAIRRYFLKEFYKDHVQVYKKRPIYWLFDSGKEDGFKALIYMHRYDEYTVARIRTDYLHPLQRKYEAEVKRLEILIESDVSEREKAVARKKKEKIQKQIRECLAYDQVIAHVANQRIKIDLDDGVAVNYAKFQGIEIPQGEGKKTLKANLLAKI

SEQ ID NO: 2782 - protein, 1171 aa, Chlorobium phaeobacteroides
METLKLKRFAQYARRSLLEQVSAKLKLVLAENSAARRERAETVKKLEEAIKGHGKEQVIERVAYIWFNRFCALRFMDVNRYNRVNIVSPADPGQFQPEILAEAKMGHIDEEMVHDKVRQQIFALLDGKAPSRDPQGEAYRLLVVAACNFWNKAMPFLFQRIDDYTELLMPDDLLSGNSILAYTREAMTPDACEDVEVIGWLYQFYISEKKDEVFDGLKKNKKITPENIPAATQLFTPHWIVRYLVENSLGRLWLLNRPGSKLALQMDYYIKPEQAETDFLRISKPEEIKICDPACGSGHMLTYAFDLLYAIYEEEGYEPAEIPEKILTNNLYGIEIDERAGELAAFALTMKARAKQRRFFNKGVKPNICVLENVHFDEGELKNYMDFVGRDLFTAPLQTTLRQFEEADNFGSLIRPDVTDVDGMLRILESKNVSGQLFISMTHQKVLQALRQADYLSPKYHVVIANPPYMGGKGMNGRLAAWVKDNYPNTKSDLFAMFIERNLDLAQKHGAVAMITMQSWMFLSSYESLRVRILGQSTLLSMAHLGARAFDSIGGEVVSTTAFVLENSNRLDYKGDYLRLVAGNSEAEKNEAIREAVKNPSCDWFYRASAADFQKIPGSPIAYWASDKLIDSFDHPKIQDIATLFQGIITGDNEKLVRVWQEICLKRASLQAHSIEEIDCISKYWVPYNKGGTFRKWYGNRELLVNFSEKGRNFTRGKHQFYSFFFKPCFSWTYISSKSIASRYFDNFIWDVHGSSAFPEKEEDIYFLMSLIGSYAGYEVLKILNPTISFQVENIAAVPVAPLKIEVKHDIISSTKGLIQLAKRDWDSYETSWDFTSLPLLNPDYHQPTLKGTYQKLRAHWREMTLEMQRLEEENNRIFIEAYGLQDELTPEVPLNEITLTCNPHYRYGNDKSEEELEALLLADTMRELVSYAVGCMFGRYALDKPGLILANQGETIEDYLKRVPEPSFPADDDNVIPMLDGDWFTDDIAERFRKFMRVAFGDEHYEANLKFVEKALGKNGKARDIRDYFLKDFYSDHVRRYKKRPIYWLFSSPKGSFNALIYMHRYRPDTVSVVLNDYLREFRTKLTSHKNHLEAVSISASASQGEKTKALKEIEKITKMIAEMEEYEREVLYPLATEQVEIDLDDGVKVNYPKLGAALKKIVGLDAKED

SEQ ID NO: 2783 - protein, 1234 aa, Clostridium clariflavum
MDKTAIKNFAVWARKKLIEDIKQKAYEIGITEKEIKEPEVSTSDTIIIGDRTLNKAEMQQRKSLVSRIREKGFNNVIEEVAYTWFNRFIALRFMEVNEYLPTGVRVLSSIEPGKKEPDIIKEALNIDLDIDRELVYRLQDGNDTETLYRYLLVKQCNALKEILPGLFEKIEDYTEILLPSNLLGEGSVIRRLVDDIPEEDFKDQVEIIGWMYQYYISEKKDEVFEGLKKNIKITKENIPAATQLFTPDWIVKYMVENSLGRLWLEGHPDEELKSKWKYYLEEAEQEPEVQKQLEEIREKCRDIRPEDIKVLDPAMGSGHILVYAFDVLYDIYKSAGYSERDIPRLILENNLYGLDIDDRAAQLAYFAVMMKARSKSRRIFREKVNVNVCAIQESNGFSREAIDYLVNSEETEIEKRVHREDVEYLINVFHDAKEYGSILEVKPIDFDAIERRLEEIRNGGTQDLFEFQYRNIILEKIPALVKQARIMSQKYDVVCTNPPYMGRKGMVSKLTAYLDINYKDSKSDLFAVFIEISRKYTKLLGYISMICQHSWMFLSSYENIRKQIINNCAIVSMVHLGSKAFEEISGEVVQSTTFVIRNYAVDSKSVFIRLVNFKDALEKESRYLNSIQNPKISYRYENIKQKDFNKIPGNPIAYWASNKVLSIFENYPLLNSIGVTRQGLATGNNEKFLRLWYEVKMENIYFYANDKDEAIASKRKWFPCNKGGSNRKWFGNNLYVINWENNGLDIKSFNGSVIRNESYYFQSGITWSSLSTSFLAMRYCPRGFIFESKGSMLFLNDIKYILTILGLLNTKVINHFIGMISPTMDYHEGPIGRIPVYYKIIESVEKLVDENIFLSSTDWNSFEISWDFQNHPLFTYKENSTTLAQAFDNWVSFSEKRFNQLKSNEEELNRIFIEIYGLQDELTPDVEDKDVTVHRIYNTKDDIPESMKGSNYVLTREDVIKSFISYAVGCMFGRYSIDSEGLIYAGGDFKDRWKYEDGQWKVRKIVRDEEGKVVEDTWVDATFVPDMDNVLPITNDEYFEDDIVSRFIEFLKVTFGEDTLEENLDYIADTLGRKSSETARQAIRRYFLKDFYKDHVQVYQKRPIYWLFDSGKQDGFKALIYMHRYDEFTVARVRTDYLHKLQKSYEAEIKRLDIIIDSNVSQREKANARKKKEKILKQMEECLQYDQVIAHVANQRIKIDLDDGVKVNYAKFQGIEIPQGEGKKPLKADLLAKI

SEQ ID NO: 2784 - protein, 1211 aa, Clostridium clariflavum
MDKVVIKKFAVWARKKLIEDIKQKAYELGITEKEIKLPGFATSDTAIIGDRSLSKKEIEQRKSLVSRIEEKGYNNVIEEVAYTWFNRFIALRFMEVNNYLPTGVRILSSVEPGKKEPDIIKEALNIDLDLDRELVYKLQDENDTESLYRYLLIKQCNALNKIFPGLFEKIEDYSEILLPSNLLAEGSVIRRLVEDISEEDFKEQVEVIGWMYQYYISEKKDEVFEGLKKNKKITKENLPAATQLFTPDWIVKYMLENSLGRLWLEGHPDEELKSKWKYYLEEAEQEPEVQKQLEEIWAKSKNIRPEDIKVLDPAVGSGHILVYAFDLLYDIYRNAGYSERDIPKLILENNLYGLDIDDRAVQLAYFAVMMKARSKSRRIFKEKVKVNICAIQESNGFPKEAIDYLVNTGETEIEKRLLREDVEYLINVFHDAKEYGSLLEVKPVDFDAIESRLEEIKKGEVQDLVEYQYRNIILEKIPPLVKQARIMSQKYDAVCTNPPYLGRRGMNSKLAKFVEDSYTTGRNDLFAVFIKICLNYSKNYVSMITQHSWMFLSGFEELRKEILNLTVIKNMLHLGTRTFEEIGGEVVQSVSFTISKIKVRGYNGLYIRLCDYMSSEEKRRNLFNRNNYYTVNSDEFFKIEGAPIAYWASPKVKNIFSDSIKLGDIAYPRKGNSTSDNDRFLRLWFEVDIDKVNFNAKKIIKEETIVRRWFPYNKGGGYRKWYGNNYYLIDWKNDAEEIRKIPTAVIANYHYFMKPGLTWSTVSTGKFSIRIFGYGFIFDNGGCCLFTDEEDRLYYLALLNSNIFDYLLGLLNPTVNYQSGEIAKFPVVFAKSEDAGNRINSLAEDNIQIARIDWDSFETSWDFKRHPLLAHKGDSSTVQQAFNNWAAFAEEQFNRLKANEEELNRIFIEIYGLQDELSPEVEDRDITVRKAERVRDIKSFISYAVGCMFGRYSIDAEGLIYASGEFKDKWKNEDGKWKVRRIVKDDEGKVIEDLWVDAAFIPDMDNIIPVTDDEYFEDDIVKRFIEFLKVTFGEETLEENLDYIADTVGKKADETSRQAIRRYFLREFYKDHVQVYQKRPIYWLFDSGKENGFKALIYMHRYDEFTVARVRTDYLHKLQKSYEAEIKRLDIIIDSDASQREKAGARKKKEKILKQMEECRLYDQVIAHAANQRIEIDLDAGIKVNYARFQGIEIPRGNDRKALKTDLLAKI

SEQ ID NO: 2785 - protein, 1220 aa, Clostridium clariflavum
MDKAAIKKFAVWARKKLIEDIKQKAYELGITEKEIKKPDVSTSDTVIIGDRSLNRKEIEQRNSLVSRIEEKGFNNVIEEVAYTWFNRFIALRFMEVNGYLPTGIRVLSSIEPDRKEPDIIREALNIDLDLERELVYKLQDDNDTESLYRYLLVKQCNALNEILPGLFEKIDDYTEILLPSNLLAEGSVIRHLVEDISEDDFREQVEIIGWMYQYYISEKKDEVFEGLKKNIKITKENIPAATQLFTPDWIVKYMVENSLGRLWLEGHPDEELKSKWKYYLDEAEQEPEVQKQLEEIRAKSKDIRPEDIKVLDPAMGSGHILVYAFDVLYDIYKSAGYSERDIPKLILENNLYGLDIDDRAAQLAYFAVMMKARSKSRRIFREKINVNVCAIQESNGFPKEAMDYLVNPEETEIEKRLHREDVEYLINVFQDAKEYGSILEVKPIDFDAIERRLEEIRDGEIQDLIEYQFKNIIIERIPPLIKQAKIMSQKYNVVCTNPPYMGDDGINLKLSKFLKENYKDTRSDLFAVFIEKTIKFSTKSSYISMITQNSWMFLRSYEKLRGMILNGATINSMVHLGPRAFEEIDGEVVRTTAFVLNNNVLNGYKGIYIRLVDIYKSLDKEKEYFVLKNRYNGVKQNSFKRIPGSPIAYWCSEMVANSFIDGIILKNISEPKQGLITGNSSAFLRIWYEVNIENIGFKMKDREEAIVSKKKWFPINKGGEYRKWYGNNEYIVNWQNDGIEIKNYKDEKGKLKSRPQNIEYYFKKGLTWTKVTSAKFSVRFTEDGFIFSEAGMKIFVHDNLLDYIGSFLNSNLVNVLLGALSETINYEQGNVARLPLKICNDININEKISHLFKTNVDISRVDWDSFENSWDFRKHPLLNYKFNGRTIEQAFNNWSAFAEEQFNQLKTNEEELNRIFIQIYGLQDELTPEVEDKDITIRKADRERDIKSFISYAVGCMFGRYSIDAEGLIYAGGDFKDKWKNEDGQWKVRKTVKDDNGKIIEDTWVNATFVPDLDNIIPITDDEYFEDDILSRFVEFLKVTFGEETLEENLDYIADTIGRRTTETARQTIRRYFLKEFYKDHVQVYQKRPIYWLFDSGKEDGFKALIYMHRYDELTVARVRTDYLHKLQKSYEAEVKRMDIIIDSNASQREKANARKKREKILKQMEECLQYDQVIAHVANQRIKIDLDDGVKVNYAKFQGIEVPQGEGRKPLKADLLAKI

SEQ ID NO: 2786 - protein, 1180 aa, Clostridium ljungdahlii
MDKSAIKNFAVNARVKLKEQIEQKAYTFGITKNEIKSVETFEDAFEVNGNRYDKRLLKHRESLVKKINEKGFDQVIEEVAYTWFNRLIAIRFMEVNEYLPSGIRVLSSTDSNKAEPDIIREAANLDFENLNVDLIYKFQDENNTEELFKYLLIKQCNELGKIMHVVFEEIEDYTELLLPDNLLQEGSIIRDLVTSITEEDFKEQVEIIGWLYQYYISQKKDEVFADLKKNKKITKENIPAATQLFTPDWIVKYMVENSLGRLWLESHPDDELKAKWKYYLEEAKQEPEVMKQLQVIRDKNKDLKPEDIKFLDPCMGSGHILVYAFDVLYDIYKSAGYSEREIPKLILEKNIYGLDIDDRAAQLSYFAVMMKARSYSRRIFRKKIDLNVCSIQESNGFSKEAIDFFASGNELLKEDVEYLINVFDDAKEYGSILEVKGIDFDVIERRVEEIRNSGTNDLFELQYKNIILERIPDLIKQGKILSQKYDVVCTNPPYMGKKSINDRLSDYLNKNYPDTKSDLGTVFMELCINLADRLGYISMINIPSWMFLTSYEKLRKKIINNHTIINMLHNGRGVFGSDFGTTAFVIRNNFIDKYVSYYKKLFQKQGEVDSITEKEKIFFSNKGIYINNQQDFKVVDGNPIAYWLSKDMKEAFKRGIKLANIAEVKQGLATSDNDRFVRMWMEVNYNKIGFNIKDRKENNYKSSKWFPYNKGGQFRKWYGNNIYIVNWENDGYEIKNFKKSVVRNENYYFREGITWTLISSSLFGVRISPNGYVFDVNGMTLFIDKSKIYYVLSFMTSKVCFEVLRIINSTMAFQVGDISRLPIILNESYVSIVNVLCEENINISKNDWNMFETSWNFQLHPIISHRNVSKTLKDAFYNWSVFSNEQFNIIKSNEEELNRIFIDIYGLQDELTPDVEEKNVTIRKADKIRDIKSFISYSVGCMFGRYSLDEEGLIYAGGEFSQDRYKTFKVDIDNVIPITDDEYFEDDIVSRFIEFVKITFSEETLEENLDYIADTLGKKGNETSRQTIRRYFLKDFYKDHLKTYQKRPIYWLFDSGKNDGFKALIYMHRYDVGTVARVRTDYLHLLQRKYEAEVNRLDMIMENANVSTREKNEARKKKEKIQKQILECIQYDQVIAHVANQKISIDLDDGVKVNYAKFQGVEVPQGEGKKPLKANLLAKI

SEQ ID NO: 2787 - protein, 1170 aa, Clostridium saccharolyticum
MDKTAIKNFAVWARRKLISEITYKAGLIGITEKGISKPLSMSTDNIQFFDIGTGKPTEISDHEIKQREALINRIKEKEGTSDYKTAFQFVIEEVAYTWFNRLIAIRFMEVNDYLPSRIRVLSSETSGKSEPDMVTTPFNTDMDFSAYEKDRIMQLKHENELDELFRMLFIKQCNKLNEVLPELFEKTADYTELLLTISFTDSDGMVSHLVNDIAEEDFTEAVEIIGWMYQYYNEERKNEVINIYKGTIKKEDIPAATQLFTTDWVVRYMVDNSLGRYWIERNPQSKLIEKLEYFVTPKNGQIQFVNEKVAPEELTFFDPCMGSGHILVYAFDVLMEIYRECGFVDRDAAHAIIENNIFGLDIDNRAYQLAYFAVMMKARSYDRRFLTREIEPNVLAINETNNISRFNCDGITNNEEENKIGEYLINAYKHAKELGSLISVDKHDYKSFIEYLGNCSLSGQLTLESDHWLRVVMPEMKRLAKQASIMSEKYAVVCTNPPYMNKLEGQLKKFVVDEYKPYSGDLFSVFMYRNFEYCRSNGYSAFMTPFVWMFIKTYEQLREYIIKQKSITTLVQMEYSAFEEATVPICSFVLKNGKEKEKGVYLKLSEFKGGMEIQKQKVLYALENNNCEYLFEADEKSFLTIPGSPIAYWVSNNMLNIFQLGKSFEGITKKGVLTGDDKVYARLWFEVSFAKIGFGLKSHEDMLVSRKKWFPVTAGGFKRKWYGNFETVINLENDGLDIRTNVTNYRLRESTYYMKEAITWTEVSSGMFSCRYVPIGILFGNGGPVSFFNNGEIKYHLGLLNSSTTMSILSYLAPTINYGPEQINKIPVIKKNVELVENIVTENVEISKNEWDSFETSWEFKKHPLLDADKIESAIQYWQDECNIRFNQLKVNEEKLNEIFIDIYGLERELSSVVEDKDVTVRKADIKSDIKSFISYAVGCMLGRYSLNYDGIAFAGGEWDDSRYNKFKPDKDNCIPITDEEYFSDDIVGRFVEFIKCAYGTDVLEDNIDFIANALDNKGNTSREIIRNYFLKDFYKDHIKTYQKRPIYWLYDSGKQDGFKALVYMHRYTADTTGIVRVDYLHKMQKIYMSEIDRMKEMEENSNNTREVAQAEKRKEKLIKQLKETKEYDEKIAHLALSRIAIDLDDGVKVNYEKVQTGQDGKKLDILAKI

SEQ ID NO: 2788 - protein, 1285 aa, Clostridium saccharolyticum
MNKTAIKNFAIWARNKMIADVSYDARLIGITEDGIAKPLPQSFGGTQFFDIGTAEPYSISSEAVHQRDKLIEVIQQKEKDTDYKTAYQYVIEEVAYTWFNRLIAIRFMEVNDYLPSHIRVLSSESGKLEPDLVTTPFDAELPFTAEEEAQIFQLKQDNKLDEVFRILFLKQCNALNEILPALFEKTKNYTELLLSLSVTNQDGVVYHLIHDIPEDDFNIERGGQVEIIGWLYQYYNTEPKAAAFAKNGKITKEEIPAVTQLFTPDWIVRYMVENSLGRLFIDKRKNEGVFADGRGLDEMTWDEAEEKRIATEKQIAEQMEWKYYLPEAVQTKEVREQLDKIQQQSEYKDVRDIKVIDPCMGSGHILVYAFDVLMQLYEDAGYSQRDAAKSILENNLYGLDIDDRAYQLAYFAVMMKARQYNRRILNGENTCHVYAIQESNSINRAHLKYFGAGMDDIEKNAAKMQLEGLLDTLTDAKEYGSILNVDACDWDLLRRFVEQSGEDEQMSMDSFGLEDTKEHLWVLIDIGQTMAQKYDVVVTNPPYMAISSAAPKLNNYVNNHYIGGKTDLFSAFIEKCLQMTAPNMYTTMITQQSWMFLTSFEKIRNIVLSYSIANMAHLGARGFDEISGEVVQTTSFVIRKTNVGEKYKGTYSRLIDGSTESEKKEMFISGKYQYISSAHNFIRIPESIIAYWVSDNTIDCFEQRTLEQVFITREGMATADNERFLRLWHEVNQHNILFDALDAQDAVIRHAKWVPYNKGGTTRDWYGNNDYVVDWENDGVEIRNNKDPKTGRIRSHNYNGEFAFKEGLTWSAISSGDLSVRYCKNGFLFDSKGAKGFAKQKENLNWILGLLNSKIAMQFLQFLSPTLDFKVGDIISIPFLFDANQKARIDEIVGSIVRMSQIEWDSFESSWDFVRHPLAPSARLKQDQLESQFRNDRMEKFGRLSWHYENWRRDCEERFNSLKSNEEELNRIFIGIYGLQNELTPEVEEKDVTVRKADLQRDIKSLLSYAVGCMFGRYSIYKDGLLFAGEPYSLQAFVDKLNDRPGTISAEELQRAYRNEGVVVDEMFFPDADNVIPITDEEYLDDDIVSRLCAWLKAVYGADTLEANLDYIAKALGNKGSTSREIIRNYFLNDFFKDHCQTYSVTGSGKRPIYWLFDSGKQNGFKALVYLHRYTPDTIGNLRIDYLHKMQRVYESEINRMQDMMDHSENAREVAAASKRKDKLAKQLKECREYDEKISHLALSRIELDLDDGVKVNYRKLQTAQDGKFYEVLADSKNIMAKEKK

SEQ ID NO: 2789 - protein, 2455 aa, Clostridium saccharolyticum
MMTKTAYYMQMAQEAAAQITGSKEQWTAFLTTSARLYKYPFAEQLMIYKQRPEATACAEYDLWNGRMNRYVKRGSKGIALLDMRGEQPRLRYVFDVADTGERKNSRPVQLWKMNAEHEQPIIRALDAAFDVPVGAGSLENHIMEAAERLARDYWEENRRQISDIVADSYLEGYDELNIGASFKRAATVSIAYSVFTRTVGNADDYFEHEDFLDIFDFNTQAAANVLGTAVSEMSSQIFREIERTIRTYERDKQAERSQKNYDGAELHEERRLPDSGHSVVGAGTEAPGQVREDAQSVPAGEQHAAVQSPDPDRETVPAPVGDSGDRDRTDGADDGGASESESGTGQEIEPDGLGAAHEHAESAGRGSHSDGTYQQLNFMSLFQSEAEQIQKIDAAAENAVREAESEKPSAFVISEDEIDRMLRTGSNFEGGKIRIYALYQQQGDTKERAAFLKAEYGLGGHSYTFMDGSRGFADYNGKGIQLRNYDHDREVRLTWSAVDKRLDRLVENGQYLTALEMEEYRKLEQEYGAPLPMPTAAHVFPPTPPEHYDTGNEHVDNMLNTAAEVYARSELAAPQRFTVMETDDGYAVWDDIQDGIHVEPDGVSEEFTSEWEAETYRQQLIEKVQEREAKDWLYVEQSKQDLQQDISFPEVESEEAAEPAHAVTDPLVLEMQEHARELARESGYAPDERFVVTMTGENFPDSKDAFAIWDYVREEYYGYSDGKVQTFADYVSASEALQEIRGRALGAEKELATVQPEPAAPVQPDYRVGDTLYLDGKAFTIEKVGLFDVELRDPDSVYPIFRSESKENLARLLGHEDNVHLHNLVVDLNPGKEAAFRAEHEAKHAENYRINSFHLGEGSPKQKFRANMDAIYTLKTLENQHRDATPEEQETLANYVGWGGLADAFDAEKTAWTGEFKELKAALTEEEYAAARASTLNAHYTSPTVIRAIYEALDDMGFEKGNILEPSMGVGNFFGMLPDSMLGSRLYGVELDSITGRIAQKLYPQAEIKVAGFETTDRRDFYDLAVGNVPFGNYRVSDKLYDKLGFSIHNYFFAKALDQVRPGGIVAFVTSRYTMDSKNPDARKYLAQRAELLGAIRLPNNAFRANAGTDVVSDIIFLQKRDHPIDIEPDWVHLGLTSEGITLNSYFVDHPEMVLGEITTESTQYGKEECTVIPIPGADLGDQLHEAVQHIGGHYEAQELAPEEELSLQGETIPADPNVKNFSYAVVDGDVYFRENSIMRKADLSATATGRIKGMVELRTIVQELIDYQLNDYPEDAIAQKQRELNVAYDRFADQYGLINSRANAQAFSEDSSYYLLCSLENVDENGRLESKADMFTKRTIRPERAVTSVDTPAEALAISIGERGRVDLPYMSELLGTPGEYEKIQQELHGVIFKDPMTQGGEETGWVTADEYLSGNVREKLRVAELAAASDPAFAVNTEYLRKAQPKDLDASEIDVRLGATWVNRDYIQQFMEETFEPPFYLRRNIEVKFSPMTAEWQITGKSTPSRNDVHAYMTYGTSRANAYRILEDTLNLRDIRIYDTVEDADGKQKRVLNKKETTLAQQKQQAIKDAFQNWVWKDPYRRAELVEKYNELFNSTRPREYDGSHIRFGGMNPEIRLREHQQNAIAHVLYGGNTLLAHEVGAGKTFEMAASAMEAKRLGLCQKSMFVVPNHLTLQWANEFLRLYPSAKLLVASKKDFETARRKKFCARIATGDYDAVIIGHSQFEKIPVSAERQERILTAQIDEIENAIAEMKSQNGERFSIKQMEKTRKGLEARLEKLRATDRKDDVITFEQLGVDRLFVDEAHAFKNLFLYTKMRNVAGLSTSEAQKSSDMFMKCQYMDELTGGRGIIFATGTPVSNSMTELYTMMRYLQYGTLQQKGLTHFDSWASTFGETTTAIELAPEGTGYRARTRFAKFFNLPELMNMFKEVADIKTSDQLHLPVPEAKFETVVVHPSEHQQAMVAELSERAAAVHSGVVDPSVDNMLKITSDGRKLGLDQRLMNPLLPDDPNSKLNACVRNVLRIYEEGQSDKLTQLLFCDLSTPKNDGTFNVYEDIRAKLIQSGVPEEEIAFIHDADTEAKKKDLFAKVRTGQVRVLLGSTQKMGAGTNVQDRLVAVHHLDVGWRPADMTQRNGRIIRQGNRNKEVQVYQYVTEGTFDAYLYQTLENKQKFISQIMTSKSPVRSCDDVDEQALSYAEIKALCAGDPQIKEKMDLDVDVARLKVLKADHQSQQYRLEDKLMKYFPAEIEKTQGFIKGFQSDIRTVAAHPLPEEGFCGMEVNGTHFIEKVEAGEAILAICKANQSLEPVPLGSYRGFKMELEFDSFQKEYQVLLKGDMTHRVPIGTSAAGNIQRLDNALAGIPARLEKAEQQLGNLRSQQEAAQAELGKPFPQEAELAEKSARLAELDALLNMDDRGNDDPDREKTTEKPSVLAELRDRAGRIPPVTHRDDEEVAL

SEQ ID NO: 2790 - protein, 1227 aa, Clostridium sticklandii
MNKSAIKSFAIWARTKLINEITYKSGLIGITDKGISHPLDSSTDNIQHFNIGTEKPYEIKDREIKQRDAYIKRIKEKEATSDYNTAFNYIIEEIAYTWFNRLIAIRFMEVNDYLPSKTRVLSSETKGKIEPDMVTSPFDTDMEFTSEEKDYIISLKHDNKLDELFRFLFIKQCNTLNAVLPELFEKTSDYTELLLTISFTDSDGIVSHLVNDIPEEDFTEAVEIIGWLYQYYNTEPKDEVFALLKKNVKITKERIPAATQLFTPDWIVRYMVENSLGKLWVEGHPNNELQSNWKYYLEEAEQEDHVKQELEKIREEYKKLNPTDIKVIDPCMGSGHILVYAFDVLMQIYESQGYTQRDAANSIIEHNLYGLDIDDRAYQLAYFAVMMKARKYDRRFLTKEIKPKLYAIKESNEINKNHLKYFGNSLSDIEKNLATSQVEYLIDTYIDAKEYGSILNVDNCNWELLYRFIEDFNIEGQMSLDSVGAEDTKKSLQELIPIAHAMAQKYDVVITNPLYMGGSGMNTKVSNYVKKHYPDSKSDLFAVFIEKCMNMTKKNAFQSMITQHAWMFLSSYEKLRSNIIKNDFISMAHLGARAFEEIGGEVVQTTSFVLRTSDIKDYKANFVRLVDFNSQILKQEAFLAHQNIHTAIKENFSKIPGSPIAYWASNKILSLFNQVKLKDVATFKEGITTANNDLFLRYWFEVSELEFSISTKNKTFKWIPYNKGGTYRKWYGNRDYVINWENDGICIKEYTGSSFRNFRFQRKEGGTFSALTSGGLSARYSEEGFAFDSKGTMFFSDIKLKNILCYLNSKILNKLLKFVCPTLDYRFGTIEKLPFLDINYDINNCVRISKTDWDSFETSWDFRKHPLIDEALLISDMDDWEEMDNSSDLETSPEIEIFFDTGVDIVSSRIATSYEMYRDFTERQFNKLKSNEEELNRIFIDIYGLQDELTPDVEDKDVTIYRIFDSNEAIPESMKSSRYSLTKHDVIVSFVSYAVGCMFGRYSLDVEGLAYAGGDWDDSKYSLFIPDRDNCIPITDEEYLEDDIVGRFVEFVKVVYGADTLEENLDFIADALETKGNTSREMIRNYFVKDFYKDHVKTYQKRPIYWLYDSGKQNGFKALVYMHRYTADTTGIVRVDYLHKIQKIYTSEIDRMKDMAENSDNAREVAQAEKRKEKLIKQLKETKEYDEKIAHLALSRIAIDLDDGVKVNYEKVQTAQDGKKLEILGKI

SEQ ID NO: 2791 - protein, 1216 aa, Clostridium sp.
MNKTAIKNFAIWARNKLIADISYRAGLMGITADGIHTALPQSTGQTEFYDIGTAEPYAITGEAIRQRKHLVELIQRKEKDTDYKTAYKYIIEEVAYTWFNRLIAVRFMEVNDYLPSHIRVLSSDTGKMEPDLVTTPFDLELDFTRDEQQTILELKNVNKLDEVFRLLFIKQCNALNEILPALFEKTHDYTELLLNLSVIDQDGIVYHLVHDIPEEDFDVERGGQVEIIGWLYQYYNTEPKNEAFAKKGKITKEEVPAVTQLFTPDWIVRYMVENSLGRLWVEGHPNDDLKSGWKYYLEEAEQEPEVQTQLAEIRAEYAKLNPEDIRVIDPGMGSGHILVYAFDVLMQIYESAGYSQRDAARSILENNLYGLDIDDRAFQMAYFAIMMKARQYNRRILNGEYRPNVYSIQESNGIDRNQLKYFGAGLNELEKNNAITQMNVLLDTFKDAKEYGSILSVEQYDWDLLDRFVSNIEVIGQMSMYTVGLDDTAEELKQLIAQGKALAQKYHVTTTNPPYMAISSGTGRLNEYVKNYYPDSKSDLFAVFIEKCKSLTFNQGFDALITMHSWMFLSSFEKLRLKIKNTDIINMAHLGARAFEEIGGEVVQTTAFVYRNTSFSGWKCTFVRIVDAKSQLEKERIFLSGTQRYLFKQSNFDKIPGTIFGYWISDKTISAFENAEDFMSKYAEAEGKNVTTDNARFIRCFWEISSEDTGTLSMGKKWLLCAMGGTYRKWFGNVQNVIDWSSKARNFYKEAPAGRIIRQEFWNLPGVTWGKIGTGDANFRLLPSEYMYQETAILQKKMEDSLFSLALLNAATSTYFLKVISPTMNFQQQDINSIPIPKVGSEDKARIIEITKKLIHSSMDDWNSFETAWGYESHPLVKIGLRYCRLNDNNTTIEESFRAWSDECEGHFEQLKANEEELNRIFIDIYGLQDELTPEVEDKAVTIRCADLQRDIKSLLSYAVGCMFGRYSLGTTGLAYAGGDWNEQKYGQFKPDADNVIPITDEEYLEDDIVSRLCDFLKVAFGEQTLEQNLDYIAKALDNKGDSSREIIRNYFLNDFFKDHCQTYSVTGSGKRPIYWLFDSGKQNGFKALIYLHRYNADTIGNLRIDYLHRMQRVYESEISRMQDMIDHSTNAREVAQSTKRREKLQKQLKECREYDEKLAHLALSRIELDLDDGVKVNYRKLQIANDGKFYEVLADSKNIMANDKLWKQYVETWKK

SEQ ID NO: 2792 - protein, 635 aa, Cupriavidus necator
MTIFLRLLTEKDKQNALANAVRNGGENVFEVDAASFCQIPGVPFAYWVSDRIRLMFKTHRPFKSEERLATRGASTCDDFRYVRVWWEAAERQGKSKCRWVPFTKGGSFSRFYSDIQQVVDWDDVRETFRGFVGRPGRWLDRPEALDYYFRPALTWPLRGISFSAQLVPKGCIFSVGGKVALAPKGELLALAGIFNSGPLDHLVRLFAGKVGGVQYETGLINQLPIPKINENTSEELSCLAKRGWSIRRSLDSVIETSHAFLLPAAIRGRLGEFSPATVELELKVIQAKVDAIAFDLYGLTEADCLTLSQIRECFGGEEDSQGGDEDESNSEDEKGSEIDLPSTDTLLSWAVGVAFGRFDWRLATGEREAPSEPEPFDPLPAKSPGMLPDGATPFHAHAGILVDDPGHPNDLARLMEEALVRVDAPVPFDVRRWLQRDFFAFHLQRYSKSRRKAPIYWPLATTSGSYTLWVYYPSLSSQTLYTAINDFIEPKLKQVGNDVVALRNKGAARSREEEKQFESLQTFELELMELRDTLLKLAPTYKPNRDDGVQITAAPLWPLFRYKPWQKVIKDTWAKLEKGDFNWAHLAMNYWPECVREKCKSDKSLAIAHGLEDLYVEPEGQPKKARDRKKVGGAE

SEQ ID NO: 2793 - protein, 332 aa, Cyanothece sp.
MTLEMQKLEEENNRIFIEAYGLQDELTPEVPLKEITLTCNPYYRYNSDKPQEELETLLLADTIKEFISYSVGCMFGRYSLDKEGLILANQGETLQDYFVKVGSKKWEVRSKEENTPNSSLDSLHSPLPTSHFPLDPLHFIPTETNVIPILEGDWFSDDITEQFRQFLRVTFGEENYQQNLNFVEEAIGKDIEKYFVKDFYNDHVKRYKKRPIYWLFSSPKGTFNALIYLHRYRPDTVSIVLNKYLREFRIKLQARLETLKQIDISASASKTEKTKALRETEQIKKMLRELEDYEQEILYPLAIEQIEIDLDDGVKVNYTKLGKALKNVTGLS

SEQ ID NO: 2794 - protein, 1218 aa, Cyanothece sp.
MDTSRLKKFAQYARRYLREQVATKLEVVLAQNSAARRENPEAIRKLTENIEVSGKEQVIEQVAYTWFNRFCALRFMDSNRYNSIGVVSPAEGQFQPEILAEAKMGHIDEEMITKHRKQIFDLLSGNAPSSDAQGEAYRLLIVGVCNYYHKVMDYLFEPIDNYTELLMPDDLLSGNSILAYTREAMTPENCESVEVIGWLYQFYISEKKDEVFEALKKNKKIIPENIPAATQLFTPHWIVRYLVENSLGHLWMLNRPQSRLIEMMDYYVDSGKWEVGSGESSLGGEDDDRQKLSGVNRLAESDGLSGVSLSGDKNVSERGTLRSDQSSETGSCFDSVKHSGGSNPSIDGGIQAFSLNSAGVESRGRNSNYDSSETQISQSGGDGTNSQSGRGNQANDLWTNSQTKITSHSPLPTSYLKINSPEDLKICDPACGSGHILVYAFELLYAIYEEEGYAVNEIPSKILTHNLYGMEIDERAGSLAAFALTMKAREKQIRFFRKPIQPHICVLKKVEFEEWEVGSGKWEVDSEKLGVSRDDLLHDLHLFKEADNFGALLRPKMSENQIANLRDYFANLWKKIPNPSLFEHKTHEKVMDVLKQADFLSPKYHIVVANPPYMGNKGMNNRLKAFLQDNYSNVKSDLFSAFMIRILEMTLQKGEMGFVTPYVWMFISSYEKLRTLILEKTTITSLIQLEYNAFAPACIPVATFTLSNQNLPNFKGGYIKLSDFRGADNQAPKALEAIKNPNCGWFYRASASDFKKIPGSAIAYWVSDSIRISFSKYKSISEQYTVKSGIMTGNDDTFLKFWFEVKISQIGFNLISYDEMKSYWYPISKGGNFRKWYGNNEHIINLRDDAYDIRNGGGNFRLREKNLYFRPYITWSRITSSQVAFRFSQGGILFSDAGPGIFAENDCQKIITFLNTKLSNYFLACINPTLNYQTRDIESLPCIDIQKDVQTPYLIKTTKSDWDSYETSWDFTTLPLLRVGSEQWEVESGEWEVNRKEGTVVNSNETIDSKQKTVDSNETIDSEPLIVDNRNEEKTPHFPLPTSHSKLPTSHSPLLTQNSPLPTPHFSLKTPHFPLPTSHSKLPTPHSPLPTPHFSLKTPHSPLPTSHSPLLTQNSPLPTPHFPLPTSHSKLPTPHSPLPTPHFSLKTPHSPLPTSHSPLLTQNSPLPTPHFPLPTSHSKLPTPHSPLPTSHSPKRNLSNPAPTMARNDLRNAEIRRRK

SEQ ID NO: 2795 - protein, 1359 aa, Dehalococcoides sp.
MSFDKDTRNLLAKTVVTCRRRLVEDTTDQLRGLFGLHPDGTVLPLEQLIHLSPDQNAAARHLRDLLDHYTVGTDGNESDRRKVAYERMVLEISFTALNRLAALRLCEERGLVIECVRKGMSSDGFQMFERISVGALGSRYDTYRVFLECMFDELALDLGVLFDRTTPQSSVFPSERCMEEILSELNKPELKHLWTEDETIGWIYQYFNPPEERKAMREASQAPRNSRELAVRNQFFTPRYVVEFLTDNTLGRIWYEMRKGATALKDECRYLVRRQNEVFLEKGDKAPIEPENENDLSQQEVLRRPFHIVHRLKKDPRDIRVLDPACGSGHFLLYAFDLLERIYDEAWAEEEGPKSEVTGCSLRDDFETLDILHREAPKLIVEHNLHGIDIDPRAVQIAALALWLRAQKTWKILGLKAADRPQIVRANIVTAEPMPGEGDMRREFTANLKPRVLGQLVDVVFDKMKLAGEAGSLLKIEEEIKDAVSEARNQWMKSPQPEQAVLFTELIKPKPEREQLRFDLSGVTNEQFWEQAEERILEALKDYAEQVENGRTVRRRLFAEDAARGFAFIEVCRKKYDVVLMNPPFGEPSQLSKQWIGCTYPITKNDILGPFLERAIMVLNVEGTVGTITAKTAFQLSSMAGFRKELILKETTIKVFADLGSEVLDSAMVKTAAYVLGKAREDVHSVFINLTGSQDKAGQLALEVSDGLSSKNVFWVKQTEFNHIPGAPFAYWADSIIRRCFAKYPSLASLNAEVKQGLGTTDDFRFVRATWEVSPGSIGVQNRWSFYAKGGESNDFYSDIHLVVNWADKGKEVYAFNGIPFGGAGAPIRNPSFYFKPGLTYTSYTNKGFSPRVLPSGCIFTTAGMAIFVSDPLTMLSLLNSRVIQLFLLMITDERKWEVGYVSSIPITKLNTVDITRLSDMALRGWREAISSTFWDETQRYFNAIAGAARISSLRTEPERLKLDSQNSLNKLQAIRREIDELTLASYGLTSRHIEFVNMRLGIETKENPEESNITASLISLLIGIVFGRWDIRIAMDSSLAPEIPDPFDPPPVCPPGMLVSPDGLPAKPDYIASEEWLRARPNADTLPPVTGVKKTTIPDDSYPLRISWDGILVDDSGFNGSQPNRDDIVRRLREVIDLIWKEKAHDIEQEACEILGVSDLRDYFRKPAGFFQDHLKRYSKSRRKAPIYWPLTTASGSYTIWLYYHRLTDQTLYAAVNKYVEPKIDETERSIARIEEALKSSSGRDLTRLTDQFHDARSFLNELRDLREELLHIATLPFKPNLNDGVIINAAPFHKLFRLRSWAKDSEDCWKKLEKGDYDWSHLAYTIWPDRVRNTCKKDRSIAIAHGLENLHDGIEGE

SEQ ID NO: 2796 - protein, 1437 aa, Dehalogenimonas lykanthroporepellens
MAFDQTTRKRLADFVGKTRLLLTEEFTRQLQNDYGLDPNSGDVTDLARLEHLDDARRETAHLLRDTMEHYLAAADTGTLSKAKKARQDILDRIVREQAFTILNRLCALRMAEARGLLIEAIAKGYQSKGFQLYQRLAGTALGETGACYRQFIFSVFDEFAVDLPVLFDRFSPQGRLFPREAALLNVLQEINHPDIDPLWAEDETIGWIYQYFNQKAERDAMRKASRSPRDSREMAVRNQFFTPRYVVEFLTDNTLGRLWYEMTQGNTALKDFCHYLVCRPTEIYLAEGEQVPKQDKTVEGLSQEELLKQPVYIPHHKLKDPRDIKMLDPACGSMHFGLYAFDLFERIYDDAWDIEAQLGADGFIRTEGLKPLHVSYSDKDAFLRDVPRLIIERNIHGIDIDPRAVQIAGLSLWLRAQRSWQTRNVKALERPQIQRSNIVCAEPMPGEADMLNEFTDQLQPRVLGQLVTMVFERMALAGEAGSLLKIEEEIKGAVAEAVQQWQKGPKPEQQLLFPGMEASQPKQQELRFDVTGITDKRFWEQAEDRILDALKKYAELAENGHATRRRLFAKDTARGFAFIDLCRNRYDAILMNPPFGASSRESKEYIDDRYPKSKGDVLANFIERTLQLSTSQGRVGAISSRTPFFLGSFDNLRTEVLGKDGHVRLLADLGDGVLEAMVETAIYVITKHRRGEPESLFFRLLVDAEKGELLRELKEECSCGETSDRTFVINPRHFESLTGNPYAYWVSKSTIETVGTHPCIEGNKAAIRVGLQTGEDLRHLRLLWEVPSGAIVPRLPQLNNPSLDIRYQCLSQLRNVGHWVPFSKTDMAAPWFSPITLVVNWENDGKELKNFTDSKGKVRSRPQNEEYYFKPGFSYMLRSTRLVPYLVPSGVMPTAGRAQIFPDDGEEYAVLGICASNVGSAVARFSGEMFARPKFQASMVQGLPVCEFPQETLATIKDHVDAEVNKRRAVVQRYEPYQEFLLPAWIHSGEGGETAWDLYSLFGRGLENRIAEAFGLNPDQLVELERDIREAVSIRGRSEDDESEDSHDESNEDDQELNVELISETPEAKAVGLLMYVVGVTFGRWDVRIAIDPSLAPKLPAPFDPLPVCPPGMLVGPDGLPAQSGCVVSEEWLRARPDANTLPKDGAIGGATIPDGKYPVQVSWNGILVDDPANAWDIVNRSRSVFELIFGDQYESVEAEISSIVGARSLQDYIRKSSGLFIDHLGVYSKSRRYAPIYWPISTPSGSYTLWLYYHRLTDQTLYTCVNDFVDSKLKEVSDDATNLRSKSNRSSAEEKELERLSDLELELKDFRDELLRIARFWKPNLNDGVQITAAPLWNLFQHRQWKARLKDTWEKLEAGDYDWAHLALSIWPDRVVRASHKDRSYAIAHDLDDQLWHEVEVEKVGRGGRVTRTTEWQPRDLSSADLQGIINEVKAR

SEQ ID NO: 2797 - protein, 1177 aa, Desulfitobacterium hafniense
MNKNAIQKYAIWARNELIEQVKQRAYQYGISEEGYGDKYATVIAGRVLTAGERSQRQAFVGEIERYGYKQAVEEVAYTWFNRFVALRYMEVNDYLPTHVRVFSDPSGNFKPEILTNVLHLDLPGLDKTKVSELLNGNATEELYRYLLLTQCNALNALLPEMFEPMGAYTEMLLPNNILKPESVIGRLVKDIPEEDFRDAVQIIGWLYQYYNTEPKQAVFDGLKKNIKITKENIPAATQLFTPDWIVRYMVENSLGRIFIGSRIQGLGISLTEAERIAKEKEIANRFGWKYYIPEAEQTPEVRAQLLPNPYSLIPVEDLKILDPCMGSGHILVYAFDVLMQIYTSEGYSERDAAKLILEKNLYGLEIDRRAFQLAYFALMMKARQYNRRIFTLGVRPQVYEPTGYADGMEYGALVRVDKLEEMQKVTMGQLATDDNADTFAVKLNTWNFRRLLAQKYDVVVTNPPYMGASGMGTKLSDFVKANFPDSKSDASTAFMEQTLYLCKPTGYMAMINIPVWMFLSSYEKLRKKLMLQNTITNMLHFGRGIFGSDFGSTGFVIGRKHIVGYVGSYRRLFEKQGAVDSVEQKEKWFFEGMGKFTATADNFAKVPSSPVAYWVSKNMLRAFETGKLLGSIADSKQGLATADNDRFLRLWFEVATNGVKFDAHNEDEALASGAKWFPYNKGGEFRKWYGNNDYVVNWENNGAEIRDFTDGKGKLRSRPQNTQFYFRECFSWSLVSSGVAAFRYKPSGHIFDVAGMSCFANKELYYLLALCNTKVVMKILEIVAPTINYQCGDIANIPILIADEAVEQINDKVQQNITVSQKDWDAFETSWNFKRHPLVEFRLAGAYAWGDNEPVRRISFAYKAWEMLADGHFQALKANEEELNRIFINIYGLQDELTPEVEDKDVTVRRADLGREIRSLISYAVGCMFGRYSLDEERLILAGQPYGERFAYASVPVAGGGPLYRVQGDCYLRKSDSTLKVCTYAPDKDNIIPVCDDEYFDDDIAGRFVQFIKTVYGADTLEENLKFIADALGGKGTPREVIRNYFLNDFYKDHCKIYRKRPIYWLFDSGKKNGFKALIYMHRYSQDLLAKLRTDYIHEQQERYRTQLAHIAGALNTATGAERARLLKQQDKLSEQARELGVYEEKVHHLADQNIPIDLDDGVKKNYEIFADVLAKI

SEQ ID NO: 2798 - protein, 1163 aa, Desulfobacula toluolica
MNTSKLKQFAQNARRQLIDMVATKLSIVLDTNSAARREREKAVKDLEKKISRTSRDQVIEKVAYIWFNRFCALRFMDANRYTAMGVVSPARGFSQPEILMEAKQGNIDDGLRIDQEKVFGLLNETIPSPEPQQEAYRMLLVAVCNDYNSIMPFLFEKIADFTELLMPDDLLSDSSILTATREALSEEACADVEVIGWLYQFYISEKKDEVFAGLKKNKKVTPEDIPAATQLFTPNWIVRYLVENSLGRLWILNHPDSRLVDKMEYYIKPEQEETDFLVIKSPEEIKICDPACGSGHMLVYAFEILYAIYEEQGYDAPQIPQLILENNLYGIEIDERAGELAAFALFMKAREKYRRFFKKNVQPNICVLENVSFKEHEVKSYMDAVAPDLFTMDLSTLLYQFEEADNFGSLIRPELTNIPDVLSLLDEKKVSDDIFLQSIHQRVLKVLKQADYLSPKYHVVVANPPYMGKGMNSRLGRWVKDNYPNSRADLCAMFIERNIDMSLGKGLVSMITMHSWMFLTSFEKFRKNVITHYPLLTMAHIGARGFDSIGGEVVSTTAFVIKKSNLIDYNGSYLRLIEGRNELEKKNIFKKNANSGELLFNKSIKAFYKIPGQQLAYWASENILNGFSLPKLGDIFHVKSGLTSGDKKRFVRDWFECQIGHINFTAQNGKFNGLKWFPHNDGGTVRKWYGNRKSVINWADDGEEIKNFSGSTVRSPIHYFKSGVTWSDISTSFFAARYLPSGSVFENTGSIVVASGREAKIVVGLLCSHVAKQYMDLMNPTLHYGVGEVAKLPFKKTKQDIEFIIARCIKLSKFDWDSYETSWDFKCLPLICGEKESIKFSIPNYPLSTKIEKSYIKLRSLWQDITVEIQKLEEENNRILLQEYELQNELSSNVPISEISLTCNPYYRYGENKSDKALEKQLLSDTIKEFISYSVGCMFGRYSLDREGLVLANQGETIENYLAKIPEPKFIPDDDNVIPIMDVDWFTDDIAERFKKFLKVTFGEEHYTENLEFIEKAIGKDIRKFFLKDFYTYHVKMYKKRPIYWMFSSPKGSFNALIYMHRYRPDTVSIILNDYLREFRTKLAARKDNLENISISTSASQGEKTKALKEIEKIKKVLDEVNEYERDILYPLATKQIEIDLDDGVKVNYPKFGKALKKIAGLS

SEQ ID NO: 2799 - protein, 1141 aa, Desulfomicrobium baculatum
MQPLARSLRNDLEKTVKSARDIAENAAKACLEQLGVGESVPFSHLSDEQKNLRRRLRAHGRQLGDIRSTKGEQEITLLLEEVAYEHWHRMLFARFLADNNLLMFDGVAVTLAECAELAADEDEGFTNEWEMAADLAGAMLPQIFRTDSVVFKLHFSPEHQRSLERLIADLPVDVFMASDSLGWVYQFWQSKRKDEVNTSEVKIGARELPAVTQLFTEPYMVAFLLDNTLGSWWASRKLTKSELSSAKDEDELRRKASLPGVPLSYLRFVKSEDDLWTPAAGTFLGWPRTFSELKILDPSCGSGHFLVAALQMLVPMRMELEKLSVHEAIDKVLTENLHGLEIDQRCVEIAAFALALTAWRYPSAGGYRTLPELNVASTGLSISSTKEQWMAILEGQHLKLDLRFHFEQLYNLFTKAPTLGSLINPHRFLGRGLLDESGMRVLMQVLRTAIKFESTASDKYELGVVAAGLTKAAELLAERYTLVVTNVPYLGRGKQDDVLKKHLETQYPLGKADLATAFVLRCLEFCTKGGSTALVTPQNWLFLTTYKNLRETLLRNRSWEIVARLGAKGFQTPMWDFNIQLSVLTASKPVDDQAMSGIDVSEASRPEEKAALLRGDDPAEILVLPQKEQLKNPDARVLFELHCDLKRLGDFAESVKGITTGDSDRFIRRFWEVERRLPGWEWFQSTVQAHITFGGCESIVEWHDGNGPMNEVPGARTYGRGAWGSPGVVVGQMARMCATLYQGTPYDNNACVLKPTNHNHLPAIWAFATSPEFVTGVRVLDQKVGVTNATFEKLPFDLDHWQKVAAEKYPSGLPEPESDDPTQWLFHGRPENSFAPLQVAVARLLGYRWPAELDANMRLSNRASKLANSCAELGHFADSDGIVCIPPVRGEAPAVERLLNLLALAYGQNWGSEMLSELLKAADHAGKTIESWLRNKFFIQHCQLFHQRPFIWHIWDGLPDGFSALVNYHKLDRKNMETLIYTYLGDWITRQRDEILSNTDGAQERLAAAETLKQRLELILQGDTPYDIFVRWKPLLKQPIGWEPDLNDGVRVNIRPFMTVPDIKKKGAGVLREKPRIDWKKDRGKEPVRPQNDFPWFWGWDETIDFAGGAEFTGDRYNNCHYSLDVKRRARRVIRAEDSTS

SEQ ID NO: 2800 - protein, 1183 aa, Desulfosporosinus meridiei
MNKTAIKNFAIWARNKLIAEITYKAGLLGITEKEVKSPLPQSSKDVQFFDIGTREPYSITGVEIEQRAKLVAAIQQKEEQSDYKTAFKSVVEEVAYTWFNRLIAVRFMEVNDYLPSRIRVLSSESSTKAEPDLVTTPFDADLEYTPYEKDRIMQLKHDNKLDELFRMLFIKQCNALNVILPELFEKTNDYTELLLNVSYTDKDGMVYHLVHDIDEADFKEAVEIIGWMYQFYISEKHEEVVNVIGGKSIKKEDIPAATQLFTTDWVVRYMVDNSLGRYWIERNPDSNLKEKLEFFISPQKSDITYIDEKVDPTNITFFDPCMGSGHILVYAFEVFMAIYEECGYSQRDAAKNIITNNLFGLDIDKRAYQLAYFAVMMKARSYNRRILLMDININVCAIYESNGVTKFTYDDLTFNEFQNNIGEYLINTFRHAKELGSLQTVDYHDYISFADYLDQCITNDQLNLFTSIWMSETLPLMRKLAKQAEILKEKYTVVCTNPPYMNKLESHLKEFVTTRYKAYSGDLFSVFMYRNLSFCKEDGYAAYMTPNVWMFLKTYENLRKFIVEEKSISSLIQMAKGAFFKEAVVDICTFVLANKPSSIEGIYIRLEDFKGDMDVQKEKVLEAINTDNCSFLYSTKTDNFSRISGIPIAYWVKNYAVFSAKKFSHSYFSGGRNKTHNNDVYVRTWWEVKRTPGWRPYSNGGVFRKWYGNNTDVVNWTPGARDFYRQHGGLLNEKFWDKEGITWNDITSGLPSFRIKPADSIFSSVSPTIFNLSFKCDNAVLGFLNSKVSIYLLNITNPTLHTLVGNVLDLPDLIENVPVSCFELVATNIKLAKMDWDFFETSCDFKRHPFLTFQTDTVAKFSTYYLNENDNISSICSNTANGWVENAFKIWRFFSEAQFKKLKSNEEELNRIFIELYGLKKELCPQVEEKDVIIRKADLGRDVRSFISYAVGCMFGRYSLDLDGLAFDGGEWDDCKYNTFIPNKDNILPISDEEYFEDDIVGLFCAFVKISFGADNLEENLDFIANSLGNKGNTSREVIRNYFLKDFFKDHCKGYQKRPIYWLFDSGKTDGFKALIYLHRYSEDTIGNLRIDYLHRMQRVYDSEVARMQETIDNSDNAREVAAATKRKEKLKKQLKETKEYDEKIAHLALARISIDLDDGVKVNYEKVQTGTDGEKLEVLAKI

SEQ ID NO: 2801 - protein, 1218 aa, Desulfovibrio magneticus
MPINRNILKTYAPQARREFIQAVTDRASVLGLSEKKIEPAEVAGDVAIIAGRPFPKEVAASRKKLEDRITLNGFTQVMEEVAYTWFNRFTALRYMELHDYLGHGYRVLSNPSGSDIPEILEKATSVDLPGLDKDKVTELRLTGDKDAELYQMLLIKQCNALHRVMPALFEAVNDATELLLPQNLLQSNSPIRKLVNDIPEENWSEIEIVGWLYQFYISEKKDQVIGKVVKSEDIPAATQLFTPNWIVKYMVQNTLGRKWLTTYPGSSIKGKMEFYIEPAEQEPEVQAKLDAITPKELNPEELTFMDPACGSGHILAEAYDLFKDIYQERGYRTRDIPRLILEKNLYGLDIDDRAAQLARFTVLMKARADDRRILDPENPAKLNILAIQESKGLDVDTVASVLLRDRVREIGSKGAQQLTLVQPKMTQGTLSETEKPEVTKDELFSLLNLFENGKTFGSLLSVHDRLKQALPRLEKLVAKSLQAYDMESRRYAKMLLPLVQQSKVLAKQYSNVITNPPYMGSGYFNEKLKNFVNEEYNGYSQDIYGCFIFRCLSMGEEKAYAGMITTPNWMSMPTFFYLREYILKKNTLLLLTDNGRGVWGPDFGSCAFIIQNTNTPGYAARFKKLYDKQGEVNSNNVLINNFFSNAWQNTNLSSFYNIPGLILSSYKLSKKLRDNFKNFKTINDIAKAKQGIKTGHNDTFLRYWHEVSCLMTSCIGKSENRTHKWFPCTKGGDYRKWYGNHEYLLNWENDGKEIKNFYSPTGKLRSRPQNIQYFFKSGITWSKISISDISSRIFPEGFTFESNGSVIFPDDESDIISLLGILNSNVAKYILSAFAPTVDFGEGSILKLPVCLCDNLTRTSIELAITISRDDWDSRETSWDFRASPLVRENAKPTISQSYLTMTCSCQNQTNKLLEIENNIDCYFIKGYGLENELGHAKADLNKITLFANPLHRYGPGKSEIEYKELLKADTVRELISYMIGCAMGRYSLDEPGLIYAHSGNQGFDPSRYTSFPADEDGIVPIMDDDWFEDDATKRFVEFIRVAWQSETLEDNLKFVADSLDPKHGEKPIDTIRRFISQKFFREHHLKVYKKRPIYWLFSSGKHKAFECLVYLHRYNENTLARMRSMYVTPLQGKYNARIEFLDKEKDNASSASAAKKLQKELDTMRKKQQELREFDELLRYYADQRITLDLNDGVKVNYGKFGSLLAEVKAITGDSGD

SEQ ID NO: 2802 - protein, 1158 aa, Desulfovibrio vulgaris
METAKLKKFAQFARRSLLEQVSAKLKLVLAENSAARRECADAVKKLEEAIKGRGKEQVIDRVAYIWFNRFCALRFMDVNRYTRIGVVSPAEGQFQPEILAEAKMGHIDEEMVSGKVRQQIFALLDGKAPSRDPQGEAYRLLVVAACNFWNKAMPFLFQRIDDYTELLMPDDLLSGNSILAYTREAMTPDACEDVEVIGWLYQFYISEKKDEVFDGLKKNKKITPENIPAATQLFTPHWIVRYLVENSLGRLWLLNRPGSKLVEQMDYYIKPEQAETDFLRIAKPEEIKICDPACGSGHMLTYAFDLLYAIYEEEGYEPAEIPEKILTNNLYGIEIDERAGELAAFALTMKARSKQRRFFNKGVKPNICVLENVHFDGNELKDYMDFVGRDLFTAPLQTTLRQFEEADNFGSLIRPDVTDVDGMLRILESKNVSGQLFISMTHQKVLQALRQADYLSPKYHVVIANPPYMGKRSMNGRLQVLAKDSYQRSKTDLFAMFIERNVDLAKDSAYVAMITMQSWMFLSTFENLRSNILSNSSIVSMAHLGARAFDSIGGEVVSTTAFICKNIADREYKGTYLRLVDGEDEQEKSNQLKELKGRPYLASSDDFDTIPGRPIAYWISEKVRNAFAQGTPFGDVGFPKVGMQTSNNDKYLRLWPEVSFHEFKDEEMPPKWIKYLKGGAFRRWYGNLDYLLRYNKNPQFIKQQPNATVLPETKLKEAKCTWTDLTSGPFNARYAPDDTFHDISGHCFYPPRNKQMVLLAYSNTRLFDYLLSLINASFHFQVGDVAKIPVLEVDPSASNNASTLVSLSKNDWDSYETSWDFTSLPVLNPDYRQPTLKTTYQKLRAHWREMTLEMQRLEEENNRTFIDAYGLQDELKPEVPLNEITLTCNPHYRYGNDKSEDELEALLLADTMRELVSYAVGCMFGRYALDKPGLILANQGETIEDYLKRVPEPSFPADDDNVIPMLDGDWFTDDIAERFRKFLRVAFGEEHYEANLRFVEQALNIKGKRNYSIRDYFLGEFYTDHVKRYKKRPIYWLFSSPKGSFNALIYMHRYRPDTASVVLNDYLREFRTKLTSHKNHLEAVSISASSSQGEKTKALKEIEKITKMIAEMEEYEREVLYPLATEQVEIDLDDGVKVNYPKLGSALKKIPGLDAKED

SEQ ID NO: 2803 - protein, 1158 aa, Desulfovibrio vulgaris; identical to SEQ ID NO: 2802

SEQ ID NO: 2804 - protein, 1206 aa, Desulfurivibrio alkaliphilus
MQPLDKTLRNLLERSVQEAREIAENAARAALEQLGVAEPTPPPHLSKLERALRLRLRAHGRQLGDVLNGGKRNTMERLIEEVAYEHWHRMLFARFLAENDLLLYDGVAVSLAECAELAGDEGLRNEWELAARLATAMLPQIFRLDSPVFQLILPPEHQQRLERLITELPREVFTAADSLGWVYQFWQSKRKEEVNAAEVKIGARELPAVTQLFTEPYMVSFLLDNALGAWWATRRLSPAELAGAADEEELRARAAIPGLPLEYLRFIKMPAAPAAEGRDEGEAWTPAAGTFAGWPQELSQFKILDPCCGSGHFLVAAFLMLVPLRMALENLSSRQAVAAVLRDNIHGLELDRRCVELAAFALALTAWRYPDLPAPSAQDSPAAPSFSADGAGGAAPLGYRPLPELHLACSGLAIGLAREEWKQLNLSKPNLRLALEWLHDTFQEAPVLGSLLDPAKTEAARIAPWDELSAALDRALNQEQSAEQQEVAVVAQGLTKAAALLTGKYHWLLTNVPYLARGKQDERLRDFCQRHYPAAKNDLATVFLERCLELCVHEKAAPPAPGRESSGLAGGAGRQGVVSVVLPQNWLFLTSYRKLREKLLQNETWHLIARLGPQAFQTPMWDFNVQLLTLSRGAIQGGGPGPLWAAANPAANPPPPHLIAGLDVSAPRTAAAKAAALLTTELKQVEQARQLDNPDAVISFSEINSLSLLGKHARSLAGVDSGDSQRFMFRHWEHPRLLDGWIYQLNSVNVTIEYGGRENILFFENGQGSLSKCPGGSIRNVKFWGKPGVTVSTMGNNAASLSLGESWCRNCACLVPEKVEHHLALWSYCSSEKFFTAVREINQKLRVAEAIFEVVPFDLDHWTKVAAEQYPHGLPQPYSDDPSQWIFHGHPCGSVVWDETAKQTAPGPLRHDATVLQVAVARLLGYRWPAELDGEMELAAEQREWVQRSALLLPHADEDGIVCIPPVRGEAAASDRLLNLLAAAYGEAWGGATLARLLNNADHAGKTLETWLREKFFSQHCKLFHHRPFIWQIWDGLPDGFSALVNYHRLDYKKLETLTYTYLGDWLDRCRRDLAEGVDGAGEKIAAAESLRQRLELILAGEAPHDIFIRWKPLEQQPIGWHPDLNDGVRLNIRPFLTVPDIAKKGAGILRDKPNIKWNKDRGKDVESAPWYHLGPQYGGQPGGRINDHHLTLAEKRLALEKEHAG

SEQ ID NO: 2805 - protein, 575 aa, Enterobacter cloacae
MSQLENNNMDNNLYRASAVDLNKIPGSPIAYWVPNFEIFNLPKIREKWISGGRIKTHDGQKYIRYTWEVSRKNGQWKRLIKGGDFRKHFGNEDFLVDWSEEAISFYEMNGGLYPEKFQSKEGICWSKITSSLQGFRIKRAVTEYDSASPTIFNDDFICDKYLLSFLNSKVSQFLLKAINPTINTQVADIMALPVCKVSIDIQRNIENAQDKLISISSEDWNSYETSWEFTQLPLLNFNFHASTISHTYEKTRRYWHERTLKMQRLEEESNRIFINAYGLQDELTPEVPLSEITLTCNPYYRYGGNLTDEERKQRLQSDTISELISYIIGCMMGRYSLNSEGLVYANAGNKGFKTLVEEGVFALFPADSDGILPITTKAWFEDDIATRVEEFVRTVWGADHLEENLKFIAASLYLAAIKPVKKGGETSREAIRRYLSTQFFKDHLKTYKKRPIYWLFSSGKEKAFECLVYLHRYNETTLPRMRTEYVTPLLGQMDSRIERLRLQQNEAETAEAKLIGKEIDSLTKQLTELRSFDDQLKHYADMKIQFDLDDGVKINYGKFGTLLAEVKAITGDKAE

SEQ ID NO: 2806 - protein, 647 aa, Enterobacter cloacae
MSLNEHCQFKKIAPRARTAFITAIKARAAEFGITAKGHIEPVISGEVLQVAGFTHPASCASALKRLQQRLANDSYETLIEHVAYTWFNRFCAIRFMELKSEEGYLEHGVRLLSHPSQPQGFEGLDRAPEVIDSLITEGVALDKPALLDLLLAGNEQETLFRELLLGQCHRLHQAMPFLFEAIDDETELLLPTGLTRTDAFWRELVDEIPELDWQQVEVIGWLYQFYISEKKDQVIGKVVKSADIPAATQLFTPNWIVQYLVQNSVGRHWLQTYPESTLKSAMPYYIDQGEQASEVVAHLAELTSASIEPESIRVLDPACGSGHILVEAYNVLYRIYEERGYRSREIPELILKNNLFGLDIDDRAAQLAGFALLMRARQDDRRLLSRNNDSGIDLNIYSLQESRHLNIQKLWQALNLNADAQHGQTQDLLRVAQDTDDPRLTLLKDLHQRFLNAKTLGSLISISTEQASAIEELYTTIQELSKNGDNMQRPESKKLLPLLEQARLLAKRYDTVIANPPYMGSKGMNADLKEFAKKQFPNSKSDLFAIFIERNLDLTKESGVVAMITMQSWMFLSSYESLRTRILNQHTILSMAHLGTRGFDSIGGEVVSTTAFVLGNFHLSSYQGAYLRLVDGNSEAEKAAMFKAAIA

SEQ ID NO: 2807 - protein, 1223 aa, Erwinia sp.
MNTNNIKKYAPQARNQFRDAVIQKLTTLGLSADKKGNLQIADAGIVGETVRYGQFDYPKSTLTRRDRLVKRAREQGFDVLVEHCAYTWFNRLCALRYMEIQGYLDHGFRVLSHPENPSGFEVLDHVPEVAETLLPEKKAQLVEMKLSGNQDEALYRELLLAQCHALHRAMPFLFEAVDDEAELLLPDNLTRTDSILRDLVDSIPEEDWEDVEVIGWLYQFYISEKKGAVIGKVVKSEDIPAATQLFTPNWIVQYLVQNSVGRQWLQTYPDSPLKGKMDYYIEPAEQTPEVQAQLAAITPASIEPESIRVLDPACGSGHILIEAYNVLKSIYEERGYRARDIPQLILENNIFGIDIDDRAAQLSGFALLMMARQDDRRIFTRDVRLNIVSLQGSLHLDIARLWQQLNFHQQSQTGSMGDIFAENTALPHTDSAEYQLLMHTLKRFVNAKTLGSLIQVPQEEEAELKAFLDELYHLEQEGDFQQKTAAKAFIPYIQQAWILAQRYDAVVANPPYMGGKGMNRELKEFAKNNFPESKADLFAMFMQHAFSLLKENGFNAQINMQAWMFLSSYESLRGWLLDNKMFITMAHLGARAFGQISGEVVQTTAWVIKNHRNEKYQPVFFRLIGGTEAEKKNDLLLHKNIFNRFKQNTFKKIPGSPIAYWIDTSSLLSFSVNKKLGEKISLKAGMSTGDNTRFQRYWFEISLDKSSINKNYNGKPSTYKWIPCSSGGEYRKWYGNNELVVNWMNDGYEIRNFKFENGKTRSAVRNDEFYFLEGITWSKISQGNFCVRYRPEGFVFDDTGRCGFSNDKNNLLFAAGLMCTPVINHYLSILAPTLSFTSGELASVPLSELDDRIPELVKSAINTAKNDWDSSELSWDYDKSPLLKNNPPPLMLKQVYEQKVLTDNEITELLTTIENNINNIFIKKNGLDNSAVKSVSKNEITLLCNPFYRYKNITNYTEQLKKYYTDLTIDFLSYSIGCQMGRYSLDREGLVYAHEGNKGFAELVAEGAYKTFPADNDGILPLMDDEWFDDDVTARVKEFVRTVWGDEHLQENLDFIAESLCLYAIKPKKGEAALDTIRRYLSTQFWKDHMKMYKKRPIYWLFSSGKEKAFECLVYLHRYNDATLARMRTEYVVPLLARYQANIDRLNEQVDGASGGEATRLKRERDSLSKKFNELRSFDDRLRHYADMRISIDLDDGVKVNYGKFGDLLADVKAITGNAAGMI

SEQ ID NO: 2808 - protein, 1283 aa, Erwinia pyrifoliae
MLPVRCAKPLAAKYWKPLSRWKKRWIRFAQRCWQPLRQVTGSVFSNPISGQRSAALCRISMNTNNIKKYAPQARNQLRDAVIQKLTTLGISADKKGNLQIADAGIVGETVRYGQFDYPKSTLTRRDRLVKRAREQGFDVLVEHCAYTWFNRLCALRYMEIQGYLDHGFRVLSHPENPSGFEVLDHVPEVAETLLPEKKAQLVEMKLSGNQDEALYRELLLAQCHALHRAMPFLFEAVDDEAELLLPDNLTRTDSILRDLVDSIPEEDWEDVEVIGWLYQFYISEKKGAVIGMVVKSEDIPAATQLFTPNWIVQYLVQNSVGRQWLQTYPDSPLKGKMEYYIEPAEQTPEVQTQLAAITPASIEPESIRVLDPACGSGHILIEAYNVLKNIYEERGYRARDIPQLILENNIFGLDIDDRAAQLSGFALLMMARQDDRRIFTRDVRLNIVSLQESLHLDIARLWQQLNFHQQSQTGSMGDIFAENTALPHTDSAEYPLLIRTLKRFVNAKTLGSLIQVPQEEEAELKAFLNALYRLEQKGDFQQRSAAKAFIPYIQQAWILAQRYDAVVANPPYMGSKGMNGELKEFAKDNFPESKADLFAMFMQHAFSLLKENGFNAQINMQAWMFLSSYESLRGWLLDNKMFITMAHLGARAFGQISGEVVQTTAWVIKNHRNEKYQPVFFRLIGGTEAEKKNDLLLHKNIFNRFKQNTFKKIPGSPIAYWIDTSSLLSFSVNKKLGEKISLKAGMSTGDNTRFQRYWFEISLDKSSINKNYNGKPSTYKWIPCSSGGEYRKWYGNNELVVNWMNDGYEIRNFKFENGKTRSAVRNDEFYFLEGITWSKISQGNFCVRYRPEGFVFDDTGRCGFSNDKNNLLFAAGLMCTPVINHYLSILAPTLSFTSGELASVPLSELDDRIPELVKSAINTAKNDWDSSELSWDYDKSPLLKNNPPPLMLKQVYEQKVLTDNEIIELLTTIENNINNIFIKKNGLDNSAVKSVSKNEITLLCNPFYRYKNITNYTEQLKKYYTDLTIDFISYSIGCQMGRYSLDREGLVYAHEGNKGFAELVAEGAYKTFPADNDGILPLMDDEWFDDDVTARVKEFVRTVWGDEHLQENLDFIAESLCLYAIKPKKGEAALDTIRRYLSTQFWKDHLKMYKKRPIYWLFSSGKEKAFECLVYLHRYNDATLARMRTEYVVPLLARYQANIDRLHEQVDGASGGEATRLKRERDSLSKKFNELRSFDDRLRHYADMRISIDLDDGVKVNYGKFGDLLADVKAITGNAAGVI

SEQ ID NO: 2809 - protein, 1223 aa, Erwinia pyrifoliae
MNTNNIKKYAPQARNQLRDAVIQKLTTLGISADKKGNLQIADAGIVGETVRYGQFDYPKSTLTRRDRLVKRAREQGFDVLVEHCAYTWFNRLCALRYMEIQGYLDHGFRVLSHPENPSGFEVLDHVPEVAETLLPEKKAQLVEMKLSGNQDEALYRELLLAQCHALHRAMPFLFEAVDDEAELLLPDNLTRTDSILRDLVDSIPEEDWEDVEVIGWLYQFYISEKKGAVIGMVVKSEDIPAATQLFTPNWIVQYLVQNSVGRQWLQTYPDSPLKGKMEYYIEPAEQTPEVQTQLAAITPASIEPESIRVLDPACGSGHILIEAYNVLKNIYEERGYRARDIPQLILENNIFGLDIDDRAAQLSGFALLMMARQDDRRIFTRDVRLNIVSLQESLHLDIARLWQQLNFHQQSQTGSMGDIFAENTALPHTDSAEYPLLIRTLKRFVNAKTLGSLIQVPQEEEAELKAFLNALYRLEQKGDFQQRSAAKAFIPYIQQAWILAQRYDAVVANPPYMGSKGMNGELKEFAKDNFPESKADLFAMFMQHAFSLLKENGFNAQINMQAWMFLSSYESLRGWLLDNKMFITMAHLGARAFGQISGEVVQTTAWVIKNHRNEKYQPVFFRLIGGTEAEKKNDLLLHKNIFNRFKQNTFKKIPGSPIAYWIDTSSLLSFSVNKKLGEKISLKAGMSTGDNTRFQRYWFEISLDKSSINKNYNGKPSTYKWIPCSSGGEYRKWYGNNELVVNWMNDGYEIRNFKFENGKTRSAVRNDEFYFLEGITWSKISQGNFCVRYRPEGFVFDDTGRCGFSNDKNNLLFAAGLMCTPVINHYLSILAPTLSFTSGELASVPLSELDDRIPELVKSAINTAKNDWDSSELSWDYDKSPLLKNNPPPLMLKQVYEQKVLTDNEIIELLTTIENNINNIFIKKNGLDNSAVKSVSKNEITLLCNPFYRYKNITNYTEQLKKYYTDLTIDFISYSIGCQMGRYSLDREGLVYAHEGNKGFAELVAEGAYKTFPADNDGILPLMDDEWFDDDVTARVKEFVRTVWGDEHLQENLDFIAESLCLYAIKPKKGEAALDTIRRYLSTQFWKDHLKMYKKRPIYWLFSSGKEKAFECLVYLHRYNDATLARMRTEYVVPLLARYQANIDRLHEQVDGASGGEATRLKRERDSLSKKFNELRSFDDRLRHYADMRISIDLDDGVKVNYGKFGDLLADVKAITGNAAGVI

SEQ ID NO: 2810 - protein, 1164 aa, Erythrobacter litoralis
MDTTKLRKFAQFARSTLIDQVTVRLEAVLSDGSSARREYPRAFKKLETLVGKLGREQVVEKVAYTWFNRFTALRYMDVNGLSPVRVVSPSVGQFQPEILSDAKSGSINEQIVPEITRDEVLSLLDGRTSSPDPQGEAYRLLVVAACNYWHDAMPFMFERIDDYAELLMPSDLQSNASILAYLREAMTPDVCEDVEIIGWLYQFYISEKKDQVFAGLKKNQKITAENIPAATQLFTPHWIVRYLVENSLGRLWLLNNPHSGLAAKMDYYIAPEEPETDFLRITKPEEIRICDPAAGSGHMLTYAFDLLYAIYEEEGYDPTEIPALILSHNLTGVEIDDRAGALAAFALAMKAAARLGRRRFLRMEAKPDICVLQNVAFKEAELQDVTAVVGKDLFTDELRETLRQFEQAKNFGSLILPRLRDPAEALRVVNARDFDGDLLLKEVQQRVIAVLRMAEALSPQYHVVVANPPYMGSGGMNPEMTSFARVNFPDSRSDLYAMFTERCLSLNVVYGMSALVTIQNWMFISSFEKLRDKLISRYHISDLLQIGFNSFPELNSKVVQAVAFVIKNGKSKYPGRYINLNDAAQSANKREILELKLKENDVFLTEDEKFSSIPGSPIGYWLSDSVFKVFENLPSLASVAPTKQGLATGDNEQFLRQWYEVSSSEIGQGTLSSKETEDRPERWYPCNKGGEFRKWFGNNAIVVDWQHSGKRIKSFKDNNGKLRSRPQNENFYFKPGITWSAISSGGLSMRLSPLGSMFETKGAMSFPEEENIFPALSFANTKVVNRLLLALSPTLDFHEGPIGRLPYLRVSGAADIGRRCSELARSDWDAFETSWDFTTLPLLSPDHRGERLASSYATLRAHWQSMTDEMKALEEENNRIFINAYGLQDELTPEVPIEEITLTCNPAYRYAVKSSEEDRETRLRAETMAEFLHYAVGCMFGRYSLEEPGLILANQGETLADYLDRVPDPSFMPDEDNVIPVLDENWFPDDITERFRLFLRATFGEQHFRENLKFIEDSLGKDIRKYFTKDFYADHVKRYKKRPIYWMVSSPKGTFNVLIYMHRYRGDTVSVILNDYLREFITKLEGERTRLEKLSDDPAASQGQKTKALKDAAKVAKQIDELNEWERDVIFPLAQRKIEIDLDDGVKANYPKFGSALKKIAGLS

SEQ ID NO: 2811 - protein, 1204 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLDHGFRMLSHPETPAAFEVLDHVPEVAEALLPENKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQQLNFHQQIQTGSMGDMFAENNALTQTDSAEYQLLLRTLKRFVNAKTLGSLIQVPQEEEAELKVFLDALYRLEQEGDFQQKAAAKAFIPFIQQAWILAQRYDAVVANPPYMGGKGMNSELKEFAKNNFPDSKADLFAMFMQHAFSLLKENGFNAQINMQSWMFLSSFEVLREWLIENKTFVNMIHLGSRAFAEISGEVVQTTAWVMNNYEINKYQPIFFRLIEGNESQKNKTLKKRESNYKDITVDDMKNIPGAPITYWLKGIHNFKRAKLAHYFLSGGRNKTHNNDLYVRYFWEVSLKEKKWVTYANGGESRKYYGNDQYVINWSDEAKLYYDSHGGLSNSKFWNKLGITWSLIGTKSISFRIKPKHLQYSSGSPVIFCEDLNQTYVTLAFLNSTVGQYYLSAISPTINTTVNDVLSLPVPELDCMHSDKIISLTESYINISSDDWNSLETSPEFKKNSLAFNIAKQKKIKKSCLYLQEKNNATLIKAQEIENEINKIFIRNYNLDEYSEIVKDRDDITLYINLKHLYGSDISDNIRQNRYFSDQLSEMMSYSIGCMMGRYSLDREGLVYAHEGNKGFSELVAEGAYKTFPADSDGILPLMDDEWFDDDVTSRVKEFVRTVWGEEHLQENLEFIAESLCLYAIKPKKGESALETIRRYLSTQFWKDHLKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 2812 - protein, 1204 aa, Escherichia coli; identical to SEQ ID NO: 2811

SEQ ID NO: 2813 - protein, 402 aa, Escherichia coli
MNSNYMPFTQRDSLGRYYTKESISALLVSQMKAEKVNNIIDLASGEGSLTYAALDRWKNAEAYSLDIESRMSKKVCDNLTHIVTDALVHSFPEMLARHQGNFDVAVCNPPFTLPEWRDDYFKIISEIGADKYISVSKYVPAEIIFISQVIRFLKKGGEAGIILPDGIFTARKFIGLRRYLLNEHSITKVIELPRNIFKRTEAKTHILIFNKKIMPHHKIQLHCITKDGELSPPVLIRKEDAVERMDYSYHYNKNEGKGFSTIGMLKNISIFRGRFNSKEITEHVFHTTKFSGDEKYIKFHCNSVEELKPSKLDVIAKPGDILIARVGRNFHKKILFVESGYSYISDCIFLIRASGGDKKKLFDFLCSQDGQEELSRASSGVAAQHITMDALKKIHLVRIKHD

SEQ ID NO: 2814 - protein, 1205 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLDHGFRMLSHPETPTAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILTEAYNVLKAIYEERGYRTRDIPQLILENNIFGLDIDDRAAQLSGFAMLMLARQDDRRILGRGVRLNIVSLQESKLDIAEVWTKLNFHQHMQRGSMGDMFTQGTALANTDSAEYKLLMRTLALFTSAKTLGSLIQVPQEDEAALKAFLERLYRLAVEGDIQQKEAAAELIPYIQQAWILAQRYDAVVANPPYMGGKGMNGDLKEFAKKQFPDSKSDLFAMFMQHAFSLLKENGFNAQVNMQSWMFLSSYEALRGWLLDNKTFITMAHLGARAFGQISGEVVQTTAWVIKNNHSGFYKPVFFRLVDDNEEHKKNNLLNRMNCFKNTLQNDFKKIPGSPIAYWATLAFINSFLKLPALGTRAVKGLDTNGSIDVFLRRWPEVSINSFDALGKGNSKWFPIAKGGELRKWFGNHEYIINYENDGIELRKNKANLRNKDMYFQEGGTWTVVSTTGFSMRYMPKGFLFDQGGSAVFCENNDELSIYNILACMNSKYINYSASLICPTLNFTTGDVRKFPVIKNNHLEDLAKKAIEISKADWNQFETSWEFSKNKLIEHKGNVAYSYASYCNFQDKLYEQLVNIEKNINNIIEEILGFKIETTENSELITLNSNKIYRYGQSETNDTFLNRHRSDTISELISYSVGCQMGRYSLDREGLVYAHEGNKGFAELAAEGAYKTFPADNDGILPLMDDEWFEDDVTSRVKEFVRTVWGEEHLQENLEFIAESLCLYAIKPKKGESALETIRRYLSTQFWKDHMKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEAI

SEQ ID NO: 2815 - protein, 1224 aa, Escherichia coli
MNTNNIKKYAPQARNDFRDAVIQKLTTLGIAADKKGNLQIAEAETIGETVRYGQFDYPLSTLPRRERLVKRARELGFEVLVEHCAYTWFNRLCAIRYMELHGYLDHGFRMLSHPETPAAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQQLNFHQQVQTGSMGDMFAENTALTQTDSAEYQLLMRTLKRFVNAKTLGSLIQVPQEEEAELKVFLDALYRLEQKGDFQQKAAAKAFIPFIQQAWILAQRYDAVVANPPYMGGKGMNGELKEFAKNNFPDSKADLFAMFMQHAFSLLKENGFNAQVNMQSWMFLSSYEALRGWLLNNKTFITMAHLGARAFGQISGEVVQTTVWVVNNNHTEFYRPVFFRLINGSEEEKKSALISRKNMFNHTLQNDFKKIPGEPIAYWVSDIYRDIFTQSPALSSIAKPRQGLATSDNNRFLKLWYEPSLRKINFSAKDRADALNSQAKWFPCQKGGSYRKWFGNHEYLVNWENDGRELLDFAASLYGSPTRTIKNIPFYFREGATWSTISSSDFSIRYSPTGFISETKGAVCFADDKDILLSILGFGNSKLVNYFLKSLSPTLDYHEGPIGKLPFKGKLKAQVLENVVNLIAISEEDWNTEETSWGFKKHPITKLDNLNYLQASFEAFKNDVQETIIRTQQLEEFNNKEIIREYGLESELNYKVSLEEITLTVNPDYKYSGTTDDKSKRMQSDSLSSLLSYAIGCMMGRYSLDREGLVYAHEGNKGFADLVAEGAYKTFPADSDGILPLMDDEWFDDDVTSRVKEFVRTVWGEEHLQENLEFIAESLCLYAIKPKKGESALETIRRYLSTQFWKDHLKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 2816 - protein, 1217 aa, Escherichia fergusonii
MNTNNMKKYAPKARREFMDAVAKRLNTFGITANKKGELQIAEANLQGSVLQIAGNSFDGKLAEPRKRIVARSQKLGYAQLIEQVAYTWFNRLCAIRYMEIHDYLGHGFRVLSHPDNPKGFEIIDHAQDAADELGLDRARIVELKLAGNKDEELYRELLLGQCHKLHEAMPFLFDALDDETELLLPDNLTRTDSILRGLVDGIPEEDWQQVEVIGWLYQFYISEKKDQVMGKVVKSEDIPAATQLFTPNWIVKYLVQNSVGRQWLQTYPDSAIKTQMEYYIEPAEQSDEVNQQLKAITPESIEPETIKVLDPACGSGHILIEAYNVLKAIYEERGFRSRDIPKMILENNLYGLDIDDRAAQLSGFALMMMARDDDKRIFTRNVRLNVLSLQESNHLDLPTLWKALNLSGSWQSGTSQGLFSDDDQDLSSFNADNRYQLLKRTLARFTQAKTFGSLIDVPSDDHEQLKEILSTLVELQESGDSMQKPAAKQLIEFVHQALVLSIRYDAVIANPPYMGSKYQTAEVKMFLKDNFKGYEKDLFSAYIVRNLQLAKEHGQLGFMTPFVWMFISSYEQLRSTLIDDEIISTLIQLEYSGFDGATVPICTFTLTKGHIPEYIGSYIRLSDFKGAANQAPKTLQAIKNPECGWFYKAKSDDFKKIPGSPIAYWASSLQFSMFDSHPLLTSIANVAEGTTTGDVNRFLKMWHEIDVNGLGIGFDSRERAKDSGKKWFPYNKGGEYRKWFGNNDYVVNWAEDGKELRQYQGSFLRGEKFYFKAGLTWSKVSSGILSFRLFDEGFLFDTGGLCAFSDNIEYIAAILNSKVSLDIMSILAPTLNFTVGTVSSLPIVEGIPRLTENANRLKRLSKSDWDSYETSWDFTKHPLLSHTSLLIKDSYSRLLLENSQSLKEYREIEEYNNKVIAEAYGITSDALTIADHEITLFSSFGYRYGPDRAVNGEFLYRSDVVAELISYSIGAMLGRYSIDSKGVVYAHTANEGFEQLVAEGAYKTFPADEDGIIPLTDQEWFKDDATNRFREFVQVVWGDDHLQENLDFVAESLCLNAIKPKKSESALETIRRYLSTQFYKDHLKTYKKRPIYWLFSSGKQKAFECLVYLHRYNEGTLSRMRTEYVTPLLGKYDAYAEQLEKQIETADSTSEANRFKKELDALIKKQVELREFDDKLKHYADMRISLDLDDGVKVNYGKFGDLLADVKAITGSAPEVN

SEQ ID NO: 2817 - protein, 1174 aa, Exiguobacterium sibiricum
MNKSALKKFAIEARRELLEKVELQARKLGITAESIQKVSVESSDAVFIEGRQLSDTERKQRNKLIARINDIGFDRVMGETAYTWFNRFVALRYMEVNEYLPTKVRVLSSNSDSAEPDMMKEALSLNLNLDKDYVYDLKLNNKTDELFKYLIKMHCNDLNRYMPFMFETIEDYSEILFPEGLLGTDSFISQMINLEFIPEENWKQTEVIGWLYQYYIAEEKDRVFKAKNKYKAEEIPFATQLFTPDWIVQYMVQNSLGRYWTEAHPEHNYLIANWEFFLKHEQEDFQEKIAPYVNKELNVEEIKCFDPAMGSGHILLYMFDVLYEIYSKCGYTEREIPRLILENNLYGLDIDDRAYQLASFSMVMKALQYNRRFLRSIEKEGLILNLAAIQETNSWSDDVISYVAGDDKETRISSTKAFFEEYKNAKTFGSLIQAKETDLTYLEKRLQEIKENPIADIFETKKRDQVITALPLLIKQTKIMSKQYDIVVMNPPYMGSGSMNKELSDFLIKNYPDSKADLFAAFMEVDHYLKQNAFYAAINQQSWMFLSSYEKLREKVIKRKSIDTMLHLGPRAFEEIGGEVVQSTAFVLRNTEIRDYKGTYLRLIGNRAADEKRDKVIGAVQNSSIAYRYSFSQENFRKIPGSPIAYWVGNKIAESFVQNTLLGEIANPRIGLVTGDTGRFLRMWFEVADEKINFGASSSLDAKKSKRKWFPYQKGGTYRKWYGNNEYIVNWENDGHEIIHDNSVNGRVKSHNYNGMYAFNEAITWTKITSGAPAFRFVPFGYLFDDAGPLCSVNNKLNFFPILALLNSVVGEFYLSLTNQTMNILPGSIIKTPFYKEVMEKHNIIEKLVTNSIAISKRNWDCYETSWDYKKHPLIEYDTKSFRLSFEQWERIAETEFNQLKLNEEEIDYIFIEIYGLEDELTSKIEDNDITIHKADLGRDTKSFISYAIGCSFGRYSLDKDSLIYAGGEFNMSQYKIFPADEDNIIPILSGTYFEDDIVTKFVDFVRITFSEETLEENLDFIAVAIGRKKNETAREALRRYFLNDFYKDHVQVYKKRPIYWLFTSGKEKAFNCLIYMHRYDKTTLSRMRTDYLHEVQIRLDAEKKDLLNVIEGDLTTKEISSAKKALKSLDKKIDELKAYDELLHHMADMQIEIDLDDGVKVNYEKFKGLVAKI

SEQ ID NO: 2818 - protein, 1238 aa, Flavobacterium branchiophilum
MKLSDHVDSIRERIYKAFNNQFARLGIGANKLMEIDKIPTDLHSKRKKIEILIASHEGETGNYEEAREKALDELTFTLFNRLAAIKVMEAHQLFNPIVTKQAAHGGRSFGHKIWLENNPEKRNEELEGMRDYFKYEFNKLGDDLPLFHKNYPYALLPYVIELNDIVEAFNAVETDIDIIKSQQPTTNNQQPNIWQSDDILGWLYESYNNAKKQAHKDSGDKTEYDKVSLQSQVYTPRWVVEFLVHNSLGKMYLEMYPDSEIKDEYKIANAPKTRVREPKPLHEIKLIDPASGSGNFLLYAFAFFYALYQDQIDNYGANYDEEDIPKLIIENNLYGVDLDDRAAQLAQLGLWIKAKQKNRNTTTLNFHVVSSDFFLPDFKEVLPIFESGIADQNQRKIVEEIWTDLQQAHKFGSLVKIEEKLSIKLHGALEKQNENQIRMFDADTIQEYERFTADFFRNLETAVAQYATQAGNSFLTDKTKDAITFLKLITQKYDVATANPPYTDSADFGPELKKYIESNYKKPFAFHTNLYATFIKRCFELTNEIGKIAMIHPRTFMFIKTFEDVRKFILEKTHLNVFVDYSLSNLFGSIMVDPAFYVMEKNIKTSDNAWFISLDQYTRTPNEKFKKEFTLEALNDYIEGKDNIHNHKLPQSKLKIIKSYPFIYWISDEFREKFGEGDIKSVLSPAQGAATTNNLKFLRFWWELDKDELSKDYPVDKKKWVNYAKGGPYEKWFGNMWLYLNYANDADSLKKAGAVLRNSDLYFNKGVTYSASGSKGASFRILPENSVFDTGGSCIFANRDFKNTSFVLGFMNSKLVSYIVDCLNPTVNAQVGDMQRVPFVLPKSKLEEEVKILVDQCVAIKDFTASFKIYESNFNKTNLIESKSISDFYNLENYLITQVLINEAIINTKIFEVYELTDADKAMVLAKEGESIGGLPVTAAAKKDYLENEVAEFPLENIKDFIQNLPETAFSTEEKDKIVAEFPNLYQSNNDLEEFCIRHQVNPINVWYWFKESNIIPKQRMNTLAMEFLADMIREILLEDEDGIIPLVPNAGEKILLDRIEEKFLEKGFSMAQYSAFDGVLGRNIKEYLNGHFFKALSDHLNLFMYLPKTPFIWHLTSGPEQGFDCYSIIYKWDRDKLMRVRSVYIEHRERALVNRQTDLRNKEVLSASEQNEADKIYKQLKEIESFKAKIDELLQEGYNPILDDGVGKNIAPLQKKGMLAYEVLNAGQLKKYLNTDW

SEQ ID NO: 2819 - protein, 1170 aa, Gallionella capsiferriformans
MNKSKLKSYAPQARRDFIAAVTARANLLGLSDSGGKLEVAIGERKGDIAIIAGQEWPAKVYELRERLIKRMTTEGFSHTVDAIAYTWFNRFAALRYMEIHDYLDHGYRALSNREGGMPEILNHATELDLPGLNKDRAVELKLAGDKDGELYKMLLVAQCNTLSRSMPFLFEHIDDETELLLPDNLLRTDSVIAKLVAAIPEEDWQEVEIIGWLYQFYISEKKDEVIGKVVKSEDIPAATQLFTPNWIVKYLVQNSVGRLWLMANPASTLKSEWAYYIEPAEQTPEVQAQLDALIQTRMIEDGGSLSPETIKMLDPACGSGHILVEAYEVLKGIYLERGYRLRDIPRLILEKNLFGLDIDDRAAQLAGFALLMKARADDRRLFDNPPTLNVLALQESKGLDAVQLSAALVGSGQWAVGSKQQLSTDVCSLITVFEYAKTFGSLIQIPPSLNMKLATMAESLQQAIKSGDLLSESAAQQLLPLVEQAKVLGMQFDAVVANPPYMGGKGMNPVLKDYAKATFPDSKSDLFAMFIERGFGWCKPTGFNSMVTMQSWMFLSSYEAMREKLLTDRTIMTMAHLGARAFSEISGEVVQTTAFILQGKHFSGFKPVFFRLVDGLEAEKEATLLAGLNRHDLTIQDAFKKIPGSPVAYWVGKKIIDAFSKNQLIGSRAKKGITTGDNEKFLRYWFEVSIEKLSMLGGNKWFPSQKGGEFKKWYGNLEFIINWGNSGFEIKNFKTSSGALRSVIRNESYYFLEGVSWTDVSTGKISARYVPDGFLFNASGPTVFSENPMLFLANLNNVVTYKNTEFICPTIHFEVGQIQRLPFTNIDDTSHVNDLVRMARQDWNASEYSWEFEESPLAAKRGNTLKKTWDQWQIACVERVLKTKALEELNNRLFITAYGLQDELSPEVPEEQITLTRADREKDSQRLISYVIGCIMGRYSLDEPGLIYAHAGNIGFDATRCQTFPADADGIVPLTDEFWFEDDAANRIREFLLAVWGAETLNENMAWLAESLGMKGNETSEETIRRYLASSFFKNHLQTYKKRPIYWLFSSGKQGAFQALVYLHRYHEGTLARMRAEYVVPLTSKIQSRIEMLIKDAEVATVTSVRNKINKEVEVLRKKHVELLAYDEKLRHYADMRIQLDLDDGVKVNYGKFGDLLAEVKAVTGGSGDE

SEQ ID NO: 2820 - protein, 1114 aa, Gallionella capsiferriformans
MKIALAREHRKTLETVIGQARVAAESGAIKALQALAVGAKEVPSHFTDTQKKLRVRLRAHGRQLGDVLRPDDTQAVDHLITEVAYEHWHRMLFARFLAESNLLMHPHGYPVSLQDCKEDAATMEPPARSEWEVAGRYASAMLPNVFRPDTPTLALELPLETEQALEALLNKLPATVFQADDSLGWSYQFWQAPKKEEVQRQMKQAGTKVGADELPAVTQLFTEQYMVAFLLENSLGGWWRGRHPGKPLPIEMPYLRTIEDGTPAAGTFAAWPDTLADFKLLDPSCGSGHFTVSALYYLVPLRVASETISVRDAVDKVLADNLHGLELDARCVEIAAFALALAAWRYPDETGKPLGHRPLPRLNIACCGVAPRTPKATWLKLANGDRQLEHGMEALYALYQKAPELGSLIDPSAVTRGDLVDANWDELQVLMEKALANSSGDEAEVEARVAAQGMAFTTRILSRRYHLVITNPPYLGSGQHGPVLKDFCEEHYKAAKGDLANVFLDRCLKLCLPGGVVQFVMPQNWLFLKTYKAQREYLLRLETWNMAALLGPKGFDTPMWDFNVQLVTLTHSTPPANHSFYGLDASEGKTPEDKSGLLISTTGISVDQQSQFNNPDFRIVIGSSANSDLLQTIASSNAGMLTGDGNYFCRYFWEPKSVHPDWELMQSTVSKTTPHGGRSQVVLWENGSGQLFKYADSVKHLNTAVQRWRSGQQVWGKKGVVVSSMGSLECTLYSGDRFDNNVGVITPTNPSHLAAIWAFCSSSQFSTEVRKIDQKINVTAATFAKVPFDIVHWQKVAAERYPKGLPKPYSDDPTQWIFHGHPKPATAPLQVAIARLLGYRWPAEFDAEMELSDEARNWISRCAEFYDLTDDDGIVCLPAVRGEPAAIDRLRALLARAFGADWSAAREAQLLTDAGCDGMPLVQWLRDKYFEQHIARFGKRPFIWHVWDGHKEGFSALINYHQLTHEKLTTLIHLYLGDWITQQKRAVDAGITDAVLKLAKAEALKVKLEAILTGEPPYDIFVRWKQEHLLPLGWEPDINDGVRMNIRPFVAAEVLRIPRAKLGIKWEADRGKDVPSAPWYKLGPQYGEPEGTRINDHHTTLTEKQAARNKAGSK

SEQ ID NO: 2821 - protein, 1144 aa, Geobacillus sp.
MNKRALKEFAVYARNELRNQIALRAQAFGITPEGSPTLVTGADYVEINGKKLPLSYKSGLQKLLKEVETKGYDQVIEEVAYTWFNRLIAIRFMEVHNYLPSKIRVLSSETRGKVDPDILTDYQYTDLPVDKEEIASLLQQGKREEAYRKLLIAQCNELHQIMDFLFEKIADYTELLLPESLLHADSLINKLGKELGDENFEHVEVIGWLYQYYMSEKKEQVGGLKNTAVKKEDLPVVTQLFTPKWIVQYMVQNSLGKLYDEWKPENHLVKDWEYYLKSSEKLPIPENISLEEIKVIDPACGSGHILVYAFDLLYDMYLEAGYPEREIPRLIIEKNLYGLDIDKRAVQLASFALMMKGQEKYRRFLKKATDLKLNIHEFVDSEPISEEVLAFLGEKVGDVSWVAALQEKFENAKQFGSLLVPDEQASFYLKYIEAIESYDVNEVELLEETYIIELKEKLLPLLKQAYLLALKYEVVVTNPPYHNKYNPVLKKFMNDNYKDYKSDLYSAFIYRCTQMTVENGFAALMTPFTWMFISSHEKLRKYIIENQSISSLIQLEYSAFTEATVPICTFVIQNQNRTSIGEYIRLEEFKGADLQPIKVKEAVKNNVDYRYSCDSKSFNAIPGSPIAYWLNKKARDGFQYVIGNNYSAVAGISTGNNNRYIFDWYEVDYSQISFSKKGGIDCKKYYPHAKGGDYRRWYGNRINVIKYNEQSIKEMSSLPGFRHDGRMHYFKHLISWSKITSSIFSARYYEPMFVFDSAAPSISIDKIDYNLLGYLNSKVAYYFMKVINPTLNYPPGYMELLPFSHSENKVINSIVSENIEICINEWNSFETSWDFKKHPFLTYRGNAKTLEECYANWADHAEKQFRQLQKNEEELNRIFIELYGLQDELTPEVPDEEVTVRRADRVRDAKSFLSYCVGLMMGRYSLDVEGLAYAGGEWDASKYKTFQPDKDGIIPLTETAYFEDDVISRLQELLIIMFGEETLAENLRWLAESLTMKNNETPTERLRRYFFDEFYADHCKIYQKRPIYWMAESGPKKAFRALFYLHRYTPETLATMRFTYVQNLQEKLRQEQKRLEQDLINPDLSSAMKKRYEKQLKQIRAQQEELVEFDKKLAELANQRIALDLDDGVVVNYEKLKTILAKIR

SEQ ID NO: 2822 - protein, 1270 aa, Geobacter sulfurreducens
MNDTFVADIQKFTLANRALLERETDEQLQGIYGWLPDGSFADASRYPAIHQLDEARETRLQLEHYAEEEKAAGFSSVDSRRKIVRETAFTWLNRLVAFRLLEERKLLKQIVAKIDKSNGFIFWLTAEGNEEVYKLHQQGDLPLNPMGEGPSNVAYRRFILWQCGELARDVSVLFDPSTLPTRLFPRPAIVKQLAESMNTEARIEAWKPGNEETLGWVYEGFIEDENEAVFKKFSKGKKVIAEEIGAATQRFTPRWIVRFLVENSLGRLWAEMHPDSRLKDSLSYLVPIENSQAHPLKLVRDITFLDPSCGSMHFGLVAFDLFAEMYREEFEKAGQPGWPENPSVNAEDEIASSIIAHNLHGIDIDLRSVQISALTLLLRARTLSPKCAFTDRNLACANVEQTSGGKLETLIAAAKFSHPIYERVLRTLAAEMKDSDQLGSLLRLERSLERLVIEERRKAEENKQFLLSFPGISPEQFDTQAGIEEFFDLLSDQLLRHLDFFVRASREMGGDPGHIVNEAAKGLRYMQLVSHHYDVVATNPPYMSRRNMSDVIAKHLDKHYPETKGDLYAAFIARCLELVAPQGKVAMVTQQSFMFIGTYEKFRSNLLSRVTVETMAHLGPKAFPNITGEKVNTTAFVIRREPDGKSLEEHCGVYFRLVRERDAVAKQIAFEGAVSAMRSGMTTPIVFTYRQIDYDTIPEKPWVYWMPEKIQELFRQGRLLSVVAPPKVGLQTGDNTRFLRKWWEIGVNHIARNATSCSDTKRSGVKWIPYMKGGAPIPWNGNHEHVVNWKMDGVEIRAFCPRAVVRNPTFYFRKGVTWSDVSPKGFAGRLSPGGFIHDVKGMTCYPSDESLNEVLGIFNSTTAKFILSALNPTISFQVGDIERLPIPSKSSKDLEAKVEESVSLAQKDSSDSERTYDFIHPPLCVTEVDERHARLRRIEEEIDQEVTRLYGLDEADRLALKTELEGIKAVAEDNNEEEGDTEEEEETVAGAWTDLSLARAWVSYAFGMALGRYRIGEPEGLGRGNFDAATIAAISALIDSDGIMPSDAGHPQDIVSRTLRILELMRGEDTARRLVRAATGGDGVPENLLRGFLDRFTGQPEVSYWRYHYQLYRKRPIYWPLQSPKRKFTVWIFQERFTTNSLFEVRRMVEERLRMLEREIADKRIVAASNRSVAKELDKLLELSDDLRDFSKNLQDILQAGYTPHIDDGVLLNAAPLHTLLPSWPETQKAWQELAEGKYDWAQQAMDHWPERVREKCKTNKSFAIAHGLA

SEQ ID NO: 2823 - protein, 1086 aa, Haliscomenobacter hydrossis
MAALTPPQRSTLESAVKLARKQAETGALNALQALAVNHPEPFVHLSPAQRALRNMLRAKARLLGDGLDGPTALKNLSHELAYETWHKMLFAKFLEANHLLMHPDGVAVTMTDCEELAAEEGFADKWDTAASYASRMLPAIFRPEDPLMQVPFASNDRIKLEQLIDGLDASIFTADDALGWVYQFWQSEAKERINKSGDKIDGEKLPAVTQLFTEPYMVHFLIDNTLGAWWLSRHPGQQPPLKFAYLRCLEDGRPAAGQFAGWPDSTAAVTALDPCMGSGHFVAALFPVFATLRMHEEGLSKTEATLRVIAENLHGLELDPRCTQIAAFNLALTAWKFCGQYLVLPEMNLACSGIAPKGKVEDWVKLVGQAAHPVEKNRLENGMRTLYQHFQLAPELGSLLDPTTIKPDAFTASFQDLKPVLEKALENEADAEQWERGVMAAGIAKAGQLLGKKYTLQITNVPYLSRGKQDTVLADYCERNYPEAKGDLATVFLDKMLKSNTLGGFSCSVIPQNWLFLTSYKKFREKLLKNKTWNIVARLGAKGFQTPMWDFNVMLIAIAHQIPTNDQTINGLDVSEAPNAAAKDEALKTAELKMVGQVEQLGNPDARVVLEAVDNYNLLNEYCSSTKGISTSDDPVFIRSFWERKNFDSDWEPYQTTPKGDNYWSGYELSICFQNGNGRLRSLAKAMKPDRHMDLRGQHIWTKKGVSIGIMSEIPAAFYLGNKFDANINVIIPNNEKHYPAIFCYCNSNEFKIALRKIDQKISVTTSTFAKVPFDLEHWQKVAAEKYPDGLPLPYSDDPTQWLFHGHPLRTTHPLQVALARLLGYRWPAENDPEMELAPEARALIAAVQAFDPLSDEDGIFCIPSVNAEAAGADRLRDYLQVVFGDAWNHQSLSQLLAQEGASASNLEDWLRNEYFSQHCKLFQNRPFIWHIWDGRKDGFAALVNYHQLDKDNLSKLIYTYLGDWIRMCEAKKKAEESGAEGLLSAALKLKTQLEAILEGEAPYDVFVRWKPLEQQPLGWDPDPNDGVRLNIRPFVEAGVLRSKFNLKWGVDRGKNPPGAPWGEVRDNDRHLRLEEKREAREKVGK

SEQ ID NO: 2824 - protein, 1172 aa, Halobacillus halophilus
MNKAELKRFAVEARRDLIDKVSLKAEQYGITENDQELKVEENYGQLYVNGKSYDTEMKQSFRTLQQRLNNVGYNQLIEEISYTWFNRIIAMRYMEVNNYLPDKVNVLSSSTGKNDPDILLQFETMNLDVKHQKVSESIQEGDNEKAYRSLLIAQCNALNQLLPFLFEKIEDYTELLLPDYLLDQESIIRKIVNELSDENFYHVREDGVRSDNVEVLGWLYQYYMSEKKEQVGGLRNNAVKKEDLPVVTQLFTPKWIVQYMVQNSLGKLYDEKYEDNQLSQHWEYYFKHKENHHLYPRFDSLEDLKIMDPACGSGHILIYSFDMLYDMYEEAGYPSREIPQLILENNLYGLDIDKRAQQIANFALLMKAAEKQPRFISRLSRKGKSPKLNVYEIVEADQTLSEEAINYFAENKMEKSFINELLSQFENGKQFGSLINPIELPYEEWINRLYNLDDQKVNLLDESYIKELKVKLLPIIEQANLLYQRYEVVITNPPYHSRYNKVLKKYMNEKYKDYKTDLYSSFIYQTKTITKDNGYFVLVTPYTWMFISTHEKLRKNLLQKSALSSLIHLNYSAFSEATVPICAFVAHKQTKSTLGVYLKLSKYKSTELSSLVKEAAKENRSYKYIHKSEEFFNFPGNRIAYWATESVKSAFKNHNELGGIAQPRAGLQTGNNDRFLRLWYEVGVEDIGFNMSNLIEAKNSNKKWFPYNKGGAYRKWYGNQYYVVNWEKDGEEIKELATSKYKNYTRTVKNINFYFREGLTWSDVNSQYFGIRYSPKGFIFDVKGSSLFTNNKDFLSIILGFLTSKVSSEMLELLNPTISFQTGDLKSLPIIEPTNRNLVKELVESSVQIAKDEWESYEISWDFKQHPFITNIKEIEKISEANSCWKEKVNNYIQQLRKNEQSLNEIFIKTYGLEGELSPKVEEKDITIRNESRINNTKSFLSYFIGCVMGRYSLDVEGLAYAGGQFDESIYQKFIPNHYGLIQLTDDHYFDKDIIVRLREFLSVTFSPDTVDENMEWLAESLIIKKNESPEERLRRYFLDEFFKNHCKTYQKRPIYWLVDSGKQKGLRTLIYMHRYQPDTMATIRFEHLQEIQSKYQNEIDMIDTRLANPSLSATDRRSLEKSRTAFQKKIDELQEFDKHLATYANEQIDIDLDDGVKMNYAKFYNVLAKIK

SEQ ID NO: 2825 - protein, 456 aa, Halobacteroides halobius
MDKIRNKLQEIGCDEIKKKTTIEVEGKEITYDLVGLINKQPVVGIDITEDNNDTKQIGILSMLSQSEQINYYGSFNTTTEEFNWYQLTEGNISQIEKVPVLQKEQELNLEEVKKWYQEIFRLFTANSSLGHDTIIEVLKVILVKVELDNGRLNALEENLTLENIKSAYQEIIATSGYNLTQEVSVTDKVLAEFATINLAKFRREDLLAVFNQVVFDALGSKQGPILTPQPLVKALGEIFSQQEGVETIFDGSAKMGQLLTACKSKQPQAKVWGMNRDLTLTEIAKLRSLILEQDNQFLEGSSLELEREKIDQLPTEFDLIVSNPEFSKPIKDKELIKEYQITDKSRAKAEELYINLYLDLLTAGGYLAIILPDGVLTNNRAQNIREFILDKSVLKAVISLPETIFRPATSVRTSLVILKKKETLAQEQPEVFMATPEDNQALEEVVADLVEWGGLF

SEQ ID NO: 2826 - protein, 1155 aa, Halobacteroides halobius
MDKTAIKNFAVQARNKLIEQVAHKAYQVGITENEIKEASASSSDALTIGERHLNQKEVEQRNELIAEIEEKDYQQVIEEVAYTWFNRFVALRYMEVNDYLPTGVRVLSSVKGAKADPDIMREALNVDLDIDREEVYQYQDDNDPDGLYKYLLIQQCNELHQIMPFIFEEINDYTELLLPDNLLAEGSVIDDLVTEIEEEDWLEGVEIIGWLYQFYISEKKDEVFASKSKISKEEIPAATQLFTPKWIVKYMVENSLGRYWLESNPNEDLQEEWEYYLEEAEQEPEVKEELEEIRDRDVRPEEIKVLDPACGSGHILVYAFDVLYEIYQSVGYMRSDIPKLILENNLYGLDIDDRAAQLAYFAVMMKAREKNRRIFRDPVELNICAIQESNTIDKAERKMIEQSGAENISYLIDVFEDAKDYGSILDIEFIDDQVIEEELEMLKDKLGLSYTKIKDKLQSLIKQAQIMGQQYEVVVTNPPYMGNRNINSKLKKYLKKHFKNSKKDLFAVFMEKCISFTKSNGFSAMITMHSWMFLKSFRNLRNKLLKNITIESMVHLGPKAFEEIGGEVVQTVSFIFRNINKRKYNGKYIRLIKYNTASKKHQEYFNKGNKYISKMSDFDKIPDFPIAYWISNCIIEIFESGIPLSELGKPREGIHTGDTKQFVKCWSEIDINKFSLSENSYETIKENNVKWIPYNKGGSFRKWYGNNEMAICFDEESRTRMSKLKSHVRPSEDLYFKKGITWSLISTSNFGVRCFKDGMLFDVSSHSFFCEESMYLFFAGLLNTNIVNNLLNILNPTLNFSSGVIGKIPVIKDYTQGQFKNINNLVEKNIKISKADWDSFETSWDFKRHPLLKHKNDTTKIEEAFNNWQEVAEDRFYQLKENEEKLNEIFIDIYGLEDELDPEVAEEDITVRKADKERDIKSFVSYAVGCMLGRYSLDEEGLAYAGGEFDESKYQTFKPNQAGIIPICKDEYFDDDIVTRFIEFLKVTFGEEHLEENLEFIADALPGRRKNPRDRIRRYFLTKSRFYKDHTRKYNKRPIYWLFQSDSRGKAFNALMYMHRYDKGTVSKIRVDYLHELQKKMEAEKLRLERTVESDVSSREKGKAKKRISKLEKDLEELTEYDKELNHIANQQIEIDLDDGVKENYPKFSDILANM

SEQ ID NO: 2827 - protein, 1193 aa, Lactobacillus amylovorus
MDKNKIKKYAINARTELINAIKVKLATLGIDENEIQDKLSISTPDKEYYVDDNEANALTGAQIGWRKDIVAELNRHGYQEDSKTAYKDFVEEVAYTWFNRIIAIRFMEVNNYLPSRVRVLSSEEGRNEPDIINEAMEISDDIGGYSNQEKELITSALTEKTPELMDSLYTMLFIKQCDALSEILPGLFEETSNYLKLLFTPHYDRGVIKELIDEIPEEYFDVEKEGQVQIIGWLYQYYNSEAKDYVIGLPKSKKYRSTQIAEATQIFTPDWIVKYMVQNSLGKFWINVLKARHKDLSEKDLVKKFNWKYYMLDAPQTEKVSERMDKENAKLKKYSIEDLKVIDPAMGSGHILSYIFDVLIQIYESEGYSRRDAATKIVEHNLYGLDIDNRAYQLGYFEVLMKYREYNRRAFRLNKNIHVLSIPSSVELNGIDIKSVLTSYFNKETVNSIENLIQSFTYGKDEGSLLKIKENINFKLIKDILDDPRIISSIELQHIFKYVKLFYKVAKILNQQYEIIVTNPPYMGSSRMNKELSSFAKKNFKNSKSDLFAMFLESWNGHLASQGYCAMVTMQSWMFLSSFEKMRKQLLKKYTISNLMHMENNVMGIAFGTAVTITHLPYDSEFKGTYHQIKMMDVKEHKINNLPVKENRYSQISQSNFDKIPGSPIAYWASENLINDFEDSIKLDQKYPAKKGLVSGDNDYFLRYWFEPIFNNICFKNQNTNSKYNFVKPPYLYAPMNKGGRFRKWYGNNNYVIKFNEDAFDIIDANKGHRSPELYFKMAVTWSAVTSGAPSFRYSQPGFVGGSGGYSIFVDKSIDTYKLLGILNSKVGNYILNILNPTINIQAGDVKRFPLKKNIIDTLKIKNSISISKQDWDAFETSWDFQKSPLLTQNTASLHQAYNSWSNEALTRFNQLKSNEEELNRIFINLYGLQDELTPEEDDKEVSVRKADQVRDIKAFLSYFIGCVFGRYSLDQDGLVYAGGDWDDSKYTTFKPNKENIILLTDRQYFDDDRDIIIRLKEFLTKTFDPETLTENMDFIAQTLEPKKFERGASAEDIIRNYFLNDFYKDHAKIYQKRPIYWEFNSGRNKGFKALMYLHRYNTEQLPMVRHYLHELQPAMNDLIEVDQNLLDQETTASAKSKYRKAIATLNKQMNEIMKYDQILDHLSQSPVDLDLDDGVLVNHDKLQQGEKLLSKL

SEQ ID NO: 2828 - protein, 727 aa, Lactobacillus casei
MVDDIKEDDFDVDKGGQVEIIGWLYQYYNTEPKDVAVASPKSHKFRAPEIASATQIFTPDWIVKYMVQNSLGKYWVQVLRARGDDRPEHQIADSYGWQYYMVDADQSDETRLEIKNLNLSLEKTKIQDIQFLDPAMGSGHILVYAYELLMDIYKSEGFSQREAALSIIQNNLYGMDIDERAFQLAYFAVMMCFRKYNRRALDQGVTTKLHFFNFVLPTTGQLDLIKNTGSINTFKVLKSVVNSFQHATETGSLTRLDQQQRTALKQVLDVLSNKEVPMYLHGLIQSLTQVQQVANILESTWDVIVTNPPYMGSARMNKYLSNYVDKTYREGKSDLFSAFMERFYNQVKPEGYCAMVTMQSWMFLKSFETLRIKFLNQHTISNLMHMENGVMGIAFGTAVTVARGKRIGDFVGTYHQIKTQDAVNKVPSALPIAGNRFNRTKQTNFEKIPGSPIAYWASQSLIHDFEIGTPMGSILEPRQGLATADNNRFLRQWYEVEPFRISFTSTSTEDALKSGAKWFPYNKGGSYRKWYGNYDYVVNWQNDGYEIKHFTFSNGKQRSVVRNPTYYFREAITWSKVTSGSFNIRFRKGGSIFDTGGNSAFADHTDTLFQVMAVANSPVGNYVFRILNPTINMLTEDFKNFPLIKIKKLDLLKTILNLSRQCTQIAKEDWDTFELSWEFKGLQLLLYIAEHQKSPPTKLLIFFEFCDKYVPIQFRGLIFYGQLSKKR

SEQ ID NO: 2829 - protein, 1202 aa, Lactobacillus casei
MDKKAIKTFAIQARRSLIESIKLKLENLGITKDGVAEKMSQSTNEIEYYGDKGLSITGQDIRRRRELVARLKGMAKQEEWSDALTDLIEEVAYTWFNRIIAIRFMEVNEYLPSGVRVLSSETKLKVPDILREAFEIEDDLGGYSVDEHGIIQKALDTEDPTDMDAAYVILFTKQANALNHYLPELFEKTDDFMQLLFTPSYSSGVIKDLVDDIKEDDFDVDEGGQVEIIGWLYQYYNTEPKDAAFKKKKYLSSDIPAVTQLFTPDWIVKYLVENSLGRYWIRVLHDRGDERTSLQIAQSFNWQYFMPEAKQDEISTRADLSKKRVEEITFVDPAMGSGHILIYAFDVLLQLYQSEGYSRREAAQNIVERNLFGLDIDRRAFQLTYFAMMMKLRRENRRSFELQLHPNVFEVPSTSLELKDFSGAKDGSPIDSGNLSDVLGRFGAGKELGSLITFESSIFDDKLINKIVSEREAGQLTFEMSDQVNHQWELRNLIRVGKALSSQYTISVTNPPYMGSGKMPKTLAKFVGKYYPASKSDLFAVFMERLQHLTKENGIFAMITQHQWMFLSSFKALRERMSSWPIINMAHLGTRAFEEIGGEVVQTTAFVVQKQKLQGFIGTYERLVDFDSQKKKQQAFLTAVQNPNLNYVYRTKQTNFEKIPGSPIAYWASKKKLELLQYSSYRLQNILSAREGMTTGNNALFMRSWHEVQFFKISFLSTAHQIERDKTWFPYNKGGAFRKWYGNIWYVINWKNHGEAIQSNIDKKTGRIRSHNYNGKFGFREAITWSAISSGMFSARYSPTGFLFDSKGVSSFANDHTTLLFCLAFLNSNSSSSFLELLSPTMDFKIGQVLNLPLAKQHSPQVVELTESLISSSREDWNSFENSWSFTTNILLTNIAEHHRNWTVEAAFQQWQKEADDRFNQLKANEEELNRIFIDLYGLQDELSPEEEDKDVSVRRANLPRDIKAFISYFIGCVFGRYSIDTPGLAYAGGDWDASKYKTFIPNKDDLILLTDDDYFGDDRDVMTRFKEFLTTTFGSENLNENLKFIADALGKRGDSSEEQIRAYLRDDFFKKDHLSTYQKRPIYWEFNSGRNGGFKALMYLHRYDRNTVAMIRTKYLHPLQEAYERKLVQLKKFEENEQQTRQKNKYKKQITTITKELDELIKYDEKLQHVANLHIDLDLDDGVLVNHAKAQADTKILTPLK

SEQ ID NO: 2830 - protein, 1151 aa, Lactobacillus helveticus
MSISTADKEYYVDDNEANALTGAQIGWRKDIMAELNRHGYQEDSKTAYKDFVEEVAYTWFNRIIAIRFMEVNNYLPSRVRVLSSEEGKNEPDIINEAMEIGDDLGGYSIEEKELITTALTEKTPELMDNLYTMLFIKQCDALSEILPGLFEETSNYLKLLFTPHYDRGVIKELVNEIPEEYFDVKREGQVQIIGWLYQYYNTIPKENSFKKKKYQTDDIPPVTQLFTPDWLVRYMVENSLGRYWIDILHAKGDSRSEKEIATEFNWEYYMPSSEKNKVVIRPELANKEVTDIKFIDPAMGSGHILIYAFDILMQIYETQGYSRRDAATSIIKNNLYGLDIDKRAFQLSYFALLMKAREYNRRVFRKHHTVNLYDVPEVKYTTKDYTDLISGDALDINTVKDLDSILSVFQHGDDLGSIIKVDKNIDFDSLRKLFANSPNQNNEQPDLFIDMRTRLNTAINVAKVLSDTYDVSVTNPPYMGGGKMDPPLKKYVQKNYPIAKPDLFSVFIEKMIELTSNIGYIGMITMHSWMFLSNFEKLRKEIQNHTIINMAHLGTRAFGDIGGEVVQTTTFILQKAKREEYLGSYERLVDYGSQDDKEKMYLEMENGKDNNDVYHVDQLNFDKIPGSPIAYWASENLIKDFEENRIKDVGTVRSGIMVNKSFTRFWFEVDINKIQLNSTSIDDMKWFKWFPLNSGGGYRKWFGLNKVVINLENNAEDIKNSKTNYRLRSTDFYFRPGITWGRITSGGSSFRKSRIGNLFGDAGPMLFLNDSNSLNYVLSFLNSKVLPELERILNPTLNFQVNDLAEIPIKGEETNKVEVLADKNIKISQKDDSLDETSFDFLHSFIKPALSFKQAYTSWSNEALTRFNQLKSNEEELNRIFIDLYGLQDELIPEEDDKEVSVRKADPVRDIKAFLSYFIGCVFGRYSLDHDGLIYAGGDWDDSKYVTFKPNKENIILLTDQQYFDDDRDIIVRLKEFLKKTFDPETLTENMDFIAQTLEPKKFERGTSAEDIIRAYFLNDFYKDHAKIYQKRPIYWEFSSGRNKGFKALMYLHRYTVEQLPMVRHYLHELQPAMNDLIEVNQNLLEQETTASAKSKYRKAIVTLNKQMNEIMKYDQILDHLSQNSVDLDLDDGVLVNHDKLQQGEKLLSKL

SEQ ID NO: 2831 - protein, 1178 aa, Lactobacillus helveticus
MDKNKIKKYAINARTELINAIKVKLATLGIDENEIQDKLSISTPDKEYYVDDNEANALTGAQIGWRKDIVAELNRHGYQEDSKTAYKDFVEEVAYTWFNRIIAIRFMEVNNYLPSRVRVLSSEEGRNEPDIINEAMEIGDDLGGYSIEEKELITTALTEKTPELMDSLYTMLFIKQSDALSEILPGLFEETSNYLKLLFTPHYDRGVIKELVNEIPEEYFDVKREGQVQIIGWLYQYYNSAPHEEVVNMNGKAIQKDEIPAATQLFTPDWIVRYMVDNSLGKYYLERHPDSAVRQELKYLLPDEIKAINENQDIIDYKLLDNAMGSGHILVYAFDLFMKMYIEQGYSKRDAAQKIIENNLFGLEIDKRAFQLAYFSIMMKGREYDRRFLRRSPTTNLYYFEDLHVSDEFYNFISDKVVRGNLKKVVKDFSDATELGSIIKIDESIDLDSIEEVVAGLDFESGLDVFGYKKIQKQILKTLKIIKVMTTKYEAVVTNPPYMNKFDKTLKKYLRDNYKNYSKDLFSVFIYHNVHQLVKGGYAGYMTPLVWMFIKTYEPLRHDIINNFKIDSLIQMEYSAFEEATVPIDTFVLKNSDDKIGTYLRLSNFKGGMIVQEQKVLEVISDPTVKYLYHTDQSNFDKIPGSPIAYWASENLINDFEKGTSLGEVVQAKVGLQTGDNKRFLRQWFEVGIDNISFNSHSIKDSVESGKKWFPYNKGGSYRKWYGNYDYVVNWQNDGYEIRHFAWPNGKQRSVVRNSQVYFKEAVTWSDITSGSFAMRFRKNGSIHDVTGMSIFSLQKDKLYIVLGIMNSKIGQYILKILNPTIHTQIGNIVNIPILLDVDHNTTFILQSNLNISKTDWDAFETSWDFQKSPFLTQNAASLHQAYNSWSDEALTRFNQLKSNEEELNRIFINLYGLQDELTPEEDDKEVSVRKADQVRDIKAFLSYFIGCVFGRYSLDQDGLVYAGGDWDDSKYTTFKPNSENIILLTDRQSFDDDRDIIVRLKEFLTKTFDPETLTENMDFIAQTLEPKKFERGTSAEDIIRTYFLNDFYKDHAKIYQKRPIYWEFNSGRNKGFKALMYLQRYNTEQLPMVRHYLHELQPAMNDLIEVDQNLLDQETTASAKSKYRKAIATLNKQMNEIMKYDQILDHLSQDPIDLDLDDGVLVNHDKLQQGEKLLSKL

SEQ ID NO: 2832 - protein, 1173 aa, Lactobacillus johnsonii
MDKNKIKKYAINARTELINAIKVKLATLGIDENEIQDKLSISTADKEYYVDDNEANALTGVQIGWRKDIVAELNRHGYQEDSKTAYKDFVEEVAYTWFNRIIAIRFMEVNNYLPSRVRVLSSEEGRNEPDIINEAMEISDDLGGYRNQEKELITTALTEKTPELMDNLYTMLFIKQCDALSEILPGLFEETSNYLKLLFTPHYDRGVIKELIDEIPEEYFDVEKEGQVQIIGWLYQYYNNAPHEKVVNMNGKAIQKDEIPAATQLFTPDWIVRYMVDNSLGKYYLERHSDSTVKPELKYLLPDETKAVDENQDITDYKLLDNAMGSGHILVYAFDLFMKMYIEQGYSKRDAAQKIIENNLFGLEIDKRAFQLAYFSIMMKGREYDRRFLRRNPTTNLYYFEDLHVSDEFYNFISDKVVRTNLKKVVRDFSDATELGSIIKIDESIDLDSIEEVVAGLDFESGLDVFGYKKIQKQILKTLKIIKVMTTKYEAVVTNPPYMNKFDKKLKKYLRDNYKDYSKDLFSVFIYHNVHQLVKGGYAGYMTPLVWMFIKTYEPLRHDIINNFKIDSLIQMEYSAFEEATVPIDTFVLKNSNDKVGTYLRLSNFKGGMIVQKQKVLEAISDRTVKYLYHTDQLNFDKIPGSPIAYWVSKKTANIFNKYPILKNYAEGSVGIQTGDNNKFIRDWWEVIYYKIKFNSKNVKDTYLAKWFPYNKGGDYRKWYGNDLTVIDWKNDGRDIKDTSEKSGHHYQEYSDNLKFRSMITWTRISSNTPSFRYKNSGYLSDMAGFSIYPDSKNIMEILGLCNSKVSLYFLEFLSPTINYMLGQVLSLVFIKSNKIPTELIENNVKISTQDWDAFETSWDFQKSPLLTQNAASLHQAYTSWSDEALTRFNQLKSNEEELNRIFINLYGLQDELTPEEDDKEVSVRKADQVRDIKAFLSYFIGCVFGRYSLDQDGLVYAGGDWDGSKYTTFKPNKENIILLTDRQYFDDDRDIIVRLKEFLTKTFDPETLTENMDFIAQTLEPKKFERGASAEDIIRNYFLNDFYKDHAKIYQKRPIYWEFNSGRNKGFKALMYLHRYNTEQLPMVRHYLHELQPAMNDLIEVDQNLLDQETTASAKSKYRKAIATLNKQMNEIMKYDQILGHLSQSPIDLDFDDGVLVNHDKLQQGEKLLSKS

SEQ ID NO: 2833 - protein, 1203 aa, Lactobacillus reuteri
MDKTKIKNFAVNARKELIDSVRQRLANFGIDKTGIADELPISTATVKYYTNEHFPLKGKAIDWRKQIVSRIKQDTNQKWDEKLNQFIDEVAYTWFNRIIAIRFMEVNDYLPSRTRVLSSEEGRIEPDMITHALEIEDDLGGYSDKERTQITDALMSHNPTQLDKVFGMLFIKQTDELSNLLPGLFEKTSDYMKLLFVPNYSNGVIKELVDEIPEEDFDVSKSGQVTIIGWLYQDYNTEPKNDAFKKKKFAAEDIPAATQLFTPDWIVKYLVENSLGRYWIKMLQSRGDTRTESEIAQKYGWVYFCPSDDSDKEIVLVKKQVEELKFIDPAMGSGHILVYAFDILMQIYRSEGYSDRQSVRSILTNNLFGLEIDDRAYQLAYFSLMMKAREFDRRVLTRNLNLNIMPVPVASRMNQQYVKDINITSNQKLILDKVVDLFRYGNEYGSAIVLPQGLNENEVLTQLEKREETFIGQLGLNDVAEMDQISSLRKIIKATKLLSSEYDVGVTNPPYMGLRRMDDNLKKYIKKQYPSHNQDMFSVFMRVMSRLVTNGHGYIGMITQHSWMFIKTFEKTRKYLNLNQTIINMAHLGARAFGDISGEVVQTTAFILLNKPAKNYVGSYERLVGGSSEEDKKRLYLECIKYPNSSSMYRISQHSFDKIPGSPIAYWAPQALINDFEKGKPLGQLVDAKVGLQTGNNKRFLRYWYEVDFNNIFFDAHNTAEAKQSGKKWFPYNKGGSYRKWYGNYDYVVNWQNDGYEIKHFTDSRGKVRSRPQNTDYYFKNAITWPLITSGNFSMRFRTFGSIHDVAGMSAFSDNPNTLKLILGLGNSSIMKQLVGLLNPTINYQIGDIERIPVLHMDKTTESAVIQQVDHAISLSKHDWDQQEESWDYGMPSVIQYEGSNLEQSLNTWLSDLQSRYYSMKNTEQNINGIFNRLYGLDQTEDSIESPISVRLPESRETTVFAVNSLLSYFIGCVFGRYSLDKLGLAYAGGNWNESVYGSFKPNQDNLILLTDRDYFGDERDIINRLKEFLRITFAPSSLNDNLHFIAKTLDPKKSERGESDEQIIRNYFLNDFYKDHDKTYHKRPIYWQFNSGRNDGFKALMYLHRYNKDELAMVRNYLHDLQAAYSNTIKFNDEQETKSSTAREKNQYRKDTVKLNKKVTEVIKYDEALQHQALAQVSIDLDDGVVVNHAKVQGNEELFSKL

SEQ ID NO: 2834 - protein, 739 aa, Lactobacillus rhamnosus
MFTPSYSVGVIRDLVDDIREDDFDVDKGGQVEIIGWLYQYYNTEPKDSAFKKKKYLTSDIPPVTQLFTPDWIVKYLVENSLGRYWIRVLLERGDKRTSAEIAESFGWHYFMPDVKQNDSTPYPNMAKKRIEDITFVDPAMGSGHILIYAFDVFLQIYQAEGYSRREAAQKIVKDNLFGFDIDRRAFQLAYFAMIMKLRRENRRTFDLHLKPNIFEVPTTALTPDDFSETINASKTDNEQLKEFLTKFNKGKELGSLIDFNADIFKNALINEIIHNQFTGQLTFDTSNQLAHRHELKSLVRVGMGLSSKYTISVTNPPYMGSGKMPKPLSDFVGKKYPASKSDLFAVFIERLQHMTKQDGFFAMITQHQWMFLSSFKSLRERMINWPIINMAHLGTRAFEEIGGEVVQTTAFIIQKQASSNFSGTYERLVDFDSQAHKEKAYLAAVKDPNLKYVYRTKQANFEKIPGSPIAYWASKPLISDFEIGIPLKDLVDPKVGLQTGDNSRFLRQWFEVNVHNISFNTKSTAESLRSIKKWFPYNKGGSYRKWYGNFDYIVNWQHDGFEIRNLKDAKGKLRSRPQNTNYYFREAITWSDVTSGHFSMRYRESGSIFDVVGMSLFSLKRDILEKILAFSNTKVMNFIMSLLNPTIHASIGYVSLMPIISSQDPRVNSLSKESVDVTRNDWDTFENSWNFSKSPLVEYIAEHQKSPPAKFLTLFEFCGKYVPIQFRRLIFHGKLSKTR

SEQ ID NO: 2835 - protein, 1185 aa, Lactobacillus rhamnosus
MDKKAIKTFAIQARRDLIKSIRLKMENLGINENGVEEKSAASTSEIEYYGDKGLFISGQDIKRRRDLVSRLKTMAKQEEWRDAFSDLIEEVAYTWFNRIIAIRFMEVNDYLPSGVRVLSSGTKLKVPDILREAFNIEDELGGYSSDERAIIQKALDTEEPSDMDAAYVILFTKQANALNQYLPELFEKTDDFMQLLFTPSYSVGVIRDLVDDIREDDFDVDKGGQVEIIGWLYQYYNIEPHDKVVNINGGPIKTNDIPAATQLFTTDWVVRYMVDNSLGRLYLEYFPDSPIKEALTYLLPGPIEKRTDEFDITKLKILDDAMGSGHILVYAFDLLIKMYIEQGYGQREAASAILAHNLYGLEIDKRAYQLAYFALMMKARQYSRRILNESVHHNLHVFETVDDVPNEAFEKMKAPKEVIDDLKLLAATFKQAKLLGSIMHFDKQFDFDKLVSAVNSLPESTQLDLFGLQSAKDSLHNILKIAQILQTKFDVVATNPPYLNRMNGDLKKYVKKFYKPYSGDLFSVFIWKNIEMTATNGYAAYMTPFVWMFIKTYEGLRKAILNTKQISTLIQMEYSAFEEATVPINTFVLKNKSDSEAEGTYLKLSDFKGGMDVQKKYVLKAVSDPSVGYLYRTKQTNFEKIPGSPIAYWASKPLISDFEIGIPLKDLVDPKVGLQTGDNSRFLRQWFEVNVHNISFNTKSTAESLRSIKKWFPYNKGGSYRKWYGNFDYIVNWQHDGFEIKHFTFANGKQRSVIRNSNYYFREAITWSKISSGKISFRHVPVGSLFDVAGTSLFSNEPYKLEILLGFLNSNTAMDILAFLSPTLNYEIGQIAALPVLPNKREFLVRNLTRDNEQISKSDWNVSEVSWDFWYFPFVEYIAEHHRNWTIEAAFNQWKEEADKRFNQLKANEEELNRIFIDLYGLQDELSPEEEDKDVSVRRADLSRDIKAFMSYFVGCVFGRYSIDTPGLAYAGGDWDDSNYKTFLPNEDDVIVLTDDDYFGDNRDVVNRFKEFLSATFGTEHLDENVQFIADALGKRGSSSEEIIRAYLRDDFFKKDHLSTYQKRPIYWELNSGRNGGFKALMYLHRYDKNTMAMIRTKYLHPLQEAYERRLDQLKSFEANEQQTRQKNAIKKQITTITKQLDELVKYDEKLQHVANLHIDLDLDDGVLVNHAKAQADTKIFTPLK

SEQ ID NO: 2836 - protein, 740 aa, Lactobacillus rhamnosus
MFTPSYSVGVIRDLVDDIREDDFDVDKGGQVEIIGWLYQYYNTEPKDSAFKKKKYLTSDIPPVTQLFTPDWIVKYLVENSLGRYWIRVLLERGDKRTSAEIAESFGWHYFMPDVKQNDSTPYPNMAKKRIEDITFVDPAMGSGHILIYAFDVFLQIYQAEGYSRREAAQKIVKDNLFGFDIDRRAFQLAYFAMIMKLRRENRRTFDLHLKPNIFEVPTTALTPDDFSETINASKTDNEQLKEFLTKFNKGKELGSLIDFNADIFKNALINEIIHNQFTGQLTFDTSNQLAHRHELKSLVRVGMGLSSKYTISVTNPPYMGSGKMPKPLSDFVGKKYPASKSDLFAVFIERLQHMTKQDGFFAMITQHQWMFLSSFKSLRERMINWPIINMAHLGTRAFEEIGGEVVQTTAFIIQKQASSNFSGTYERLVDFDSQAHKEKAYLAAVKDPNLKYVYRTKQANFEKIPGSPIAYWASKPLISDFEIGIPLKDLVDPKVGLQTGDNSRFLRQWFEVNVHNISFNTKSTAESLRSIKKWFPYNKGGSYRKWYGNFDYIVNWQHDGFEIRNLKDAKGKLRSRPQNTNYYFREAITWSKISSGKISFRHVPVGSLFDVAGTSLFSNEPYKLEILLGFLNSNTAMDILAFLSPTLNYEIGQIAALPVLPNKREFLVRNLTRDNEQISKSDWNVSEVSWDFWYFPFVEYIAEHQKSPPAKFLTLFEFCGKYVPIQFRRLIFHGKLSKTR

SEQ ID NO: 2837 - protein, 1184 aa, Lactobacillus rhamnosus
MDKKAIKTFAIQARRDLIKSIRLKMENLGINENGVEEKSAASTSEIEYYGDKGLFISGQDIKRRRDLVSRLKTMAKQEEWRDAFSDLIEEVAYTWFNRIIAIRFMEVNDYLPSGVRVLSSGTKLKVPDILREAFNIEDELGGYSSDERAIIQKALDTEEPSDMDAAYVILFTKQANALNQYLPELFEKTDDFMQLLFTPSYSVGVIRDLVDDIREDDFDVDKGGQVEIIGWLYQYYNIEPHDKVVNINGGPIKTNDIPAATQLFTTDWVVRYMVDNSLGRLYLEYFPDSPIKEALTYLLPGPIEKRTDEFDITKLKILDDAMGSGHILVYAFDLLIKMYIEQGYGQREAASAILAHNLYGLEIDKRAYQLAYFALMMKARQYSRRILNESVHHNLHVFETVDDVPNEAFEKMKAPKEVIDDLKLLAATFKQAKLLGSIMHFDKQFDFDKLVSAVNSLPESTQLDLFGLQSAKDSLHNILKIAQILQTKFDVVATNPPYLNRMNGDLKKYVKKFYKPYSGDLFSVFIWKNIEMTATNGYAAYMTPFVWMFIKTYEGLRKAILNTKQISTLIQMEYSAFEEATVPINTFVLKNKSDSEAEGTYLKLSDFKGGMDVQKKYVLKAVSDPSVGYLYRTKQTNFEKIPGSPIAYWASKPLISDFEIGIPLKDLVDPKVGLQTGDNSRFLRQWFEVNVHNISFNTKSTAESLRSIKKWFPYNKGGSYRKWYGNFDYIVNWQHDGFEIKHFTFANGKQRSVIRNSNYYFREAITWSDVTSGHFSMRYRESGSIFDVVGMSLFSLKRDILEKILAFSNTKVMNFIMSLLNPTIHASIGYVSLMPIISSQDPRVNSLSKESVDVTRNDWDTFENSWNFSKSPLVEYIAEHHRNWTIEAAFNQWKEEADKRFNQLKANEEELNRIFIDLYGLQDELSPEEEDKDVSVRRADLSRDIKAFMSYFVGCVFGRYSIDTPGLAYAGGDWDDSNYKTFLPNEDDVIVLTDDDYFGDNRDVVNRFKEFLSATFGTEHLDENVQFIADALGKRGSSSEEIIRAYLRDDFFKKDHLSTYQKRPIYWELNSGRNGGFKALMYLHRYDKNTMAMIRTKYLHPLQEAYERRLDQLKSFEANEQQTRQKNAIKKQITTITKQLDELVKYDEKLQHVANLHIDLDLDDGVLVNHAKAQADTKIFTPLK

SEQ ID NO: 2838 - protein, 718 aa, Leuconostoc kimchii
MIDGIPESDFDVQLEGQVEIIGWLYQYYNEESKDKAIGQPKSHKFRDVEIASVTQIFTPDWIVKYMVQNSVGKYWMNVLKTRPSFTSEKEIAQNFGWEYYMEDADQPIDVETNLSVENDILNKDIQKLKVLDPSMGSGHILVYAFDLLMDIYQSEGYSKNEAATSILNNNLFGMDIDRRAFQLAYFALMMKYRQYVRRGLSDENSAHVYDIPSTSGFDALDFAAIEETFSNPVALEIKKVLNRFEHGDEQGSLLNTDDIDFNVIEDALADLKNSSIPLDLINVIDTLENSLVVGQTLSAMYEVVITNPPYMGSSRMNSSLSDFAKKQFPNSKSDLFAMFMEHYNGRIVKNGYNAMVTMQSWMFLSSFETMRTYLLEKFTISNLMHMENNVMGIAFGTAVTIVRNVNLPTFVGTYHQIKTSDASGKVPKNLPVYGNRYNRTNQANFKKIPGSPIAYWVSANLIHDFEVGTRMDKIVEPRQGLATADNNRFLRQWFEVSLNNIKFDAKSIDESISSNKKWFPYNKGGSYRKWYGNYDYVVNWENNGAKIRNFTDAKGKVRSRPQNTNYYFREAITWSDVNSGHFSLRYREFGSIHDVKGMSAFSTDKSVFEYILSLLNSPVGEYIFKMLNPTISLQIGNFQTFPVLGIHADSTAIKAFAHRNISLSRNDWDSFEISWNFKMHPLIRHIDEHNRNWNITPILNHCNVPNLSQKIFLEVNYG

SEQ ID NO: 2839 - protein, 1183 aa, Leuconostoc kimchii
MDKRAINNFAVKARRDLIRDITNKLGLLGIDEDGIQEKRAESTAEIEYYGELAYEISGDDIRLRRELVSHLKSRVAEDWNTLLQDFIEEVAYTWFNRIIAIRFMEVNDYLPSKTRVLSSENGRTEPDILTEAFDIEDDLRGFNSNQRALLAKALDTEIPEDLDKAYTMLFIKQANALNDNLPYLFERTSDYMQLLFTPSYHDGVIKDLIDGIPESDFDVQLEGQVEIIGWLYQYYNEEPHNAVVNINGGTVKTNDIPAATQLFTTDWVVRYMVDNSLGKYYLERNAHSELGTHLEFLLPDSLEMVSDDLDVTQIKVIDNAMGSGHILVYAFDVLMKMYAEQGYSSREASSLILENNLFGLEIDKRAYQLAYFALMMKAREYNRRALTSNISPKVYVFEDTSNINDNYFESLPVSESNIQDLKYIVSLFHDSRTLGSIIQIDKPVKTGNLRTVLTNIPQDTSLDLNNTREITYQLLRLLDIVETMQNKYEAVITNPPYLNKMNKVLKEYVKTHYKDYSSDLFSVFIWHNINMTVTNGYAAYMTPFVWMFIKSYENLRKSILNTKLISSLIQMEYSAFEEATVPINTFVLKNSSTSENGVYIKLSDFKGGMDVQKVKTLEAIENPDVDYLYRTNQSNFNKIPGSPIAYWASDNLLRDFEIGQQMDTLVEPRVGLQTGDNSVFLRQWFEVSYAKIAVDAKNIPESVSSNKKWFPYNKGGAYRKWYGNYDYVVNWENDGQDIKNFKFPNGKQRSVVRNPNYYFREAITWSLITSGGFSIRYRSAGSIHDVSGMSAFSSSHDKLMNILGLMNTPIGNHVFKMLNPTINLQIGDFNSFPVLDKAIDNPEINEKVTGAVAISKNDWDSFETSWNFKMHPLIRHIDEHNRNWNLKEAFEVWKSETQDRFDQLKDNEEELNRIFIDLYGLQDELTPDVANKDVSVRLADEVRDIKSFLSYFVGLVFGRYSLDVPGLIYAGGDWNSDQYKSFQPNKDNVLILSDDAYFNDSRDIINRLKEFLRVAFGNENVQANLEYIAQIVGKGGGTAEEKIRQYFIKDFYADHVSVYSKRPIYWEYNSGKKEGLRALMYVHRYDADTTGMIRTDYLLPLQEAYENALANFESLVESETVAKIRKVYEKKVTRLTNQIDEMKMFDQVLQHLATARIEIDLDDGVVENHVKIQDGQKLLTKIK

SEQ ID NO: 2840 - protein, 1038 aa, Methanobrevibacter smithii
MKDENKLDELFRFLFIKQSNKLNEILPGLFKTTDDSLELLLNISFTSEEGVVRQLIDTIPEEDFTKQVEIIGWLYQYYISEKKNQVININKSNIKKEDIPAATQLFTTDWVVKYMVDNSLGRYWIERNPNSSLKEHLEYYLGEAQQDEETQSKLDEIRSENISVEELTFFDPCMGSGHILVYAFDLFFEIYKELGYLERDIPELILKNNIFGLDIDDRAYQLAYFAVLMKARKYDRKILQKGIVPNVYAIQESGNITDSIIEFIQKHDEKIVNDVIYLKEIFESGKEFGSLIQVKNIDFNNLRTSLNEIIDNSKSTLTDINITNIISNDLMALINQAELLSKKYSAVVTNPPYMNKFEKNLKDFAKKYYKDYSKDLFSMFIYRNTKFTKSNAYLGFITPFNWMFIKTYEKLREYILKNLEISSLIQLEYNAFTEVAMVPVATYIFCNENKTNGLYNGIYIKLSNFKGNMDTQRNKVLKAISNPVDYKYISNSKKYSNIPTSPIAYWASLNVTNSFKNKKLIEYAYPKAGISTGNNDKFLRKWFEVEFNNINFNCNSMEETKNVKEKWFPYNKGGKFRKWFGNNELIINWKNNGYKIRNFKHSTIRNPKFHFKKSLTWSTLSSSDISFRYNEQGFLFDSKGANCIIKNEIYFNYLFALLNSKVTMEVLSFLSPTLDFGIGSISNIPIILDNSNLNKINKIVSENIIIQKNNWDNHEISWNYTIHPLLIFGERKIEKSIVKFNKLQKVDFNKLKSNEEYLNKYFIKLYKLTNELDYNISKDSISMNLLSKNDLITSFISFAVGCMFGRYSLDKKGLQFAGGKFNITNYNKFIPDDDNIIPVLDTAYFDDDIVGYFTKFVETCFGKKTLEENLDFIAGALSKSKKPSREIIRQYLLKNFFNDHKRTYKKCPIYWQFSSGKHNGFNCLVYMHRYEPSLVARIRTDYLHKTQKAIEQKITNNDNIINNSTSKQEVTRATKEKAKLQKQLKETQEYDEVLAHIANQNIEIDLDDGVKVNYAKFQNIEIKKEGSKTKKINLLKKI

SEQ ID NO: 2841 - protein, 144 aa, Methanobrevibacter smithii
MDKTILKNFAVNSRNKLIEDTIYRLSLLGITEDEIQDPIEADGMQTFQIGGTNFSIYDDDINKRKEIIEDIESKGFNNFVEEVAYTWFNRIIAIRYMEVNNYLPTKTRVLSSETAGKIEPDILTDALDIDLDYTQEEKELIFKL

SEQ ID NO: 2842 - protein, 646 aa, Methanobrevibacter smithii
MTPFVWMFIKNYENLRKFIINNKSISSLIQLEYSAFSEATVPICTFVLSNFDENYAGTYLKLSEFTGGMDVQKEKVLQIINGDEILNDKNKFIMKKENFNSIPGNPISYWVNDSIIDIFKNSKKLGKIVAPKCGLKTGITEKYVRKWFEVDYNNIGFDIPNREMAKKSMLKWFPASNGGQYRKWYGNIEDVVFWYDDGYEIRNLFNPNGKLKSRPQNMQYYFKKGLTWSALTSKKLSLRLSPIGNIITGAGYGLFNNEFSLLTIMGFLNSKIATYFSSIFSETLNFEVGILNRMPILIKENSEINKLVSDNITISKENWDNYEFSFDFIKHPFMNFNSDLLKECYEMYASDFKLKFNELKKNEEQINVFFIQEYDLKNHIKKNVPNEDITLFKPNLTEDIKSFISYAVGCMFGRYSLDNEGLQFAGGEFNIDNYHKFIPDEDNIIPVLDSEYFEDDIVNRFVEFVKICFGEETLEENLDFIANALAKNKKPSREKIREYMLKNFFNDHKKTYKKCPIYWQFSSGKENGFNCLVYMHRYEPSLVARIRTDYLHKTQKAIEQAIANCDNIINHSSSNTEVTKATKEKSKLQKQLKETQEYDEALAHIANQNIKINLDDGVKVNYAKFQNIEVSKEGKKSKKINLLKKL

SEQ ID NO: 2843 - protein, 522 aa, Methanobrevibacter smithii
MESLANVKQGLATADNNRFLRYWWEVDFNNIGFSSINCEDSKNTNKKWFPYNKGGDYRKWWGNQEFVVNWENDGYEIRNIIGPNGRVRSRAQNTQFYFHKSLSWSKISSGKVAFRYYPNGFIFDVAGCSVFLDKKNINYIFGFLNSNICGDILDLISPTLNYEVGHVASLPIIFDESKQNEIENLVITNINIEKEDWDENETSWNFKSHPFVFFKGDSLSEKYNFWQKYKTNQFNYLKTNEEKLNKLFYDIYNVDGDHEIEDKYISLNKNDLKKDIESIISYSVGCMFGRYNLNQGGLCFAGGEFDLNKYHNFIPDDDNIIPVLDTAYFDDDIVGYFTKFIEKCFGKEKLEENLDFIAKVLSNSSKPSREVLRDYFLKNFFNSHKKIYKKHPIYWQFSSGKENGFNCLIYMHRYEPSLVAKIRTDYLHKTQKAIEQRIANTNTIINNSTSKQEVANITKEKVKLQKQLKETQEYDELLAHIANQNIEIDLDNGVKFNYELFQNIEIKKEGKKSKKLNLLKKI

SEQ ID NO: 2844 - protein, 1172 aa, Methanobrevibacter smithii
MDKTAIKTFAINSRKKLMEDVEYKMSLVGIDKDNIYEPISSANGIETYQLGGSTNSIYDNDISKRERLVKEVKQKGFENVVEEVAYTWFNRIIAIRFMEINNFLPTKTRVLSSETAGKIEPDIITEAFDVDLDYTQEDKELIFKLKDENKLDELFRFLFIKQCNKLNEILPGLFEKTDDYLELLLNISFTNEDGVVRQLIDTIPEKDFESQVEVIGWLYQFYNTELKDETFANLKKRIKISKERIPAATQLFTPDWIVKYMVENSVGRLWLEGHPNNELKSKWKYYVDEAKQEPEVEQQLITIRKESEILKPEDITVIDPCMGSGHILVYVFEVLMDIYVSEGFTEKDACESILKNNIYGLDIDKRAYQLAYFAVLMKARKYNRRILTKGISPLLCSIEETNSISKEFIEELISQDRTIEDAFNYLISSFKNGKEFGSILTIKPIDFEKINNLISKFESNNNLTKLKYLDEINLLKNIINQSILLSKKYDVVVTNPPYMGNNGMNPNLKDYIKSKFPLTKTDLFAVFLEKGLEMIKDYGFNCMVTMQSWMFLSSFEKFRKKLIETTTISNLLHMDNMVMKIAFGTSATVFRKINLMNYNSTFYHVKLSDVENDIVNPLFFNDKNKYIIKQFNFDKIPGSPIAYWIDDNLIACFNNTNLSSLGDIKVGLQTGENTRFLRYWWEVDFNNIGFSSINCEDSKNTNKKWFPYNKGGSFRKWWGNQEFIINWENDGEELRNFKKSVLRNSQFYFHQSLSWSKISSGKIAFRYYPNGFLFDVAGCSVFVDDYLNYIFGFLNSNVCGNILDLISPTLNYEIGHIASLPIIIDENKVEEINNIVLENIKICKDDWDDYETSWNFKKHPLLKFNENNLKNSFKSWESYKKEQFNQLKSNETKLNNIFSEIYDIDSNYNVEDKHVSINSSNYEMDIKSFVSYAIGCMFGRYSLDDDCLISTNSNFNIENYSRFIPDDDNIIPILDTEYFEDDMVGRFVEFVKICFGEETLEENLEFIANALIKNNKTSREKIREYLLKHFFNDHKKLYKKCPIYWQFSSGSNNAFNCLIYSHRIDSQIIARIRTEYLHKTQKAIEQRLLDCENLLNTSDSSSEKAIITKEKNKLIKQLEETIGYDEALNHVSNLNLSFNLDDGIKENYSMLQDIIISREGMKNKKINLLKKI

SEQ ID NO: 2845 - protein, 707 aa, Methanobrevibacter smithii
MKNIIQQSKFLVKNYDIVATNPPYMGNSGMNPNLKDYLKKNYPNSKSDLFAVFIEKCHDFCNEKGFVAMITQQSFMFLSTFEKLRVELINNHTIINMAHLGAHAFEEIGGEVVQATTFVNKNNLIENYKSTFHRLTEFNSESKKEEEFHNDENKFILSQSIFNLAPSFEFIFWENHNILNSFKLYPPLSKYGKPSRGLATYNDNKFLRYWYEVSFNKIGFGCSSVDDSIKSKKKWFPYNKGGDYKKWYGNNNFVVNFYNGGEEIKKSGKGAFSNINYYFKKGLTWSRISSSYFGVRYHDVGFIIGDAGPSVLMNDDSNIFYIFGILLSNFTLRIISALNSTMTFQVGDLNKVPINMNNHEKENIEKLVKSCIYISKEEWDEFELSWDFKNHYAIKFSQDSFENTFFKYMDFKNNQYNKLKKNEFILNNLINKIYNITDIQDSVVSIKNEITLTKIHLEEFVKSFISYAVGCMFGRYSLDNEGLQFAGGEFNINNYSKFIPDDDNIIPVLDSEYFEDDIVNRFVEFVKTCFGEETLEENLDFIANALAKNKKPSREKIRDYLLKNFFNDHKKTYKKCPIYWQFSSGKENGFNCLVYMHRYEPSLVARIRTDYLHKTQKAIEQAIANCDNIINHSSSKQEVVKATKDKAKLQKQLKETQEYDEALSHIANRNIEIDLDDGVKVNYAKFQNVQVSKEGKKSKKINLLKKL

SEQ ID NO: 2846 - protein, 1092 aa, Methanoculleus bourgensis
MTVLTREERNALDGAVQEARRKAELGAKNALSALGVREERKPAYLTAEQAELRRRLRAECRRLGSFDDLVRSVAYEQWHRMLFARFLAENRLLIHPEFGVPVTLAECEEIAREEGRDLWEVAAGYAAKMLPGIFRQESPLTQVRYATEDTAALEAILAGIPEETFRAEDALGWTYQFWQTEKKKEVNASGKKVEGYDICAVTQLFTEPYMVQFLLQNTLGAWWLHLHPDSSLREEWVYYKEQVQHDFSAWPESPAELKILDPCCGSGHFLVAAFHMLLAMRRELGEETEDAIRDIVRDNLHGLELDPRCIQIATFSIALEAWKAGFSPTESYLPVPNLACTGIPIRAEKEEWLKLAGGDGLLEGVLEQYYDLFKNADTLGSLIKVENPQTLVDRAALAKKFEQALRREKEAGDPVAETFGETGHGVLKAAGLLAGRYDYVMTNVPYLSSGNQGNLLKSFIEEHHPCGKNDIATVFLERCLSFCRPGGKVSIVLPQNWLFLVSYRRFREYLLKNERWDLLARLGPGAFETISGHVVNAILLNITHTKPPAGHLLCGLDVSEERDAAAKARSLLDAEMACVEQAAQLENPDARIVADDQGTSTLLSEYSNGVHGFGSKDSPRYFRQFWEMFAPNEDWQIMSTTVGRTIDFGGKEQLVYWQNGKGLLAELGRKGLAIPAGGLAWRKKGVQISQMSELPATLYFGEIFDKNTAVVLPHDPSHLPAIWCFCSSPDYNIAVRKIDQKLNVTNATLVKVPFDLDHWQKVAAEKYPHGLPEPYSDDPTQWIFHGHPCGSVIWDEETKMLARGPLRTDGAVLHVAIARLLGYRWPAELDPEMELSKEAREWVAESEKLLSFADQDGIVAIPSIRGEGRLVDRLRELLAAAYGPAWSPNTENELLRGIGYTKKDGNLKGDLEGFLRDEFFASHCKLFGHRPFIWQVWDGTKDGFSVLLNYHNLDRRNLERLTYTYLGAWIAQQRAEVQNEVPGAERRLAAAEDLKERLAKILEGEAPYDIFVRWKPLHEQPIGWDPDPNDGVRLNIRPFVEAGVLRSQPRINWKKDRGKDPVPNASGTQERHNDLHLALDAKRKARAAVKDA

SEQ ID NO: 2847 - protein, 619 aa, Methanolobus psychrophilus
MDKARIIKFSDTVRDKLHQEVRERAAFYGIEPKEILPVDSEHTDSMVIGGKVFNKKIKAQREQLVKEVRRKGYEQVMDEVTYTWFNRFVALKFMEVNDYIPVKVFTSDDSERTEPGIITHALELDLLELDLELVLDLKAENEDEELYKYLILRLCNYLNRTMSFLFEEIADYTELLFPEKLLHIGSIVKDMNGIIAEDDWREVEVIGWIYQDYIAPKKDKVFKDLQKNVKISKENIPAATQLFTPHWIVRYLVENSLGRLWMLNRPGSRLAEKMDYYIRPEQAEKDYLKVSSPEDIRVCDPACGSGHMLVYAFDLLYAIYEEEGYDHSEIPEMILTHNLFGVEIDKRAGELAAFALVMKARRKNRNFFRKPVQPNICVLENVSFEEGELNAYITAVGRELFTNEVRATLLQFNEADNFGSLIRPKAADVSTILKMPKPKVLSENLTLLSTHQKVLQALKQADHLSPKYHVVVANPPYMGGKGMNDRLKSFAQDNYPESKSDFFAMFIDRNLDLAMKKGMVAMITMQSWMFLSSYEKLRASILDDRTIISMAHLGPRAFDSIGGEVVSTTAFVIENTQHPEYKGAYIRLVDGNCEAEKDAWLREAVMQARNVAIHRMEAQ

SEQ ID NO: 2848 - protein, 444 aa, Methanolobus psychrophilus
MKKFKGSVIRNPNYYFKEGMTWSTISSSKLSMRYSSKGFLFETKGSVCFPLDDDSFKYCLGFMNCKVVEELLLAISPTLDFHEGPIGKTPLIISQEDQISNTVSILIKNAKSDWDSYENSWDFTTLPFLQPEYHHPTLRKTYIKLRAQWKEMTLEMQRLEEENNRVFIEAYGLQDELTPDVPLSEITLTCNPHYRYNGNRSEEELEALLLTDTIKEFISYAVGCMFGRYSLDKPGLMLANQGEKIGDYLEQVPEPSFMPDVDNIIPMLEDEYFEDDIVGRFKEFLKLTFGEDKLSDNLDFIAEALGGNGKKSSEVVIRDYFLKSFYKDHLRMYKKRPIYWLFSSGKGRAFNALVYMHRYNKETLAMMRTDYLLELEGKLDAKREMIKSDIGKDAQEKARLGKMIEELMAYDEVLKNKADAYIEINLDDGVVVNYGKFEGLVEKI

SEQ ID NO: 2849 - protein, 798 aa, Methanomethylovorans hollandica
MALKKSELYSSLWSSCDELRGGMDASQYKDYVLVLLFIKYVSDKYAGVPYAPITIPEGASFADMVALKGKPDIGDQINKKIIAPLVSANKLSDMPDFHDATKLGSGKEQVDRLTNLIAIFENPALDFSKNRAEGDDILGDAYEYLMRHFATESGKSKGQFYTPAEVSRIIAQILGIRQADTTSSTTAYDPTCGSGSLLLKVADEARTKITLYGQEKDAATSGLARMNMILHNNPEALIWQGNTLADPKFVEDGILKTFDYVVANPPFSDKRWSTGLDPLHDTYERFKPFGIPPAKQGDYAYLLHIVRSLKSTGKGACILPHGVLFRGNAEADIRRNLIRKGYIKGIIGLPANLFYGTGIPACIIVIDKEEAHNRKGIFMIDASADFMKDGPKNRLRARDIHKIVDVFTKQTDIPKYSRMVSFEEIGKNEFNLNLPRYIDSQQAEDLQDIEGHLHGGIPTADVDALQRYWDVCPELRQTLFKANRPNYLALAVDKAAIKSTIYEHPEFSAFISGMNAHFAVWQEQASAMLRELQADSHPKEVIAKLSEDLLAHYADKPLISQYDVYQHLMDYWETTMQDDCYLIADEGWKAKTYRIIEKDKKGKEKDKGWTCDLVPKSFIVARFFAKEQEIVDKLTAELESVTARSTELEEENSGEEGAFSELDKVNKANVTARLKEIKGDREAQEEAAVLNDWLQLANEEADLKKHLKDAENALDAKAYAHYPQLTEDDIKTLVVDDKWLTALDTAIHGEMDRISQSLTQRVKELAERYETPMPLMTERVAQLEAKVNGHLERMGFRL

SEQ ID NO: 2850 - protein, 581 aa, Methanomethylovorans hollandica
MTIANTLSTNPVPNFYRASAADFKKIPGSPIAYWVSDKMRNTFLAGASLGSIAKPKLGMRTGNNERFVRYWFEVWHNKIGFSFKNSQEAKDSGLKWFPYNKGGDFRRWYGNNENVVNWENDGYDIKVETLKNYPQLSWDNLGWKISNEKDFFKPCLEWSRISSTYFAVRYSPGGFLFDTNGSSAFPKQEHLKFLIAFLCTKISSNFAKVINPTLAFQPGDLSVLPILGIDIIADSIDTICHNIIEISKSDWDSYETSWDFTTLPLLQPEYHQPTLRETYTKIRAHWKEMTLEMQRLEEENNRIFIEAYGLQDELTPDVPLSEITLTCNPHYRYNGGKSEEELEALLLTDTIKEFVSYSVGCMFGRYSLDKPGLVLANQGEKIGDYLNQVPEPSFMPDADNIIPILEDEYFEDDIVDRFKEFLKVALGKEQLSENLDFIAEALGGNGKKSSEAVIREYFLKSFYKDHLKMYKKRPIYWLFTSGKGRAFNALVYMHRYNREMLAKMRTDYLLELEGKLDAKKEMIKSDMGKDAQEKVRLKKMIAELMAYDEVLKNKADAYIEMDLDDGVVVNYAKFEGLVEKI

SEQ ID NO: 2851 - protein, 617 aa, Methanomethylovorans hollandica
MDKASIIKFSDTVRDKLLQEVADRAAFYGIHPKEILPVDSEHEDSIVIGGKVHNKKLKDQREKLVREIKHKGYQQVMDEVTYTWFNRFVALKFMEVNDYLPVQVFTSKDADRNEPGIITHAHELDFLDLDADHVLDLRSENKDEELYKYLILKLCNYLHSTMPFMFEKIEDYTELLFPEKLLHVDSIVKDINGIIPVDDWREVEIIGWIYQDYIAPKKDKVFKDLKKNVKISKENIPAATQLFTPHWIVRYLVENSLGRLWMLNRPSSRLCEQMDYYIRPEENETDFLRINSPEDIRVCDPACGSGHMLVYAFDLLYAIYEEEGYDHSEISENILTRNLFGIEIDKRAGDLAAFALTMKARGKNRNFFRKPAVPNICVLESIAFEDDELNAYITAIGSELFTNDVRDTLLQFNEADNFGSLIRPKAEDVSGILQLPKPKILSENLTLLSTHQKVLQALKQADYLIPKYDVVVANPPYMGGKGMNARLKDFAQDNYPDSKSDFFAMFIDRNLDLAMQKGMVAMITMQSWMFLSSYEKLRAGILDDHTILSMAHLGPRAFDSIGGEVVSTTAFVIENAQHPEYKGAYIRLVDGNSEAEKDTWLREAIMQVRNITQQTEA

SEQ ID NO: 2852 - protein, 1161 aa, Methanosarcina acetivorans
MDKSAIIEFSNKVRNKLNEEVKSQAAYYGIFPKEIHSVEEHPDSVVINGSVFNSKIKNQRSQLVKQIKEKGYEQVMEEVTYTWFNRLVALKFMEMNGCLQDQIKVFTSTDPNKPEPDLLTNALKLDFLNLNRDLVLDLKAENKDEELYKYLILKLCNYLNKIMPFLFEKIEDYTELLFPDKLLHTGSVLHDLNSIIPDEDWQEVEIIGWIYQDYIAPKKDKVFADLKKNIKISKENIPAVTQLFTPHWIVRYLVENSLGRLWMLNRPESSIVDLMEYYVKPEQQETDFLKINSPEELKICDPACGSGHMLVYAFDLLYAIYEEEGYTPSEIPEIILTHNLFGIEIDKRAGELAGFALTMKARGKDRHFFKKQVQPNICMLENITFEQSELDAYIDAVGSELFTNAHRATLLQFAEADNFGSLIRPAAMEVSGLLSLLESKNLSGNLSHLSTHQKVLQALKQADYLSPKYHVVIANPPYMGNKGMNNRLKTFLQNNYADVKSDLFSAFIVRNTELAFPKGQLGFMSPFVWMFISSYEKLRDFLINEKTITSLIQLEYSGFDGATVPICTFTSENAYHPEFKGGYVRLSDFRGAENQSPKTLEAIKNPKCGWFYRASATDFKKIPGNPIAYWVSNKVRDLFGNITLGDFFDTEGQNKTTDNDKYLKYHWELREKTIGVDKKWVLCAKGGSFRKWQGNIEYVIDWSPEARAFYRKDHSARIVEEEFWYREGITWTGITSSLSGFRYLEYGCTYETAGPTIFVKNANKYVILGYLNTPIVAKFINIMNPTLNTKIKDVQALPIIQSILFDNQVESVSLRLVNLSKSDWDSYETSWDFTTLPFLQSEFRQPTLSETYTKLRTHWKEMTLEMQRLEEENNRIFIEAYGLQDEITPEVPLSEITLTCNPYYRYGNNKTEEELETLLMTDTVKELVSYAVGCMFGRYSPEKEGLILANQGEKLGDFKEKVPRATFLPDEDNIIPILDDEYYTDDIVGRFKEFLKHTFGAETLSENLNFIAGAISKKNESPGKVIRDYFLKDFYKDHVKMYKKRPIYWLFTSSEKGKAFNALVYMHRYDKTTLAKMRIDYLLDFESKLDAQRSLLKKEITENSKNSGKAESELAKLNKKINELVKYDELLKNKADQMIEIDLDDGVKVNYEKFKGLVGKI

SEQ ID NO: 2853 - protein, 1165 aa, Methanosarcina mazei
MDKSAIIEFSNKVRDKLNAEVRSQAAYYGILPEEIHAVEEHADSVIINGKVFNSKIKNQRSQLVKQIKEKGYEQVMEEVTYAWFNRLVALKFMEMNGCLPDQIKVFTSTDPNKPEPDILTNALKLDFLNLNRDLVLDLKAENKDEELYKYLILKLCNYLNKIMPFLFEKIEDYTELLFPDKLLHTGSVLHGLNSIIPDEDWKEVEIIGWIYQDYIAPKKDKVFADLKKNIKISKENIPAVTQLFTPHWIVRYLVENSLGRLWMLNRPESSLVDRMEYYIKPEKQETDFLKINSPEEIKICDPACGSGHMLVYAFDLLYAIYEEEGYTPSEIPEMILTHNLFGIEIDKRAGELAGFALAMKARGKDRRFFNKQVHPNICMLENVAFEQGELNDYIETVGRELFTNAHRATLLQFAEADNFGSLIRPVAKDISDLLHLLESKNLSGNLSLLSTHQKVLKALKQADYLSPKYHVVVANPPYMGGKGMNNRLKTFAQDNYPDSKSDTFAMFIERNLDLAVKKGMVAMITMQSWMFLSSFEKLRENILSNDTILSMAHFGARAFDSIGGEVVSTTAFVLENAQHPDYKGSYLRLVDGNCEADKEAELKAKKSEPFCASAAAFQKIPGSPIAYWVSENVINVFTGNKCIEDFAELRQGIATGDNDRFLRFWNEINFSKIGFECEDRESFWFNEFDYAPYNKGGGYRKWYGNNEYVIRFSRVNYEILKQMGNHCPSEQFYFKAGATWSALSSSPLSLRLFPTGFIFSDKGQALFTNKYEHLIKIISFLNSNVCGNLLKCISPTLDYHSGYLRTLPLCIKDIPINDSLISLSKFDWDSYETSWDFTTLPILQPEYHHPTLAETYTKLRAHWQEITLETQRLEEENNRIFIEAYGLQDEMTPDLPLSEITLTCNPYYRYGNDKTEEELEALLLTDTVKEFISYAVGCMFGRYSPEKEGLILASQGEKLADFKEKVPGATFLPDEDNIIPILDDEYYMDDIVGRFKEFLKLTFGADTLSENLDFIAGALSKKNEAPEKVIRNYFLRDFYSDHVKMYKKRPIYWLFTSSEKGKAFNALVYMHRYDKTTLAKMRIDYLLDFESKLDAQRSLLEKEITGNSKNSGKAESEFAKLNKKINELVKYDELLKNKADQMIEIDLDDGVVENYKKFEGLVGKI

SEQ ID NO: 2854 - protein, 1107 aa, Methanospirillum hungatei
MTTLSKSDRNALDKAVQKARDISEEGARKALISLGVSDEKKPEHLSDEQAELRRRVRVVLRRLGTEEEFIRSVAYEQWHRMLFARFLIENDLLIHPEHQVSVSFEDLVELAHDEQVDPWELAARYASDMLPGIFKQDDPLLKITYAPEDRNALRDILAQIPGDTFRTSDALGWTYQFWQTKKKDEVNKSGVKIGAAELPSQTQLFTEPYMVHFLLDNSLGAWWAGKRLKEEDLKTATSEEELRQKASLPGVPLTYLRFVQDENGVWTPASGTFSEWPDQLSELKMLDPCCGSGHFLVATLLMLVPMRMEMEGLSAGKAVDAVLSENLHGLEIDERCVEIAAFALALAAWTYPDAGGYHLLPDMPVACSGLAITSKKEEWVALAGDNQDLAFALDLLYDEFAQAPVLGSLIDPMRRFGEGKIIPITWDQIAPMLDKVLATKRDEEREGIGVVAHGLARAAGMLAGRYHLIATNVPYLVRLKQHEGIKDFCANYYPLSKNDLATVFLEKGLEFCKKGGTTTIVIPQNWLFLSTYSKLRINLLNNSVWNMIARLGPKGFHTPMWDFNIQLLIISKFHKKNHYIEGLDVSKLNNPMEKEQKLITGKITKISQRSQIDNPDARISFDNIQGILLEKFGFAYMGQRTGDGLRFIQNFWEQNEKGKEWVYFGSTVEKTSLYSGNSQILLWENGEGQLAEYQRILAEKQYASGGWKQGWQAWDKIGVRISQMNNLPVTIHCGPHYDNNTATFIPYNPDHLTAIWCFCSSSEYHDAVRKIDQKLNVTNATLVKVPFDLEYWTKVAAEKYPNGLPKPYSSDPTQWIFHGHPANSDDPIQVAVAKLLKYQWPAELDPEMELSDEQREWVEKAKELQPYVDDDGILCLPPVKGETKLVEYVRAMLAAAFPDWSIQKEQELLIKSGYTTKEGAVKGDLELYLRDEFFTAHCKLFHQRPFIWQIWDGRKDGFSVLVNYHLLDRKALEKLIYSYLGAWIAQQREEVAAEKTGAELRLKAAEDLKKKLILILNGESPYDIYVRWKPLHEQPIGWEPDLNDGVRMNIRPFVTAGVLRSQPKINWNKDRGKDPVPNCSGTTDRLNDLHFTLAEKLKAREEAGEHG

SEQ ID NO: 2855 - protein, 612 aa, Methanospirillum hungatei
MDKAKIQLFSDSLRKNLLEETKKRAAHYGITGKAIATVEQEFEDSIIIGGEVYPRSIRDQRAYLVKEIEKKGYDRVMEEVTYTWFNRFVAIRFMEVNDYLPVRVFSSTSSGKTDPDILTKALDLTFLDIDREHVLDLKSDGRHEELFRYLFLRLCNYLHTTMPFLFEPIQDYSELLFPDRLLHTDSMLRDLNTIIPEDDWRETEIIGWIYQDYIAEKKDVLIKAKKQYTADQIPAVTQLFTPKWIVQYMVENSLGRLWMLNRPHSRLYERMEYYIRPDEQETDFLKISSPEELKVCDPACGSGHILVYAFDLLYEIYKEEGYLEQEIPEFILTHNLYGIEIDKRAGSLAAFALVMKARRMDKKFFDHPVQPHICVLENIELDEEDIDSYISAVGSNLFPTGLKETLMQFTEAENFGSLIRPMVGDVTDIRKILAEKNMSSNLLLFDTHQKVLKVLEQTEYLQPRYHVVIANPPYMGNKGMNNQLRDYAKKFYPNSKSDLFAMFIERGFDLLVHQGYSAMVTMQSWMFLSSYEKMRQNILDNATIICMSHMANGVMGIAFGTAATVWCNAYIKDYKGYFCYVEYENIGSDGKPISFPPYNERNKGAGLSITGA

SEQ ID NO: 2856 - protein, 632 aa, Microlunatus phosphovorus
MNTAPLKSFATWARRELITQVSARLTAVLAPASPERVENQRAVSALERDIASAGGGAKGKDAITDRVAYTWFNRIIALRFMDANGYTGIGVVSPAHGQQTGQPEILADAKRGSIDPAVVSNKRTLETITGLLDGTRPSADAQGEAYTLLLAEYCRYWHRPMPFMFEREGDYTELLIPANLLAADSILTKAAAALTEEICYDGGDGAGGVEVIGWLYQFYISERKDEVFAGFKKGKKAGAVEIPAATQLFTPHWIVRYLVENSLGRLWMLNYPSSRLIEQMDYYIAPVDEETDFLKISSPEELKIIDPACGSGHMLTYAFDLLYAIYEEEGYAPSEIPGLILTHNLYGTEIDPRAGALAAFALTMKARAKQRRFFSKRVVPSICVLDPITFSPDELDYLVTKNGDRHAEKAFWNQFAEADTFGSLIQADPDLTVRLARHLATLDDEGDMLRADALKWAQRVIDQAEYLTRAYTVVVANPPYMGSKQMNARLSQFMKDEYPDTKTDLFSGFIERCTAFAGPRGAVAMITMQSWMFLSSYEKLRASLLTNQRITSMLHLGARAFDSIGGEVVSSTAFVLNSRPGGSRGTITAQKGVFVRLVEGSSEAEKIAALRTALVGRDKGSGYHLASGEVRL

SEQ ID NO: 2857 - protein, 264 aa, Microlunatus phosphovorus
MKDEYPTGKADLMTAFMVRAQELTVRRGTWAMINLPSWMSLKSFEDLRHDLLGSQRIASMAHLGRGIFGSDFGTVAFVIDNARATKSAPSVYRRLFEQHVDVRPVSAIEALFRDSAYNRYEVSQADFARRQMIARPLVAANKRGAERSDLLGLRGALDQADEDSLLGSDRASTPAWSAVQNERSRGDDLAPNRVESASTKVQHRGDPLIGEEGGPELLVRAKKHPRLHRDHRHRPSRTCEGGAAFDEAGEQVGLGVRVLVLHEL

SEQ ID NO: 2858 - protein, 324 aa, Microlunatus phosphovorus
MKTLEQVVAQHRAEWAARSRTQQQLEIENNEAVARLYGLEDEVSSHVPLERVSLTNNSAFRWPNKTPEERDVLFTESAIVDLVSYAVGCMFGRYSLDEPGLILADQGATVQDYLAKVPTPTFKPDPDNVLPIVDGDWFEDDIVARFRQFLRTAFGEQHFEENLRFVEESLGAGSLREYFITRAGRSKFYDDHVKRYKKRPIYWLFSSPKGSFNALIYMHRYTSSTVSTVLNEYLREFESKLEANLQHQERLAAGNGTPREKAAALKDAERLRKVLLELGEYEHDVLYPLASQQIAIDLDDGVKANYPKFYPALKKITGLEAADE

SEQ ID NO: 2859 - protein, 389 aa, Moorella thermoacetica
MRDLPATLYTGELFSNTAPVIIPRKYEYLPGICAFCMSGEFTKALRAINPNVAVENGYVSKIHWDPGKWLYSDTTIPLPKAYADAPTQWIFKGTITSSIAPLHVAIARLLGYQWPEHELDELDELSNSDGIVCIPAVRGEDPAAERLRALLAAAYGNDWSPTKEQELIAATGSEAKDLDEWLRNDFFEQHCKLFHHRPFIWHIWDGRRRDGFHALVNYHKLAEGNGKGRQVLESLTYSYLGEWITRQKDGVKRGEGGAEDRLAAALELQKRLIAILEGEPPFDIFVRWKPIEKQPIGWEPDINDGVRINIRPFMASDIPGGRKGAGILRWKPNISWGKDRGKEPVRPQEQFPWLWKNGKFTGDRVNDVHLTSEEKRKARETMNRKTRSK

SEQ ID NO: 2860 - protein, 731 aa, Moorella thermoacetica
MPMPVLSVEQRNKLERTVVEARDVAEAGAKAALEALAVHHHEPYSHMTPEQRRLRNHLRARARQLGDRQDQRGKMEITHLIQEWAYEHWHRMLFARFLAENDLLIEPEMGVAVSLEECGELAQEEGTDLWTLASRFAQQMLPQIFRPDDPVLQVTFAREYQLKLEQLLNDLEPGIFKASDALGWAYQFWQSKRKKQVNESGNKIGADELPAVTQLFTEPYMVNFLIHNTIGAWYAGKVLAENPQLAGQAESEEELRRAVALPGVTWDYLRFARSGDGEGPWRPAAGTFEGWPQRAAELKILDPCCGSGHFLVATFYHLVPIRMAEEGLTAREACDAVLSDNLHGLEIDERCTQIAAFALALAAWTYPGAGGYRPLPGLRIACSGIAPNTKKENWLALAGDDERLRNGMARLYDLFREAPILGSLIDPGSALENNLIEAGFDELRPLLEKVMSAEKDDYEQHELGVAACGIADAVQILSGRYHLVITNVPYLARGKQGAGLKNYLDTHHARSKQDLATAFIERNLMLCLEGGSTALVTPQQWLFQTGYSKIRKKLLRDLRWELLAILGEHAFRSSEAAGAFPAIYVCSKLLPKDNHLFFSINVSERSSACDKDLYLQHASLNKMQQISQLKNPEHIIITNTFSGFRVFGDYADCYQGISTGDNPRFCIKFWELPSILPGWERFQTPPEETQYYGGREHLIRWEERASIQELGAIRGKNAWGKWGIVIGVDCQ

SEQ ID NO: 2861 - protein, 1164 aa, Parvularcula bermudensis
METNALKKFAPAARTLLIDQVTAKLDLVLDPASAARREAPKAVQELEAAIKRTSKRQIIEQVAYTWFNRFTALRFMDVNGYNQVRVVSPAEGQTRPELLSEAMAGNLPDGAPATIQTLLDGRTPSNDPQGEAYRLLLVHACNGWHKHMPFLFEKIDDYTELLMPEDLLSQSSILAELRKVMTEDACRDVEIIGWLYQFYISEKKDQVFAGLKKNQKITAENIPAATQLFTPHWIVRYLVENSLGRLWLLNNPHSGLAAKMDYYIAPEEPETDFLKITKPEEIRICDPAAGSGHMLTYAFDLLYAIYEEQGYDATEIPALILRHNLTGVEIDDRAGALAAFALAMKAAGKLGRRRFLRMEAKPDICVLQDVAFTEAEMQDVAAVVGKDLFTDELRETLLQFEQAKNFGSLIVPKLRDPAETLRVVEAWDFGGDLLLKEVQERVIAVLRMAEALSPKYHVVVANPPYMGGKGMNDVLSEMLKAEYSNSKYDLFAAFIERCQALNMGKAFSALVTMESWMFISRYEKFRTSFFDRSAIQSMVHMPYLGKGGTSMGINFGTTAFVAEKSRKENYPGNYQCIRYYECDERGVPNSFPMENERTSATTTADFESLPGTPVVYWCSGQVKALFTETPAVSEFSETREGLTTGSNDLFLREWHEVSFGKAGIGITSTEEASATDYRWFPYVKGGEYRRWSGNFEHFVNWYDDGQELRKFADPKTGRIRSHNYNGDYGFRGGFTWSGMSSGSFSVRHVPEGFMFDAKGPMGFPTGTSTTADLTAFLNSRVADHLLKMLAPTMDFKLGHVLNLPLVSDFGPSVSQTADQLADWVKSDWDAYETSWDFTTLPLLSPEHRGESLADSYATLRTHWQSMTDEMQALEEENNRIFIDAYGLQDELTPEVPIEEITLTCNPAYRYGVKGTEEDREIRLRADTMAEFLSYAVGCMFGRYSLDAPGLILANQGERLEDYLARIPDPSFMPDEDNVIPVLDGDWFSDDITERFRLFLRVTFGEAHFRENLRYIEEALGKDIRKYFTKDFYADHVKRYKKRPIYWMFSSPKGTFNALIYMHRYRADTVSILLNDYLRAFIIKLEGERKRLEQLSDDPDATQGERTKAQKDAAKVAAQITELSDWERDVIFPLAQQKIEIDLDDGVKANYPKFGSALKKVTGLS

SEQ ID NO: 2862 - protein, 569 aa, Pectobacterium carotovorum
MNNAEQQFLNELDNKFWKAADKLRANMDAANYKHVVLGLIFLKYVSDAFEARQQDLITLFRDVGNPDNIYAMSRDGYDSDEEYAQAIVDELEVEDYYAEKNIFWVPKAARWETLKNKAMLPTGTVLWVDETTGQDVKLRSVSWLVDNALDEIEKTNPKLKGILNRISQYQLGNEVLTGLINTFSDANFSNPEYNGEKLNLKSKDILGHVYEYFLGQFALAEGKQGGQYYTPKSIVTLIVEMLQPYNGRVYDPAMGSGGFFVSSDRFIEEHAGEKQYNAAEQKQKISVYGQESNPTTWKLAAMNMAIRGIDFNFGSKNADTLLDDQHPDLRADFVMANPPFNMKEWWSAKLENDVRWKYGTPPQGNANFAWMQHMVHHLAPKGSMALLLANGSMSSNTNNEGEIRRNLIEADLVECMVALPGQLFTNTQIPACIWFLTKDKTGGNGKAHRKGEVLFIDARKIGFMKDRVLRDFSREDIAKIADTFHAWQMDKEYEDEAGFCFSATLEDIQKNDFVLTPGRYVGAAEQEEDDEPFAEKMARLTAQLKDQLEDSAKLEEQIKANLGGLGYEF

SEQ ID NO: 2863 - protein, 1214 aa, Pectobacterium carotovorum
MNTNNIKKYAPQARNQFRDAVIQKLTTLGISVDKKGTLQIADAEIVGETVRYGQFDYPKSTLTRRDRLVKRAREQGFDVLVEHCAYTWFNRLCAIRYMEIHGYLDHGFHMLSHPDNPTGFEVLDHVPEVAEALLPEKKAQLVEMKLSGNQDEAIYRELLLAQCHALHRAMPFLFEVVDDEAELLLPDNLTRTDSILRGLVDGIPEEDWQEVEVIGWLYQFYISEKKDAVIGKVVKSEDIPAATQLFTPNWIVQYLVQNSVGRQWLQTYPDSPLKGKMDYYIEPAEQTPEVQAQLAVITPASIEPESIKVLDPACGSGHILIEAYNVLKNIYEERGYRARDIPQLILENNIFGLDIDDRASQLSGFALLMMARQDDRRIFTRDVRLNIVSLQESLHLDIAKLWQQLNFHQQNQTGSMGDMFAENTALAHTDSAEYQLLMRTLKRFVNAKTLGSLIQVPQEEEAVLKEFLDVLYRLEQEGDFQQKAAAKAFIPYIQQSWILAQRYDAVVANPPYMNGKGMNGELKEFTKNHFPDSKSDLFAVFMQYAFSLLKENGFNAQINMQSWMFLSSYEALRGWLLDNKTLITMAHLGARAFGQISGEVVQTTAWVIQNHHTKFYKQVFFRLIDGNEEQKRNALNAQKNRFETKQNDFDILPFKQIGYDLPQQVITCFSSSKTLASVASAKAGLTTGDNNIFQRLWFEIDIKKISVLDSEKKKWFPCNSGGEFRKWYGNNLVVVNWEHDGYEIKNFFDDNGRRKSSPRSTDKYFHEGVTWSKIGSGKFSARYFPHGYIFDDTGQSIFPNKIDIFSLTGILSSVVGGYFLSKISQTLSFNKGEVESIPFIKPLHDISEYAKEAIQISREDWDSRELSWDFKKPYVLTYSSERIKNSYEKLLEQNDISISKIKEIEEKINSILIQTYKLENVISSESLLEDISLFKNPNYLYGPSHYSHEIKKRYRSEAIFELTAYIVGCMMGRYSLDREGLVYAHEGNKGFAELVAEGAYKTFPADNDGILPLMDDEWFDDDVTSRIKEFVRTVWGEEHLQENLEFIAESLCLYAISPKKGESALDTIRRYLSTRFWKDHLKMYKKRPIYWLFSSGKEKAFECLVYLHRYNDATLARMRTEYVVPLLARYQANIDRLNEQVDGASGGEATRLKRDRDNLSKKFNELRSFDDRLRHYADMRISIDLDDGVKVNYGKFGDLLADVKAITGNAPEVM

SEQ ID NO: 2864 - protein, 1160 aa, Pelobacter propionicus
MNKAKLKSYAPAARRDFIQAVTDRAHFFGLSESNIIPVEESGDVAIIGGRPFPLKVAAQRKKLEERVKREGFNQVMETVAYTWFNRFLALRFMELHGYLEHGFRVLSNSGNSTVPEILDYASELDLTGLDKQKVVELKLDGSKDAELYRLLLVAQCNALHTTMPFLFEKIEDETELLLPDNLLHSDSLIRKLVTEIEEEDWQEVEIIGWLYQFYISEKKDQVIGKVVKSEDIPAATQLFTPNWIVKYMAQNSLGRKWLATYPNSPLKAKMEYYIEPAEQTDDVKAQLAAITPDSLDPETLTLLDPACGSGHILVEAYDVFKEIYLERGYSNRDFPRLILEKNLYGLDIDDRAAQMAGFALLMKARKDDRRILRSDNPVKLNVMAIQESGDIAIDNSVFGEHANALRDVVDLFKNGKAFGSLIQIPEALAAKLQTLEEALMQTMTTGDLYAVHAANMLLPLVEQAKISAGRYDCVVANPPYMGSKFFCPVLKNFIEVQYKPAKGDLYTCFMMRNTLFTHKGGLIGMITIPNWMFLSTFKDLRKWLLDETTIETFIHNGRGVFGSDFGSCAFTFSHTTMPNYYGSYKRLFEKQGSVASNEELNERFASSQIKTSSTANFRIIPGSPIAYWLSNSMLSTFLNKKVLGEIAVGKHGMSTGNNNRFVRLWHEVSNKQIGFSFADKVSASDSNVRWFPYNKGGAYRKWYGNQEYVVNYWHDGYDMVTGAKDGSNSGFRHDGRDSYFKPCVSWSFISASYFGVRFYPKGFIFDVAGSAVFPSEKDLFSVTGFLCSKVAPNLMAALNPTINFQVGNVISLPYISVDADKIVSNIISIANTDWDFFETSWDFQSLPLLTNHLKSATLETSWKNWQTHSSSQIILMQELEKENNRLFIGAFGLQDELSPEVPEDQITLSRADREADMKRLISYAIGCMMGRYSLDNHGLIYANSGNIGFDPIKYPIFPADDDGIVPVIDIDWFPDDAACRFEEFLKVTWAPETLEENLKFVADSLSPKGSETPRETIRRYISTQFFKDHLQTYKKRPIYWLFSSGKQRAFECLVYLHRYNEATLSRMRNEYVTVLQGKFSAQFDYLTNEVNAATSTAERNRLQKQLDTLRKKQVELAAFDDLLRHYADQRISLDLDDGVKVNYGKFGALLAEVKVVTGSE

SEQ ID NO: 2865 - protein, 1241 aa, Pelodictyon phaeoclathratiforme
MKLSDHVKSIRELISSAFANQFARLGITAERQSEPATLDQPQQELRATLDAILESHNKETGTPAAAYQKALDDYTFTLFNRLAALKVMEAHRMFPEVLTKRAENGGHSFGHRAWLEQNPFMSSEELEGLLFYIRFAFDTLSDKIRLYSRESTYDMLPYVLDLNAIIGAFNAVEEDSDVGSEIWLSDDIMGWLYESYNLSKKQAFKESGDKIEFDKVALSSQVYTPRWVVEFLVNNSLGKLYLEMYPDSEIGRKYKIANIPATRVREPKPLTEIRLIDPATGSANFLLYAFDLFYDLYLDQIENYGAEYDEEEIGKLIIEHNLYGVDLDDRAIQIAQLGLYIKALRRNSRIHIERFNVVSSDFYLPDFDVVASSFSGSLATDSQQMSLIKAIWADLQRAYQFGSLIRIEERFNANFASLFEKAKADQQDLFATAEFESQEKFKAELFRDLHNAVSAYSQSSGNSFLRSKSNDAITFLEIMTRKYDVAVANPPYTDSSDFGKELKAFIEGNYKKPYGFHSNLYATFIKRCAEIITDTGKIAMIHPLTFMYIKTFEGVREYILNNLHINIFVDYGLSNLFGSIMVDPAFYVLEKGITTNDKSLFISLDQYTRTPQEKFKKDYALTALENFVSGKTDKHNILINQDKLKIIKSWPFIYWISDAFREKFGSNALQDSFYVAQGLVTSNNERFLRYTWEVFNDYAEENILANQKWFFYPKGGIYCKWLGNNWLLVNWEDNGYEIKNFCDDQGKQKSRPQNESLYFKAGITYGSSGSKGICFRYMQTGQIFSGGGPGIIPKAFNNIPYVIAFLNSKLSAYLLGSLNPTVNTTQGDLNRVPFCLPTKKLEDSITYFSNTAIDVKKRLYSFSLVESNYEANPFLIGISNIDLREKIKSFFTYENHLLTQVLLNEAIINEKIFEVYELTPEDKAMVLAKEGESIGGLPVFPEARAAYLTETEVTAEFPLDKIFTFIESLPTMTMSGQEIADLTAKFETLYQSNNDLEEFCIRNKINPINVWYLFKKSGVLPQQRAKTIAMEFLADLIREILNEDDDGIVPLVRNTGEEILIDRIEKKFEEKGLTSAQFAAFPTVLGKEINDYINNKNFFSDLSDHLNLFMYLPKTPFIWHITSGPRQGFDAFIIIYKWSRDKLFTLKSVYIEKRETALRNRQSDLLGEKSAQAEEEKDTIFHQLKEIESLRKKIDELLSEGYDPKLDDGVGKNIAPLQKRGIIAYEVLNPGQLKKYLNAEW

SEQ ID NO: 2866 - protein, 1208 aa, Photorhabdus asymbiotica
MNTSNIKKYAPLARIQFCHAITQKLTSLGISVDKNSDLQIADVTEIGDWVRFGRYEYPKTVLARRNRLVERAHVQGYTQLIEHVAYTWFNRLCAIRYMELHGYLDHGFRVLSHPTDPIGFEVLAHVPEVVGNLALSNPQQLVEMKLAGDQDEALYRELLLGQCHFLHKAMPFLFDSLNDETELLLPDNLTRTDSILRGLVDSIPEEDWKQVEIIGWLYQFYISERKEQVIGKVVKSEDIPAATQLFTPNWIVQYLVQNSVGRQWLQTYPDSPLKECMPYYIEPAEQIAEVQVQLATITPDSIEPESIKVLDPACGSGHILIEAYNVLKRIYEERGYRRREIPRLILENNIFGLDIDDRAVQLSGFVLLMMARQDDRRIFTRNIRLNVLSLQESSQLDISALWQGINLHQQSCTGSTFDMFAQNEISTNSQSADEYQLLERTLALFTQAKTFGSLIQVPQQDEEALEVLLRQLIELEASGDTHQKEAARILIPFIHQAWLLAQRYDVVVANPPYMGTKGMNGDLREFARKQFPDSKSDLFAMFMQHAFSLLKMNGFNAQVNMQSWMFLSSYEALREWLLDTKIFVTMAHLGSRAFGQISGEVVQTTAWIMSKYHVDGYLPVFFRLIEGGEEEKKSLLIEKKNRFDKVKQDSFRQIPGVPIAYWISTGLMNLFKSNLPMEHYADISTGLSTGNNDRFLKMWTEINHLNRDWVPCQKGGSYRKWYGNNEFVIDWGNNGERLKKFKGSTLRNVHNYFREGISWTRVSSASTAFRYFEDSFIFESTGPSLFPKESDKKTLYFFAGLLNSKLATVLLEFIAPTLDFLSGHIAKLPCLQGNWIDVISENSSKLIKIAKEDWDNYEISWDFKRNPMVENNERRLLSSYKKMRADFSNNIEIMKDLEFENNSVIVKNSSLEQDVCIDIVLNEITLTCNPHYRYGNESTEQELENRLQSDTLAELISYIIGCMMGRYSLDQAGLVYAHASNQGFAELVAQGAYKTFPADNDGILPLMTSDWFDGDITVRVREFVRKVWGEDHLQENLDFIAKSLCLYAIKEKRGESSLETIRRYLSSQFWKDHLKTYKKRPIYWLFSSGKEKAFESLVYLHRYNDSTLARMRTEYVVPLLARYQRHIDLLQDQRDGASSAAETNLLKKRQEGFTRKFNELRSFDDRLRHYADMRITLDLDDGVKVNYGKFGDLLVDVQVITGNPPEVA

SEQ ID NO: 2867 - protein, 1180 aa, Polaromonas sp.
MNKTKLKSYAPQARKDFIAAVTARANLLGLSEKGGKLEIAPSQTQGDVTVIAGQAWPVKVHAQRDQLIERIQKDGFAQTMEAIAYTWFNRFAALRYMELHDYLGHGHRALSSSAGGLPDILTHATDLANSDAANALRGLNAAKVTELQLAGNRDGELYRMLLVAQCNALSRAMPFLFERIDDDSELLLPDNLLRSDSVIAKLVEEIPEEDWAEVEIIGWLYQFYISEKKDQVIGKVVKSEDIPAATQLFTPNWIVQYLVQNSVGRLWLMANPQSTLAQAWPYYITPAEQTPQVQAQLDALIQTRVREDDDTLNPETITVLDPACGSGHILVVAYDVLKAIYLERGYQPRAIPRLILEKNLYGLDIDDRAAQMAGFALLMKARADDRRLFTATDDAGNLQPPKLNVLSLQESKGLSVDELATHLAPFKVQRATITALVETFEHAKTFGSLIQIPYALKKHLAVLPEVLALVKQSGDMYANAASDDLLPLVQQAQVLARQFDAVVANPPYMGGRGLPRSVTDFMSAEFPSSKLDLYSVFMERGFQLCKATGINSMVTMQGWMFLSSFATFREKLLDERSITSLIQIGYNSFPEMNSKVAQACAFSFLASKVDGLLGRYVDLNSAPQSSDKSEILLNRDSEIVYDVFPDDFRKMPGSPLSYTIAPGLLKAFSFTKLGELTKGEGKNVTADNERFLRLVWEVSAETVGKGRKWIIYAKGGDYRRWAGNLDYVCNWSEAARKHYRFNNSSRIISEEFWYLPGLTWTVIATSGVGFRYLPCDTTFDTKGLALFFERDENIVSMLALLNSTVGQKLISLVNQTMSINTIDIKSIPVCPSFPEISSEATELINSALEDWNSEERSFDFSMPQLLRHGEQEKSLSSAFAAHFKAIASSISRTRQLEETINSTLIEAYGLRGELSPEVPESQITLARADREKDCQRLISYAIGCMMGRYSLGAPGLIYAHAGNIGFDASRYGTFPADADGIVPLTDELWFEDDAASRIREFLLAVWGPDTLEENMAWLAESLGSKASETTDETIRRYLADKFYKDHLQTYKKRPIYWLFSSGKQGAFQALVYLHRYHEGTLARLRAEHVVPLTGKIQSRIDMLQKDATTASSTAARNKLAKEVDKLKKKHVELLAYDEQLRHHADMRITLDLDDGVKVNYGKFGNLLAEVKAVTGGAGDD

SEQ ID NO: 2868 - protein, 1268 aa, Pseudomonas brassicacearum
MAFDQSTRGRLQKLVNTCRSLLSEEFSIQLQQAYGLDPKTGDVTPMARLIHLDDRQRHTAQVLRQTLAHYLGADADDTDHRIAVLDRVVREQAFTVLNRLAALLMMEARGQLIESVSKGYQSRGYQLYSKIAGNALGETGQAYQVYLFSVFDELTQELPALFDRYAANGLLFPRETALRAVLGELNHFEIEPLWAEDETIGWIYQYFNSKEERKAMRDASQAPRNSRELAVRNQFFTPRYVVEFLVDNTLGRLWFNATGGQTELRDRCQYLLVKPDEQPQASSKVRDPRTLKLLDPACGSMHFGLYAFDLFLEIYRETWAWEQQNGPGSLDVSTQPQAALKPLCRTYEDEAAFTRDLPRLIIEHNIYGVDIDPRAAQIASLALWLRAQRAWHEAGVKAKDRPRIGQGHVVAAVAPPAERELRHQFAANLDQRDAELFEKTLQLLKGLPELGVLLQVEHELPSLIRQVYVGKGTGLFAEQEQESWLNAEARLRAALTEFTQASHSTYQGRLFAQDALQGLRLIDLCSEVFDVVVMNPPFGDGSTEWSGYLSNRYGKHANNLFCTFIARAISLSKLGFVGAITDNTWLKKTDYEDLRELVLDGDLQLANLVDLGWGVLDDANVAACAFTLSALSTDIVNTLDLQESPLDGKGDLLRTVVSQFSNPFSLKEQPSAPQINSVDRRFFDNFPGKAIAHEAPPAFVSLFTLWPGIDPSFCKTRRGYTPGDTFRFFRLWWEVSSDLGAQKWWTLNNGGAYSPIITDGLLVGYRDDGWSQYRPLSGFRLESEQWFGKPGIGWGKRTDYMYAYPLPAGSIFSHEGHCAFPTDDVYLWPLLAYLNSSLGQQLLNLFCGQHKLAGYVSNLPCPPLNSEELRLAGDAAKECWEAASKISRTSEQSEIYNSPFSQITKPWEVNKLLSGWVDIYFKKIAEIDRLVDKCAAKATNISSFSSSGDDRPRAFVEKFCTSYDWARELVSYLFGCAVGRWSVGEFDSDLENLCAGNPFEKINYHFLDVDARNVVLVDDPGAPLDASGLIRSYLRKIWNEDADVIESAILEHIGEESLRSYLVRPNGFFADHRDRYSKGRRSAPVYWPLSTASGSYTLWVYYPSLSNQTLFSAVNDFLDGPNGKLTQVSRECAELRITGSGRSRDEEKQYETLQTFEQELTDLRDNLLKIAPTFQPNHNDGVQITAAPLWPLFRHKPWQKVLKDTWGKLEKGDYDWARLAAAYWPERVREKCKNDKSLAIAHGLEELYVEPEAAPKKTRGKKKAGGEE

SEQ ID NO: 2869 - protein, 356 aa, Pseudomonas stutzeri
MITKVHRADWDSYETSWDFTSLPLLHSDYCLPKLKDSYQKLRAHWREMTLEMQRLEEENNRIFIEAYGLQDELTPEVPLNEITLTCNPHYRYGNDKSEDELEALLLAETMRELVSYAVGCVFGRYSLDKPGLILANQGETLADYLAQVPQPSFPADDDNVIPMLDGDWFTDDIAERFRRFLRVAFGEEHYEENLRFVEQALNIKGKRNYSIRDYFLGEFYTDHVKRYKKRPIYWLFSSPKGSFNALIYMHRYRPDTVSVVLNDYLREFRTKLTSHKNHLEAVSISASSSQGEKTKALKEIEKITKMIAEMEDYEREVLYPLATEQVEIDLDDGVKLNYPKLGAALKKIVGLDAKED

SEQ ID NO: 2870 - protein, 602 aa, Pseudomonas stutzeri
METGKLKKFAQFARRQLIEQVSAKLKLVLAENSAARRESLDAIKKLEKAITRTGTEHVIERVAYIWFNRFCALRFMDVNRYTRIGVVSPAEGQFQPELLAEAKMGHIDEEMVPEKSRQQIFALLDGKAPSRDPQGEAYRLLLVAACNFWHQSMPFLFERIDDYTELLMPDDLLSGNAILAYTREAMTPDACEDVEVIGWLYQFYISEKKDAVFEGLKKNQKITPENIPAATQLFTPHWIVRYLVDNSLGRLWLLNRPGSKLVKQMEYYIPPEKPETDFLRISGPEDIKVCDPACGSGHMLTYAFDLLYAIYEEEGHDPTEIPEKILTHNLYGIELDERAGELAAFALTMKARARQRRFFNKRVKPNITVLEKVSFSREELDEYMGHVGRDLFTHGLRGTLPQFSEADNFGSLIVPKVGNVADVLATLEAKDMAGNLFLAETHQRVLSVLRMVEALSPRYAVVVANPPYMGGKGMNGRLSAWAKETYPNSKSDLFAMFIERNLDLAVKGGAVAMITMQSWMFLSSFEALRSRILNQHTILSMAHLGARAFDSIGGEVVSTTAFVLENAHKPDYRGAYMRLVDGNSEAEKMEMLAEAIAQGSAA

SEQ ID NO: 2871 - protein, 1182 aa, Psychrobacter cryohalolentis
METTKLKKFAQQARVTLIEQVATKLKFVRAEESLARRENPIAVKKLEELIKQQSEQEIVERIAYIWFNRFCALRFMDMNRYNRSLVVSAAADDTQPEVLALAKAGDIDERVVSEPVREQILNLLNGRAPSQNPEAEVYRLLLVAYCNQWHESMPFLFQRIDDYTELLMPDDLLSSSSVLTDMREAMPASACKDVEVIGWLYQFYISDKKDDVFARLKKNEKVTPENIPAATQLFTPHWIVRYLVENSLGRLWLLNHPESKLADSMEYYIKPADDNDDSDYLKVARPEDLKICDPACGSGHMLTYAFDLLYAIYEEQGYGAADIPSLILTHNLYGIEIDERAGELAAFALTMKARDRHRRFFNTDVRPNICVLEPISFDDDELDEYMDFIGRDIFTADLEETLRQFDEVDNFGSLIRPKLKNVAEILEQLEATDVSGQLFLGHTHQKVLKLLKQADYLSPQYHVVVANPPYMGGSGMNNRLKAWAKKEFPNSKSDLFAMFIERSLDLVCNQGLVAMITMHSWMFLSSFKELREQLLNQVTITSMAHLGSRAFDSIGGEVVQTTAFIMKKLSDLDYKGNYLRLVDGNSEFQKNRMILEISEEKKFNNLYQSSANDFKKIPGRPITYWISKPYIDCYDNGELIKDVFPAKLGMRTGDNAKWLRLWYETSLIKCSFSDLNSDQDIQLPKSWFPYNKGGEFRRWYGNNEFLVFWENDGYDIKEETLIKYPQLSWDNLGWKITNESDFFKKSLTWSFISSNSFGVRCSLGGAIFDVGGSSIFPEGDNYYLAAGYLCSKICFEFLKATNPTLNFQVVNINNLPWIQLDEENCKRVNELVKKLVEYSKFDWDSYETSWDFTTLTLLEEKYRKSNLADTYKGLRTHWQQMTNDMQHLEEENNRIFIDAYGLQDELTPDVPLKEMTLTSNPYYRYGGVKTDDELEALLLADTMRELISYAVGCMFGRYSLDKPGLILANQGDKIEQYFEQIPDPSFMPDKNNVIPILDDGWFSDDIVERFRKFIKVAFGEEQYESNMQFIEQSLGKNDKPRDIRDYFLKDFYDDHVKRYKKRPIYWLFTSGNFSALIYMHRYQPDTVSIVLNDYLREFRTKLNAYKDQLDTIKISSSQSQSEKTKAIKKLETTTKMITEMEEYERDVLYPLATKQIDIDLDDGVKVNYPKFGKALKKVTGLS

SEQ ID NO: 2872 - protein, 1166 aa, Rhodococcus erythropolis
METAPLKSFATWARTTLISEVTARIAVVLAPGSSARVERSNVVTTLEKVIQSAGGGELGRASVADMVAYTWFNRIIALRFMDANSYTGIGIVSPERGRDSGQPEILAEAKRGNIDSSVVSNQHTVETVTNLLNGTRRSEDPQGEAFSLLLANYCRFWNRSMPFMFERDGDFTELLMPGNLLADDSVMASAVTVLTEEVCKDVEVIGWLYQFYISERKDEVFAGFKKNKKAGAAEIPAATQLFTPDWIVRYVVENSLGRLWLLNRPTSRIADQMKYYIAPVDEEIDFLKISSPEDLKIIDPACGSGHMLTYAFDLLYAIYDEEGTDPADIPGLILANNLFGTEIDPRAGALAAFALTMKARSYQRTFFTKQVKPNICVIKSISFSPAELGTLAIPGGDPADEEAFWNQFQYADILGSLIQPEEKLIGALKRHINTQEETYKGRLVGDIYARATQALTQAEYLSSGYHVAVANPPYMGRKNMNNILAAFAGQKYPDTKTDLFSMFIERCCNLCLDRGQLGFMTPFVWMFISSYNKLRQKLTQHATITSLIQLEYSGFEGATVPICTFTIENSAHPGYSGSYIKLSDFVGSELQKPKALEAIQNPDVNWFYRAKSQDYENIPGTPIAYSLPKNAIRAYREFDNFGSHSYGQPGLQTSDNARFVRLWHEVDTCSFNYRALSSREAQSSRARWFPLVKGGEFRKWYGNLEYVVDWEDSGARIKDSINKKYPYLNGNIDYVVKDRGYFFRPSINYNKITSGRFTARYAPAGTIFDVAGSAVFPYGNPMLALAFLGSKTGDFFVRAQNPTLNVQSGDIARLPYPESALTSRAATLTTLVQNAIDISRRDWDSAETAWEFTCSPLVHSYSAQVPLGNRVSSVIENIQGEHVRLSEVETLINYEVAKAYGLDQDINPYVSPEEVTLRPNNKNLIVRDLVSYAIGCMFGRYSIDEPGLILANHGDTLQNYLAKIPDPSFMPDADNVIPIIDSDWFEDDIVALFRQFLRVAFGNQHFEENLRFITEALGVKNLRDYFVKSFFKDHVQRYKKRPIYWLFSSPKGSFSALIYMHRYTTSTVSTVLNEYLREFKAKLEASRQHHQRLAAGTCTAREKATSQKEADRLRKVLLELDEYEHDVLYPLATQQIQIDLSDGVKANYPKFGNALKKIPGLEAKDD

SEQ ID NO: 2873 - protein, 1326 aa, Rhodopseudomonas palustris
MDKDTRNAIERATQKIRRILQEDFAEQLDGVFDVRSDGRVAEEGGRHLSGRQLLLRDRIVAAVEHKRRAGMQPTDAVRDYIRDAAFTTLNRFAALKMLEPRGLVQECISRGENSIGFTEFCGLAPGLKTVDGAGYRLYIESIFDELSTEVKVLFDRRDPASALWPRKAAFDEILEILNGSGLVGVWNEDETIGWIYQFFNSGEERRQMREESQTPRDGRELAIRNQFFTPNYVVRFLAENSLARIWWEMRRGDTRILLESEYLVCESFDLDQAAGMSADQPRTKKDPRSLGAIDPACGSGHFLLYLFGLFLMIYEEAWHDLDAPTFQGSGRTLREDFPELEEFRKAMPGLILRYNLFGIDIDFRCAQIAQLALWMRAQRAFKEMNVSRAARPRIRRANIVIAEPIPGDAPLIENFASTLKPAALGTLFKGIVAELNHADEMGALLPLDRTLASLIDEANKSISQAREKGKQATLPGFDEQRAESVRYVDLRGFSSFQEAEALLKESLEEFLINAVNGIGVRRRLFVDDAEQGLALVDLMNRHYDVIVMNPPFGTPSDGARERIAAEYPQTKYDLGAAFVDEWRNRLTPRGRLGVIFNRTNWFLSRLQHFRSRLLERSWLACNADLGLGVLDAFVETAMTVIENGPQEKRQSIWFRLTEGGDREGNLRRFVRDVNSRSVTSNTFIHPQSAFENIAGKAFSYWLSPALLHIKELTPLTASGIEAKQGLATKDNFRFLRLHWELKQNGERWKLYSKGGAYAPLVGLYHLVIDWGAAASAAYANRDGQFCCLLTGQAHKYAFRPCITYSQRTSRFSARVFPAKGLFDTKGSAVFSPNVTTESDDAEQLVALCLLLNTSLGQFLFDSSGGASDEGKARDYSQGMVGALPGLADIKRAMNPVLQEAKDVIGELVRLQGSDPTSIYYTGLPSASWMNSSRPEDIVEQATNLQKRLSGLLREAGTRYCDALGLDAGSQAFVDETVRGMHREAVHEALAIDPADISSQIRQSILLSVFAPRKVGGGIVQQVKDNPLLAVAWSPHSLSESPVRVLVTDSGHELDLARRMSKFCQEHKLSDDCVRTWCGFDDFEEWTKLDAFAEHVSMFSKSQRIAPVLWQIGTADGRYSIWLLSYMVNRNTLLDVENDLVVPKIASVKRELEAFRVETGAAPTADQRKRLESLESFSENLARFRDEIVKVALLFDPHEEDGATICAAPLYRLFPQNKPWQAELRKTWKDLCDGKLDWSNVAMRLWPERVIPKCAEDLSFAIAHDVVDVFWLKNSEGKWQVRKVPVQSIESLVDERTSLNVKTALKNFIESSDAAGSVKRARKSKAA

SEQ ID NO: 2874 - protein, 1162 aa, Saccharophagus degradans
MNHLQPLDKKLRSQLENTVKKARDIAEEAALAVLEQLGVGEKTKPNYLDAAQQNLRVRLRAHARSLGDARKPDGEQSIERLQEEVAYEHWHRMLFARFLAENNLLMYPDPDEPVAITLEECEDLAADEGAANGWELAGRYASQMLPQIFRVDSPVFELKLAPNHQLDLEKLLISLPTEVFTASDSLGWVYQFWQANNKERINKSEVKIGARELPAVTQLFTEPYMVSFLLDNSLGAWWAARRLSEDHLKNASSEEELRQKAAIDGVPLEYLRFVKNEAGVWEPASGKFEAWPNELSELSTLDPSCGSGHFLVAAFNMLVPLRMEFEQLNAEQAVDAVLRENIHGLELDQRCVELAAFAIAISAWKYPNAGGYRTLPEVQVACSGLAINAAKEEWKQLAAHMGGKQNLSIALDWLHDNLKNAPVLGSLMNPAKSKAAGLVSWQELSEALDKALANDEAEVAQTNEQHENAVVAQGMAKAAKLLASQYQWVITNVPYLARGKQEDTLKDFIEQHYPAGKNDLATAFLDRCLEFCVKGGTSSIVLPQNWLFLTSYKKFREKLLTQDTWHLIARLGPGAFETISGEVVKAILINLSRGNSAGESGGLFGAAEHSQLIRGVDVSEPRTAAEKAEQLITVVVKSVEQAKQLENPDARVALESSLEGELIEKYGYSHHGLTSGDTPRMKFAHWEICDTSAIWIPFQSTVRDSEHYGGNESILRWDNGEGPILELQGARKDGTGAWGKHGILISQMGVLPVTFYTKSAFDNNTAVFVPNNENEIPAIWCYCSSTEYNEAVRQLDQKMSVTSATLAKVPFDLDHWTKVAEEKYPNGLPKPYTDDPTQWIFHGHPCGSVVWDETQKWTAHGALRTDESVLHIAVARLLGYRWPAELDASMELADEQREWVKRCEALLPLADDDGIVCIPAVRGEALAYDRLINLLAAAYGDAWTPSTINQLLSSVGYAGKTLDAWLRDKFFEQHVKLFQNRPFIWHIWDGLNDGFAVLINYHKFDQKLLETLIYTYLGDWIKRQKDEINAGVDGAQERLAAAEALRKRLIKILEGEAPLDIFVRWKPLEQQAIGWNPDLNDGIRLNIRPFILVDDVKVKGAGVLRHKIPSIKWTKDRGADVESAPWYHLGPHYGGKEGDRINEHHLSLAEKKAAREQLSESS

SEQ ID NO: 2875 - protein, 1225 aa, Salmonella enterica
MNTNNIKKYAPQARNQFRDAVIQKLTTLGISADKKGNLQIADAELVGETMRYGQFDYPKSTLTRRDRLVKRAREQGFDVLVEHCAYTWFNRLCAIRYMEIHGYLDHGFHMLSHPDNPTGFEVLDHVPEVAEALLPEKKAQLVEMKLSGNQDEAIYRELLLAQCHALHRAMPFLFEAVDDEAELLLPDNLTRTDSILRGLVDGIPEEDWQEVEVIGWLYQFYISEKKDAVIGKVVKSEDIPAATQLFTPNWIVQYLVQNSVGRQWLQTYPDSPLKGKMDYYIEPAEQTPEVQAQLAAITPASIEPESIKVLDPACGSGHILIEVYNVLKNIYEERGYRARDIPQLILENNIFGLDIDDRAAQLSGFALLMMARQDDRRIFTRDVRLNIVSLQESLHLDIAKLWQQLNFHQQNQTGSMGDMFAENTALAHTDSAEYQLLMRTLKRFVNAKTLGSLIQVPQEEEAELKAFLEALYRMEQEGDFQQKAAAKAFIPYIQQAWILAQRYDAVVANPPYMGGKGMNSELKEFAKNNFPDSKADLFAMFMQNAFSLLKENGFNAQVNMQSWMFLSSYEALRNWLLDNKTFITMAHLGARAFGQISGEVVQTTAWVIKNQHSERYQPVFFRLIDGREEVKKSDLLLRKNIFDKFTQHDFKNIPGMPIAYWIDLPSLLSFRHHKKLGEKIALKAGMSTGDNIKFQRYWYEVSIKKTLITNKESNTKIDIHNIKWFPCSSGGEYRKWYGNNEIVVNWENNGYEIRNFKFENGKTRSAVRNDEYYFREGITWSKISQGNFCVRYRPKGFVFDDTGRCGFSNNKNELLYAAGLMCTPVVNHYLSILAPTLSFTSGELASVPYPEIEDEIIELVTNAIEIAKNDWDSQEQSWDYVCSPLLEHNSTQLLRNIYKQKINTNIKLVETLLLIENTINNIFIDKLQLDKTIIKAVLQSEITLLCNPNYRYKNIQDHTDLTNKYYTDITIDILSYIIGCMMGRYSLDREGLVYAHEGNKGFAELVAEDAYKTFPADNDGILPLMDDEWFDDDVTSRVKEFVRTVWGEEHLQENLEFIAESLCLYAIKPKKGESALDTIRRYLSTQFWKDHMKMYKKRPIYWLFSSGKEKAFECLVYLHRYNDATLARMRTEYVVPLLARYQANIDRLNEQVDGASGGEATRLKRERDSLSKKFNELRSFDDRLRHYADMRISIDLDDGVKVNYGKFGDLLADVKAITGNAPEII

SEQ ID NO: 2876 - protein, 1225 aa, Salmonella enterica
MNTNNIKKYAPQARNQFRDAVIQKLTTLGISADKKGNLQIADAELVGETMRYGQFDYPKSTLTRRDRLVKRAREQGFDVLVEHCAYTWFNRLCAIRYMEIHGYLDHGFHMLSHPDNPTGFEVLDHVPEVAEALLPEKKAQLVEMKLSGNQDEAIYRELLLAQCHALHRAMPFLFEAVDDEAELLLPDNLTRTDSILRGLVDGIPEEDWQEVEVIGWLYQFYISEKKDAVIGKVVKSEDIPAATQLFTPNWIVQYLVQNSVGRQWLQTYPDSPLKGKMDYYIEPAEQTPEVQAQLAAITPASIEPESIKVLDPACGSGHILIEVYNVLKNIYEERGYRARDIPQLILENNIFGLDIDDRAAQLSGFALLMMARQDDRRIFTRDVRLNIVSLQESLHLDIAKLWQQLNFHQQNQTGSMGDMFAENTALAHTDSAEYQLLMRTLKRFVNAKTLGSLIQVPQEEEAELKAFLEALYRMEQEGDFQQKAAAKAFIPYIQQAWILAQRYDAVVANPPYMGGKGMNSELKEFAKNNFPDSKADLFAMFMQNAFSLLKENGFNAQVNMQSWMFLSSYEALRNWLLDNKTFITMAHLGARAFGQISGEVVQTTAWVIKNQHSERYQPVFFRLIDGREEVKKSDLLLRKNIFDKFTQHDFKNIPGMPIAYWIDLLSLLSFRHHKKLGEKIALKAGMSTGDNIKFQRYWYEVSIKKTLITNKESNTKIDIHNIKWFPCSSGGEYRKWYGNNEIVVNWENNGYEIRNFKFENGKTRSAVRNDEYYFREGITWSKISQGNFCVRYRPKGFVFDDTGRCGFSNNKNELLYAAGLMCTPVVNHYLSILAPTLSFTSGELASVPYPEIEDEIIELVTNAIEIAKNDWDSQEQSWDYVCSPLLEHNSTQLLRNIYKQKINTNIKLVETLLLIENTINNIFIDKLQLDKTIIKAVLQSEITLLCNPNYRYKNIQDHTDLTNKYYTDITIDILSYIIGCMMGRYSLDREGLVYAHEGNKGFAELVAEDAYKTFPADNDGILPLMDDEWFDDDVTSRVKEFVRTVWGEEHLQENLEFIAESLCLYAIKPKKGESALDTIRRYLSTQFWKDHMKMYKKRPIYWLFSSGKEKAFECLVYLHRYNDATLARMRTEYVVPLLARYQANIDRLNEQVDGASGGEATRLKRERDSLSKKFNELRSFDDRLRHYADMRISIDLDDGVKVNYGKFGDLLADVKAITGNAPEII

SEQ ID NO: 2877 - protein, 1225 aa, Salmonella enterica; identical to SEQ ID NO: 2875

SEQ ID NO: 2878 - protein, 1225 aa, Salmonella enterica; identical to SEQ ID NO: 2876

SEQ ID NO: 2879 - protein, 1225 aa, Salmonella enterica; identical to SEQ ID NO: 2876

SEQ ID NO: 2880 - protein, 1225 aa, Salmonella enterica; identical to SEQ ID NO: 2875

SEQ ID NO: 2881 - protein, 1225 aa, Salmonella enterica; identical to SEQ ID NO: 2875

SEQ ID NO: 2882 - protein, 1225 aa, Salmonella enterica; identical to SEQ ID NO: 2875

SEQ ID NO: 2883 - protein, 1191 aa, Selenomonas sputigena
MNKNAIKKYAVWARRELIDRVSKKAMRYGIAPEIPADPEADSVEGRLLSDTEKKERRALIEKVAAHGYEQTMEEAAYTWFNRFAALRFMEVNGYLPSHVRVFTNDAGEFKPQILAEAIHLDLPGLDKEKVYALKEGNDEEALFRYLIIVQCNALNEILPGMFQRLEDFTELLLPDNLLREGSVIERLVKQGDAGSIPEEDWRDQVQIIGWLYQYYNTALNELVYDGNLSKEKIPKHLLPAATTIYTPDWIVRYMVENSLGRLWLEGHPNENLQGEWKYYLPEAEQEESVQKQLAEMRKESANRKPEDIRCIDPCMGSGHILCYMFDVLVKIYEDYGYTAREAAASIVQNNLYGLDIDDRAAQLSYFAVMMKARQYDRRFFSRGIQPNVMAIEESNGLATWAETAGDSLVSGQLTFEDDFIRMADYLIEIFQDAKEYGSILTVQADRYDALVDFIEKTGQETGNLLFRAWIDEVERRILPLIQQAKVFSQKYDVIVTNPPYLGSTRFSFKLNEYVKKYFPNEKSDLSMVMLKKSLQETAKTNGYVAFVTTASWMSLSSFEKLRSYMYKDCAIDTLVDCGTELFEGKVGHNSIVSWVVRKTKFNYRMTAVRLVDYCYSRRDEKEVEFFNKKNYFVATQENFSKIPGSPVAYWVSEAMLRCFGEKCIKDYGFAGIGMRTGDNERFLRLWYEVSANNFSITSKGVIKWIPYNKGGNFRKWYGNNEYVVNWENDGEEIKDNTRLNYPELGDNLGWKISNEKYYFKPGITWTGVTMAKFSCRIYPSGFIFDSGANGLFPYKKQDESYLAGFLNTKIANDILRIINPTINTGSGTVKSIPVIKSKTQQKKVDELTNQNISISRADWDAFETSWDFQSHPLAPTAYERREQLSYGIHSAERKKSVSLLTDRYAYWEQACNDRFSALKENEEELNRIFIDIYGLADELTPEVEDKDVTVRRADLPRDIRSLISYAVGCMFGRYSLDTPGLVYAGGEWDDSKYRTFLPDEDAIIPICDDEYFDDDIVGRFVEFIATVFGKETLEENLQFIADALGGRGSSREVIRSYFLTGFYADHVKTYQKRPIYWLFDSGKKNGFKCLVYMHRYCPDTIARIRTDYVHEQQSRYRTAIESLEQARDNAATAGDKVKAGKKLAAVEAQAKELLEYEEKIHHLADQMIAIDLDDGVKHNYAIFQDVLAKIK

SEQ ID NO: 2884 - protein, 1154 aa, Shewanella sp.
MRQALDKTLRNLLEKAVVRARELTEIAALEALTRLGVGLGEAPSYLNDDERALRNCLRAHARQLGDRLHTNGKQDIAHLSAEMAYEHWHRMLFARFLEQNQLLMYDQYTAVTLAECQELAADEGVKDGWQLAGVLAERMLPQIFRTDSPVFALPLAIDRVRELEDLILTLPTAVFTAQDSLGWCYQFWQSKRKEEVNAAGVPIGADELSPVTQLFTEPYMVSFLLDNSLGAWWAKKRLTDADLRSASDEATLRRAAAIPGVPLEYLRFVKTKDSQGVLWQAAGGWFEAWPEDIAALKTLDPCCGSGHFLVALFLMLVPMRIELEGIDAKTAIDRILRDNLHGLELDSRCVEIAAFALALEAWRYPNAGGYRSLPALNLACSGLDVSALGSEWQALAKQRPEISDALSWFARTFKDAPVLGSLIDVNSAYYHGKTEGEPAPWQVLLDAQAGMQNLGDEAQIAQVTAQGLAMAAKLLANQYTLVATNVPYLARGKQCDTLKDFCENYYPEAKSDLATVFLERCLDFSPKGGSSTIVLPQNWLFLTSYKKFREKLLTQDTWNLVARLGPRAFETISGEVVQAILITLSKGEAAQGALLHGLDVSAPKTAADKAEQLLIEPLKSVEQAKQLENPDFRVALNETNSTALVNSHADTATGMQSFDRPRFIYQFWEIVSFSNGWEPCQSTVRSTTHMGGCEFTVRWESGEGQLYAMMEDKRLLENYTSAIWKAGSQYWGAKGVMVSLMGDLPVSLYLGKPYDQNAGLIKPNSDESLLSIWAYCSSGDYGSTVREVDQALKVTNATLGKIEFDHEYWLSVAKEKYPHGLPKPYSNDPTQWIFHGHPCGAVVWDEHKKWTAIAEKRTDETVLQVAVARLLGYRWPAELDEKMELADEMLTWLSKCDDLLALQDDDGIVCLPAIRGEKAAASRLEAMLQAAYENDWSAKVLTNLLASVGSKSLETWLRDKFFEQHCKLFQHRPFIWQIWDGLNDGFSVLVNYHKLDYKGLERLIYTYLGEWIRTQEHGVKEGVDGADSRLMAAKNLKDTLEAILKGDAISTKSGLDIFVRWKPLHEQPMGWHPDLNDGVRLNIRPFIQAPDIGKKGAGILRAKPNINWNKDRGTDVASAPWYHLGPEYGEKEGARINDHHLSLAEKQAARDKQE

SEQ ID NO: 2885 - protein, 1154 aa, Shewanella sp.
MRQALDKTLRSLLEKSVVRARELTEIAALEALTRLGVGLGEAPIYLKEDERALRNRLRAHARQLGDRLHSNSKQDIAHLSAEMAYEHWHRMLFARFLEQNQLLMYDQYTAVTLAECQELAADEGVKDGWQLAGVLAERMLPQIFRTDSPVFALPLAIDRVRELEDLILTLPTAVFTAQDSLGWCYQFWQSKRKEEVNAAGVPIGADELSPVTQLFTEPYMVSFLLDNSLGVWWAKKRLTDADLRSASDEATLRRAAAINGVPLEYLRFVKTKDSQGELWQAAGGWFDTWPEDIAALKTLDPCCGSGHFLVALFLMLVPMRIELEGCDAKTAIDLVLRQNLHGLELDSRCVEIAAFALALEAWRYPNAGGYRTLPALNLACSGLDVSALSSEWQALAKQRPEISDALGWFARTFNDAPVLGSLIDVNSAYYHGKKEGEPAPWQRLLDAQAGMQNLGDEAQSAQVTAQGLAMAAKLLANQYTLVATNVPYLARGKQCDTLKDFCENYYPEAKPDLATVFLERCLEFSPKGGSSTIVLPQNWLFLTSYKKFREKLLTQDSWNLVARLGPRAFETISGEVVQAILITLSKGAAAQGALLHGLDVSAPKTAADKAAQLLIEPLKSVEQAKQLENPDARLSLDISLELELLGANAQTGTGIQTFDSPRFLSPFWERFKIEKNYIVCQTTVVNSTLFGGLSQCLKWEGGEGDLAHMMSEKEILENYKSGIWRAWSRFVGRDGICVSLMRHLPVARYFGLSFDNNTGVIIPSNKSDLPAIWAYCSSEVFNTELRKIDQKLNVTNATLVKVPFDIKYWSKVAEEQYPKGLPKPYSNDPIQWIFHGHPCGSVVWDEDKKWTVVAEKRTDETVLQVAVARLLGYRWPAELDDTMDLADEMRTWVDKCDDLLALQDDDGIVCLPAIRGEKAAANRLEAMLQAAFEEDWSASVLTNLLASVGSKNLETWLRDKFFEQHCKLFQHRPFIWQIWDGLNDGFSVLVNYHKLDYKGLERLIYTYLGEWIRTQEHGVKEGIDGADSRLMAAKNLKDTLEAILEGEAISGKSGLDIFVRWKPLHEQPIGWHPDLNDGVRLNIRPFMQAPDIGKKGAGILRAKPNINWNKDRGTDVESAPWYHLGLQYGEKEGARINDHHISLADKQAARDKQE

SEQ ID NO: 2886 - protein, 1131 aa, Slackia heliotrinireducens
MDSSRIKRLATGVRDELRREVEGRLEAVLAADSPERLSDGTGVVRLEARIEAEGRDAVVEAGAYTWFNRLCALRFMDARGYTPTPAVTPRAGSTMPAVLADAAQGSFDPEYGLAPAVRERVVSLLSGSTQRANATEAAYAELLRAVCAHYAKPMPYLFSEDAASSLLMPRGLLSEGSILGRIVAEMDAGACSSVEVLGWLYQFYIAELHDQVYSGFKRSVKAGPAEIGPATQLFTPEWIVRYLCENSLGRLWMLNHPGSPLAERMDYYIAPEGDEPHIEVSSAEEVRVLDPACGSGHILVYAFDLLYSMYEEEGWLPEEIPAMILQNNLKGLEIDARAAEIAKFALEMKALERDPRFLERDVDADVTVLRPVALDEADMPYLSQSFKERVGLIEAMAHMGEVGSLYVPEAGDARAVAAEIERLAPKAQSDMFARDLAGRLGAMLENVEALSGSYHCVVANPPYLGSGNMSTYLSRWCKGNYPDAKADLCTCFIERCLHFTKQYGVESIITSDTCMYISSFEKLRRKILEQTTLYSFLDTRGTNAHPDVFDANAGWILGKGHLSGVKGSFFKLSHRTSEKDTALLNAIHNPKCGWLYKADTDLFKTIPGCPIAYLVSETMMGAFRNLGNVASLGRASVGIKTGNNGAFLRFWWEVARGKILFNGVSSDATFIEGYRWYPCNKGGAFRKWYGNAEYVVDWRENGKYAFESAEKNGNHAQDYSDDLKFRPYITWSDVTSGEQSFRLKTNDLSEMTGMGIYPDDDSRNALLGLLNSSVAKRYLELLAPTMHLKIRELGSIPWNDDSRCDEVRRTVDTNVAVARKDWDSFETSWDFERHPLARTSRVEDAFALWQSECRSRFDQLKANEEKLNRVFARIYGMEGEVPIEVSDDKVSVRLADLQRDVKSLISYGVGCIFGRYSLDAPGFVLANQGDTARDFLAKVPDPSFVPDEDNILPVLDAEWFDDDVVTQFYRFLAAAYGESTLDENVAFIEGALGCDLRTYFVRDFYSDHVKTYQKRPIYWLFQSPQKGFSCLVYMHRYSEGTVGEILTKYLRAYEDKLRLRVQVLGRSERAADLKAADRMRAQISELEAWEKEVVYPLAHERVAIDLDDGVKINYNKFPHALAKVQGLSDWR

SEQ ID NO: 2887 - protein, 1140 aa, Slackia heliotrinireducens
MDSSRIKRLATGVRDELRREVEGRLEAVLAADSPERLSDGTGVVRLEARIEAEGRDAVVEAGAYTWFNRLCALRFMDARGYTPTPAVTPRAGSTMPAVLADAAQGSFDPEYGLAPAVRERVVSLLSGSTQRANATEAAYAELLRAVCAHYAKPMPYLFSEDAASSLLMPRGLLSEGSILGRIVAEMDAGACSSVEVLGWLYQFYIAERKDEVFAGFKKNKKAGPAEIGPATQLFTPEWIVRYLCENSLGRLWMLNHPGSPLAERMDYYIAPEGDEPHIEVSSAEEVRVLDPACGSGHILVYAFDLLYSMYEEEGWLPEEIPAMILQNNLKGLEIDARAAEIAKFALEMKALERDPRFLERDVDADVTVLRPVALDEADMPYLSQSFKERVGLIEAMAHMGEVGSLYVPEAGDARAVAAEIERLAPKAQSDMFARDLAGRLGAMLENVEALSGSYHCVVANPPYMGTSTLYKPASDFVKENYPDEKADLCTCFIERAKRFNLRRGYSALITMQSWMFLSSYEKMREKIINHECIISMAHLGARAFDAIGGEVVSTTATIFQHIKDSEREGTYIRLVDFLGEANKSSICRKAICDASSTWLYRAYVSDYKIIPGMPIAYWVGNGMKSAFLNGTPLSVDGRPRKGLTTTDNGHFLRLWHEVSADKVCLTAENADVAKASRCKWFPYDKGGDFRKWYGNRECFVNWEDDGAEVKALITSKYNGGSYTKEVRSEEMYFAESLTWTELCTGMPGFRYSPAGTIFDSSGSSMFPRSHILYYLGLMNSSVMSEILKMLNPTLHYNSGVVAKAPALFSEFDLRLVEAAVSENVSLAKSDWDSFETSWDFETHPLVRTECVADAYTLWQSECRDRFEILKSNEEELNRIFARIYGMEGEVPIEVPDDKVSVRLADLQRDVRSLISYGVGCIFGRYSLDAPGLVLADQGATVADYLVKVPEPTLVPDADNILPVLDAEWFDDDIVTQFYRFLAAAYGESTLDENVAFIEGALGCDLRTYFVRDFYSDHVKTYQKRPIYWLFQSPQKSFSCLVYMHRYNEGTVGEVLTKYLRAYEDKLRLRVQVLSRSERAADLKAADRMRAQISELEAWEKEVVYPLAHERVAIDLDDGVKINYNKFPHALAKVQGLSDWK

SEQ ID NO: 2888 - protein, 1219 aa, Spirosoma linguale
MDTRRLKPFAQQCRQRLMQGIADRLNYWGFVATSRQPVETLEKLDGGYLFRGQVFDETDVPRRWQLLAGAVQTHGFAHVQETVAYTWFNRLMALKILAHNNYQPDVLSFTRPDTPTPQLLDEARRAQPPYLSEQLYRILRPLLTDYTRETDAFARLLTAYCVQHPVLHRLFDVADDVSTLLLPADMLGESGVLAFINNSTAISEADFKQVELIGWLYQFYIADRKDEVFAGFKKGLKAGPDDIPAATQIFTPRWIVSYLVENTLGRLYLDQNPDSSLGETMRYLVKTEKKPTTVADETGQSREAAPTTLSFNEGALPMQADVSVASLRLIDPACGSGHILVTAFDLLMRIYNEEGYTKRQAVTAILNSHLVGLDLDERAAQLSRFALLLKASQYWPGVWDTDIIPDVWAMPDPWMPTDTDLLSFLGTDGREFLAELHTALRLMQQSQNLGSVMRPNLSRAGRTHLRNRLLIYEAQSDDAIDIFAGTNRQHLRHYIHVLLILTDHYAAVAANPPYINSGSMEAVLKGYIEKHYYRSKINLSLSFMEKCCDMCQSKGIWGLINQDSWLLKTSSVELRKLLLDTNAVESVLHLGPNAFDELGGEVVQTTAATFRKSESHPSSSGIYYDLTMFGSSAKKEGAFLAGVNQFSKVMQQSFAELPGNAISYRMRPGLSTIFKTEEKLGDYADVKQGLSTADNDRFLKLWHEINIHKISLQGKAERKWVPCTKGGSFQKWYGNNEYVINWENNGYELKHFFDKNTKKLRSAIRNEIYYFRKGITWSVMSSGSNGFRILPEGFIFEHKGSACFAKDESDLESIIGFLNSPVAYSLNQALSSGNEIKEGILQKLPYKEPYNATKISPIVQSCTNIARLDWDSRETSWDFAENPLVAIQRQASGSLRQAYETWAAQVAGQFVELHRHEERLNHIFIDLYGLQDELTPEVSPRNITLLPEELDKNQLMAEAEREDNWLINPTGVVTSAIRRDVVARQFISYAVGLLMGRYRLDSPGLHIAHPNATPEELADYTVTRTENGIPKTEPFTIDPDGILPILGEEGGFPDDLGRGLRQILELIWGGHQLTDTVSWLEESLGQSLDKYLTFNFWGDHCRLYQKRPIYWLFSSPKGAFKALVYLHRINGFTVSTLRNKYLLPYIDRLSRQIDHFNSTKSQLGTAENRRIETLRKAYEECRQYDLLLRDAADRQFVPDLDAGVTRNYAQLSKVLAIIK

SEQ ID NO: 2889 - protein, 528 aa, Sulfuricurvum kujiense
MNKSKLKSFAASMRRDLMDAVRAKADYILSHDIDELPPKFYDHRDKIATLAKLVQTTGKEEVVERIAYIWFNRLIALRFMDAALINEIAVVSPIERQSLPQLYNEVRAGHVPEGYTFDRTKFFDLIDGKIQSSDPENEAYAMLFIAACNAWHEHLPFMFEKIADYTELLIPDDLLGAASLRARVVDALEAEDCQDVEVIGWLYQFYIGEKKDAAMAKKGKYNTSEIPAVTQLFTPDWIVRYLVENSLGRIWMASRPNSKLRESMRYYVEHDDATTPITVSSVEELTLLDPCCGSGHMLTYAYDLLEKIYEEEGYPKSDIPGLILTHNLYGCDLDERAASLAAFALTMKARLSHRRFFRKSVRPNIVELLPYDDDRFANIKDLGSLIRLKPSTAKLDEGVFAYSNREFTLQERILGGDFHCVVTNPPYMGGKGMNTVLADFVKKQYPDSKADLFACFIERSLDLTKSGGYAAAVTMHSWMFLSSYEALRVKLLENHQIDTLVHLGARAFEEIGGEVVQTVAFVLQRGNK

SEQ ID NO: 2890 - protein, 578 aa, Sulfuricurvum kujiense
MATYIRLTDYKDSDTKEQQFANPANRHTANQNDFSKIPGSPIAYWMSDTVRSKFILYPSIDDLMTTRAGMCTGNNDFFLRYWFEIEFIKIGFYKSSFDEVISSNKKWFQFNKGGEYNRWFGNNDIFIKFNKENIDLLSNSCNKLASKELYFKEGITWNAVSSSNFGVRLHQKGSIVSNAAMVAFPENEFNYIFAFLNTVIVKKMVEFLSPTINFNVGDISKVPVIFPNSSTIKSKINTLTDQCIEISREEWDSRETSWDFKQNELIRHKTDDGKIASAFTAYCDHWREKFHQLHANEEELNRLFIDIYGLQNELTPDVALEDITILKSESRIENGELIFNADEIARQFISYTVGCMFGRYALDREGLVVANMDQPYPTDTPFAIDDDNIIPVLEEEVFADDIAARFERFVGVAFGEERVGENLRWVEEALGMSIRKYFYGEFYKDHVRRYKKRPIYWLIQSPKKGFSALIYMHRYQSDTMARVQTMYLREYLTKLESLIEHYNAIASNPSSSAKDAKDAAKLASKLEGKHRDALDFDRGDMSRIAAEQITIDLDDGVKVNYQKFKGVLPDIGLSKGED

SEQ ID NO: 2891 - protein, 522 aa, Synechococcus sp.
MPRSAVTPTPAGANLGYEAELFKAADKLRGNMEPSDYKHVVLGLIFLKHISDRFEAKQQELAAEFPDDPEILEDKDEYTAENVFWVPKESRWSYLQANAKQPTIGKLIDEAMLGLEKVNDSLKGVLPKEYARPALNAVMLGELIDLISNIAFGTSHDNARDVLGRVYEYFLGQFAGSEGKRGGEFYTPRSVVRVMVEMLQPYQGRVYDPCCGSGGMFVQSEKFVEDHAGRIGDIAIYGQESNYTTWRLCKMNLAVRGIDSDIRWNSEGTFHKNELPDLRANFILANPPFNISDWGGDRIREDARWKFGIPPVGNANYAWLQHIWHHLAPTGTAGVVLANGSMSSQQSGEGDIRQAMIEGDAIDCMIALPGQLFYSTQIPACLWFLAKDKSNGIARDKKLRDRRGEILFIDARKLGYMVDRTRREFSDEDVAKIAETYHCWREGAGYEDIPGFCKSANLEEIRGHGYVLTPGRYVGAAAAEEDDTPFAEVMQQLTTKLGQQFQESARLESVIRENLQGLGYDF

SEQ ID NO: 2892 - protein, 1324 aa, Synechococcus sp.
MDQEIRNKLRNVVTKCRKLLEDSISQELEGKYNIFARKEKVTADPDAPMNHLMEEDRAARRDILDHFAHIKARGFKPKDALDQLIREIAFTHLNRLCAYKMMEAREVYVGGQKFREAVSRGVNSNGVKFYLAEHEEDERLFNTGHQDIAYRHFLDWLGGALSEEIGVLFNPNDPANRLYPRQKTLDEVLDLLNGGGIKTEETELREQWPQIWSQDETIGWVYQYFTPKELRDKARKESQAPRNSYELAFRNQFFTPRYVVEFLTDNTLGRIWYEMRKGDTTIKDQCRYMVRRPTEIFLKEGEQSPNNAAEGKDDLSQEELLKLPVHIPHRPKKDPRELKILDPACGSGHFLLYCFDLLLTIYEEAYSDPDLGPALKKDYPTLDALKRDVPRLILAYNLHGIDIDLRASQIAALALWLRCQRAYQEMGLKKDRPKITRSNFVCAEPMPGEEPMRKEFVDQLEPKVLGQVVEVVFDKMKLAGEAGSLLKIEEEIRDAVAAAKKQYVRETTQATDRKGQPLLFTQVAMDRITGKPDQPSLFDLSDITDNQFFEQAEGRVIEALRFYAEKAQNGQRLQRRLFTEDAVRGFSFVDLCRNRYDVVLMNPPFGECSQLTASILASYYPDWNTNLLCAFVARAWAITCGNGSVGVIYDRTAAIKSTYEDFRRCSLLPDNRLLAVADLGWGVLDANVEVTTAVLHRSTSDPSCFVDARAVGVEEKGGFIEQSLKSASDVPTSTWVRPKTFLHLPNAVLAYDFPEYLRRAFTAYSSLEKSGITAAQGHALKSEVHYRAFWEVSPLEPIGPNRRWIGAFKGGDYSPFFLKTHHIALYGRDGSLVPKSTANVLRNKSLHTLPGIAYGKRGEYLDSQVLLAGQIFTHEGHAFPNLGRHVAWAALCLMNSRLFQHGVNCYCGQHKHSGYVNLFPFAPALLKSGDELSHLAKRIYSLKEMWARGDETHFLFVAPHVMLCERTDSFAKSVNSIFNQLEAWDTEIQAADARIEEIVSDAYKVTDSDVRELVARTANRPVDRTAYDTSIRSLKEMGMRLSLEMTSYCVGIVYGRWDVRFAIGSKVACVPEPFGELPQHPLATLLEVNEVGTGGDYPIAVCTSGILVDDPESDNDIVTAIQRCLDVLFDKGSENALEEMTQRLGTDSLRDYLRKAPTGGFWQAHVDTYSQSSRKAPIYWLLQSSKKNYAIWLYYHRLDKDLLFKALVNYVEPKIRLETSRLESLQSQKAAAGDSGKEAKRLAKEVEKQEDFLSELQDFEDKLRRAANLHLEPDLNDGVVLNIAPLHELVPWKEAKKYWDELMAGKYEWSSIGKQLREKGLVEG

SEQ ID NO: 2893 - protein, 300 aa, Syntrophomonas wolfei
MKLAEHVEHIRQIIDQAFRNTLGRMGITATVLQPLENLSQQFHLDRIRIEDVFENFAAETGSVADAYEKLVEELTFTLFNRLAALKVMEAHGLNSPILTRSSQHGDRSFAHFLWLEQNPEGRNEEQEGLLPFIEEQLNTLSADIPLFSPQYPYHLLPTAIELRDIIDAFNAVEKDEQVEADIWKSDDVLGWLYESYNNYKKAAHKESKAKTEYNKVSIQSQVYTPGWVVKFLVDNSLGKLYLEMFPDSTIKEKYKIANAPAKPNRERKPLTEIRLIDIIMQSLIQFNYPKSYCAQGCAEI

SEQ ID NO: 2894 - protein, 309 aa, Syntrophomonas wolfei
MMEVATRQTVLQNTIYKRKKRLPLSVLDRRKSLYQVVSAHLPTGNKARIAYLHCIKDGKNIDPACGSGNFLLYAFDLLYDLYIDQINNYGADYDDDEIPELIIRHNLHGIDIDDRAVQLAQLGLHIKVKRQNRSVKIEHFNIVSSDFFLLDYPEVKHLFENGEKLSLELENIVTEMWDELQQAYKFGSLIRLEEKFSLRMQELVQQWDEGRLFKEQTLANYEQFRENFFTGLQNAVAHNTAKHGINFLNSKTGDAIRFLELLTQKYDVAVANPPYTDSNDFGPELKKFINSNYKKPYKFHSNLYAAFII

SEQ ID NO: 2895 - protein, 706 aa, Syntrophomonas wolfei
MRCYELINEEGKLALIHPLTFMYIKSFEDVRRLIIDKLHINVLVEFGMGGLFPQDIWVDPAFYILESKKHNVFESIFVSLDKYSNTFNQSRKKDFLLEAINDFNNGLNNKHLFKLEQSKFKLIEGLPFIYWISDGFREQFKEKTISELFNPVQGAATTNNHRFLRFWWEVNKSTISINFEVDKHRWVYYSKGGPFNKWYGNMWVLLDWKNNGQDLIDAGAVLRNSSYYFQEGITYSASGSKGASYRYLPSNCIFDTGGSCVFLKKEYKNLHYLIAFLNSPLSRYIINCLNPTVNTQVGDMQRIPVVIPLKEQEECISIFATKNIEIKKHLCSYRIIETNFDKTALTACSETALRDRLLSYLNYENAQLTLVLINEAIINQIVFDVYDLSPEDRRQVETQMGKPVGELPVIAEARDAYLASTTIESETVREFIQKLSITTFDEEKIHSVKDEFATLYQSNNDLDEFCIRHQLNPINVWYWFQESLVLPSGRAAEIALGFLADTCRTVLMEDEDGIIPLAGLPGESGLLDRLEHYYLNHGFTSAQFSQLDELLGRPINEYLEDYFFMNLSDLLNLFRYLPKTPFIWHLSSGPQQGFEAYIIIYKWNRDSLFKLKTRYLGKRVESLEFRQIQLADSKTAQAQNEKEKIRLQLQEIAEFTSKIDELIAEGYDPQLDGGVGKNIAPLQKKGLLRSEVLTAGQLDKYLKADW

SEQ ID NO: 2896 - protein, 106 aa, Syntrophomonas wolfei
MTGVMLVYLHRYQPAMVAILRTDYLHRLQDVLEVEKQHLQRTINDEAGSSSARKAAKELTRLDKQTLELKKYEELVHHYADMHIPLDLDDGVKVNYAKLGELLAKI

SEQ ID NO: 2897 - protein, 1183 aa, Syntrophomonas wolfei
MNKSNLRNFAVMARTELIERVKQKAYELGITEEKVKKARIEASDAIYINGKALDSVQVKQRDSLIAAIDKKGYTQVMEEIAYTWFNRFCALRFMEINDYLPTGVRVLSSTVAGSVEPDIMREAFNLDFDFSGDKERETYREKVYEMKEKNDQNGLFKYLVIKQCNSLHDILPFLFEKIEDCSEILFPDNLLQENSFLRNMTNPEIIPEEDWQEVEIIGWLYQYYISEKKDEVFANLKKNIKISKENIPAATQLFTPHWIVGYLAENSLGRLWMLNHPQSRLIEKMEYYIKPEQDEEDYLIIKSPEEIKVCDPACGSGHMLVYAFDLLYAIYEEAGYMPTEIPEKILTHNLYGIEIDKRAGELAAFALVMKARQKHRRFFRQGIQPHICVLENIHFEEDELKNYQEEIGHDLFTANLFPTLRLFEEADNFGSLIRPVITDVSDILQLLEAQDLSGNLFFNATHQKVLQALQQVDYLSPKYHVVIANPPYMGGRGMNGRLKVFADKNYPDSKSDLFAMFIERGFDLIVERGYNAMVTMQSWMFLSSFEKLRESILNKYTIISMAHLGARAFDSIGGEVVSTTAFVINNDHYQEYKGAYLRLVDGRNEAEKEEELILTRDNPYRASAADFKKIPGSPITYWVSEKIYKIIDNSQKLGDISEARMGLATGNNDRYTRLWFECSLKNIGFSMLNRTHAQKSALKWFPYCKGGNFRRWYGNNEYVVDWYNDGKQLQCNMHPSGTRVWAHNFNLDYIFCDSITWSDITSGILSVRFNDKGFLFDGSGTCAFFKDSNQKLAALGLLNTSFVRDFSKVLNPTLHFQTGDYRVIPYRTELENRDFLFGVRKLINLSRIDWDSYETSWDFTELPLLKPEYHEPTLQETYQGLRTHWQEMTLEIQRLEEENNRIFIDAYSLQDELTPEVPLSEITLTCNPYYRYGDDKSEEELEERLLLDTIKEYISYAVGCMFGRYSLDQEGLAFAGGDFEPSLYKTFPADRDNVIPILAEDYFSDDIVTRFVDFVRITFGAATLEENLEFIADTLGKRAKETARDTIRRYFLNDFYKDHVQTYKKRPIYWLFTSGKEKAFNALVYLHRYQPATVAILRTDYLHRLQDVLEVEKQHLQRTINDEAGSSSARKAAKELTQLDKQTLELKKYEELVHHYADMRIPLDLDDGVKVNYAKLGELLAKI

SEQ ID NO: 2898 - protein, 72 aa, Syntrophomonas wolfei
MIDISKSDWDSYQTSCSARKAAKELTRLDKQTLELKKYEELVHHYADMRIPLDLDDRVKVNYAKLGELLAKI

SEQ ID NO: 2899 - protein, 1168 aa, Syntrophus aciditrophicus
MATLSSELRNKLERVVIEARDAAETAARAALETLAVHHHEPYPHMNPVQRELRNHLRARARQLGDRKLHKPDRSGKDHAIYHLTGDCAYEHWHRMLFARFLAENNLLIEPEENMAISLDEAGELARDEGVDMWVFASRCAQKMLPQIFRPDDPLLQVSFATEHILKLEKLLASLPWEVFTASDGLGWVYQFWQSKKKGEINRSEVKIGADEISAVTQLFTEPYMVEFLIHNTLGAWWAGKRLKAEGAASAGTEDELRAKLALPGLTWDYLRFVRGQDENGGPWRPAAGTFEGWPKAAKDIKALDPCCGSGHFLVALLRHLVPIRMDEEGLSANNAVEAVLRDNLHGLEIDERCCQIAAFALALAAWTYPGGGGYRLLPPLHIACTGIRQQATEEQWVKLAEQSGMPTQATEDDRIKNGLLNLHRLFSQAPILGSLINPKQLKADVFTADYEMIQPYLAAVLKAEEVDDETHEQAVAAAGMAKAANLLTGKYTLVITNVPYRQADDLDRTLLEYAEKNYPDAKTDLATVFYCRLNDMLSLTGSSAVVLPQGFLYKDYYARLRKRLFREHNFYVIARLGARAFRGINGEEVKVCLVIADKLNSTKKIVISQYLVTSGDADEKQQNLQVIAEVLVAQEDALVSAKYILRGEQKAKERLLEEYAWYSNGIQTGDYPRFGKCFWEVPAFLTQWSLQLSTVQESVTYGGREQCLLWESGCGSLHQFIREKVGPSRVKSWVRGLNCRDRRGVAISAMGELKATLYSGEIFDDNTVVIIPKSVDHFDALWAFCSDALYDRLVRKIDQSSKVRGALLRVPFDLAHWQKIAADKFPNGLPEPESDDPTQWLFHGWPEESTATLQVAVARLMGYHWPAELDCMMRLSEQTRALVKRCRELSKFVDEDGIVCIPSVHSEEPAAIRLNALLAETNIEQAKMRELTGGIDLDDWLRNSFFEQHCKLFHDRPFVWHIWDGRKRDGFHALVNYHKLCEGDGKGRRLLESLTYAYLGEWITRQKDGVKRGEEGAEDRLAAALELQKRLEAILAGEPPLDIFVRWKPLQKQPIGWEPDINDGVRLNIRPFLASDLPGCRTGAGILRYKPNIKWTKDRGKEPQRPKDEYPWFWGWDEKTVDFSGGETFDGNRWNACHYTNKVKQIARETAKKEKSNASKCSDNGLLW

SEQ ID NO: 2900 - protein, 704 aa, Tepidanaerobacter acetatoxydans
MDKSLIKNYAVWARNKLIEDISQRAYELGITENEIKKPEEVSQDYIRINGKKLKSFEINQRKSLEAKIREKGFEQVVEEVAYTWFNRIIALRFMEVNGYIPTGVRVLSSAEPGKTEPDIITYAEHIDLDLNQEVVARLKDENDTEELFRYLLVKQCNKLNDILPGLFEKIGDYTDILLPKNLLSEGSIIRRLVSDIPEEYFKEQVEIIGWLYQYYISEKKDEVFAGLKKNQKITKEKIPAATQLFTPKWIVKYMVENSLGRLWLEKISGQEIVGSGKWVVDSKKLKEKWKYYIDEAEQEPEVEEQLKKIRAESKDMKPEDIKVLDPAMGSGHILVYAFDVLFDIYKSAGYSEREIPKLILENNLYGLDIDDRAGQLAYFAVMMKARSKNRRIFRENIDINLCSIQESNGIPEETITYFAGGKKFISKTELEEKIKGKDNLSDADFEIQARYLIHVFQDAKEYGSILEVKKLDFDKTENRLEEIRQNHPGDAFEFGHKQILLEKLPPLIKQAKIMSSKYDVVVTNPPYMGRKGMNNALKKYVDEHYKDSKNDLFAVFMEVGINYLEQYGFMGMINQQSWMFLSSFEKLRSKLMKNITIINIVHLGPRAFNEIRGEVVQTVAFVFAKWRELYPTSMKQLKSSYIRLVDFSSAYEKKKKFINAIEDKNVNYRYDNVKQEMFSKIPGGPIAYWVNKKNCKHISKQTTR

SEQ ID NO: 2901 - protein, 452 aa, Tepidanaerobacter acetatoxydans
MISSKNSFGLRYVPKGFIFDSNGSAIFIDKDKIRYILGFGITKVASELLKILSSTLAFNISDVASLPIKLANSDKCLNKINHIVDLSISISKTDWDSFETSWDFKKHPILTHKGDADTIEQAFNNWAEFAEKQFYQLKANEEELNRIFIKIYGLEDELTPEVDEKDVTVSKADRERDIKSFISYAVGCMFGRYSPDVEGLVYAGGEWSDKWKIENGQWKVRKLVKDEDNDILEDTWIDATFAPESDNTIPITDEEYFEDDIVARFIEFLKVTFGEEKLEENLDYIAESIGKRKSETSRQALRRYFLKDFYKNHVQTYKQRPIYWLFDSGRQDGFKALIYMHRYDEHIAARVRIDYLHKLQRKYEDEIKRLDVIIDSNLSLREKNNARKAKEKLQKQIQECLEYDQVIAHVANQRIKIDLDDGVIVNYAKFQGIEIPQGEGKKPLKANLLAKI

SEQ ID NO: 2902 - protein, 1253 aa, Tepidanaerobacter acetatoxydans
MDKSLIKNYAVWARNKLIEDISQRAYELGITENEIKKPEEVSQDYIRINGKKLKSFEINQRKSLEAKIREKGFEQVVEEVAYTWFNRIIALRFMEVNGYIPTGVRVLSSAEPGKTEPDIITYAEHIDLDLNQEVVARLKDENDTEELFRYLLVKQCNKLNDILPGLFEKIGDYTDILLPKNLLSEGSIIRRLVSDIPEEYFKEQVEIIGWLYQYYISEKKDEVFAGLKKNQKITKEKIPAATQLFTPKWIVKYMVENSLGRLWLEKISGQEIVGSGKWVVDSKKLKEKWKYYIDEAEQEPEVEEQLKKIRAESKDMKPEDIKVLDPAMGSGHILVYAFDVLFDIYKSAGYSEREIPKLILENNLYGLDIDDRAGQLAYFAVMMKARSKNRRIFRENIDINLCSIQESNGIPEETITYFAGGKKFISKTELEEKIKGKDNLSDADFEIQARYLIHVFQDAKEYGSILEVKKLDFDKTENRLEEIRQNHPGDAFEFGHKQILLEKLPPLIKQAKIMSSKYDVVVTNPPYMGRKGMNNALKKYVDEHYKDSKNDLFAVFMEVGINYLEQYGFMGMINQQSWMFLSSFEKLRSKLMKNITIINIVHLGPRAFNEIRGEVVQTVAFVFAKWRELYPTSMKQLKSSYIRLVDFSSAYEKKKKFINAIEDKNVNYRYDNVKQEMFSKIPGGPIAYWVNKKIVNIFQNKLLGDMAKVRKGMDTGNNERFLRYWYEVSRCKVGIGLRKGEDTIKFAKKWIPYNKGGGFRKWYGNNEYVINWLNNGLELKEHKSANLRSINLYFKEALSWTLISSKNSFGLRYVPKGFIFDSNGSAIFIDKDKIRYILGFGITKVASELLKILSSTLAFNISDVASLPIKLANSDKCLNKINHIVDLSISISKTDWDSFETSWDFKKHPILTHKGDADTIEQAFNNWAEFAEKQFYQLKANEEELNRIFIKIYGLEDELTPEVDEKDVTVSKADRERDIKSFISYAVGCMFGRYSPDVEGLVYAGGEWSDKWKIENGQWKVRKLVKDEDNDILEDTWIDATFAPESDNTIPITDEEYFEDDIVARFIEFLKVTFGEEKLEENLDYIAESIGKRKSETSRQALRRYFLKDFYKNHVQTYKQRPIYWLFDSGRQDGFKALIYMHRYDEHIAARVRIDYLHKLQRKYEDEIKRLDVIIDSNLSLREKNNARKAKEKLQKQIQECLEYDQVIAHVANQRIKIDLDDGVIVNYAKFQGIEIPQGEGKKPLKANLLAKI

SEQ ID NO: 2903 - protein, 1167 aa, Thauera sp.
MNKAKLKTYAPQARKDFIAAVTQRANLLGLSESAGKFEALPAERRGDVVLIAGREWPARVAQQRERLVRRIQRDGFGYTMEAVAYTWFNRFAALRYMELHDYLGHGHRVLSSATAGGLPDILAHAADLAASRELPGLDTAHIAELKLAGNKDGELYRLLLVAQCNALSTAMPFLFERIDDETELLLPDNLLRTDSVIAKLVAEIPEEDWAEVEIIGWLYQFYISEKKDQVIGKVVKSEDIPAATQLFTPNWIVQYLVQNSVGRLWLMANPASTLKSEWPYYIEPAEQTPEVNAQLDVLIQTRMAEDGGSLNPESITVLDPACGSGHILVEAYALLKGIYLERGYRLRDIPRLILEKNLYGLDIDDRAAQLAGFALLMKARADDRRLFNDPPRLNVLSLQESKGLDLDELATHLAPFGVQRATVKALLDTFEHAKTFGSLIQIPDVLNAQLPALAEALGKAKETGDLYAQMAAQDLMALVEQARVLGRKFDAVVANPPYMGSGFMDPVLKAFVERRYPMEKGDLFSCFIRQGEQVSTPTGFIAFVTMQGWMFLSNYESFRRDFLQRNVISSLLHLGNGVMGIAFGTCSAVFQRSPIKAFAAKYIQVDASQLSDEGEIDLSESIATVRSINHFQSSPGLALAYSLEPHQMALFDQNPPISEKVEAREGMTTADNGRFLRYWWEINTEQINRSALSEADAKNSPRRWYPYQKGGEAVKWFGNNQWVVDWQDDGAGVKGNVDPNTKRIRSHNYNGVYSFREGITWSSFSNGGLAFRYVPPGSLFDSTGSMAFSSSNLFGYLALLNTPSVFRFLKAYSPSPRIKIESLLAIPDILQNHDINELDELSRECVQISSKISRFEEVSPTFAINKEQDLLSPKALSSTFKAWRSRITENEIRMEELLSKGFGFSEHGTIDNGTGGSEFNARHLISYAIGCMMGRYSLDEPGLIYAHAGNVGFDSTRYKTFPADADGIVPITDEFWFEDDAANRVREFLRAVWGADTLDENMAWLAESLGTKAGETADETIRRYLADKFFKDHLQTYKKRPIYWLFSSGKQGAFQALVYLHRYHEGTLARLRAEYVVPLTGKMQTRIDMLEKDAAAAPSTAARNKLNKQIEKLRKKHVELLAYDEKLRHCADMRISLDLDDGVKVNYGKFGDLLAEVKAVTGGTGEE

SEQ ID NO: 2904 - protein, 1134 aa, Thermacetogenium phaeum
MPVLSAEQRNKLERTVVEARDVAEAGARAALEALAVHHHEPYSHMSSEQRRLRNHLRARARQLGDKQDKSGKLEIIHLIQECAYEYWHRMLFARFLAENDLLIEPEMGVAVSLDECDELAREEGSDLWTLASRFAQQMLPQIFRPDDPVLQVAFPYEYQLKLEQLLDDLEPDIFKASDALGWVYQFWQSKRKKQVNESGNKIGADELPAVTQLFTEPYMVNFLIHNTIGAWYAGRVLAENPQLAGQAESEEELRRAVSLPGVTWDYLRFVRTGDGEGPWRPAAGTFKEWPKRAAGLKILDPCCGSGHFLVAALYHLVPIRMAEEGLTAREACDAVLRDNLHGLEIDERCTQIAAFALALAAWTYPGAGGYRSLPQMRIACSGIAPNAKKEDWLALAGDDERLRNGMARLYELFQDAPILGSLIDPGSAIENNLFEAGFDELRPLLEKAMSVEKDDYEQHELGVAACGIADAVQILGGRYHLIITNVPYLARGKQANKLKEFCLKYYNEAKNDIATVFLNRLLRLNSPEGTTALVLPQNWLFLTAYKKFRTRMLKTRRWDIVAKLGPGAFETISGEVVNVVLLAISTSAPSDGHTFAGLDATAPRTAREKDRFLCIGELRTVDQSNQFKNPEARVTITEIPLVDETLGQYCSILQGSSTGDEPRFVRCFWEFNSFNVRWKLLLSAPDEGVYSGRSHVWDWPNDNCELAKSDGARIQGLEAIGKQGFFVSGSRRITASIYNGEFYSKVLATIIPFNSLNKLAIWAFLESDVFEREVRKLDQKILVTPGVFANVPFDLEYWQKVAAEKYPKGLPEPYSDDPTQWIFHGHPTVSTSPLQVAVARLLGYRWPAELDDSMRLSAEARRLVRRCRELESYADNEGIVCLPAVRGEDPAAERLRALLAAAYGDDWSPEKERELIAATGSEAKELDEWLRSDFFEQHCKLFHHRPFIWHIWDGRRRDGFHALVNYHKLAGGNGKGRQVLESLTYSYLGEWITRQKDGVKRGEGGAEDRLAAALELQKRLIAILEGEPPFDIFVRWKPIEQQPIGWEPDINDGVRVNIRPFMASDLPGGRKGAGILRWKPNINWRKDRGKEPRRPQEQFPWFWNNGQFTGDRVNDVHLTNEEKRKARENANRSR

SEQ ID NO: 2905 - protein, 1203 aa, Thermoanaerobacterium thermosaccharolyticum
MDKTAIKNFAVWARKKLIEDIKQKAYEIGITEKEIKEPEITTSDTMIIGDRTLNKAEMEQRKSLVSRIKGKGFNNVIEEVAYTWFNRILALRFMEVNGYLPTGVRVLSSIEPGKKEPDIIKEALNTDLDLDRELVYRLQDANDTEGLYRYLLVKQCNALNEILPGLFEEIEDYTEILLPSNLLAEGSVIRQLVDNISEEDFKDQVEIIGWMYQYYISEKKDEVFEGLKKNIKITKENIPAATQLFTPDWIVRYMVENSLGRLWLEGHPNEELKSKWKYYLEEAEQEPEVQKQLEEMRAKSKDIRPEDIKVLDPAMGSGHILVYAFDVLYDIYKSAGYSERDIPRLILENNLYGLDIDDRAAQLAYFAVMMKARSKSRRIFREKVNLNICAIQESNGFPREAIDYFVNHDETEIEKQKLRGDVEYLINVFNDAKEYGSILEVKPIDFEAIEKRIEEIRNGGTGNLFEYQYRNIILEKIPALVKQARIMSQKYDVVVTNPPYMGYSGMNINVINYIIEKYPKSKTDLYSVFIEQCSKLVKNDCFFAMITMHSWMFIKSFIEFREYMLNYKLTNMVHLGERAFEELSGEVVKTVAFVYRKRKCLQYKPVYIRLVEYNSCEEKEKEFFNINNYYVKQSLQKIKELPGVQYVYRMTDKLIKNYNGKLIEEVTDYNGAQNKTGNNDKYIRFKWEIDDTKFKKDWYGITKGGKFRRWYGNLESVIDWSVDARNFYKNNKTSCIMNEDYLFREGICWTKSAFGNKPSFRYLNNQVLYETAAPTIHVKNSENFKYILGLLNSSVGNVYIMYRNESNSYQLIDIIKIPFIQPKDRLTKNRVIRLVDVCIELSKTDWDSFETSWDFKKHPLLVHKGNSNIIEEAFNNWAVFAEKQFYKLKANEEELNRIFIEIYGLQDELTPEVEDKDITIRKADRVRDIKSFISYAVGCMFGRYSIDAEGLIYAGGDFKDKWKCEDGQWKVRKIIKDEEGKVIEDKWVDATFMPDMDNVLPITDDEYFEDDIVSRFIEFLKVTFGEDTLEENLNYIADTLGRKSSETARQAIRRYFLKDFYKDHVQVYQKKPIYWLFDSGKQDGFKALIYMHRYDELTVARVRTDYLHKLQKSYEAEIKRLDIVIDSNASQREKANARKKKEKILKQIDECLQYDQVIAHVANQRIMIDLDDGVSVNYAKFQGIEIPQGEGRRPLKADLLAKI

SEQ ID NO: 2906 - protein, 1513 aa, Thiocystis violascens
MTPAAKNALATTIRALRERLLADLHAATESAYRLSIRVQDAGLSEAAQARRRRLEGWIAEQRRAQPNAEIARDDDDFRREAEKQAAYTLLNRLVMLRLLEAPGPAGSEHEKPLRAPAMLTGGWESQAYKDFRQLAPALARGDETEGYAFLLRLVFEDLATELPGLYGSAGVAELIPIPAATLRHLVEAFDRPELESCWRDDMTLGWVYQYWNDPEREALDAKLHGGAKLAPHEIASKTQMFTERYMVDWLLQNSLGVLWLTICRKHGWTPEAETDGTLERLEERRVEWRARRESGEVTLTELMPLQTDSERRWAYYVPQPIPEDAVEQAPASLRDLRLLDPAVGSGHFLVAALDLLFALYLEEARHRRLAEHPDWTDRAILEHILAHNLHGIDLDPRAVQIAAAALWLKARRLAPDVRPERLNLVASNLRLASLPDDDPALLELRLEVEREIGLPAALTDTLVHALRGADHLGSLLRIDRAVEEALERHDLELGRELPAQGDLFDGFSEPQRTPMGREEARATLLDRLERFLGRHTGGDDLGLRLRGEQLAAGVRFMRMLGAGRYDLVVANPPYQGTAKLADVRWVERHYPLGKADLYAAFLLRGLELVREGGVSAMLTMRNWMFIKQYAALRAHLLERFDLRALGDFDRGAFEDVPDEVVSVAVSVFRKSDPCGESVAICPTPRDDRSRDGERTQRKRVATVCQIGRCKFDPAVLKVVAEWPLVYWWDNSFIKHYDALPKFGDLYEIRQGLCTGDNARALRFCWEVKQYQVKVSANRNDLFGNSIWLPFMKGGEGRAWEEPLLLVVNWCFNGLEIKVGHEAGLLAARPQNEAFYLTRGVAVQTTGSDFSARLHRYNSVFGDKARSIFPENSYQVVALLNSAKARELVSALNPTIDFTVGDLKRLPFWPVPESRALVELIEHAFTEHEVHREPSVEFKHPGPSPWRHAQDWAQTAVDRPEGAPLPDYAPEYDLEPPTDHLSFALGVALGRFGGGPGLGGEGILDPQSADLTHALPDGLCFLDITLDAEDRRDSLGHPAAAPLHAAWDRYGPALDTRRKSLREWLALDCFKDVHRSMYENRPIHWSLSSANRTFVAWVNIHRFTERTLRLLLADHLQPALTRLDGTLADLRAARDGADPKAARAAERRLAVSLKARDELADFIAAVEQCADRGPPPTDPKCPARERDARYDPDLDDGVMINAAALWPLLDPQWKDPRKWWKELASSQGKKDYDWSHLAMRYWPERVDRKCQADPSLGVAHGCFWRYHPARAWAWELRLQDEIAPDFRIEEPPYRPGGDDIGDPGDDLHRDAFLRENPEKALEIVEKEAERRIGRGDQRNVVSELILLESGLWTARPGLIWAMELRLSGRQDAHFRLRAPDEPHARADFLRDCPQQALAAIEREAERRIRSRGRRRPVPELCILEAGLWSALPAKVWEIELRLAGRQLADFHFRAPDEREARAAFETENPGFVRDREAFIASLVVQQEIFDGTDDAGEEEPSDEGMAEEDEEEVE

SEQ ID NO: 2907 - protein, 673 aa, Thioflavicoccus mobilis
MSLFLRLLGEEDKGAALLEAVRAVAAGEADPRVFDVEPASFEQVPGAPFAYWVRDGIRRMFRLHPAAESDVRRFTKGLCTTDDFRFLRLYWENRGEKQAVRWFHFVNGGSTTRFYQAVNIAINWYKDGLELKAFLDGKIGKENQWSRWINSVTYYFRPGITWPLRTGRFSPQVLPTGTIFSVRSYAAFMPKDALLCALGLMGSSALDFLLKLSLGRSGHPEFVIGVIQQAPFPQLASSECAILADTARTAWSLKRKLDTATLTSHAFLLPALLQVQGKSLDTRCGSWSDRMQQTEQALAEIQSEIDARCFDLYGFDEADRAGVMASDSLGESGQSDDAETGDGDEDESSGPSADPKVLAAEWFDWLVGVAFGRFDLRLATGEREAPPEPEPFDPLPVCSPGMLTSDQGLPLNEPPSGYPIAFPADGILVADADEVQGQVGSDLMSRLRSILRILAVRIEGGDAPGLAAEALEAELCRLLGTKTLRDWLRRPSGFFADHLGRWSKSRRKAPIYWPLSTESGAYTLWIYYPRLTDQTLYTCVNDHIDPKLKEIGADLERLRGNGDLDAKTRKRADALLELQREIQALREELLRVARLPYKPDQNDGVLISAAPLWKLFRHNPWRNALHSCWETLETGGYDWSHLALALWPERVRALCRTDKSVAIAHGLEDLYGG

SEQ ID NO: 2908 - protein, 663 aa, Thioflavicoccus mobilis
MAFDTATRNELQKLVGRVRDLLVKEFTAQCQTLYGIQPDGTALALEKLEHRPENEQTLARLLRDRIDHLAAGLSGSKRRAEAIDRLVREQAFTVLNRLCALRMCEERGLVQECVRQGMGSKGFQVFEKSAASLGGDTFSRYRLYLDLLLDELAIELGVLFDRFAPTGLLFPGETALKALLEQVNVQTLSHIWGEDEAIGWVYQYFNDREAIKATKKQSQSPRNSRELAERNQFFTPRYVVEFLTDNSLGRLWYEMRQGRTALAEICRSLVRRPDEVFLGPDDDHAAPPGTSVVPFRAKKDPRDLKILDPACGSGHFLLYAFDLLLVIYREAWADTHSPRSDLTGTTLAEDYASEADLERATPALILRHNLHGIDIDPRAAQIAALALWLRAQRAWRDQRLKPAERPRVVRTHIVCAEPMPGEKETLADFAGQLRPPVLGQLIQVVFERMRLAGEAGCLLRIEEEIRTAVETARAQWLEGGRPEQTELFPELAGPKQQELRFDLSGVTRDAFWDQAEGRILSGLRRYAEEADLGADMGRRMFAEDAAAGFAFIDLCRQHFDVVVMNPPFGAASTGAKNYITKTYPRSKNDLLAACVERGIGWLHPGGLLGAITSRTAFFLTSFRNWRQGVVLGDAKPLVMADLGHGVMDAAMVEAAAYVLRKQG

SEQ ID NO: 2909 - protein, 1208 aa, Vibrio cholerae
MNTNNIKKYAPKARREFMDAVAKRLNTFGITANKKGELQIAEANLQGSVLQIAGNSFDGKLAEPRKRIVARSQKLGYTQLIEQVAYTWFNRLCAIRYMEIHDYLGHGFRVLSHPDNPKGFEIIDHAQDAADELGLDRARIIELKLAGNKDEELYRELLLGQCHKLHEAMPFLFDALDDETELLLPDNLTRTDSILRGLVDSIPEDDWQQVEVIGWLYQFYISEKKDQVMGKVVKSEDIPAATQLFTPNWIVKYLVQNSVGRQWLQTYPDSAIKTQMEYYIEPAEQSDEVNQQLKAITPESIEPETIKVLDPACGSGHILIEAYNVLKAIYEERGFRSRDIPKMILENNLYGLDIDDRAAQLSGFALMMMARDDDKRIFTRNVRLNVLSLQESNHIDLPTLWKALNLSGSWQSGTSQGLFSDDEQDLSSFNADNRYQLLKRTLARFTQAKTFGSLIDVPNDDHEQLKELLCTLVELQESGDSMQKPAAKQLIEFVHQALVLSIRYDAVIANPPYMGGKGMNVELKNFAVERYPNSKSDLFAIFMERGFSLLSQDGFNAQVNMQSWMFLSSYEKLRNSLLENQTLLTMAHLGARAFGQISGEIVQTTAWVFKNGYVRGHQPVFFRLTDGNEQEKKLALIEQQTRLDEVQQEDFLIIPGRPLTYWLSSKVFELFKNNKSFGDIYDARQGLATGDNNKFLRYWWEVDFSKIFFDAKSIEESMTSGCKWFPYNKGGSFKRWYGNHEYIVNWESDGCEIRNFFGENGKLLSRPQNTKYYFKPSISWSDINTSYNSFRYYPHGFIHDATGHSAFNWNENEKRIALAFCNNKLASELISALNPTIHFHIGYFNALPYVQNLIDADLSHVDELITLMKLDYDSRETSREFSLCLASHDSEKISDWFRNKLALNELHINSVQSLEKKNNEITLEACGLLDVYGTDLDEKEISIEKITACDIAVNIVSLSVGCMLGRFLLKKGNDALQDKVKFNLEFYNSKEEEIFYQIDEDGIIPLTDKEWFKDDATNRFREFVQVVWGEEHLQENLDFVAESLCLNAIKPKKSELALETIRRYLSTQFYKDHLKTYKKRPIYWLFSSGKQKAFECLVYLHRYNEGTLSRMRTEYVTPLLGKYDAYAEQLEKQIETADSTSEANRFKKELDALIKKQVELREFDDKLKHYADMRISLDLDDGVKVNYGKFGDLLADVKAITGSAPEVN

SEQ ID NO: 2910 - protein, 1246 aa, Vibrio cholerae
MKLVDHVDHLRELIEAAFDKQFARLGFSKTKQMDATQVEKLPEEVKTKRERFAVMLENHIGETGGYESAREKLLDELTFTLFNRLAAIKVMEAASLFPPILTKQKEHGDRSFGHKAWLEMNPHMRDEELEGIRDYLKSAFDELGQTLPLYSKAYPYALLPDAISLNDIIDAFNVVDTDAQANDSSEETIWQSDDVLGWMYESYNNAKKKAHKDSGDKTEYNKVSLQSQVYTPRWVVQFLVENSLGKMYLEMYPHSEIKQRYKIANAPTTQIRAPKPLHEVRTIDPACGSGNFLLYAFDFYYELYLDQIENYGADYDEKDIPKLIIENNLHGIDLDDRAIQLAQLGLFIKAKKKRRTVGELHFKVVSSDFYLPEYVAVKHIFEQGNLVSAQQREFIEKVWGDLMQAYKFGSLIHIDKELKEQLSQVKERALGETFDSTQKLKKKIVEGDLFAAADYAEHQEFAENFFANLFAAVEQYARTERNTFLSGKTRDAITFLELLTTEYDLATANPPYTDSADFGPDLKEFIEDNYKKPHKFNTNLYATFIKRCCELTDKDGKVAMVHPPTFMYIKTFEDVRKYMIEKTSIDLFVEWGYLGMFHQSARVDAAMYVLDKNKQEKDSTFIKLNHIYEGKRYNAFVEAYDNLIDGVAYQNNYTIPQSKLKIIKSWPFIYWISDDFRAKFGEEALGDNNKALTGLMTGNNNKFLRFFWEVNPANLSDHYPSDSKRWVGYQKGGPFVRWYGNNWCVVDFSSNGEKLATTDNREFYFKEGISYSASGSKGVSFRQIENKYSFDKGGPCVFNIQQKFTNEYLLGFMNAKLCGYIVDCLNPTVNRQVGDIRRIPIAIPTKSQDSGISILVKTNVEIKKRLCQFSIVESLYLYSPFIFFTQGEFKFRLSGFYNLENHLITQILLNEAIINEKIFEVYDLTEHDKAMVLAKEGVSIGGLPITLEARAAYLSETEATKEFPLDAIREFIEALPLKKFSAEEREAIESGFGSLYQSNNDLEEFCIRHQVNPINVWYWFKQSKVIPKQRMQTLAMEFLANMIREILMEDEDGIIPLVPNAGEKVLLDRIEEKFFEKGFSTAQYSSFDSVLGRPIHDYLNKYFFAELSDHLNLFMYLPKTPFIWHLTSGPEQGFDCYIIIYKWSRDNLLRLRSVYIENRERALQNRQSDIAGNESAEAQNEKERIFKQLKEIDAFKKKIDELLAEGYNPILDDGVGKNIAPLQKKKMLAYDVLNAGQLKKYLNADW

SEQ ID NO: 2911 - protein, 1159 aa, Zymomonas mobilis
MDTNALKKFAQSARNLLIDQVTARLDMVLVEGAAARREHPKAIAKLEAAANSNRAQVIEHAAYTWFNRFTALRFMDVTGLTNPRVVSPADGATRPEILAEAMAGNLPDRARPEIAEYLNGTRPAHDGQAKAYRLLLIHACNEWHGAMPYMFERADMLDRAEDYTELLIPDDLLSPDSILARLREVMTEDACQDVEIIGWLYQFYISEKKDQVFAGLKKNQKITAENIPAATQLFTPHWIVRYLVENSLGRLWLLNRPQSKLALRMDYYIAPEEPETDFLHITRPEDIRICDPACGSGHMLTYAFDLLYEIYAEEGHDTAEIPGLILKHNLTGIEIDDRAGALAAFALSMKAAARLGRRRFLRMEAKPDIVVLQDVRFTPAEMQDVAAVVGKDLFTDELRETLGQFEQAKNFGSLIVPKLRDPAETLRVVEARDFGSDLLLKEVQARVVAVLRMGEALSPKHHVVLANPPYAGASGLNEQIQVFAERFYPASQTDLFGMFIERSLSLAVRHGLSAMVTIQNWMFLGSFEKLRLSTIERSSIVNLLQIGFNSFPELNSKVVQAAAFVLEKAAHDKVGVYINANDAPQSANKDEVFLNRKSSNEKYFVSSDKFAKIPGSPIAYWLSETAIQAFESGESLGDHFSISEGLKTGENEKFIRLWHEPAASRTTHFSKAANWVPHSKGGEFRRWYGNYNWVVEWGRNGSALRASGKAGFQGLPNYGKKGATWSKITTSPYCVRLQPEGLIFDSACPGLFEKGQVKLEQAMGFLNSKACRTIISALNPTLNYQVGNVSCLPIVSDARGDGVGITTASALISLSKSDWDAYETSWDFGTLPLLSPDHRAETLAASYANLRAHWQGMTGEMQRLEEENNRIFIDAYGLADELTPEVPIEEITLTCNPAYRYGVKGSEEDREARLREDTVAELLHYAVGCMFGRYSLDAPGLILANQGEGIEDYLARVPEPTFAPDRDNVIPVLDADWFADDIVTRARDFLRVTFGEAKFRENLAFIEAALGKDLRKWFTKDFFDYHVRRYKKRPIYWMFSSPKGSFNALIYMHRYRPDTVSVVLNQYVREFIHKLEVERTRLEKLALDPAATPAQQTKAQKETATVIKQIAELTEWEREVVYPMAQQKIAIDLDDGVKRNYPLFAGALKPIKGLEAADD

SEQ ID NO: 2912 - protein, 1198 aa, Magnetospirillum magneticum
MNRNKLKTYAPKARRDFIAAVTARAIKFGISKDAIEPVQVQGNIALIAGQAHPRKVADQRLKLEARVKTRGFEQVMEEAAYTWFNRFAAIRYMEVHGYLDHGYRVLSHPEGKATPEIVEHAQHLDLPGLDKEKVIELKLDGTKEGDLYRMLLMAQCNALNSAMPFLFERIDDETELLLPDNLLHSDSVIRQMVIEIEEADWQEIEIIGWLYQFYISEKKDQVIGKVVKSEDIPAATQLFTPNWIVKYMVQNTLGAKWLATYPQSGIRAKMEFYIEPAEQTDGVNTKLAEITPKELNPEEITFLDPACGSGHILVEAYDLFKDIYLERGYVLRDVPRLILEKNLFGLDVDDRAAQMAAFALLMKARNDDRRILEKHQKMNVKSILSSKKLNIDDQKIASDSNKFELIPSDDLLPETIQQPMLSMSAATATQTLAELVAIFRDADSIGSLTKIPERLLKRLPILRNLAEKQLLSRDRLEDSLAAKSAFFALKLIDQAETLSMHFDCVAANPPYIGNRAGMNDTIKQYAQDYFNNARGDTFSMFVARGLEFCRTGYMSMVTLDSWLTLSTYEYFRSDILNNSTILSLAHMPYEGKKPTAMGINFGVACFTLRGVCSKYMGYFIRQRYVDLIGDGSLKSLSAFTGLGKRIDGGQFLNAPANAIVYGLSDQGRRKLFSATPLRDLVDAREGMATAGNDRFLRWWHEVPYGNIAFNINSGTEAVESGSKWFPYNKGGEYKRWFGNIGLIVNWENDGLEIKGNIDPITQRVRSHNYNGDYAFLPGLTWTSMSSKGTAARIMPNGFMFDAKGPMAFGSQETINFAAALMNSVVGRFFLSSLSATKDFKIGHILALPVEKSMISKNSIHEYVNELWGLAKNEWASFETSWEFQSPPLISGHCIKNAFVEWQAKCHRSYSRSGELQRHVDEELVDEYGLAEELGDKYESGEITLYIGDNQSDVFWLASYSIGCMMGRYSLDEPGLIYANSGNVGFDPSRYTTFPADDDGIVPIMQADWFDDDATNRVVEFIKVAWSPETLAENLKFVADSLGTKSGETPIDTIRRYLSTDFFKDHLKTYKKRPIYWLFSSGKEKAFEALVYLHRYNEGTLSRMRMEYVTPLQGRIASKIDQLGRDIDAAASTAAQNKLRKEQEKLKKQQAELVKFDEELRHYADMRIKLDLDDGVKVNYGKFGTLLAETKAITGGSEE

SEQ ID NO: 2913 - protein, 1162 aa, Marinobacter aquaeolei
METAKLKKFAQFARRSLLEQVTAKLKLVLADESPARRERPQAIKKLEEAVTDQGKEQVIERVAYIWFNRFCALRFMDVNRYNRIGIVSPAEGQFQPEILADAKMGHIDEEMVSESTRQKIFALLDGKTPSQDPQGEAYRLLVVAACNYWYSAMPFLFERIDDYTELLMPDDLLSGNSILAYTREAMTPDACEDVEVIGWLYQFYISEKKDQVFADLKKNKKVTPENIPAATQLFTPHWIVRYLVENSLGRLWMLNRPGSSLIEQMDYYIEPEEPEEAFLRINSPEEIKICDPACGSGHMLTYAFDLLYAIYEEEGYEPADIPAKILTHNLYGIEIDERAGELAAFALTMKARAKQRRFFRKPVQPNVVVLENVTFTESEMQDVAGLVSKDLFTDELHETLCQFEKAKNFGSLIVPKLREPAKALRAIEELDFGSDMLLKEVQARVMVVLRMSEALSPKYHVVVANPPYGGAKGLNEELNRFAKKAYSASKNDLYAMFMERAFELTQTCGLMAMVNMQSWMFLSRYEALRSKLLDVGTLISMAHLGERAFDTIGGAVVSTTAFVVKKAHFPDFKGVFLRLTGGSSEADKSRLARESILEKTRNWYTACSRDFETFPGTPIAYWATPQFLRAYRGGDKLGDIADTAVGLFTCDNERFLRCWYEVNDKDISHTTESLSETTLKYYPYNKGGGFRRWYGLNELVVFFQNEGVEIRDHRKSSGQSWSLPGEKYYFKEGITWSGLTSDANSFRWSDKGFVFESNKGQMLFSDSSNELLPFLNSKVCEEIVSLINPTLSLQSNEVKKIAYIRPSKAAVENMSKKLVQLSRSDWDSYETSWDFTAIPLLSPEYRGEKLEDSYIRIRTHWQSMTDDMQWLEKENNRIFIHAYGLDDELTPDVPLEEVTLTCNPHYRYGNNKSEEELESLLLADTMRELVSYAVGCMFGRYALDKPGLILANQGETIEDYLKQIPEPSFPADDDNVIPMLDGDWFTDDITERFREFLRIAFGEEHYGENLRFVEQALGKDIRKYFLKDFYNDHVRRYKKRPIYWLFSSPKGSFNALIYMHRYQPHTVGTVLEYLRDFKDEKLKARKDHLEAVSISAGASQGEKTKALKEIEKINKILVELDDYERDVLYPLATEQVEIDLDDGVKANYPKFGEALKKIPGLS

SEQ ID NO: 2914 - protein, 1178 aa, Nostoc punctiforme
MNRTAIKNFAIWARRYLREQVKARAAQFGITHKSITEPQTVAGGLLVAGQTLNTTEANQYHQLRNRLQDLTLSSSQSQAVDALIDEIAYTWFNRLAALRFMEVNGYIGRVLSSSDPNLVDPDLLRDASSIAEMGDLPGLDLDTLNEWRSFANRDPNPDEFLYRRLLLAQCKALAEGIPALFDPRQNYQALFLPGNLLNQDSIVRRLVKEIPEEDWQNIEVVGWLYQFYISERKDEVIGAKSKVAAADIPAATQLFTPHWIVRYMVENSLGRLWLEAHPESRLREYMPYYLENPNDNGEGEKPQALTPQELTVIDPACGSGHILVYAFDLLFEIYKEQGYLERDIPALVLTHNLYGLDIDERAAQLASFAVLMKARAKNSRILRKSLALNITAVRPTHSQTLPPATELNAEDWQPLIEAFKDADNLGSLITTPAFDGEKLKWQLNNLEASDSLFRECVTALQALLLQAELLRNKYWVVVANPPYMGSKSLNDVLRSFANQNYPDSKSDAFSIFIERFLNMSLQNGFIGLMTPFTWMFLSSYEKLRRRILSENTITSLIRPEYHAFFDSAYVPICTFTILNKALPEYQGTFIDLNQFYGANLQPIKVLEAIKNPGCGYLYYSNSVDFARTPGSVIAYWLSEKLLNIFENAESLGNVFESKQGLSTANNDRFLRLWFEVNLNDSGFGLCSREEAKFSGKRWFPYNKGGEFRKWYGNQEFVINWNNDGEEIDSFRPKAVIRNSSYYFKPSVTWSLVSSSYFGVRYSGKGFIFDSAGSSAFCQSDMIFSLTGFLCSNITNKLIQAINPTLNFSSGNVAALPWISEKANIIKPKINSIVENCINISRQDWDNFETSWDFQTHPLLRHNTKHLSEAFTIWQSKSETAFRELQRLEEENNRYWIEAYGLQDELTSEVPDDQITIRHADLNKDIRSLISYAVGCMMGRYSLDKPGLIHAGQPFDPTLHQTLSASSDAIIPITDQAYFDNDIVTRFIEFLRVAYSPETLSENLNFIANALTLKNGESAQERIRRYFLQEFISDHIQTYKKRPIYWLFTSGKKRAFGALLYLHRYSEDALARIRTDYVLELQVKLDGEIARAQQQLDNTTFSAAKKAATNRLKELQAQQLELRDYQAKLQTQADARINLDLDDGVAYNYTRFKGLVYEGADLKIADLEKASQWKRELLK

SEQ ID NO: 2915 - protein, 1174 aa, Rhodobacter sphaeroides
MDTTKLKKFAQFARRALIEQVAARLEAVRGEGSAAQREHPVAFKKLQASIAEHGADDVIERVAYIWFNRFTALRFLDVNELSAVRVVSPLPGQFQPEILADAKAGNINEQLVPEATRRKVRDLLEGLTPSQDPQAEAYRLLLVAICNSWQTTMPFMFERIDDYTELLLPADLLSNASILAYLREAMTPDACQDVEIIGWLYQFYISEKKDQVFAALKKNKKIEAENIPAATQLFTPHWIVRYLVENSLGRLWLLNRPGSKLAERMDYYIAPKEPETDFLKIGKPEEIKVCDPACGSGHMLTYAFDLLYAIYEEEGYEADKIPALILANNLTGVEIDDRAGALAAFALAMKAAAKLGRRRFLRMEAKPDICVLQDVKFTDAELRDVAAVVGKDLFTDELRETLGQFEQAKNFGSLIVPKLRDPAETLRVVVARDFDADLLLRPVLERLEKVLCMAEALSPKYHVVVANPPYMGSKGMNKTLESWAKKHFKDSRADLYAMFMERSLALCVRHGFTAMINMQSWMFLSTFDSLRSKLLTQNAIVSMAHLGERGFDTIGGAVVSTTAFVLGKAYSPRTEGVFLRLVSGRNEAEKSTAARAAVSGVNSDVKFCSSAADFQKLPGNPIAYWASEAFLRLFDEGKPITDFVSSRDGLTTGDNEAFIRYYWEPAFESVGFGYADAKDFWKSGRKFAPLIKGGSYRKWFGNLSNVITYDKQHYEVLAVSGNKLPSREKYFQRNLNWTRISSPSGSFRYTEPGCIFESASLCTYSDSDQDMFYALAGANSCITIPQLDLVNPTTNLLSGYFDMLHLPEHDAAARSIAAGNAKQLVSLAKSDWDAYETSWDFTTLPLLSPDHRAGTLEATFARLRAHWQGMTDEMKRLEEENNRIFINAYGLQDELTPEVPIKEITLTCNPAYSISGDKTETEREDALRVCTMQEFLSYAVGCMFGRYSLDAPGLILANQGETLAEYLARVPEPSLLPDEDNVIPVLSEEFESWFPDDIADRFRKFLRVTFGDAYFRENLAFIEAQVGDIRKYFSKAFYDDHVKRYKKRPIYWMFSSPKGTFQALIYMHRYRPDTVSVLRNEYVVEFIRKLEAERAKLAKQSDDPSATQAQRAKAEKAIGTIVKQIAELEEWEREVIFPLAQEKKKIDLDEGVKRNYPRFGAALKPIKGLEEADE

SEQ ID NO: 2916 - protein, 1119 aa, Runella slithyformis
MNTNALKRFAKEARLKLLSQVARKLEFVLTQDTAELRGKTKELSQLRQKIRDLGQAQVIEMVAYTWFNRLVALRFMDANGYTLPKVLTPLPGMTNPEILQNALGGTLDPDLTLDRQRLNDLLDGRTAAADARTDAYKLLLVAACNQWSKAMPFMFERISDYTELLLPDDLLSDFGIVADIRNGMSDEDCQQEELLGWLYQFYISDENERLIKSKSIYQKHELAPASQLFTPKWIVKYLVDNTLGQVWAEMNPNTTILDKLEFYIEPSYKNQLSTRSKKRLEDIKFFEPCVGSAHILSYAFDVFYLMYEEQGYNSSEIPELILKHNLFGVDIDERAAQIASFVMMMKGRRKHSRFFRKQIEPNITFYQNFENDPKFNNVKALGSLVKVEPNEIDTLKVEGGSLFTERQEKLKKLYTFLGQRYDCVVTNPPYISSSRMEGSVKQYVEVNYPDTKADLFATFIVRCLELCNEEGLTGYMTPFVWMFISTYQKLRNNLIDNHLINNLIQLEYSGFDGATVPICTFTLRNKNIQDAKGSYVRLSDFKGSENQGPKTLEAIQNPHCGWFYTANQKDFEKIPGSPIGYWASPHLIKCFEEGGSIEDITVSRNGMTTGNNDRFLRKWFEISNKNLNVNINDISQKLDVGTKWVPYNKGGEYRKWFGNIVDVLFWFDHQNVLFKNKNTIVRNRNYYFKDGITWTLLSSSYFGVRSLEIGSVFDVNGMSMFTTNVHVDKYYLLGLLASKLSKKFLEIINPTLAFQVGDINKIPILTSLKSNNISKIVLKNIEISKKDWNLKESLSWDFQQNELIKQQKGAVSEALESYQSYWSEKFYELHGNEEELNRQFIEIYGLQEELTPEVPLEEITILQEEAKIVNGALSIEPVPVLLQLLSYTVGCLFGRYSLDKEGLILANQGETLQDFLQQIPNPTFLPDEDNIIPVLEGEWFNDDIVGRFRAFLKAAFGEEHFDQNLRFIEDTLGKDIRKYFVKDFYNDHIKRYKKRPIYWMFSSPKGHFKALMYLHRYQPDLCSKLLNDYLQAFISKLEAAKHTQTMLSVREDISAREKIAANKEIDKLELMLKDCRDYERTLFLIATQKINMDLDDGVKVNYQKFKEVLVPIKGLESDE

SEQ ID NO: 2917 - protein, 1441 aa, Halopiger xanaduensis
MDGQSTQPRKAQLDKEEREHLEDVVTEMRDRVEANVRYQLEDEYDLDEKPDDDASLSEEQEDLVEAIELEAVDGNDWDDGYEQYITGVGYTIVNRLAALRCMEVRDFIDDEVTAFRDDGLTPAADRLVTEEFMLEEEAVLEAYRNACDDLAEEIDILFDRSTAYSQLDPDDDTYEDLCGMLDEVSDEVWRADDVLGWVYEYYNVNLLDDLRRKGDREGLEPEDVPAANQFYTPHWVVRMLTDNSLGKLYLEDNGTLQETVDRQDSLTPDERKNRPLSPDESPDIADFCTYLVPSEEEGEPPEFDGPEDIRVIDPACGSGHFLLYAFDVLERIYRAETDLDHAEIPREILRNNLYGVDLDMRACQLAAFNLYLKGRTRAEAEGASGFDMPEVGIVCADAKVADIEGVEEVFDEVADGKSDVEDALRRILDAFEEVHGLGSLLDVRGTLGDLFEDDSEQAGVQITLGDDPREDHTLGQILHSLRDAVDQHREEDSFLAQDLRSFVRLLDVLAQDYDVALMNPPYGSKNRMPDVVQDYVEEHYRYSSEFYINFFEVCDRVSKEDGRIGMLVPRSFMYKNRYQDFRSDFIGDEGSFDFLAEYGIGILDNATVRTVGTVVQSGANQGSKGSFLRLHDIQTEQKEQVFTEVLSDSNDNEVIRSFDIELQEFDKIPRTPICYSIPQEIRALHECETKLDAEHAGVDGESICNAVPGLQTADDDRFVRRFWEIDDYEVFKPIAKGGADAWLVPPVTETVEWSGNGTILKRSSKSIRTRNESLYGNKGLSWTYIKDTGRRFGYYPGGLFSHTGFMLFPKTEKSLWKMMAILNSTLYHNLFLSLTTERHWNAGEVGSVPWVESIDKQDGLESAAREQYEIMVEQRANDPSSPYYTGPSLLPTESGDSFYSHPHSRSLSESEASIDPSTISVSDPIRPAARKEEQARLKRRQQLENLSEQIDSQVFSAIELSSEVQDRARQEIFLRTSEDPEDREVPNPESVPEVPDNLDEQVKDLVHHFAMKAVREESDGIIPLEGTDEQADMLNHIVEQFEDAYGEHAEDRLVEVDDILGAESAADEAYPNLRSFIEDELFAYHVDTMENTPIVWKLSTARLLADAKGEGFACFVDYHQLDASLFDRLSNQYLEPRKAELRERRSAANQRRNNESLSTSERAEATDEFEFCSSALEQIAELEEVMQELGSTSEREFDDDDRERVSKLAPKVAAFREETAERIETLKRLREMNGEEWFQDTFSDNFWNAVDEWRDEWVDALEELEHACEEYAKPSDEPVEAHLADLFDYFNWRLKGSDHYSSTGILFMTYYFEREGSDLLDDDGEPFDNLTEDEKLLASLATGIDDASVLDEEYLQQIADDEGVDNVDELPPLAEFKALAEEIDDRCQTVDKQIPSDWSDRALSEITTAGYQPVHKHGVAINITPLAEKDIVPEVVEDKVL

SEQ ID NO: 2918 - protein, 1430 aa, Halorhabdus utahensis
MDNIQDTSAGLNQTSADSHMEGDSTTPRKAQLDKEEREHLEDVVTEMRERVEANVRYQLEEYDLEERPNKDTSLSDEEEGLVEAIKLEAVDGNDWDDGYEQYITGVGYTIVNRLAALRCMEVRDFIDDEVTRFREDGLTPAADRLVTEEFMLEEEAVLEAYRNACDDLAEEIEILFDRSTAYSLIDPDDDTFEDLCVMLDEVPNEVWRADDVLGWIYEYYNVKLLDDLRRKGERQGLEPEDVPPANQFYTPHWVVRMLTDNSLGKLYLEDTGELQNVVDSQESITPQERKNRPLSPEKSAELADFCTYIVPSEEGGKPPEFGEPADIRVIDPACGSGHFLLYAFDILERIWRKETKVDHKDIPRKILKHNLYGVDLDMRACQLAAFNLYLKGRTRTEAEGGSDFEMPKVSIVCADAKIADIEGIEDVFDEVISNSSSIKSALSEDDVEEALNNIVRSFEDIHGLGSLLDVRGTLGEMFSDDSEGLQLTFEDDFTADYTLSGFLHTLQEAIAEHDNNESFLAQDLRSFIRLIDILAQEYDVALMNPPYGSRKRMPDEVTEYVEEHYRYNPEYYINFFEVCDNITKENGRIGMLIPRSFMFKKWFKQFREDFVGGEGVFDFLAEFGLGILDNATVRTAATVVRSGVEGDDTGSFIRLYDVESESKEEAFLDTISKSDDIKRKRLYNVQLSEFSIVPETPLSYSIPSEIRYLHDTDLKIDAEVAEIDGNSISTIATGLQTGNNDRFLRKHWESISDDFRPYAKGGADAWIIPPAIHTVNFNGGGREIRAAGRARFQNSQFYGKEGLSWTYIKDTGRRFGYLPEGYVFDVAGSMVFPEEDYSPWRLMSVLNSDLYHCLFLSLTPERQWNQGDVGRIPWISDLDDEEELIDISKEQYQLMISQRVYDPTSPFYIGPALLPDQSNVEFFYNHPVLDKIEEISKTDFSGSNPAVSVTEAVQKAQQRKSRKSSQLEQLATQVDEIIYDELEIQDKVRQKIISEIALRTGEDPENREISSALVESVGDTQHQIKLLLHHFAVESIQQKSDGIVPISSERGHPNIFDAVKERIENAYEGHAEDRLAEIDDLLGSRSADEEAYPNIRHWVSNDLFEFHTDTMENTPIIWKMTTSGLTSDREEDGFACFIDYKQLDAALFDRLSNQYLEPRKAELREQRSAANQRQNNESLSSTERAEATEEFEFCTNALEQIAVFEEVIQELAMANTRDWDQSKQNIASNLESKVKDFREKTEKRLRLLEKLAQKDDVSLADIFTKTFYPTAQQEREEWTGSLKELEEACRAYSRDASEPVEAHYYDYLSYFDEVIGSTHFASNGILFMTYYFEDGTKYLEDGTPKEDLSEEGQILAELAVGLEDYINLAEEINEDCERLTKSIPSNWEDRALSEILTQGYQPKYKHGVEINIIPLSDKNIVPDIVEDKVI

SEQ ID NO: 2919 - protein, 1373 aa, Halobacterium salinarum
MRDRVEANVRYQLEDEYDLDEKPDDDASLNEEQEDLVEAIELEAADGHSWDEAHEQYITGVGYTIVNRLAALRCMEVRDFIDNEVTAFRDDGLTPAADRLVTEEFMLEEEAVLEAYRNACDDLAEEIDILFDRSTAYSQIDPDDDTYEDLCGMLDQVSDEVWRADDVLGWVYEYYNRPVVEALDAKNTLEPEDVGPANQFYTPHWVVRMLTDNSLGKLYLEATGQESAVPEPEALSPEERKERLVTPEDSPSVPELCTYLIPDEEAGDAPEFDHPRELRVIDPACGSGHFLLYAFDVLERIWWAETDLDRAEIPAKVLNHNLYGVDIDLRSCQLSAFNLYLKARTRAEAEDGQFEMPNVDIVCADARVAEVEEGTEVLDEITGEGTDLRGALGEIIDTFQHTEALGSLLDVSGTLEEVFESGQTGLSDWGDGTHQSLSSFLKALREAVDERSSDSFGEQNLKSFLNLLVVLTQEYDVSLMNPPYGSGGRMPDPVQEYVSDTYNYKEEYYINFFEACDRRTKTNGRTGMLVPRSFMFLKTFEDFRGDFIGGQGAFDFLAEYGIDILDNATVRTAGTVVRSGVETGQTGTFLRLDDVEKGEKESSFLHAAFVDAAEEGIQRRYTRKLEEFESVPGAPLSYWVPTKLRSWYDSETVLDSDNADLPERESYGVINQGTATADDQRFVHAFWEHPRNRDWSPFAKGGSDAWLLPRVKQTVLWGNSGKELSRYPKSYPRNTQYYFKEGLTYTVAKESGRRFGYLHDSSVFGHKGSVLIPNRAIWQALPYTNSHLFTYLMLAQTTERMWEVGQVSKIPWREQLEPVDSLETLSRKAIGHLISKRQYDFVSPHYTESILLDVLGESDTLDLYDHPHRELREELTLDSPSSTVDARASLSELGTAAATHLERIEAELQDCADEIDETVFNCFDVTEDQRETILQEIALRTNRDPREREEYDPDSITEPSGDFLEQVKDLLLHFTLHAVDDADDGIVPLSHIDDKDNLLTHIQSEFERVWGEHATDRLAEVDDVLGNRSAADEAYPNLRAWLEDDLFEYHVLKFDRTPILWQISSKRLVSDSEREGFGCLVDYHQLDASIFDRLQNQYLEPRRTHLREQRAAANSHRNDDSLSTSERAGAAEEYERCESGLEQLSIFEEQLGGLAESDPRDWPESNQERAEEAAQRVAKFRNRTVSRLDTLETLANLDDVDMEDLFSPSFYETVQENKDEWIDALDDLEAAFEAYATDGTEPVEAHLYDLFEYYDDLTGSSHYASNGILFMTYYFDQFEDAGQAQIGGAGVSERQRLLSELAADVDEYKELATVISEDCDAVATDISADWEERALSEVTTAGYQPNHKHGVVINITPLAEKNIVPEVVDDKVL

SEQ ID NO: 2920 - protein, 288 aa, Halorubrum lacusprofundi
MTDDSLSQRKAQLDKAEREHLEDVVEELRERVEDNVRYQLTQKGLDDEPEGPDTLDEDIEQLVEAIELEGVDGHTWDEAFEQYVTGVGYTIVNRLAALRCMEVRDFIDEEVTVFKENGLTPAAETLVHEEFLLEDEAILEAYHNACDELAEEIEILFDRSSSYSLVDPDDDTFEALCGMLDDVPDEVWRADDVLGWVYEYYNRPVVEALDAKNTLEPDDVGPANQFYTPHWVVRMLADNSLGKLYLEATEQESSVPAAEELSIEERKERLVTPEDAPGVPELCEGVIE

SEQ ID NO: 2921 - protein, 1298 aa, Halorubrum lacusprofundi
MPPQSATSATEFVEQAFETTVDDHARADLLQIIDDAVSTLRKKMKKDETVERMLRSGGGGSYVLKSSMTRDGLQPEPFTQSAVIEPLLDKLGYDYDTEAGGLSGGRTEVADYTISLRDYDDIDSTRLLIEAEPINKDLDSRKHGAGQVRSWLSQREFESDFGFATDGLRWMFIRYDPDSYTHNVIEEVDLQPVFVALFENQVGPREPLEEAVFDADLERVDTLLRTFEFANFRSIAGEARQVIKQKQEEITDEFYDDYIRYVFGIVNESEETPRSLTHDGVIAPEGATADDTRLFSVEMMNRLIFIKFLEDKGIVRPDLLQSILDTYEDGLYTDSLYQQFIQPLFYDVLNKRPDKRSPQIQDIELFADIPYLNGGLFRPSIQHDGSDDREQFKEADFDVRNSILRSILELLESYSFSTDGSVTDLDPSVLGNVFEKTINYITADNADQNKELGAYYTPKEITRFSAERTVRPALFDRLKQVVIEERGWPEAELENYDTVYELIESLPASMDLITTLLGEVDNFRVVDPACGSGHFLTSVLEEIVGVRRALWAHTDSYPHEQALKKTTVQHNIYGVDIVGPAVEIAKLRCWLSVIAELQQEDLESMDQEELALPNIAFNLRQGNSLIGYTGFPETTEDGDGYTLDSFNEDTVRTRYENIIDEITAYEEAIESEQAEQHRKEANRLLENARDELVDDVKDEFVAAGVDDITPEKVETFDPFHWVLEYAEVYSDGGFDVIVGNPPWDRLSPRRDDYFSRFDSAFRTLMPDEKQERQEELLTDPEIAEGWEEYKRETEIFATYFKNSDSYELQQPKVAGRTAATESDLSALFLERVFQIARDDGYLAQILPGAIFNGLSTKDLRLHLLDETSIDSLVTFENNGIFSDIDNRYNFGVVTFENQGETTDVRGIFKQTDVDILQNFEDQALSLSRRVLRNYSPEAAIFPYLQSQQEVDVLDTILQHPPISEEIGSSWYVEPYRELDRGNDVDRFVEDEEEGDYPVLGGSNIFQFAYSDAYFGVESPKFWSVDEDKDPELSAKKRIRGKNLRKLKRAVYDAFDGTGSQVGFVNDLLEKRRSKELSDEDVLLDCTEYRIVYRDIARSTDERTMISTVIPKGVVCHDKAPQLRPYSIEPSEKDLSEDTLHSAYKRIYSDEELFVATGLLNSLPFDFLMRTKIDSTVVFYKLKESQAPRLTKGDEWFEYIWRRSARLNCYGDEFAEMRDRLDGIEPVVDVTERRRVQAELDAAAFHAYGLNHEQTAFVLGDFHRVQSPRLMDEDYFQLVLEKYEQLAEVEVEQVQESTQ

SEQ ID NO: 2922 - protein, 1408 aa, Haloarcula hispanica
MYWENITDSHMDGNALAPRKAQLDKEEREHLEAVVTEMRDRIEANVRYQLEASDLADRPDDASLSETQETLVEAIELEAADGHDWEEAHEQYITGVGYTVVNRLAALRCMEVRDFIDDEVTAFRDDGLTPAADRLVTEEFMLEEEAVLEAYRNACDKLAAEIEILFDRSTAYSLIDPDDDTYEDLCGMLDEVPDEVWRADDVLGWVYEYYNRPVVEALDAKNTLEPEDVGPANQFYTPHWVVRMLTDNSLGKLYLEATEQEDAVPNPDALSPEERKERLVTPEDSPSVPELCTYLIPDEEAGDAPEFDHPSELRVIDPACGSGHFLLYAFDVLERIWWAETDLDRAEIPAKVLEHNLYGVDIDLRSCQLSAFNLYLKARTRTEAEDGQFEMPSVDIVCADARVADVEEGAEVLDDITGEGTDLRAALGEIIDTFQHTEALGSLLDVSGTLEDVFESGQTDLSDWGDGTHQSLNSFLKALREAVGERSSDSFGEQNLKSFLNLLVVLSQSYDVALMNPPYGSGGRMPDTVQEYVEENENYKYTTEYYINFFEACDRLAKADGRTGMLVPWSFMFNKSFQTFREDFVGGRGAFDFFSEFGYDILDNATVGTVGTVVRSEADSGQTGTFIRLPDVAKGEKEGEFIRASFEGSETGVKRLYHRDLSEFAMVPGTPLSYWVPRGLRSIYQSDTVLDADNAGLEDRETLGDIKQGTATADDSRFVHKFWEDRGAEWVPFAKGGADAWLLPRIKNTLLWGEDGTEVDRYPKSYPRNTDAYFNESLTYTVAKRSGRRFGYLHDSSVFGHKGSVLIPDRAIWNALSYTNSHLFTYLMLAQTSERMWEVGFVSKVPWRTELEEIDELATLAREAVGHLISKRQYDFVSPHYDGPVLLDALGVDDPLPQYDHPHRELRDELSLDSPTQTVSTADSLNQVGTAAAKHLARVEQTLQSCANDIDDAVFDCFDITDGQRETILQEIALRTIEDPREQEVYAPAAISEPSSDFPEQVKDLLLHFTLRAINDTDDGIIPLSEIDGTDDLLTHIEAEFERVWGEHATDRLAEADAVLGNRNASDEAYPNLRAWLENDLFEYHVAEFDRTPILWRLSTERLVSDATGEGFGCLVDYHQLDASIFDRLQNQYLEPRRTHLRERQAAANSRRNDESLSTTERADAAEEYDQCESALEQLSAFEERLGDLSQATPRDWPSVNQERAAEAAERVAEFRERTASRLDTLETLADLKDVDMADLFSPSFYETVQENKDEWVDALDDLQTAFEAYAEDGSEPVEAHLYDLFEYYDDLVGSSHYASNGILFMTYYFEQFEDAEQSQIGDTGVAERQRLLAELAADVDEYRQLADEIAANCDEVATDISGDWEERALSEVVTAGYQPTHKHGVAINITPLAEQDIVPEVVADNVL

SEQ ID NO: 2923 - protein, 1455 aa, Haloarcula hispanica
MDGQSTHPRKAQLDKEEREHLEAVVTEMRDRVEANVRYQLEDEYGLDEKPDTVGASADESSLAAAREDGDASLSETQENLVEAIELEAADGHDWEAAHEQYITGVGYTIVNRLAALRCMEVRDFIDDEVTSFRDDGLTPAADRLVTEEFMLEEEAVLEAYRNECDALADEIEILFDRSTAYSLIDPDDDTYEDLCGMLDEVPDEVWRADDVLGWVYEYYNVKLLDDLRRKGDREGLEPEDVPAANQFYTPHWVVRMLTDNSLGKLYLEDNGTLQETVEAQDALTPDERKNRPLSPDESPDLADFCTYLVPSEEEGEPPAFDGPEDIRVIDPACGSGHFLLYAFDVLERIWRAETDLDHAEIPREILRHNLHGVDLDMRACQLAAFNLYLKGRTRAEAEGATGFDMPEVGIVCADAKVADIEGVEEVFDEVAGGKSDVKDALRQILDAFEGVHGLGSLLDVRGTLDELFEDKIDQESVQITLEDDPRDDHTLGQILHSLRDAVDEHRQGDSFLAQDLRSFIRLLDVLAQDYDVALMNPPYGSRNRMPPSVKEYIDDHYRYPAEFYVNFFEVCDDITKNHGRIGMLVPRTFMFKARAEQFRSDFIGGEGSFDFLAEFGLGVLDNATVRTAGTVVRSGVEPDPSGEFIRLYDLEASSKEEKFVEVLSGDEPDVQRLFEVDLDSFSKVPGNTICYSTPEEVRDLHDTELRLDCEVSDIDGESIGYARQGIATTNDFRFMRFHWETDDFDTFNPIATGGSDAWILPQIVEVVRWRDQGTRIKRYSGTVRTPNEFLYGREGLVWTRSKETGRRFGYYPSDGLFSQTGYLFVPKDSDLLWQLLASLNSDLYHSLFLSLTVERDWVGGIVGRAPWITAFEGEEKLESLAKEQLSIMASTKTSDPVSPYYISPDILPITGDRGYFYQHPHSKKIDLVSEAKEQSPPKEESIIEAAKTAKTEGISTRQRLETLAENINSLVYDLAGISGNTQKQIEEEIRLRTGKNQNSESNETVSETPDNLEEQVKDLIHHFAVEAVREENDGVIPLKSADDQPDMLDRIVDRFHDAYGEYAENRLVEVDDILGAESAADEAYPNLRAFIDDDLFEYHVETMENTPIIWKLSTERLLADAKGEGFACFVDYHQLDASLFDRLSNQYLEPRKAELRERRAAANQRQNDESLSTSERAEATEEFEFCSSALEQIAEFEEVMQELGSTSERDFDEDDRELVEELAPKVAAFREETAKRIETLEQLREMNGEEWFQDTFSDNFWEAVNEWSDEWLEALDELENACEEYAKPSDEPVEAHLADLFDYFNWRLKGSDHYSSTGILFMTYYFEREGSKLLNGEGEPFDTLTEDEEMLASLATGVNDASVLDEEYLQQMADVEDVDDIDDLPPLAEFKALAEEINDRCQTVDKQIPSDWSDRALSEITTAGYQPNQNHGVIINITPLTEKNVVPEVVEDKVL

SEQ ID NO: 2924 - protein, 1402 aa, halophilic archaeon
MTDDSLSQRKAQLDKAEREHLEDVVEELRERVEDNVRYQLTQKGLDDEPEGPDTLDEDIEQLVEAIELEGVDGHTWDEAFEQYVTGVGYTIVNRLAALRCMEVRGFIDEEVTVFKENGLTPAAETLVHEEFLLEDEAILEAYHNACDDLAEEIEILFDRSSAYSLIDPDDDTFEELCGMLDSVKDEVWRADDVLGWVYEYYNRPVVEALDAKNTLEPEDVGPANQFYTPHWVVRMLADNSLGKLYLEATDQEEAIPEPEALSPEERKDRLVTPADAPTVPELCTYLIPDEDPGDAPNFDHPRELRVIDPACGSGHFLLYAFDILERIWWEETDLDRAEIPAKVLEHNLYGVDIDLRSCQLSAFNLYLKARTRAEEEDGDFEIPNVGIVCADARVAEVEEATEVLDDITGEGSDLLEALDDVIETFQHTEALGSLLDVSGTLEEAFDSSKTQAELSDYNGGAHQSLHSFLKALRRAVEDQTSDSFGEQNLRSFLHLLVLLTQEYDVSLMNPPYGSGGRMPNGVQNYVSDTYNYKEEYYINFFEACDRRTKTNGRTGMLVPRSFMFLKTFEDFREDFIGGQGAFDFLAEYGIDILDNATVRTAGTVVRSGVSGNSEGTFLRLEDVEKGEKEAAFLNHSFGNSEKEDVERLYTRDVSEFGLIPGKPLSYWVPQSLRKIYDSDSVLDEDNAGLPNRNGIGDIKQGLATADDGRFLRNFWEVNSPDIWVPFAKGGVDSWLLPRVVKTLYWGSNGSEIDRFTNSYPRNTDYYFSDGVTFNRVKTSGRRFGYLQEGSIFADKGPTIFTSVNPWRLISYTNSRLFTYLMLAQTTERMWEVGQVSKTPWRTELLGIEALEDLSKEACGLLISKRRFDFISPYYTNPVLLDIVGVEDDLQSYNHPHRKLQQELDRGLYSENLSLEASLSELGTAASVHLEQIEASLQDCADRIDEAVFNCFDISEDQRETVLQEIALRTNEDPREREEYDPKSITEPGDKFPEMVKDLLLHLSLHAVSSTDDGIIPISRIEGEDDLLTEIESEFERVWGEYADARLAEVDNVLGSQSAGEEAYPNLRTWLVEDLFDYHVSKFDRTPILWRFTTERLVSDPSGEGFACLIDYHRLDAGLFDRLQNHYLEPRKNFLSEQRTAANRRRNDDSLPTSEQAEAAEQYDRYESGLEQIEVLEERLVELVQPSLRDWDRESQNMAEEAAGRVAKFRRRTKEHLEVIDELAAMEDVDMGELFTDNFYEKVENQREEWITALEDLEKAFNAYAAEADQPVEAYLYDLFDYYTDDLLGSSHFASNGILYMTYYFDDFKQADQARLDDAGISRRQRLISQLASNLDEYIELGESISDDCKEISSKISSDWTDRALSEITTAGYQPNHKHGVEINITPLSDAEVVPKIVDNEVL

SEQ ID NO: 2925 - protein, 833 aa, Natrinema pellirubrum
MASDSLSQRKAQLDKEEREHLEDVVTEMRERVEDNVEFQLTQKGLDDEPEDVDSLDEDTQQLVEAIELEAVDGETWSEAFDQYVTGVGYTIVNRLAALRCMEVRGFIDEEVTVFKDNGLTPAAETLVHEEFLLEDEAILEAYHNACDDFAEEIEILFDRSSPYSLIDPDDDTLEELCAKLDSVPDEVWRADDVLGWVYEYYNVKLLDELRRKGDREGLEPEDVPPANQFYTPHWVVRMLTDNSLGKLYLEHTGELQDIVETQEKFSPDERKNRALSPDESTDIADFCTYLVPSEEDEEPTDFDHPEELRVIDPACGSGHFLLYAFDVLERIWRAETDLANEEIPRKVLQHNLYGVDLDMRACQLAAFNLYLKGRTRAEAEGADGFEMPEVGIVCADAKIADVSGVQDVFEEVADSRAGVEDTLEKILDAFEEVHGLGSLLDVRGTLGELFTDESGGQQLALTDDFTATHTLSNFLHALRDAVSEHRDEDSFLAQDLKSFIRLLDILSQDYDVALMNPPYGAQGRMPDLVQNYVESRYEYGPEFYINFFEVCDSLTTEGGRIGMLIPRSFMFKRSFHEFREDFIGERGGFDFLAEFGLGILDNATVRTVGAVVRSGASQTGTGTFIRLHDADSRQKEEVFTNEVLANTESEIKRVYNVPLADFGKIPKTPLSYYTPDILRALHENDLKLDAGAASIEGDSVCDVKTGLQTGDNDRFIRTHWEVPDFDDFVAFTKGGSEAWVLPQTSLALYWGDDGMEIKRQESSVVRNEQYYFDEGLTWTYIKEGGRRFGYFPSGGIFDQKGPMTFPNEDLSAWTLLAVLNSELFHGLFLSSVS

SEQ ID NO: 2926 - protein, 580 aa, Natrinema pellirubrum
MTRYLSLTPDREWNPGDVGRIPWDKRLQKQDELAAIAREQYKLVLEERVTDPVSPYYGGALLLPPEVREDFFYDHPHTNVADELPSIEQGELEASQSFSDTIEQAIEARENRHAHLKELQERANEIVYDSLDISSDTRKSIATEIKLRGNSSESSTSTQDPGEVLRSEVESLVHHVAMMVIDDAEDGIVPLESLENKPSIYEQVLSRFEKVYGDHTDERMAEIDEILGSRSSDHDAYPNLKKFLSDGLFEVHINQMEKTPILWRLTTDRLVSDSDQEGFGCYIDYRSMDSNIFDRLQKKYLEAQKADLRERRNTADRRRSDEALPTSEQAAATEEYERCMSSLSQIELFEETLQNLASSSPRDWTESDQKLAKDLLPKVNRFYEQTQMFLQTYDKLIELNDEDWLEDTFSQSFIETIENNKQMWLSSLDDLRTACEAYSTGNHEPIPAHLYDLFIHFEDELVGSVWPTSTGVLAMGYYPQREAEKYLNENGEPKETLSDETAILLARIAAQFDEYESLADEIESHCQSLSNRISSSWKQRALSEITTRGYQPIHKHGVRINITPLAEAEIVPKIVNEQVI

SEQ ID NO: 2927 - protein, 1425 aa, Planctomyces limnophilus
MTMTPDAKTKLSKTIRALRERLLTELNEAVDREYKFTLKNPKLDTKTKIKRQRLEDWLAEQVRTQTGKVKRTKEVFRSDAEKQAAYTLLNRLVLLRILEAVGLRKPKVVTGGWNSQGYKDFRELAQALVQSDDGEGYPFLLQLIFEDLAIDLPGLYGSAGVADLIPVPSPTIRAVVEALDDEALETCWTDDMTLGWVYQYWNDPEREALDAKINGGGKIEPHEIASKTQMFTERYMVDWLLQNSLGPMWLAMCQKHGWTPGVVADGTLDRLEQRRSEWRAKRDAGEVALTDLMPLETDAERRWAYYVPQPIPEDAVDHAPPSLRDVKILDPAVGSGHFLVVAFDLLFALYKEEAKHRGQQAGEQWTDQAIVERILEHNLHGIDLDPRAVQIAAAALWLKAQLVAPSAQIKQLNLVASNLGISRLADNDPSLVELRRAIEAETGIPGKLTMQIVDALKGADHLGSLLKIDQAITEAMHSFEKSLGMKDKVDRVLFGPELGSEIVIQSGGVDRAATEAGILSALENFLSRHTSSEELGLRLAGEQLAAGVRFVRLVKEGAYDLVVANPPYQGTSKMADVKYVATHYKLAKADLFAAFLLRGLQLVREHGVSAMLTMRNWMFIKQYSDLRQHLLQTYDLRALGDFDRGAFEEILDEVVAVAAACFARAPHRSESVAQCPTPREDRSRDNERTKRKRAATLCQVGRHTFDPAALKVVPEWPLVYWWDRAFLKAYSEVGTVGANSPARKGVCTSNNGWFIRRPWEISVNRIRHPRSVDPTCHWAPYVMGAAGKAWIEPVSFALEWSRHGLMVKVLNDYIYSSYSRTIQNQHLYFRKGVAFTTIGSAFTGRSFRVPSIFDTTGCSVFGADIANTTALFNSSKARSVLTSLNPTIHFTNGDVNRLPLFPIENADDVFSLVETAFTNHESHREPSVEFKRPGPSPWRQAQEWAQLAVDRPEGAPLPEYIEELDPEPPTDHLSFALGVALGRFGAGGEGILDPTKDDLSKALPAGILFLDGALGDDDRRDSLGHHAAQIIHDNWSEYGPQIDKRRSLRDWLREKFFPDVHKGMYENRPIHWPLSSGKKTFVAWVTIHRWNDQTLRVLLADHLEPALKRLDGEITDLTAARNSADRKQARGAEDRYADVKAWRDELAEFIHHVQECAERGPEPPDAKKPEREVDARYIPDLDDGVMINSAALWPLLDPQWKDPKKWWKELVAAQGKKDYDWSHLAMRYWPTRVDEKCQKDPSLGVAHGCFWKYHPARAWAWELRLQDEIGPEFEIKEASYRGDGGDSEHRINYLHKEPTEALAAIEKEVLRRKRKQKQPQSELTILEPILWSIVPDECWELELRLTEKQQVEFRLLAPDEPECRARFEQAHPDRVKSRCALVSKLSPPDLYVDLEDEDEAASADAEDLDTEDADAIDANTGEVEA

SEQ ID NO: 2928 - protein, 1324 aa, Anaeromyxobacter dehalogenans
MPTLTPDAKQLLSRTVRELRARLLRDLNDEAERRYRLSIPPEKAKLPEDLRRKRERLDAWLDERARTANPKNKREMESARARFLGDAVKEAAATLLNRLVLLRHLEALGLQKPVFVTGGWNSKGYRELREFAPALLGDETEGYAAMLRLVFDELALELPGLFGDVGLTRLFAVPPATLREVVERLDDPGLEPAWTDDTTLGWVYQYWNDPEREALDAKLNAGGKIEPHEIASKTQMFTERYMVEWLLHNSLGLTWLCICNRNGWTADAEAVLSVLDARRAEWRKKREAGEVAHDALMPIEGELEEHWKYYVPQPIPDEAVASAPASIRALKLLDPACGSGHFLVIAFDLLAGMYREEARHRGEVWSDREIAEAILENNLHGIDIDPRAVQIAAAAVMLKAKRQAKDARPKRVNLVAPVLRLGNLPDDDPALMRLRREVRAETGIPEELTSRIVKALAGVDHLGSLLKVDATVDEAIADSERILRPGAQLELGGDAGKTLERSPNEVRAALHEKLEQFLRQHSGEEDLGLRLDGEQLAAGIRFTRAAREASYDVVVTNPPYQGTARISGAEYYVREYPRAVADLYAAFMERALVLARPHGIAALVTMRGWMYLAQFEELRAALLDSCDIRSLADIGTGAFGSRSMDDVISSAMVVVRRGRPDGKAIALQAAPLADASRDSGKPLRRAAALLCGQGRYEFEAGWFEAVEGRPIIYWWDKGFLARYRAAKKLGEVAPGRNGMSTQDNVRFLRKWWEVRTEDVAVTRPLLRRNGFGLARWAPYVKGAAGRQWFEPMTDVVDWERFGLAPKVFCEHLYGSYSRTIKNEPLYFRRGIAFTVIGSSFGARAHRAESVFGHMGASVFPDDIPGVLCLMNASVSKYVLSSLNPGLHFLVSDVNRLPVFEVPDSAKIYAVVEHVFIDHESGREASSEFRRPQPSEWEYAQSWAQRAVDRGPLEALPPYSPEPVPAAGIDHLSYAVGVALGRFGSKGEGVLTESRGSALPLGMLFISAALGDGSLAHAACASLRNAWVEHQAGDCADLCTWLRTGFFKHHKSVYENRPIYLPLSSAKKSFVAWVSIHRWDAQTLSNLLAEHLHPEKRRLEGELEDLRHARAKGEKSGKGKAEKRFADVSKLLEELTAFIDLVTECAERGPPPTSPDEPLRERDARYEMDLDDGVMVNSAALWPLLEPQWKDPKKWWKELATANGRKDYDWAHLAKRYFPERVEKKCVEDPSLAVAHGCFWRLHPAKAYAWELRLQDEIRQEFTIDEPGSEKARAAFLKSHADEAKAIRLKEQERRERKSRKSDPEENLSLSLESSEVEAEAEEVE

SEQ ID NO: 2929 - protein, 1497 aa, Haliangium ochraceum
MTMTPEAKRQLSTAIRGLRARLLDDLHDATESAYRMGVRAQDAGLREAPRARRRRLETWIRDQLRAQPNAADADADAAPSKTSKTSKNAKKTKAAKTAAKSAAPARDKDAIRRDAEQQAAYTLLNRLVVLRLLEAAGLRKPAVLTGGWSSPGYSAFRDLAPALVRRLHEVDAHEQDESEGFTFLLGLIFDDLAHDLPGIYGPAGVAELIPIPAATLRHIIETLDDPALASCWHDDMTLGWVYQYWNDPAREALDAKLNAGGKVEPHEIASKTQMFTERYMVDWLLQNSLGPMWLAMCQKRGWTPACQADGTLDALEQRRSQWRAQREAGEVEPTALMPLHGELEQRWAYYVPQPIPDHAVEHAPGSVRELQILDPAVGSGHFLVVAFDLLFALYQEEAGHRGEHGHERWRDDAIACSILENNLHGIDIDPRAVQIAAAALWLKAKKRSPEAEPACMNLVAADLRLAALPEHDRGLSLLRREVERETGMPAALTDRIIEALRGADHLGSLLQIDRAVDEAIREHETELGRLQPEQGEFWKELGPERRAKISNEEARAGIVARLERFLEQRGGQEDLGLRLRGDQLARGIRFLRMIEPGRYHLVVGNPPYQGTSKMADTAYVQAHYPRGKADLYAAFLERGLQLVRAGGTSALLTMRNWMFIKQYSDLRQWLLKSYDLRALGDLAIGAFDEVPNDVLSVVISVFRRVEPQPEASVAQQPTPPDDRSYDRQRTLRKRAATLCHVGRHAFDPAALQVVPEWPLVYWWSEKSLREYQIGPLIGEVAPATFGATTGNNVRFLRFAFEVPLLMVDPPEWKTAWVPFIGGAKGRAWVEELREAMHWNALGLEYRVFCERSLGANFRSPSLQFKRGVAFAMIGDSFSARVHRYASIFGDMGSSIFPDYNATAVCAMNSARSRNVLSSLNPSLHFGVGDVNRLPLFPVANADEIYATIERAFTEHESHREPSVEFKTPGPSPWRHAQDWAQAAVDRAEGAPLPPYQAEPDPEPASAHLSFALGVALGRFGAHGEGILDPATADLSHALPAGVLFLDGTLDSSEQGDGLGHPSCQDLHRVWRERGGDIDPAFDLRSYLRVRFFDDVHRQMYENRPIHWPLSSEKKTFVAWVNIHRWDAQTLRALLAEHLHPTQTRLEGQLTDLRAARDGADKSAARAAEKRYAKLVGWRDELAAFVAALTQCAEHGPPPSDGKCPPRQVDARYAPDLDDGVMINSAALWPLLAPQWKDPAKWWKELATAKGKKDYDWSHLAMRYFPDRVDQKCQADPSLGVAHGCFWRYHPARAWAWELRLQDELEPAFQIVEPPYAPPGLAGDDASTGDPGHEAHRAAYLREHAEEALQAVEKEALRRRGRGQDAAAIAELALREPGLWSRHPALCWALEDTLIAKQSAPFRLRAPDEAKARAAYLAAHPQAAKARARLLDELQPSQTALAIADSDAGKTAGKKAGKTAGKTAGKTPGTKTGKKAGKKPAGKKAGKKAGKKAAGDAS

SEQ ID NO: 2930 - protein, 1484 aa, Haliangium ochraceum
MTMTPEAKRQLSTAIRGLRARLLDDLHDATESAYRMGVRAQDAGLREAPRARRRRLETWIREQLSAQPNAADADAAPSKTSKTSKNAKKTKAAKTAAKSAAPARDKDDIRRDAEQQAAYTLLNRLVVLRLLEAAGLRKPAVLTGGWSSPGYSAFRDLAPALVRRLHEVDAHEQDESEGFTFLLGLIFDDLAHDLPGIYGPAGVAELIPIPAATLRHIIETLDDPALASCWHDDMTLGWVYQYWNDPAREALDAKLNAGGKVEPHEIASKTQMFTERYMVDWLLQNSLGPMWLAMCQKRGWTPACQADGTLDALEQRRSQWRAQREAGEVEPTALMPLHGELEQRWAYYVPQPIPDHAVEHAPGSVRELQILDPAVGSGHFLVVAFDLLFALYQEEAGHRGEHGHERWRDDAIACSILENNLHGIDIDPRAVQIAAAALWLKAKKRSPEAEPARMNLVAADLRLAALPEHDRGLSLLRREVERETGMPAALTDRIIEALRGADHLGSLLQIDRAVDEAIREHEHALGRLSPSQGHLFEGHGPAQRTLISSEQARAGIVARLERFLEQRGGQEDLGLRLRGDQLARGIRFLRMIEPGRYHLVVGNPPYLGTGKLRDSEEFKRSYPDAPMDYFAGFFLRGVEFLRPGGACAFIALSNWMFLRTYETFRKRMLENHLGVLAELGKAAFSTGGTLISTAMAMFRRLPPGEAKSLGFRTFEDYEVRRDEAQPVRTECALLCHVGRHAFDPAALKVVPEWPLVYWWNDKTLHEYRSSPLLGELAPATFGATTGNNVRFTRFVFEISSQSSDATMLDVGWVPFINGAKGRVWFEELREAMHWQNAGLTYRVFCETSTGANFRSPHLQFRRGVAFSMVGSEFTARVHRYRSIFGNKGSSVFPDDLVGAVCAMNSTRAREILQSLNPGIGFEVGDVNRLPLFPIANADEIYATIERAFTEHESHREPSVEFKAPGPSPWRHAQDWAQAAVDRAEGAPLPPYQAEHDPEPASAHLSFALGVALGRFGAHGEGILDPATADLSHALPAGVLFLDGTLDSSEQGDGLGHPSCQDLHRVWRERGADIDPASDLRSYLRTGFFDVHRQMYENRPIHWPLSSEKKTFVAWVNIHRWDAQTLRALLAEHLHPTQTRLEGQLTDLRAARDGADKSAARAAEKRYAKLVGWRDELAAFVAALTQCAEHGPPPSDGKCPPRQVDARYAPDLDDGVMINSAALWPLLAPQWKDPAKWWKELATAKGKKDYDWSHLAMRYFPDRVDQKCQADPSLGVAHGCFWRYHPARAWAWELRLQDELEPGFRIVEPPYAPPGLAGDDASTGDPGHEAHRAAYLREHGEEAVQAVEKEALRRRGRGQDAAAIAELALCEPGLWSRHPALCWALEDTLIAKQGAPFRLRAPDEAEARAAYLAAHPQAAKARARLLDELQPTQTALNIAAGDAGKKAGKKAGKKAGKKAGKKAGKKPAGKKAGKKAGTPAAGDAS

SEQ ID NO: 2931 - protein, 1231 aa, Burkholderia thailandensis
MIDRAKLLADLKLQVRALEADLRQRFVSNASEYKSRLTAEWQAARDAGRTSEDVAIWAEAQFTQSAVAWVLACVFVRFCEDNDLLDAPLISGTDGRGQSAVSRQEAFYLQSPTASDNDYLREVFAVAGRLPGLSDVLKVQSSLLLAPVSADMGKQLVRFFRATNADSGSLVHDFADPEWNTRFLGDLYQDLSEAARERYALLQTPEFVESFILDRTLTPALDVYTLEEVDLIDPTCGSGHFLLGAFERLAPRWLRKRPENVNLALQEALGRIAGIDLNPYAVAIARFRLLIAALKMASVKKLRLAPDFHLHVETGDSLLHGFDQRDYAGAQVSLALDTPQENLAAVADHLYRHAFAAEDLTATNRILARKYAAVVGNPPYIAVKDRAVSALYRERFSSCHGKYALVAPFCERFWALAKPLDNAQRAGYVGLIVGNAFMKREFGKKLVEEFFPSVDLTHVIDTAGAYIPGHGTPTVILAGRNRLPASPVIRAAMGIEGEPSKPDDPSQGIVWRAIVDQIDQRDSESKWISVSDIDRSTLAKHPWSMGGGGASSLKEAIEDSAEKILADFADSIGITSFTLEDNAYIHDSQTFRRQGVEVQLLRDMVVGDEVRDWFNDCESTALFPYDANYSPIRLAAFRKAFAFLWPYRTCLSNSKMFGGQTKVEAGLNWFEYGRLTAGKLVTPLSITFAFVATHNHFVLDRGGKIFNRSSPVIKLPAGTGEDEHLGLVGLLNSSTACFWLKQMFHNKGSTVDQHGARQRTSAFEDFYEYTGTGVGKFPVPNVRPVQIARQISDLAIECSRHLPAALIARGAISRKELDASRAESARIRSKMIAWQEELDWKTYSLFDVTDEELCFDKDPPEVKLGERAFEIALAQDCTAGIAATTWFDRHRSQPITSVPTHWPSDYRALVEKRIAAIRKSRDLALIERPECKRRWVSDEWDALEKAALEQWLLNRLEAADLWPHDALPAPKLRSVRELVDALSGDEEFRRALDLYAGSGSDAHVTVVALVQQASVPFLDALRYSESGLRKRAVWRNTWLMQRREDALDAEVARQLTDEPIEAIKEEQAKRKAAEVGVVPVPPKYKQVDYREGVYWKLRGALDVPKERFVCFPGLERSNDAGSPMLLWAGYDAKARALALTGYLYEMLQREGADVARLTPALAGLDELLPWVHQWHPEADDDLGMSTGDYLQGLLDAQLAQHGLTLSALRAWQPEAPVRRKRGKRGQHVAQA

SEQ ID NO: 2932 - protein, 1202 aa, Candidatus Accumulibacter
MINAAALLRDLKRLTTTIESDLRERLAATPDLDASLDNEWQAARNAGRMAATLHDFKEEAITQAAVHWLLMGVFIRFLEDNSLIDRPWLSAASPAQRALAQDRHESYFRAHPGDSDLEYLLAAYRDVGRLPGLGPLFDERHNPLFRLAVSGDGAMAIVGFWQKIDPDTGTLLHDFSDPEWSTRFLGDLYQDLSEAAQKKFALLQTPEFVEEFILDRTLNPAIAEFGYREVRLIDPTCGSGHFLLGGFARLLECWQKNEPGRNARDAVQQALNGIYGVDLNPFAVAIARFRLLIAALKACAETSLAEAPNFRFNLAAGDSLLHGPRLGHGQLALGGEAENLGRGALAHAFASEDLPDLNRILGQRYHAVVGNPPYITVKDAALNAAYRARYLTCHMKYSLGVPFTERFLELAIPGSEREPAGYVGLITTNSFMKREFGKKLIEDFLPRIDLSHVIDTSGAYIPGHGTPTVILFGRNRAPLTSVVRTVMGIKGEPSTPDDPALGLVWRAIVEQVDVAGSESAFVSVADTPRSTFAKHPWSIGGGGAADLKEMLESGSERTLGDVANVGVGVVTLEDDAYQIPSDLVGRRSFPKEFVRGFVVGDIVRDWFFNTHSVAVFPHVDKSFQASLAPEIYRWLWPLKTGLSNRIWFKKTQLQRGYEWFAYGHISAEKFNTPLTITFAFYATHNHFVLDRGGRVFNRTAPVIKLRAAASEGEHLGLLGLLNSSVACFWLKQVAQNRGSTVDGKGARQRTDPFEDFYEIGAGIAAKLPLVTLDCYDLTRRLDDLSQHLDDNSPAAIVSATRTRAALVAARCESVSLRRQMIATQEELDWRCYQLYSLTQTELTHPQPPDIALGERAFEIVLARRIAAGQAETTWFARHGSTPITELPAHWPADYRCIVEARIALIESDKVIGLIERPEYKRRWASTAWAEQEQTALKGWLLDRLESSLKDAAADTPSLTSTNKLADPLRSDTDFMQVAELYAGRSDFDVALLVANLVAGEAVPVLPVLRYSEAGLRKRAEWERTWDLQRREDAVDAETSDESERRRRKTAEIGDIPVPPKYKSSDFQKTDYWRLRGGLDVPKERFVSFPHCSRDADGSLLIAWAGLNPLQLGTAIATCYLDMKDNEGWHAERLKPLLAGIAELAPWIKQWHNDPDAEHGTRMGDYLDGFVDEEARDLGLTREAVVGWRPPATTVRRGRRPAI

SEQ ID NO: 2933 - protein, 1332 aa, Corallococcus coralloides
MKANDRARLTTALRDHVAKIAADLRAKMRAPGAARVAAEQLHKDERVAEDFEVWTDLLSRRAAVLWVLKSVYVRVLEDRGLLAPGRLLDPEAQQLFEKLAPNLGETAFLRWIYKDLASTRGGMPELFSPQPAEVALPSDELSRALIGFWRHRDADTGAVWSFVEERFEGELMGDLYQELDPVVKDRFALCQTPDFVRAFILDRTLTPAIETFGADDVRLLDPACGSGHFLIDGLKRLVAATAEKHNDWSKENVVAHALDRVVGIDLNDYACALARTRLIMTAAELAGVTKLADAARFRPHVYWADGLEQVEKEEQKLSTQFDLFTKVEEKPRATLTRSDVRAALKKVFAKKFQAVVANPPYILERDEARKEYHRELIGKNRRYVSATGKYSLGAPFTERCFQLADKDGFVGIITSNNFTKRDFGKALIERVLANLDLTLVVDAAQAYIPFHSTPTVLLFGRHRKPVGDAVRAVLGKRGESGTPCDPAHGEVWTSIATNWPSVGFDNDYISVADVPRTMLNVHPWSLGGGGASELKQRIESAAESTLGRLSESIGITCFTLEDEAFIASEEVLVRHGIPADQRRPMVEGDLIRDWAVAPTDVAVFPYDDTLNVLASVDGSKLEAWLLPYKTRLSNNKMFGGRTKVEDGLKWYEYGRFTASKLRTPLSIVCACVATHNHFVLDRGGRNFKQSVLVIKLPSEATEGTHLALLGILNSSTACFWMKQVFYPKGSKTHDVDSAGTLPENNRFDFAATGMNAFPVPHGLAASSAGTIAATINALATERSDHLPHSVVRRPGVLVSSTALRAALREAEQREMSAFLRMVFWQEELDWEIYRLLGLTPQGSTNLLAECDVQPDSRPFAWAEGMLPSGLSPKVAEEYVRRRKLLESERFLGLLESPVSKRLWRGTQGVFGRYDRTYLDKTRTALSAWFAGRVEAVARDRSRHFSLEHLVAALQDDDDALAVCEVLTDRRDFNLSQLVAQVLQAESVPSHPLHTYKPAGLVKRQAWERTWLDQARVDAGEKTSPEVPPNYANTDFLKPEYWQLRGKLDVPKERFIAFTEVPGRSGVETLYGWAGWTAQQRVKAILAIDEELEDDSVPLADRIGLLDSAWRLLSDVAREDAPAATRLKAELQALVGIEGPSTTLIGDWKKRFPPPSTRAAGPRRTSTKEVEDDDSFDDLPAIIPDVSSPDDAALFIWAVLHASGGSATRTDLARAFALRARPNLLKRLAPAPLKRAVTHWGTTVGSRSVKAGLLASTLAALAERNGVVLGTNSEARVTVSTSPHTPSEEQIDPWFRFEADLAVKVLRAQPVDDFSSIDKSLSAADRKLLETAA

SEQ ID NO: 2934 - protein, 1200 aa, Corynebacterium variabile
MQNERSDNMARNTTSNSEASLTAALQPVIRNLVKDMRSRLTEDAALHQTWVTEHARAQAADRIGASFEEWSEEQLQQAAAGWVLTTVFLRFIEDNDLFGTRQVFLTGYDADRRSLGRDYEAALYQAHSDYSYRAYLTHCFEQLADVPATKDLVGPHAAIHIIDPSDDAARGIIEFFRALDADENTRWTFNDPERSTRFLGDLYQDLSEYAQKKWALKQTPNFVEEFILDRTLTPALEERPLEGFKLIDPTCGSGHFLLGAFHRLVTEWEKHAPAMPAPERAKKAMQSIHGVDINPFAVAISQFRLTVAYMQAAKDTRLTERESKPGFTVLAGDSLLFGPDAVGQGALNLQAQNFVYSTENADALDEILTPGTYDVVVGNPPYIEVKDPILKKQYKSRYSRYIKGQYNLTIPFMVLFYNLATNGSANIPAGWTGQITGNSFFLKPFGVSLVENFFTEVDVREIIDTAGAHIPGHGTPTVIIIGRNSAPSRRKIVGVIGLEGEPTTPADSSKGLVWTSIVNNIDESGYEDSYISVQELSRDFVSSHPWNLHGTTISQTAEWIQEKSKKTVGEITDAVGRTTHTGLDPAYFIPKNRSLTKFSETVEVATGSNIRDYLIINCNVTLFPYDSIGNSITPHFEEQKHYWTYRSRLQKRTDFGKTVEQRGLRWFDHTMFFPDRYQRKLCLPFPFVATHNHFSLNRDNRVFNQKGPAIIMPNEASEEDHLRLLGVLNSSTACFWLKQNSHGKGIGGVNQESRHELFDEFYEFTGTTLKKFPLPDLEGSDVTERGRRLDALAQELATYEPAAVFTNGTPNQETIDEAEANYVRVRRLMIAEQEELDWAVYFLYGLTDTDMSLPAGSVSGIELGSRPFEIALARRVDAGETTTAWFERHHSTPVTEIPDSWPEAQRVAARARLDLMASDKSIKLLEAPEYKRRWSDDLWTDKVHTALGDWLLTRLETPELWRRADGMPQPRTIRELAAQVETDPDLADVLSVLPLWSTRRGATVEKMLDDLLKGEAVPYVASLRYRNRGFAKRAEWEATWDAQRREDAGEITAEAVPVPPNYSSADMVPTAWKHRGKLDVPKERFISYPGASPEGDSTLLLGWAGWNDLDKGLAIFSTFADRADEDADTETLAGILAGLVEALPWIRQWHNDLDPQFNLKMGDYLEAQLAEAARSLSIPVEDIPAHAPKPATRGRKKTSK

SEQ ID NO: 2935 - protein, 1239 aa, Frankia sp.
MIEARRLLADLQRQVRGLEADLRARARSDRDVDDRLHKRYQEAKTGCRTGVGYETWLDQQLTQVAVGWVLACVFTRFCEDNTLLGRPMLAGPVRPEQEADETGEARERVDGVAEAREWQTFYFQAEDHKNDSDLDYLRAAVARLEAYDATRDLVNRHNPLHLVDISPDAATGLLEFWRRIDPETGALVHDFSDPASSTRFLGDLYQDLSEQARKDYALLQTPEFVEEFILGRTLAPAIDEFGLAEVRMIDPACGSGHFLLGAFDLLLDRWQKQEHGIDVKVHVERVLGQVHGVDINPFAAAIARFRLVIAALAVCGITRLVDAPVWRIRIAIGDSLLWGTEDQQDELDGVATHALTGSTGEGEFTYEYEDARELKEILEARYHAVVGNPPYITVKDRAPSNAYRVRWSACHRQYALSVPFAQRFFRLAVNGGFTGQITANSFMKREFGKKLIEEFFPSVDLTLLVDTSGAYIPGHGTPTVLIFGRHRRPSLTTVQTVLGIRGEPSAPADPAKGLVWTRIVENFANADHTDAYISTLGIKRIDLARHPWSLAGGGAAQLQAQIDTTSARLHNLGVDIGRTVQLGEDDAWILAHSSPAVTRFQDNMVPHVFGELVRDYTIEQPPIAINPYADITKGIPLLKDQEVVQNLLWPNRTILSARTIFGRSLAENDRPWYAYLEIYANRLHTPLAIAFPFVSTHNHFTLDRGGKIFNRTATVLKLPEGATEEKHLRLVGVLNSSAACFWLKQVSHDKGIRGQGGGFTSDDWEHFYEFTGTKLKEFPLPDGAPLVLATRLDGLAQELQRVAPAAVARDAVPTREALVHARAEWERIRAEMISAQEELDWEVYGLYGLLGDDADGLIGSSVTKPPLALGERAFEIVLARQHDAGETETEWFTRHRSTPIIQLPAHWPQDYRALVERRLAKIDDDPYLHLIERPECKRRWASRPWAEMEAEALRAWLLDRLEARELWHRPEPTPRTVAQLADELRTDAEFTAVARLYARDTALGDVVADLVRDEHVPFLAAWRYTDMGLRVRAQWERTWDLQREQDAEDERIRAEEERRKESDEPLPPAPPRKIIDIKVPPKYKQTDFRETSYWRSRGKLDVPKERFISYPDASRDGTLLLGWAGWDHLQQAQALATYIADRREVDAWDAEKTKPLLAGLLELLPWVAQWHSELDPEFGIRPADAYTGFLDEQVRQLGLTRDDLTGWLPAARKTRTTVKKPAKKPANKPATTPAKAARS

SEQ ID NO: 2936 - protein, 1197 aa, Frankia sp.
MIDRVALLKDAQRQVKDLEKDLRAQVDEVAEVGTRLRAEYDRAFKVGRTAATWSAWLGERVTQAAVAWVLGTVFVRFCEDNGLIGDPFLAGPTTARLTLAEERTEDFYRRQPEKTARDWLRKSFDEIAKVPVGAGLFDQRHNALFQIPPTHDAAKNLLAFWRRRTEAGTLVHDFTDDAWDTRFLGDLYQDLSEDVRKKYALLQTPEFVEEFILDLTLTPAIDEFGYDVVKLIDPTCGSGHFLLGAFRRLLAEWEKNSPDRDVFERVQLALDAVHGVDINPYAAAIAKFRLTIEALRVAGLTTLDAAAGYTFPLHVAVGDSLLKNRQLDLFGEERDELAEFAYATEDLADHLGILEEGRYHAVVGNPPYFTVRDKKLNALYRDLYSSCAGRYTLSVPFAQRFFELARQSDGDGVGAGRVGQITANSFMRREFGKKLIENFFARVVELTHLIDTSGAYIPGPGVTTVILAGRRNQRKRIKTVRMILSVRGEPSIPDDPSQGAVWRAIVNSVDGSSNDWVATADVDRDVLSSHPWTLSVGDVGAIMDRLGAEGHRKLKDEILGDIGFAGFSGVDEAYYLPASWHARFRTPQALVRPVVTGEDVRDWRTSPTLYAITPYTSDGSLIPIASSSDWVRHLWKYKQIVGRLTDFSGRTRLDLGTPWWAWYRWVAARNSAPDIIACPKIASLNHASYGHDGYTYNQHVPVIVLPGSSGADARLSLVGILNSSTACFWLKQVSHNLGSTADATGARRTATPWENFYEVTGANLENLPLSAQCPLPLARELDRLARNLTMVFPQAVAAAGPPARPLLRTARNEWESTRARMIALQEELDWQVYRQYGLLADELTLPMADVPEIKLGERAFEIVLARKIAAGEETPEWFTRHGSTQIFEPPAHWPAEYRTLVEKRIAVIEADKNIGLIERPEYKRRWATEGWDKLQDAALREWLLDRLEARELWFADVDGMVQPRLWTTGRLADELAAEADFVAVAEIYKPGENLSKVVDDLVENEHVPFLASLRYKDSGLEKRADWESVWEQQRAEDTTPTPEAAKKIRDSIPLPPKYAQADFRKASYWKARGKLDVPKERFISYQPASPDNDPTLLVGWAGWDHREQAQALATLIVERQDNDGWGAARLTPLLAGLREVMPWVRQWHNEVDPLYDGSPAEVYDAFLADAMGRHNLTADALADWRPQAAARGRRATK

SEQ ID NO: 2937 - protein, 1282 aa, Haliangium ochraceum
MERTRYEELQKALQKQEKAIAKASIAWGRKAGKERVTRLHAEAETGGSFDDFLKVAAGRSAVRFLLRTVYVRVLEDLGILEEPRIRGLRSYEAFRALAPSLGYRAYFAWIFRDLAVDFPALFEPAPDELPMPGEELCRALWDLWHDQDGEGGLRYAWTGGDFDSRFLGDLYQDLDADVRKRYALLQTPDFVEEYILDHTMTPALEEFAPEALRDAGEAFRVLDPTCGSGHFLVGAFHRMADFWEARGMGRWAAAEQALDSVWGCDINPYAVDVARFRLLLEVVQRTGEKDLGRLSQLKLHLRAMDSLIPWEGPPKGQTGELFPGADRLSKYGTAEERALNAAFLQRDFHAVVGNPPYVVPKDPAKRDDYRVFWPNSAAGKYGLSAPFIERLFTLACEGGWTGQITGNAFTKREFGAAVVEKFLPTVDLTDIIDTSGAYIPGHGTPTLILFGRNREPVESVVRCVGGKLGEPVRPEVPSQGHYWSAIKYAPKSVSDESPYLTVSSYARVWLKKHPWNLKGGGASELQRRIRGKASFELKDKSKRLGLMTKPVLDDVYIPAPLWLLRLEPRGGVILAEGELIRDWGVGLGACAVSPNVPSSPYNVDVSLAETGPRRFAHFWRFRGLLWNRRSRATRFAPLRTIVGAQFYEFPFYYPQTLEGPQVCHASVATHNHFVFDRGGRLFKQTAPCVQLPGDSDGADYLSLTALLNSSTLGFWMRQVFYPKGGDKQGDGGRVWSEPWTDRLAYDSTKLKRAPIVTEDRAERVALAEQLDALAQERAAQLPAAVLGRSDWNPDELAAALAGAHDEYRALTARMVALQEELDWLTYQSYELLPRDTAAWNPVAPADAEPLAPGHRPFEIALARHNATCAPEERSEWFSRHGHDEVTDIPAHYSAATRARIQARLALIADNADMRLLEQPQFKRRWQMPAWDKEVAAACESWLLDRLEDLFAPPLADQASDDAAAAAPEPGPPPPLADPRPYTLEEITAAWQREPRVQAVADVYAGGRHTVLSLLAERLLDEHGLPDHPYRIYTDEGLRKLRQWQEVWRLQDREDAGEKVKIPKPPEFAKGDFQSERYFKLRGKLNVPRERFLVFAELLPARYGWNGWRDLKRALAQVESYTAVEQHPTAPLPRPSTDDPRRCGATLGLWESLPDVKRWVSAAEEGGLRALAEEVCQRSACPCEVVQAWQAWQSGTLEITAADDERDPDEVTLDDRILVMKRFGMGGVLSINDLQGWWNRGPAELDRILDTLVATGELTLKGKGNRRRYTPGAPKGQPKSPQA

SEQ ID NO: 2938 - protein, 1173 aa, Microlunatus phosphovorus
MINAAALVADLKKQVLVLEDDIRGRLEQLPVIKADWQARHRRQVDADRTASAWTSWRDDQITQAAVAWVLTTVFVRFCEDNGLLSPVWIAGPPTRRQEALDAQLAYFREHPDDSDREWLDQATAHLAKRPATAGLVDEHSGLWLVSPSGQACSDLIAFWRQRTEDGALLYDFTDEQLTTRFLGDLYQDLSDHAKKTYALLQTPEFVEEFILDQTMDPALAERPLEGFRLIDPTCGSGHFLLGAFRRLLDRWDKAAPGMELQARVNLALKSVYGVDLNPFAVAIARFRLTVEALRACGLRSLEHAPHFDYHVYTGDSLLFGASDSPLPFDGADPDLLASQVSYSTEDAYELRSVLAPSRYDAVVGNPPYIPVKDPVLKREYKRRYLSCKANYALTVPFVERFFQLAVARTDNRPSGWVGMIASNSFMKREFGDRLVEEYLPRVRLVRVIDTEGAWIPGHNADGTPTVTIVGRNEPQDGRVIRVLTGKGLRETRATARVGGSAHWLRIVERVEEPGYEDDWITVGDRDPSELSRHPWILAGGAVPKLMSKLETGPRRLRDVTRDVGFMAVTREDDAYLRGGHVLQRLGIGEGSRRRFCAGGDLRDWRAIGGMDAICPYGSDGKPAIDDQARKALWPLKASLMNRRAQSGYQVDIGLHWWEYSQMNERRLLSQRVIAYAEVATHNHFVIRSDDSVYGRTAPCIALPDSMTDEEVQGLCGFLNSSLACFWLRQRCKPKGGAAGDVWRRTYQFNVSNVAEIPIPEDLPYSLARRIQELVLETRDLDPLMTSPLKLRSDASNKYSSSLAHMISLQEELDWYVYGVVGVFQSASMQMWCEFPPKILPGQRAFEIALARGVSKAGEIPTWFAEHGIVPHTELPSGWSPSYRALVERRIEMLGSDDLLGLLERPEYKRRWSTWDDWNSRYDQSLRDWILSELESRRFWFSEGSHPRPISIAQLADMVSREELLVRAICMLERRPDVSIVPFLSNLLTGEAVPFLAAYRMTEGGLRKSDSWREIVNSQMEDGDEFPRPAALPRPFEEQDFRSSIWWQARGKLDVPKERFILYPDAGRSTDSTLLLGWAGWDHAEQALALAMIIAEREEEGWTDERLIPLVAGLAELQPWVEQWHAEVDPTYGVSLAAFCREQLAERSRQVGRSPEQLADWRPKPATRGRRART

SEQ ID NO: 2939 - protein, 1174 aa, Micromonospora aurantiaca
MIPLKALQTQVTALTDDLRGQVAADSELESSLRKEHARATEARRTGGTFETWLDDVVDQAAVAWVLGCVFVRFCEDNELVDPLWIGGPEPVAPVGRAMQHRQQHLIDNPRHNDREWLREAFTYLRGLRATGKIFDEHNPVWRFDISGAAAEKLSEFFRRGPGLVSLRVDDLNTRFLGDLYQDLSTHAKKTYALLQTPDFVEEFILDRTFEPAVREFGLPETSVIDPTCGSGHFLLGAFGQLVRKWREREPATDIRVLVERALGQVTGVDINPFAVAIARFRLLIAAMRECGLTSLERTPSWPVRVATGDSLLQWGRKSRHQGDLIAMLEGQNAFAYAAEDADVLADYLREGQYTVVVGNPPYITVADKARNQLYRDIYPDVCHRQYALTVPFAKRFFDLARQSDEHGEGAGHVGQITGNAFMKREFGKKLIEDYFAHQVELTAIVDTSGAYIPGHGTPTAILVGRSRFRRRAPNIRIIRGIRGEPERPGDAANGAVWTAIKKQFDLPGSDSEWISVQDTPRSEMACFPWSLSGGGAVELRDLIEQRSVPLGSAVDSIGRTTHTGQDEAFYLNSAAVATRGMSSAVVPVVAGEDVRDFQLHLDAVAMFPYGTDGVPRETSISESRFYWITRVWLRSRIDFGRTVEQRGLRWFDHSMFFAKRFRVPRSIAFPFVATHNHFVLDRGGKVFNRTAPAIKLAERATEYDHLRLLGVLNSSTACFWLKQVSYPKGGDPIGGDGARVSAEPWSDRYEFTGTKLQEFPLPRAYPVERARLLDSLAQRLAGLTPAAVAESAVPTRERLATAHADYDETRARMIALQEELDWEVYRLYGLRDDDLTFVEPPRLALGERAFEIVLARRMAAGEVETQWFARHGSTPLTELPAHWPDDYRALVQRRIEVIESDRNIALIERPECKRRWATEGWDAMQAKALRDWLLDRLEAPELWGDRPIPQSVAQLADRVRHDDDFRAVLELWAGRDDYDLTKTLAKLIADEHVPFLPAYRYKPSGLRKRAQWERTWAQQRLEDAGEDVDIKVPPKYTSADFAKPSYWRARGKLDVPKERFISYPKAGRDGDGTELLGWAGWDHLAQAQALATVYLDRKLQAAWSAERLLPLLAGIAELEPWLHQWHTDERPDFPGVPAQFFTDLIDTELSQLGADRPDLLALRGLGGHADNRGE

SEQ ID NO: 2940 - protein, 1189 aa, Mycobacterium gilvum
MGWAATELVTALKRQVLALETDLRARVDGDDEHARQKDVLDAWRRYYDAAFAAQRTAASWQEWRNDRVTQAAVAWVLLTVFARYCEDNALLSPRWIGGADADHRAQALDARRAYFQQHPEHTDREWLSQIIGHFGKFTATAGLVDRFSPLHLVAPSGDAARALLEFWWQQDGDGQPLYGFAGVDTRFLGDAYQDLSEHAKKTYALLQTPEFVEEFILDQTMEPALADRPLQGFTVIDPTCGSGHFLLGAFARLHQRWQREAPALGARELVAKALDGIYGVDINPFAVAIARFRLLVAALHAAGDSSIEQNIGYTPHLAAGDSLLWGANQQLLPEDLLAGPAIRADATEDADALRSILQREHDVVVGNPPYITPKDAALNATYRKLYSTTHRQYALTVPFMELLFRLAHGSAGTRPAGWIGQITSNSFLKREFGSKLIEEFLPTVDLREVIDTSGAYIPGHGTPTVIIVGRKQRPSSDTVRAVLSVRGEPGRPDNPAKGLVWSTIVDHIDEPGFEDAYINVSDLPRQTFSSHPWSLSGGGAVQLQQQVDKQTAKLGERILVVGRTTHTGSDDAFYLPDAASERLRLTNDVVPVVLGEGVRDYTVVPHLDTVFPYDSDGVPSSLSDSALRYLWPNRSVLSQRIDFQQTLEERGLRWIDHSMFFPQRFRSPLSIAFPFVSTHNHFALDRGGKVFKQTAPAIKLPAGASVEDHLRLLGVLNSSVACFWLKQNSHNKGEGGGARVEAGYAARGEAWRESYEFTGTTLKDFPLPANTPMERAKLLDGLAHELQERSPAELAKRETPTAATLEDSRAELDRLRALMIANQEELDWEYYRTYGLIEVDLTYTGEVPGVALGERAFEIALARRMKDGVETTWFVHPLQISSPITEIPDHLPTAYRDLLQRRLDAIETNPHIRLLEKPEYKRRWASEPWDKQVESALRDWLLDRVEDRALWFDRDGRPTPQSVAQLADVLDRDADFRSVLRLWVGDPNATTGASLAKLLADEAVPFLAAYRYKPSGLDKRAAWEDTWALQRREDAGEKLGSPIPVPPKYKPADFVKVSYWSHRGKLDVPKERFISYPAAGRDTDATELLGWAGWDHAQQALALASLISARIDEGWDTARLVPLLAGLNELAPWVRQWHNEIDPEYGESVADTIDAELTSRLNEHHLTVTDLTSWRPVQSARRGRRAART

SEQ ID NO: 2941 - protein, 1209 aa, Nocardia cyriacigeorgica
MIDRAALLADLKKQVVAVETDLEKQLDVLPEVKARLHDEWAQARKLNRTAATESSWLGERVTQVAVAWVLGTVFVRFCEDNHLIADPYLTGPTDDRRELAHARYDAYVETDPDPTYRGWLENAFAELGAGQAGKLLFDPNHNALYQIPVSHDGARELIEFWRTRDEHGVLVHNFTDPLDEDGINGWDTRFLGDLYQDLSEDIRKNYALLQTPEFVEEFILDRTLEPAIREFGYETIQLIDPTCGSGHFVLGAFRRLTQRWADEQPTKDRHERVHAALNSVHGVDINPFAIAIARFRLLVAAMAAANVRTLAEAARYEWPIKLAVGDSLIKARQLELTFDGDHRDPLAEFSYATEDVHDYPGILEPGRYHVVVGNPPYITVKDKNLNELYRGLYKSCSGSYALSVPFAERFFELARLGQHDGHGFGRVGQITANSFMKREFGTKLIEEYFAQTVELTEVIDTSGAYIPGHGTPTVILIGTRRSGNSRSTTVRTVRSVQGEPRAPERPENGRVWSAIVEQIDNPGSVSQWVSVDDLERTRYFNKQPWILLDGGLEMVERLHESAKDKLRSVTTEIGTGAITREDSAYMLGNGCLRRKGIEPDYRRAIVEGTEVRDYSIAEATASLWPYSESTLKAQASERVTRALWPHRVILRNRVAFGKSQVARGLTWFEYSMFFTERYRKPLGIPFAFVATHNHFVLDRGGKVFKQSAPVIKLPEGASEEEHLRLVGLLNSSTACFWLKMVSHDKGNGGIGGGIASESWEKFFEFTGTKLQDFPLPGRYPGSLGEALDSLAEQLAETQPATITSNATPTAETLRNGKRRWESIRRKMIALQEELDWQVYGLYSLLRDDLTAVKDEIPEITFGERAFEIVLARKAARGEASGEWFARHAAQPVTSLPNHWPDTYQKIVRRRIEVIESNRAIGMIERPEYKRRWATDGWEALQEKALRAWLLDRMESYDLWFGDTGQPQVLTLSRLTDRLAADEDFVSVAALYSPRTDLAQVVADLITDEHVPFLAALRYKPSGLKKRADWEHVWDMQRQEDAMPDGHNKNKFRDSIPVPPKYTSADFLRTSFWQARGKLDVPKERFISYGSANVATPELYGWAGWDHREQAMAIAIYLAEHNLSTEEITPFLAGLLELQPWLDQWHNEVDPNFGIAPSTFLAGDRRDRQDEHGLTDDDLRNWRPQPATRGRRATTKRTTKKKSATAEGDN

SEQ ID NO: 2942 - protein, 1233 aa, Polaromonas naphthalenivorans
MINAPQLLTDLKRRLALLESDLRERIHTLPDLKASLQAEWQVARDANRTAETLESWSDQVITQAGVHWLLSCVFLRFIEDNTLVERPWIGGTPGSGRLVLARDRHETYFRASPLESDRDYLLACFTEAGTLPGLHTFFDAAHNPVFRLGISGDAAMSLRQFWQQQDPNTGALLHDFTDASWNTRFLGDLYQDLSEATRKRYALLQTPEFVEEFILDRTLTPAIREFGYREVRMIDPTCGSGHFLLGGFQRMVGEWSRAAPAHNRRDVAQKALDAVAGVDLNPFAVAISRFRLLLAALQASDVHRLSDAPDFTIHVAIGDSLLHGQRFGLSGQSGIQSDDLFDVAESHADSGLAHAYASEDLKLVQRILGRQYHAVVGNPPYIVVRDAALNAAYRSQYASCHRQYSLGVPFTERFFELAVTGRPALLPLPQGEDRGEGGPGSAGFVGLITANSFMKREFGSKLIEQVLPRLDLTHVVDTSGAYIPGHGTPTVILFGRHQTPKPDNPIRTVMGIKGEPSAPNDPAHGLVWSAILSQIDRAGSESEFVSVADMERKGLAKHPWSIGGGGVADVKEQIEANTVPLSSITTDLGFVCITKADDVFVLPLEAAIRKGCEPAVLKAFAVGEDVRDWTVNSENICLFPYSDKAELRPASDLANALRFIWRCRTSLLDRKIFGGETYRETGKAWYSYGQIPAERFKIRTAITFAFVATYNHFVLDRGGKVFNRTAPVIKLPAGASEDSHLGLLGLLNSSTAGFFLKQVCFNKGNGGIGGGISDEHWELRYEYNASQLVDFPVVENRPLDLATHLDHLANQLAASQPAALLAAAHAGTEALPTRASLDAARVHATELRRQMIAGQEELDWRCYRLYGLLPASSQAADVEHAAPPEVALGERAFEIVLARRVAAGTETTTWFERHGSTPVTDIPGHWPEDYRQVVQRRIDLIASDRNIALIERPEYKRRWNSPKWNDLEQAALRDWLLARLELPRYWPASADQPPQLTSTSRLADAARMDADFMQMATLYAGHADFDIGQLVAQLVASEAAPFLPVQRYTEAGLRKRAQWEATWALQRREDAGEDLTASVGAIPVPPKFKSTDFLKTDVWRLRGGLDVPKERWVSYPGCERGADGSLIIAWAGWDHLQQATALAGFYLDMKDSEGWPPERLQPLLAGLLELVPWLAQWHNEVDPVYGERMGDYYQGFVAEEARAQGFTLDDLRAWTPAATVKARGRRKATAASE

SEQ ID NO: 2943 - protein, 1649 aa, Polaromonas naphthalenivorans
MKKPKVISVNQMSLFGDVIEIEEPPASVAVLKPVAKAVETLTKRREMFVLESKYFAQLTGPAAKVKANLAAVKMAMQGGKKSLEEKAVIVAYSGWGGISAMFADNGDFEAQRLEFLEMVGEKSYAQARDSVLTAYYTEPEVIQAMWGLVQKMGFKGGKVLEPSAGTGNFIGAMPVALREASTITMVEPDSVSATICKALYADSDTLVHTCGMEIAPLRSESFDVVIGNVPFGNYRVHDSKFDCMKLVIHDYAIAKSLDLVRAGGIVAVITSTGTMDKPKSNFREYIAERADLVTAIRLPSGAFTRLGETDVATDILVLRKKPKVADSHVGHDFKVAEVIKLHEFGNMNERSYDTINAFYSQNQRQLLGMPKASTNQFGACLKFVPELAWGEQLKTMCSDATLDGWYTHEERKEIRENFVADMSGLKTMVASGFFFDDQGQLYYMTNQNAESQAHLPEPKRRRIEGMTHIRNCVVELLELDSVGANSTYERAKLNRLYDAFVVKYDYLMKPYNRRLFSLDSHAPLLWSLERYDDENEKAVKTDIFSKSTVSAAVLSDTAESLSDAIALSYNRFARLDLAFMAKALSLGEDEVVQKLLDANRVFFDPESREYVDSEVYLSGKVLEKLLVARAAAEGDERYMLNVAALEAVVPATVPLSKVSIQLGVPWIGQEDVQAFVDEIVTLDAEKVQDYNDIKAVTVTQVIGMAVWSVTMGNRFQKETRYSGDWGTAHRPFDDLLSDLLNQRSTTVYMEIEVEPGKTKRIVNKDETLAARDKAEKIQAAFTSWVYADPERVQRLEFTYNSKFNGTLNREFDGAHLVVPGLSSAVKLRSDQLDGIWAGLIGGNKLYAYAVGGGKTLITICLAQMMKRLGFAKKPTIVVPNHMLEEFAGQYARAFPRARILAASKEDLEGDKRRVLMMRLAMEDWDCIIITHGSFGKIALSKQVVQDFADEAGEKIDAMISGSDDRNVVREAVRQKKTVIAKVMALAEKGKKDDGVLTFDQLGIDQLLVDEADLFKNLWFQTKKTRVPGLSSACSGRALDLFLKSRIIFERRKDGFGLVFATATPIANTIGEMFIMQTYLQPDRLKELGIDGFDAWAANFAREVTSIEVTPDGGGYRMHTRFSQFVNVPELMLIFKEVALIRTKAMLALPEPKVAGGRHCIVAARASEAQKAYVQKLVDRAAAIREGKVKPHEDNMLCVTGDGRRAALDMRCVDGLEMDHAGSKLNACIENVYRHWAEGREKKLTQLVFCDLSTPKAHGFSVYTDMREKLVLMGVPVEEIAFAQDYKTTAQKGELHRKVRSGRIRILQGSTELMGFGTNVQDRLVAEHHLDAPWRPRDVEQRDGRIIRQGNLNEEVFIYRYVTESTFDAYMWQTLERKAGFIAQVMEGKTEMRSVEDVTSQALSFAEVKAIASGNPLVIEKAGVDAEVSKILSLKAAWRSDREIVLSRLANCVQSIDYSKKRIQAFEGDLGSIGNASEVTLGGMVHSASDKTGKSVMAHLASIKASVTTKEHQWRSFDALLAVGNMSIGLELHGKIGSASYKFFAKGSSGVSFEFTLPYGAKDIEIFLRSKHLETDLMDKLSWFRTRLIADEAELINLKRGAEKPFEYAERLEAALNKQEEIDKSLDLRADDVSTLFMEEEKQEEAEMAS

SEQ ID NO: 2944 - protein, 1209 aa, Saccharomonospora viridis
MRGADLGELVKDLRRQVTVLEDDLRARAQEVPEFHTPLRAEYDEAYKRERTAATWESWLDQRVTQVAAAWVLGTVFVRFCEDNGLIQWPFIAGPGERLVDAEERHEAYFREHPQDNDRDWIVAAFNHLSEAHPTAAGLFDARFNPLWEITPSFEAATELLQFWRRRGDDGEIRYDFTDPEWDTRFLGDLYQDLSEHARKTYALLQTPEFVEEFILDLTLEPAVEEFGLADLRTIDPACGSGHFLLGLFRRILTKWREVEPGTDQWELIQRTLASVHGCDKNPFAVSIARFRMLVAVLREANAMRLDQAPQFPINIAVGDSLMHGRGAPGIQGELFALDEPHTYTTEDVNEYVRSCDLLGKGSYHVVVGNPPYITVKDKQENKNYRDRYDACSGTYALSVPFAQRLFQLAIRRDGSERDAGYVGQITANSFMKREFGKKLIEQFFKTVNLTHVIDTSGAYIPGHGTPTVILVGRNHSYRQDEPVRAVLGVRGEPSQPEDPSKGLVWSAIVEQLCEPGSESEWVAVDDLERARFSVFPWSLSGGGAAPLFEDIDQHPVKLGDRVKSIGRTTATGADDVFLLPERKVAERLGFSESVRTLIVGDSVRDFRVSGAVYVYSPYSDFSNESVVDADSSLVTHLLWPFRHVLSRRVIFGKGLQESGSPWYVHLENYPSKLKVRCGIGFAFVATHNHFVLDRQGFLFNRTAPVIKLPEEAGEDEHLELLGVLNSSTACFWLKQVCHNKGNGADSKGARTTAVPWEDFYEFTGTKLQEFPLPAVLPLDLGRALDSLAQDLAAHEPSAVAEASTPTRARLDAARAEHTRIRGRMIALQEELDWTVYHSYGLLDDAERARLTAPDLDTVPEIRLGERAFEIVLARKMAAGEAETAWFERHGSTPVTEIPAHWPDWYRQIVQARIDVIEKRRDIGLIERPECKRRWASETWERKEADALRTWLLDRCERRDLWFGLRDGFSQPRTLTVNQLADQFRDDADMHAVAALYASDHLGKPDLPLARVLETIIADQHVPYLAALRYKDSGLRKRAQWEQVWEKQREEDRTGQRLDIPVPPKYTSADFRKTSYWTHRGKLDVPKERFISYPDASPDADPSLLLGWAGWDHKDQAQALVNLINDRTADAGWETERLTPLLAGLAEVMPWVRQWHGEYDEEWEGVPADEYQAFLDEQRTKHQLTEDDLKNWRPAPTRRGRRGTAKETQQ

SEQ ID NO: 2945 - protein, 1218 aa, Saccharopolyspora erythraea
MKETTSVNDEATARGIDQAALVKDLRARVSTLEDDLRARAAEVKEFDAALREEYEAAREAERTAATYESWLDERVTQVAAAWVLGTVFVRFCEDNGLIPDPFLAGWGERLAEAEERHEAYFRERPQDNDRDWIIAAFDTLAAAHPTAKGLFDRNHNPLWEITPSFEAASDLIRFWRRRGDNGHVHHDFTDPELDTRFLGDLYQNLSENARKTYALLQTPEFVEEFVLDLTLTPAIEEFGLDGLRTIDPACGSGHFLLGIFDRLLTRWRAKEPGTDSWTLIRRSLESVHGCDKNPFAVSIARFRLLVAALRAAGDARLDGAAEFPINVAVGDSLIHGRGAPRPEDELFAAEEAHTYATEDVNEHVRDYDLLGRASYHVVVGNPPYITVKDKQENANYRTLYPDVCSGKYALSVPFAKRLFQLAVFTSGDDRRAGFVGQITANSFMKREFGKKLIQDYFAQKIHLTHVIDTSGAYIPGHGTPTVILVGRNHFPRMGESIRAVLGVRGEPGEPEIPAEGLVWSAILDQIGKPGTESEWVSVQDGERTSYSRFPWSLSGGGATDVFAMVEEAPKRLKSLLERPIGFASFPGQDEVFFFSDSWFRRNRVEDEMARPLVVGEVVRDWDEKCDQTALVPYGWDQKPIEFNPASPWGRHLWAMRRVLYSTTGFSGETRDELDVPWWTWYRWIPERYATPLSIPFAFVATHSHFVLDRGGKVFNRSAPVIKLPEGASEDEHLELLGVLNSSTACFWLKQVSQDKGNRGGERSTGRYAWESYFEFTGTKLQDYPLPQDLPLELGRTLGSLARRMSEKDASVFASGAAPTRLELNASRAEHDRIRSRMIALQEELDWFVYHSYGLLGDAERERLTVRVLDAVPEVRLGERAFEIAMAPRAAEDEAIEQWFIRHDSTPITEIPTDWPDWYREIVQNRIDVIEKRRDIALIERPECKRRWSSEPWEKKEAEALRTWLLDRCERRDLWFQVRDGFEQPRTRTVHQLADAFRTDEDLHAVARLYATDHLGKPDLNLSQVLERIVADQHVPYLAAHRYKDSGLRKRAQWEQVWELQREEDRTGTRMDIPVPPKYTSADFRKTSYWSQRGKLDVPKERFISYPDAAPGSDTSLLLGWAGWDHKDQAQALVNIVNDRGEKEGWGAEELTPVLAGLAEVMPWVRQWHGEYDEEWGGVPANEYQAFLDEQRGKHHLTEDDLKAWRPTGRRGGAKGERQ

SEQ ID NO: 2946 - protein, 1311 aa, Saccharothrix espanaensis
MGWFRHPAHPAPLPWLLVTTPSLDRSTLLADLQKQVLILENDLREQVDREPEVMADLTARHEAALTSATLGTFIGEQVTQAAVAWVLGTVFVRWSEDNKLIRPMLSGSGDRLAEAEDAQGAFFRQQPHATDADWVEQTFDSLRRSDAGEALFDRKHNPAYLIPMSHDGAKALIGFWRTRRPDGSLVHEFRDDTWDTRFLGDLYQDMSQAAKDKFALLQTPDFVEEFILDYTLTPALDEFGLDGFRLIDPTCGSGHFLLGAFERLASAWRERDLNLSDTEIARKALDSVHGVDINPYAVAIARFRLTLAAWWLAGVRTIEQAAGQRWAVTVAIGDSLLAKKSDTLAGLDQFVGIQMESEDVEDYPTLLDEGSYHVVVGNPPYITVSDAKLNAEYRRYYTACHRQFQLTVPFAQRFFDLARRAGTDRRESGYVGQITSNGFMKREFGTKLIKEFFPTIELTHVIDTSGAFIPGHGTPTVILVGRRRSPDRSQPVRAVLGIRGEPGQPTDPANGIVWTAITSQIDRVGSESDWVSVTDFPRERLFQHPWSLSGGGADTLTTDIERTSQRKLNQHCELIGFLAITREDDAYVLDSAAARRLSLGNTVQTFAIGAELRDWDHSPEFDAVFPYTADARSTRLTQASEKHLWPNRVLLFRRRALSGYHIDRGIDWFAYSDFHPTRWRSTFLISFAFVATHNHFVLNRGGKVFKQSAPVIKLPAETTEDDHLQLLGALNSSAGCFWMKQVCHDKGSQSGTGGFMHDAWEPFYEFTGTKLEQFPLPADLPLARARRLDTLAQQLSDSTPQAVAKAGIPTRDLLSRAHDDYTTFRARMIAEQEELDWDVYRRYGLLSDAEAASVVIPDPSTVPALNLGERAFEIVLARTVAAGETDTQWFARHNSTPITELPTHWPDDYRRVVEARIDLIYKRRDIALIERPECKRRWSVEPWDKQQERALREWLQDRLESRHLWYAEDANGAEQPTMRSVSELTDLLRPDTAFTDVARIWAADALGNQDVDLSEIVAALVDDEHVPFLPVLRYKPAGLRKRADWEHVWDLQRQEDDIAAELGKDVTDPVVRKEVETRLGTIPVPPKYGSGDFLRNSYWRHRGKLDVPKERFVSYPGATRDGDGSLLLGWAGWDHREQAHALAVLISHRHTEEGWPADRLTPLLAGLHEVLPWVKQWHSDVDPVFGESPYVIYEGFLENQLGESGIARNDLPTWRPATKMDVSPLPRRGTRRPAAAKEPKQPKVDRAFTAEQFAVVLDFAANGPLTTSQTTEVTGLPSAQARELLKQLVERGDLIQTGQRRGTRYELPSAR

SEQ ID NO: 2947 - protein, 1217 aa, Singulisphaera acidiphila
MVYIKTLLPELRGVVKDLAEDLLVRSMTDAESDAGLREAHRKIKESGRTAQSFEEWRDDYLDQVAVAWVLACVFVRFMEDNDLINERWIAGEGEHGKMAEGEHELFFRSHPHDTDREYLHHVFVEVRKIPAAAELFAEGKTPLWALAPSGDAAKRLLEFFQEVDAEVGGLKRSFATEKWDTQPIVDVYEKLSPQARFLGDLYQDLSEHARKKFALLQTPVFVEEFILDRTLTFALDEFGLDGLRMIDPACGSGHFLLGAFDRLFHEWMKPEHGVNNKVVAAQNALDGVWGVDINPFAVAITRFRLLVAVVNACGIKKLNQQNYSWKLHLATGDSLLWGSKPSFNGERVPIKRQGNFFEEVDRIYAIEELAALDEVLGQGYHVVVGNPPYITVKDKAQSEKYRELYSACHRQYSLGVPFTQRFWELAIRKGERINQDSETVSSGPGYVGMITANSFMKREFGKKLIEEFFPRVDLTHVLDTSGAHIPGHGTPTVILYGRSRKPVSDTVRAVLGIKGEPTTPDDPSQGLVWHSILSQIDRAGAEDEFTSTTEVPRKTFASHPWSIGGGGAADLKEILELSGSILADAVDLIGLMFMTRADDIYFADRASLIRAGVNVTNIASDVEGDAIRDWTISTIESVLYPYDDQLRPVREQSDSGVIKFLWPCRVTLWTRREPNGDHRQIGLTWYEWSRFQKERLRTPRTIAFSKIATHNHFVLDRERQLFNCSAPIIKLPADATEDDHLALLGLLNSSTACFWMKQVMSGKHKGDGGEAHADPAYQRFEFTGTQLLNFPIPEQRPLDLSRLFDGLGQKYNVSLPNAIVQRGIPTQAGLEEGRATAACVRGRMIALQEELDWECYRLYDLLSDDLRYIGNDLPEIRLGERAFEIIMARRMAEGKLQTTWFVRHGSTPITEIPAHWPTAYRTLVERRIRVIDTIKEIELIERPEYKRRWNTEPWEEQERRALKGWLLDRLESPRYWPNVELQSTAQLADRASGDPEFLPVAALYRGRPDFDVTALVAELVEAEAVSFLPVLRYKPSGLRKREVWERTWALQRKQDAGGDVGDIPVPPKYTTPDFLKNDYWRLRGKLDVPKERWISYPHLQTESDPSLVVGWAGWDHLQQATSLVAYYDARKREGWDNMRLSPLLAGLDQLLPWIHQWHPEIDPEFGDTAGQSYQTLLENDSHELGLTLDDIRNWQPPEKARKAHSPRKKKSLAEDAE

SEQ ID NO: 2948 - protein, 1197 aa, Sorangium cellulosum
MAGKRKKGADESLTTALARLLEKTLLPDLTARAKTPAVAAVLAEQHAREKAESRTADPLAEWTPRWLEQIGVAWVLSCVFLRTLEDRGLVRHRRIAGEGAADAEQLFFELAPSLTARDYLLTAFREVARHPSAEDLLGPTRNPAFRLSPSNEGARALLDFFRQPDKTGGGLCWRFEGSDTRFLGDLYQDLSPSVRERYALLQTPDFVGAFILDLTLDPAIATFGLEETHLIDATCGSGHFLLDAFERICEHRMRTAPGIDVREHAAAALGQVHGVDINPYAVAIAKFRLMLAYMAKAELGTLAEVPQRLPIEVVVADSLLHGVVGTTRRFAELEGQRAEAWGQPMFELEDQDASDRVFGRKYQAVVGNPPYIVPRDDGPRDEYRKHYRSCHRGYSLSAPFTERLFQLAEGGGYVGLINANSFMKREFGKKLIEEVLAHLDLTRIIDTSGAYVPGHGTPTVILFGRNQRPVATTIRAVLGKRGEPNTPELPEQGVVWRSIATRNDDTGFENEFISVVDANRAKFAQHPWTLGGGGAADVKVLIEARGTSRLGELVDSIGRSTHTGEDSFFFMLPSAAERAGVARDGFVPLVKGEQVRDWGIAEDEATLFPYDIKTAEPRPPIGRAAPIYWPYRTILRNRQDYGEKIEQRSQGGRRLQWFEHSMFFPERYRNPLSITFAFVATHNHFVLDRGGKVFNRTAPIIKLPEGATEEDHLALLGYLNSSTACFWMKQVFHDKGSGTDTGKWQSEPAKIAYEFTGTGLLPLPIPSIPQPKPLAELASAIELVARKRSELLGELINGLTEDQSRHDFQGRIAKAADLDGQLLAHGVYLQEWMDWLVYGSLGLAPVSLVARFETDSNVRTGVPLGGRPFELLLARNGQAIGIDGQPLLTQLPPSCSPETAALWEDLISTIAASPELSVLETPDYKRRWCITPKDMGGRVLTFEDRMRDRLQSWLADRIEAIFREGQARFSLRQLLERLSLDVSFGVAAQHWSGATDLDAVIAAFVAADAVPYLAALRYTPEGLETRAAWEHTWALQRREDAGEKLSAPIPVPPKYDAKDFRDPNYFRIRGKLDVPKERFISYPGAEKDDDPSPLFGWAGWNHLERATALAGLYQERKTEDGWGADRLTPLLAGLLELVPWLKQWHNEMNEEFGERLGDYYERYVDTEARALGLSLDALRAWRPEARGRKGKAKRAAP

SEQ ID NO: 2949 - protein, 1210 aa, Streptomyces coelicolor
MIDRKALLNDLKQQVKAVEADLGKQVKALDEVGARLRAEYDQARKLGRTAATWNSWLDERVTQVAVAWVLGTVFVRFCEDNRLIPEPYVTGPDNYRRDLAETRYDVYVEADDDPTYRGWLRRAFAELGDGQAGRLLFDSDHNPLYQIPLSHDGARELVEFWRQRDEEGALVHDFTDPLSADGTEGWGTRFLGDLYQDLSEAARKTYALLQTPEFVEEFILDRTMNPAVREFGYEELKMIDPTCGSGHFVLGAFRRLVRLGGENQPGKDVHQRVRAALDSVHGVDINPFAVAIARFRLLVAAMAASGVRTLDEASKYEWPVHLAVGDSLIKSGSQQGSLFGESDDDLTDELAEFKYATEDVGEHPEMLRPGRYHVVVGNPPYITVKDKSLNALYRELYPACAGKYALSVPFAQRFFELAKREDAEGSGYGMVGQITANSFMKREFGTKLIEGYFGHAVELTEVIDTSGAYIPGHGTPTVILVGTRRGGDGRSPVIRTVRSVQGEPVAPENAEEGLVWRAIVEQIDKPGSVSQWVSVDDLDREKYFSKQPWVLADGGQEMLEQINAASHAILKRDLHRIGFYGIMGADDAMSAVPRTFRRNNAESEYVRRLVVGDEVRDFRIADGDDAFHPYGSQRDLVGPDAFPNLAAWLWPYRTELGGRATFSGGTYFADGRPWWEWHQLPKDVGAHAWSLNFAFVATHNHVVLDRSGCAFTRTAPVIKLREGASEEEHLRLLGLLNSSTAGFWLKMVSYPKGGDPVGDEGARVSVHPWSDRYEFTGTKLQEFPLPSEYPTGLGTALDALAQRLAAASPAAVAAEAVPIAGLLREARTRWEAIRSRMIALQEEMDWQVYSLYKLHSEDLRVSEDPDDTNIPELTLGGRAFEIVLARRVAAGEASDEWFKRHNSTPITEIPAHWPAPYREIVQKRIDAIESNRAIGMVERPEYKRRWATEGWDALQEKALRSWLLDRMENRDLWCDENGQPTILTLARLTDALSRDEDFASVAKLYAPRKELAKVVAELITDEHVPFLSALRYKPSGLKKRADWEEVWDLQRKEDAAPDEPAKRKIRDSIPVPPKYTSADFLRPSYWKARGKLDVPKERFVSYGQTNAATPELYGWAGWDHREQAQALATYFTNTALSTKEITPFLAGLLELQPWLSQWHNEFDMLYSGSPADFFAGYRQQKQGEHGLTDDDLRGWRPPAATRRRRAAAKQ

SEQ ID NO: 2950 - protein, 1213 aa, Streptomyces griseus
MIDRKALLNDLKQQVKAAETDLSQQVKAVAEVGARLRAEYDRARKLGRTAATWNSWLDERVTQVAVAWVLGTVFVRFCEDNRLIPEPYLTAPEDDRRDLALARFEDYVSTSDDPTYRGWLETAFEELGAGQAGRLLFDKKHNPLFQIPLSHDSARDLVDFWRARDEEGVLVHDFTDPLEEDGDGTKGWDTRFLGDLYQDLSEAARKTYALLQTPEFVEEFILDRTMTPAVREFGYEGLKMIDPTCGSGHFVLGAFRRLVRLWADGQPGRDVHERVAAALDSVHGVDLNPFAVAIARFRLLVAAMAASGVRTLGDAAGYEWPIHLAVGDSLIKHRHKQGNLFDGLEEEGADELAEFKYETEDVHEHPEILRQGRYHVVVGNPPYITVKDKRLNELYRGLYDACAGKYALSVPFAQRFFELALIGHAESGRGYGMVGQITANSFMKREFGTRLIETHFAHEIELTEVIDCSGAYIPGHGTPTVILVGRHRSGSQRSDTILTARSIQGEPGTPNNAEEGKVWSAITNQIEDPGSVSQWISVDHLNRKHYFGKQPWILTDGGLELNQQIEKTSTEKLRSALSRDIGFASFPGQDDAFIHPPETLRRYGIGDNVAKPLIVGEVVRDWSTHSFESAIAPYDSSLSPLPYDESSPWGRLLWTARRYLRSTTDFDGRTQHDLGKPWWAWYRWVPERYRTPLSITFAFVSRQNHFVLDRGGNVFKQSAPVITLREGSSEEDHLQLIGPLNSSTACFWLKMVSQAKGGMDNNSGGGNRWVPESWMVHYEFTGTKIQEFPLPAIRPTALAATLDSLASQLASESSSATIRETTPTASALRELRGKWHSVRARMISLQEELDWQVYSLYGLHPEDLTGSEDPDSSCVPPLTLGERAFEIVLARRVAAGEASNEWFKRHNSVPITEIPRHWPDTYRELVQKRIDAIESSRAIGMVERPDYKRRWATEGWDALQQKALHSWLLDRIENRRHWFTENGTPALVSLAQLTDALSRDEDFVSVAKIYEPHKELHTVVAELMTGEHVPFLAALRYKPSGLKKRADWEHVWNLQRQEDAAPDELAKRKIRDTIPVPPKYTSADFLRPSFWKARGKLDVPKERFISYGQSNAATPELYGWAGWDHREQAYALDAYIASHEALTAEELTPFLAGLLELQPWLDQWHNEFDATFSSSPATYFRGDRQMVQGENGLTDDDLRAWRPVAVKRGAKRK

SEQ ID NO: 2951 - protein, 1321 aa, Thermobifida fusca
MTAVSSPPASSTVFAAPRGYSSVRVAGSLLTAALIGRIGSGDPQLPGLRSEDYGLAPGRRLGEFASRHWEELLGVYREFQQQLTQASSGESRAALTRERWLLPLFDALGFGRLHPQREGLTVAGRTFPVSHLGRNVPIHLVAWGRDLDRRSNGERAPQSMLQDFLNSSDEHVWGMLSNGQKLRLLRDAASLSEAAFIEFDLESMFDGALYADFVLLFALAHSSRFEARTSDKPGNSAEQPSVANCWIERWRVEGDRAGIRFRAKLRDGLKAALEELGTGFLEGNAELREKLRRGDVSRREFRDELLRLAYQLLFLFVAEDKGALLAPDADQAAQDRYRTYFSTQRLRRIAVQRVGDRHDDLWRTLLIVLNALGSDEGCPELALPALGGLFVPANAVEGDGSHPGLLRGRDVTLSNRRLLAAVRHLTRVEDEGGCWQQVDYQHLDAEELGLVYESLLNLVPYTDPAVRVFELRSAAGNDRKTTGSYYTPSSLVETLLDSTLDPVIEEHAKRGVPDDLLKITVCDPACGSGHFLVAAARRIARAYAVLEAGDEEPTPDAISRAMPKVVRHCIYGVDLNPLAVELTKVSLWLASVEPGKPLAFLDDHIKVGNALFGATPRLLEAGIPDGAFTALKGDDRKVAAGLRARNRREVRALHRERGREVRGQAQEVRVFDAPLDKQRCKRAADAWCAAFVWPQRPGAPDGVTTATLLRISQGQALPPDQQEMIDRLARKYRFFHWHVEFPEVFRGCDGDPAEDFNPVTGWRGGFTCVLGNPPWERVKLQEREFFESRHSEVAGAANKAQRKALISELAGSEEGAHLLREFQEAKHTSEGLSLFLRESGKYPLNGRGDVNTYSVFTEQGKDLLHPHGRLGVIVPTGIITDATTQHFFKDVVGRQVLASVFDFENRRRLFPDVDSRLKFSLVTLTGHADTVEHARFAFFLHSAAELNEPDKVFTLSTKEILKLNPNTGTCPVFRSRRDAEITLQIYDRAPVLVTHGEEAENPWGVSFTRMFDMSNDAQLFRSYAELASDGWRLEGNIFVRGEEQMLPLYEAKMLHHYDHRWATYGKTGRSARDIPLEEKNNPHGFALPRYWVPRQEVEKRVGRENGWLIGFRKISNVTNERTLVSFAFPLRALADSGNILLTDKEEKSSLYANITSFILDYTLRQKLGGTNLNFFQFEQLPVISPEDFSRKAAWDFGFTVHEWLTPRVLELSYTTWDMELFARDLGDFGAPFVWDEERRFLLRCEIDAAFFHLYGIARDDVSYIMEMFPLVKRKDLKQHGFYRTKDTILEVYDAMAKAIEADDPYQTVLDPPPGKGSRHCT

SEQ ID NO: 2952 - protein, 1195 aa, Thermobispora bispora
MTVVPAALLKDLQRQVTLVAEDLRRQAERVPELGARLEGMYRAANEVGRTGETWNAWLTAQSEQAASSWVVACTFIRFCEDNDLTAHRWIASRDANGNATTEAADAEAAWIRRNPRLTAREWLREAFTWLRATRAGQALFPDTDFVWWWDISADMADALIAAFRRRDADGVRLAHDFHSPELDTRFLGDLYQDLSEHVRKRYALLQTPEFIGDFILDRTLTPAIDDFGLDGLKLIDPACGSGHFLLGAFDRLLQAWAAQAPGMDERVRVQKVLDSIHGVDINPTATAITKFRLMVAALQACGVTRLDDPGIPALRLNVATGDSLLYASKFGGRQTELQVQDGSLVAHRYDWEDIDRYPGILAHGRYHVVVGNPPYITVKDKALNLAYRDRYPTCHMKYALSVPFAELFFRLAVWDTERPGYVGQITANSFMKREFGKKLIEEFFAAKVELTHVIDTSGAYIPGHGTPTVILIGKNRDRNRLGTIRAVLGIRGEPSQPEDPRLGLVWRSISGHIDQPGTETEYVSVADLPREWFTAHPWTLGGGGSAQLQTLIESMAQVKLGELVESIGITCFTLEDDVYVFPERCLDRRMIPKDFRRPMVLGDGLRDWGISVNGSISVFPYDFNFLPVEVENERVLYLHFWPYRTNLSKNIMFGGRTKVAAGLRWSEFGRLTVNKLRTPLSITFAFVATHNHFVLDRGGKVFKQSAPVIKLPREKTEDEHLRLLGLLNSSTACFWLKQVSYPKGGDPIGDEGARVSLEGWSDRYEFTGTKLQDFPIPEGAPLERARRLDALAQELATVMPQHVCARGVPSREALAEARRRYHEIRAEMIAVQEELDWEVYKLYGILDEDLTYDGDDLPGLALGQRAFEIVLGRKVLDGEVETQWFARHGSTPIRDIPAEWPQAYRELVQRRIEMIENKPLIGLVERPEYKRRWAAEPYEKMQAEALRTWLLDRLEDRRLWFDEAEHPRALSAAQLADLVRTDADFRQVLDLYLGRPDYDITAEVAALLKDEHVPYLAAYRYTESGLRKRQDWEHVWALQRREDAGEKVEIPVPPKYGPKDFAAQSYWRHRGKLDVPKERFIGYPGAERDGDPTPVYGWAGWDHLQQAKALASLIIERGYPTGDPRVTPLLAGIAELEPWLHQWHNQYDAVYGEPPAGFFTRWLETKLTEHGLTREALAAWRPETKQRGRRARKGA

SEQ ID NO: 2953 - protein, 560 aa, Hahella chejuensis
MADAGLRWYDYMQHTASAYQTSLSITFAFVATHNHFVLDRGGNVFNRTAPVIKLPTLATETDHFGLLALLNSSTACFWGRQTFFGRGGFSDGKWQERMEWDGTKLKAFPVVEDTSKQATLFAKQIDSLTKRLESCSPSSILNQAEDQLYEALSKAKETEYKILREMIALQEELDWFVYYLYGLTKAPLCCEGELPEIDLGQRAFEIVLARKINAGELKTVWFEHHCSKPNTEIPSEWPEKYRDIVNARINEIKENESIKLIDNKDHKRRWARDSWDDRLKLAAKDWLLDCIQKLMEFHKLSTCAQLADKVREHKKARQVAAIYTRGEDFDFQTLVSDLVASDNVPQTAADRIKPAAMEKYRAWQETWEKQRLEDAIDAEFGVDRPLSEVDSADESNRAKYEEAKRKAEAKKAEIIGDIPLPPQYKQSDFRKASYWPLRGKLDVPKERFFSLPGCEKDGDNTLVIGWAGLNHLQRAQAIAAWYEDRKENDGWEAERLMPMLVAIDELIPWLKQWHNDIDPEYGERMGDFYESYLLEELRRWELTREELLDWRPPTTTRRRR

SEQ ID NO: 2954 - protein, 1240 aa, Actinomyces sp.
MNTSVLESLAAASRERLIEMSVAAIERKMADPLLSDADRVRLTQAVDKHAEAGGNRVLGAAKVVAYSWFNRLTALRYMDAMGLSGDYGVVTPAEGAGTGVPECVQRARGGDFDRHIGEDARARIVQLLFDNQDLDAYVLLLREYFTSWHLVMPGVFPEAEDWTNLVPPTDLLSAGESVRADIVAAINPNDSGRMDVEVIGWLYQFYISARKQEINESKAKIDKDTLAPVTQLFTPHWVVRYLVENTLGKQWLRAHPDSALREKFEYLVTPAEGQEDEGLAISNPEDFRVIDPACGSGHMLTYAFDVLWEMYAEAGYPTRQIARLILEKNLHGADVDGRAAQLASFALTMKAVEHNPGFLGRIERQSQRDGETSWQGPRIVHVESMELDELSPAEIADASDDGVSLGMSQLIEQLRYADAYGSLIRVPEGASTLFREIARRIEAGEKQQVLGGADSEEWLRAADMCEILEDGRYTTLIANPPYLSMKKAKDPLKRFANKHYKRSSTDLCTMFIERAASLAQRRGAIGMITMHAWMFLDSYRELRPWMLSTMSIDSMAHLGTRAFDSIGGEVVQTTAFTITNATSDVDRVGVYLRLVDGRNEAEKDLVLRTVACEQKHDIRFEVSPATFAVIPGRPIVYWASRQMLNAFEAGVPLGEVAPAKQGLATADNERFLRQWFEVSADRSYMQARDRADAQASGARWFPHNKGGEFRKWWGNQDYVINWQDDGRELWDFRPRSVIRNPDCYFRPCVSWARVSSGDPSFRLFDSSSTFNDKGAAVFLSSHQQTYEMLGYLNSSTTLKLESTIAPTVMFEVGQVKNLPWIKPESFDSAGVERLIEIFRADWDARETSWDFARPPYLRGGYSLLQDAFDDWYRRSCETADEARRLETENNRYWAEVYGLADEVEINVPLSRVSLTYNPRFAFAPTKGAPERSEEEYRWLHYQCSARELISWAIGVTMGRYSVDVPGLVLADQASSLDDFRARVAEARLEPDDDGIIPVTGGAFDDDASRRVRAVLRVVFGAADLGDNIEFLTRCLAVKPGSSSAEFVPPAIPADPERALEDYMAKSFAADHQKDYSGRPVYWSLESPKGTFRALIYLHRYTPDTVGQVLTKYAAPFVDRLKAESEAVGRERDAVMGDDRKADRERARIDKRRAEIDATIAEVQGFIDSVLQPLAQRRIHLDLDDGVRINRLKLAYGWRSDLADLPQPAIGVATAAVKKEIEKDLKWAHKEVAKNNAWWSE

SEQ ID NO: 2955 - protein, 1190 aa, Vibrio cholerae
MNTAKLKKYAPQARREFITAVSKQFNQLGIYSDKQISEVKQEGSVLLIEGKTFEPSVKTARERLVKKVQAMGYNQLVEQVAYTWFNRLCAIRYMEIHDYLGHGFRVLSHPDNPKGFEIIDHAQDAADELGLDRAHIVELKLAGNKDEELYRELLLGQCHKLHEAMPFLFDALDDETEFLLPDNLTRTDSILRGLVDSIPEEDWQQVEVIGWLYQFYISEKKDQVMGKVVKSEDIPAATQLFTPNWIVKYLVQNSVGRQWLQTYPDSAIKTQMEYYIEPAEQSDEVNQQLKAVTPESIEPETIKVLDPACGSGHILIEAYNVLKAIYEERGFRSRDIPKMILENNLYGLDIDDRAAQLSGFALMMMARDDDKRIFTRNVRLNVLSLQESNHIDLPTLWKALNLSGSWQSGTSQGLFSDEEQDLNSFNADNRYQLLKRTLARFTQAKTFGSLIDVPSDDHEQLKELLSTLVELQESGDSMQKPAAKELIEIVHQALILSTRYDAVIANPPYMGRKGMPQALKGYISEFYPECIWDIYSAFIMKSRKMVLSSGRLAMITMHSWMFLSAFEELRKNILSKDTILSMLHLGTRAFKEIGGEVVQTCAFVIERENSNAVPCSFYDLQGYDNSDEKENAFLVGDAPLYNGLKNIDFKLLPSASICYWATKDLLSLFSEYPRIGIKTINKSLNLTGDNNRFLRFFWEIDSEEIGKDRKWIFYAKGGAYKKWYGNFDYVINWSQDAVSFYRSDRTARIIPENLWWKEGVTWTKVTTSAPGFRLLPKEANYDVGGSSILFDDIEQVHRCMGFLNTPLATYLIRLLNTSVNIQVGDIEDLPDLSSKVNPKDVSRAIELSKTEWNMWESSFEFSGVKFEGKSFYESFKLFHEETTRIINELHTLENIISANVTKDLNVSIELRDVDLESISLESNCSLLELQSKWAAQLISYVIGCIMGRYSIINEGIMFASKKQNHFFEKVNEGAFSNFFPDDDGIIPLTDQEWFKDDATNRFREFVQVVSGEAHLQENLDFVAESLCLNAIKPKKSELALEAIRRYLSTQFYKDHLKTYKKRPIYWLFSSGKQKAFECLVYLHRYNEGTLSRMRTEYVTPLLGKYDAYAEQLEKQIETADSTIEANRFKKELDALIKKQVELREFDDKLKHYADMRISLDLDDGVKVNYGKFGDLLADVKAITGSAPEVN

SEQ ID NO: 2956 - protein, 1232 aa, Vibrio harveyi
MNTNKLKTYAPKARLAFMDAVKKRAAVLGIYENKISEATIQGTDTLIEGRIFTRKQGQQRQQLVKRIEALGGGKDGYNQFINEMAFTWFNRFTAIRFMEVNGYLDHGFRMLSKEEGSEFGKGFEILAHAADVAEDLGLNKSDIVQMLLAGDKEEELYRELLLAQCHQLSKIMPFMFEKLDDATELLLPDNLTKTDSILKELVNDVPEDNWREIEVIGWLYQFYISEHKDAVIGKVVKKEDIPAATQLFTPNWIVKYLVQNSLGRQWLATYPDSELKDKMEYYITPAEQSDEVIEQLKAITPTSIDPEQIKVLDPACGSGHILVEVYEVLREIYLERGYRLREIPELILTKNIYGLDIDDRAAQMAAFAVLMKAREDDRRIFSRVEDNHIKLNIHAIQSTEHININKLWSDLDLDDNKQAGSMDDLFAEPQLGISEASEENKVYLDLLRHLKEQFIDAKNLGSLVEVDSQNLEPLTALQEKLAGKAQGNEPTTREAAQALLPIVEQAIVLATKYDVAVANPPYMGSKGMNAALKNFAKKSYPNSKSDLFAIFMERVFSFLKEDGYNAQVNMQSWMFLSSFEKVRDSLLDTKTIITMAHLGARAFGQISGEVVQTTAWVIKKDHLNGYQPSFLRLVEGNEEEKRTALLEKKNLYSKIKQNEFSQIPGSPIAYWVNALTRATFTSNRRFGDIATTRKGLVTARNDVYVRSWSEVNFSKLGLECTNREDAQSSNCKWFPYIKGGEFRKWYGNKWEVVNWENDGYALQNTTHPTENRIWATNFNLEYIFAPNINWSDITGGGFAARYSFGGEIFDATGLSCFPPEADRLEVLGYLNSSIAGDLLKLLNPTLHFQAGNIASLPYLPHGNRESLKEYVSELVDIAKLDWDEFEVSWDFLGNPLIKANKNSLIMATESVFSKYSLLTQRTISLENNVNEIVHELFGFQNSTEKTEVKEKITLKTNPFHRFNVNHLQAHKSSVIAELLSYSIGAMMGRYSLDREGLVYAHSGNNGFKELVAEGAYNTFPADDDGIIPLAAEEWLFDDDATSRFRDFVKTVWGEEHLQENLDFVAESLCLDAIKPKKNESSMETIRRYFSTQFYKDHLKTYKKRPIYWLFSSGKEKAFECLVYLHRYNESTLARMRTEYVTPLMSKLETQHSVLTESRTNASTTEQRRIDKELKSIEKKQSELRAFDEELKHLAEMKISIDLDDGVKVNYGKFGNLLADVKAIHGKNPEEIK

SEQ ID NO: 2957 - protein, 1154 aa, Lachnospiraceae bacterium
MDKNAIKKFAVWARTELIARVSLKGVEYGITEDKIEDANADSVGGKVLTADEKKQRQALIAEINDKGYKQVMEEVAYTWFNRFSALRFMEVNGYLPSHVRVFTDEENSFKPQIITEAIHLDLDGLDVEKVYELKDAEKTEELYKYLLIVQCNALNKILPGMFQRLSDYTELLLPDNLLREGSVIQQMIELIPEDDWKDAVQIIGWLYQYYNSEKKDDVFAALKKNVKITKENIPAATQLFTPDWIVRYMVENSLGRLWLEGHPDVKSQLLPTEEEQSAYSTGNRDPEDTKWHYYLEETEQEPEVQVQLAEIRKEYAALTPDQLKVIDPCSGSGHILAYMFDVLMKIYESYGYTTREAVASIVENNLYGLDIDDRAAQLAYFAVMMKARQYDRRFFSRGIQPHVYAIAESNYVDKFAVDYFCNGDMKLTAAMDTIISELHDAKEYGSILTVTPQDWSALYDRFAEIKEDIHISRGAALRGLLPLVQTAETLAQKYDTVVTNPPYMGSAGMNSKLYDFVKEEYPDVKSDMSTVCMRKTISMCNEHGYMAMINIPVWMFISSYGKLRTEIITRNSLVQMLHFGRGVFGSDFGTTAFVIGKRFVPNYCGTYRKLFMKQGAVDSVETKELWFHEGKGAFSAKQSSYLRIPGNPIAYWVSERFISNFAERLVQDTHFSGGRNKTHGNEQYTRMWWEIADREKWQLYVKGGDFRRWYGNQEVVVDWSTGAKESYASHGGLYNQDYANKPGICWTLITSAKTAFRYKIPEAHYDSGAPTIFNDKFSLDLTLLGFLNSNIATEYLQLLNPTINMGNTYVLSLPYIDVGIRKAEIDTLVKKNIDAAKDDWDSFENSMQFRSHPLVRFMETDGKIATAYNLWSMHAACAFNEMKQVENRLNELYAEVYGLSDEISTEVPDRDISIRKGDLQRDIKSLISYAVGCMFGRYSLDVDGLAYAGGEWDASKYASFAADKDNIIPICDDEYFEDDIVGLFVEFVKTVYGEDTLDENLRFIADALGGKGQPKDVIRNYFLNDFYKDHCKIYQKRPIYWLLDSGKKNGFKALIYMHRYQPDTIARIRTDYVHEQQARYRTAIADLEQRIANASTGERVKLNKKLTTLQAQETEIRAYEEKIHHLADQMISIDLDDGVKKNYAIFQDVLAKIK

SEQ ID NO: 2958 - protein, 1221 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLEHGFRMLSHPETPTAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNILSLQESLHLDIAKLWQQLNFHQQVQTGSMGDMFAENITLAQTDSAEYQLLMRTLKRFVNAKTLGSLIQVPQEEEAELKVFLDALYRLEQEGDFQQKAAAKAFIPFIQQAWILAQRYDAVVANPPYMGSKGMNGELKEFAKNNFPDSKSDLFAMFIERGFLWLKNAGFNSMVTMQSWMFLSSFENMRENILTNYTIETMVHMGNGVMKIAFGTNATVFRNNHISTYQGSFSYVENGNINQEGNPKQFPVINERLKTATTNDFKKIPGSPIAYWISHSLLNVFETSKPISEYFDTRLGMSTANNDEFLRFWHEVSIQNIGFGCKDREEASNSLKKWFPYAKGGSYRKWYGNHDYVVNWENDGEKIRNFGIENGKVRSHNYNLDFIFRKGITWSDVTSGSNAFRVLPQGFLFDGRGSSGFCEDNLRPTILCLLNSKLSYNIINIINPTIAINVGEIAKIPLHNNLMNNKNNIENLTLEIIDLHKKDWDEKENSWNFYRNALIDKKSNNLKEALLRKYANDTIEINRCHSIESELNHQINITYDLESYVNQTVDLAQITLFKNMAYIFSDTANKESLYVTILISELISYSIGCQMGRYSLDREGLVYAHEGNKGFSELVAEGAYKTFPADSDGILPLMDDEWFEDDVTSRVKEFVRTVWGEEHLQENLEFIAESLCLYAIKPKKGESALETIRRYLSTQFWKDHLKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 2959 - protein, 640 aa, Coprobacillus sp.
MAKKNGYQAMITQHAWMFLSSFEKLRGKLLHTDIVNMAHLGARAFEEIGGEVVQTTSFVIRKSHIANYNGEYCRLIEPTTQQGKEDMFLSCENRYAADQSNFSKIPGSPVAYWVSESILAAYEQGGLIGDSADVKIGMGTGKNEIFVREWWEVFYTKIDFSLKTINDLAESNGRYFPYNKGGEFRLWFGNLQEVLWFDAEGRRYMNTMSGHRENGAHDFYCKEGLTWSFISSSKFGIRYLPTGCFFDVAGSTLFSRVDNAYTLGFLASCVCFDILGILNPTLNYQAGNIKSLPLLVDREDEVDECVYQNIQISKDDWDSYENSWDFQRHPLVSGQCSVDSEQCSDHCTLISDHYKEWEQQCDQRFSQLKANEEELNRIFIDIYGLQDELTPEVEDKDVTVRKADLGRDIRSFISYAVGCMFGRYSLDVDGLAYAGGEWDTGKYASFAADKDNIIPICDDEYFEDDIVGLFVKFVKTVYGADTLDENLKFIADALGGKGQPKDVIRNYFLSDFYSDHCKIYQKRPIYWLFDSGKKNGFKALIYMHRYQPDTIARIRTDYVHEQQARYRTAIADLEQRISNASTGERVKLNKKLTTLQAQNTEIRTYEEKIHHLADQMISIDLDDGVKANYAIFQDVLAKVK

SEQ ID NO: 2960 - protein, 1210 aa, Enterococcus faecium
MDKKAIKNFAVNARRKLIDEVMTKAKRLGIDESKIEDVKKIDSNLQEIEKSGIRIQGKEIAQRNKLIAELKQRASVTSYSEAFQELIEEVAYTWFNRLIAIRFMEVNDYLPDTYRVLSSEISGKIEPDIITDIYDADIFEELSSNEQQQVRTWKTDNSAEAMDKLYQLIFIKICNQLNDYLPELFEEVEDYTELLFTASYIKKDGVIADLLSIPEDDFYVQAGGQVEIIGWLYQYYNSEPHNQVVNIYKGIVKKQDIPAATQLFTTDWVVRYMVDNSLGKYWLDHYPNSELRNKLKYLIPDKYAFEQATSVSNLKPEELKIIDNAMGSGHILVYAFDVLMEIYLTLGYSERDAARAIVEYNLYGLEIDKRAYQLSYFAIMMKGRQYDRLFLKKSLSPNLREFIDSPKVTDEYQERISELNNDKYSERWNEYKELIFDQFENGKELGSIIKLVDKNNQAITKEYLGKVREYISKFNEFTNMDILYGMKEIQEKYLHILDVAEMLVDKYVAVVTNPPYLNKMDKKLKKYVNDNYSDVKKDLFSVFIKLNSQMLIDNGYASFMTPFVWMFISSYEKLRSFLINERNISSLIQMEYSAFEEATVPICTFTIKNSNEQDGSYIKLSDFKGGMEVQKIKTLEAIHQHGECDYFYSTNQDNFKKIPGMPIAYWASDNVITDFAQGKLTNDVADAKQGLATGNNNKFLRYWFEVEFNKIKFDAKTLEDAKKSRKKWFPTTKGGRFRKWYGNNEYVVNWENDGDEIKNYVNENGKLKSRPQNLNYYFKKGITWSTLSSGQVSFRLQNQAIFETKGSVLFSKDITDFEEIFGYVNSKLVNHFLTFISPTLDYHEGPMGKLPFLKVTSERKLKKIREKVDENIDIARKDYNALETSYEFRRNILLSYMFKKDLSEAFNCLSRQLVNQFNTLKSNEEELNDIFINHYSLEKELTKEVQDEYISARLPDKAREIKDFISYSIGCIFGRYSLDEDGLIFAGGEWDPSRYQKFKPDTDNVLLITDDEYFKDSQIDIVNRFIDFVEITFGKETLEENLQFIADTLGGKGTSREIIRRYFVQDFYKDHLKTYSNRPIYWQLDSGKQNGFKALMYLHRYTPDQLGKVRTEYLHELQKAYDNRIELRQQQISTSDNPKERNAMTKEIVKIQKQLKEVREYDEKLGHLALKRIELDLDDGVIVNYDKLQRDPKTGEKFQIFAKGVKEPKK

SEQ ID NO: 2961 - protein, 1246 aa, Vibrio cholerae; identical to SEQ ID NO: 2910

SEQ ID NO: 2962 - protein, 1205 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLEHGFRMLSHPETPTAFEVLDHVPEVAEALLPENKAQLVEMKLSGNQDEALYRELLLGQCHALHHVMPFLFEAVDDEAELLLPDNLTRTDSILRGLVDNIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQQLNFHQQVQTGSMGDMFAENTALTQTNSAEYQLLMRTLKRFVNAKTLGSLIQVPQEEEAELKVFLDALYRLEQEGDFQQKSAAKAFIPFIQQAWILAQRYDAVVANPPYMGSKYQSLSVKKHLKDNFTGYDKDLFSAFIVRNLELSKQGAQLGFMTPFVWMFITTYEELRKKLIEQEIITSLVQLEYSGFDGATVPICTFTLQKGHINHFTGSYIRLSDFRGASNQGPKTLEAIQHHNCGWFYEAQPDNFKKIPGTPIAYWLGQNINIFDNDKIANSWFSGGRIKTHNGDKYIRYIWETSRLSSKWKKLIKGGDYKKHFGNEIFLVDWSVNAIKFYEKNGGIYPSKFRDKAGICWSKITSGQASFRVKSEDVEYDSASPVIFNDKFNSDLYTLALLNTKVFNVLLKALNPTINTQVNDVMSLPFIKMEAAVQEKIETNEQLLINIAMHDWNSQEISFDFMVNSLVSESRASSEVASSYAIARKKWQDAFNKTKELEEENNHLVITSSNFNGINEELIDSEITLVSNPYYKYGDSTTNNETRLLSDSIADVLSYSIGCMMGRYSLDREGLVYAHEGNKGFAELAAEGAYKTFPADNDGILPLMDDEWFEDDVTSRVKEFVRTVWGEEHLQENLEFIAESLCLYAIKPKKGESALETIRRYLSTQFWKDHMKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEAI

SEQ ID NO: 2963 - protein, 1239 aa, Lachnospiraceae oral
MNKSAIKNFAIWARNKLITDISYRAGLMGITTEGIAEALPQSMGGTEFYDIGTENPYSISGDAIKQRKKLVEVIREKEADTDYATAYKYIMEEVAYTWFNRLIAIRFMEVNEYLPTHIRVLSSDSGKLEPDIVTNPFDTELQFTEEEKEKIVQLKTDNRLDELFCMLFIKQCNALNENLPALFEKTNDYTELLLNISVIDREGVVYKLVHDIPEDDFNIEKGGQVEIIGWLYQYYNTEPKAQVFARPSGTKIRKEDVPAATQLFTPDWIVRYMVENSLGRLWVEGHPNDELKANWKYYLEEAKQEPEVEEKLTEIRREYAKLNPEDIKLIDPCMGSGHILVYAFDVLMQIYESAGYGQRDAARSILENNIYGLDIDDRAFQLAYFAVMMKARQYNRRILNGEHKPNLFSIKESNGINRNHLKYFGMNLSEDDTEKAVSQINALLDTFIDAKEYGSILTVEEYEWGLLESFVADSEPTGQISMETVGIEATKENLLQIIEQGKVLEEKYHVVVTNPPYMAISNSNNKLNGYVNRKYIGGKTDMFSVFIERCLQFTIRNYYTSMITMQSWLFLTSFEKIRNKILDNEIASLAHLGARSFDEISGEIVQTVVFTIKKISLEGRYKGLYSRLVSGNSEKEKECLFLYQNNLYISKGENFRKIPQRLIAYWVRENTIKCFDYPALDEIFITREGMATADNERFLRLWSEVRFDSITLDCATSKQAAEKDVKWIPYNKGGKERDWYGNNEYIVDWSHDGYTIKNNIDIETGRVRSHNYNGEFGFKEGITWSAISSGDLSVRYCPEGFLFDSKGAKGFVKKSNEDLIWILGLLNSKVSMQFLQFISPTLDFKVGDIVSLPFISDKERQSDILVLVKELVSYSKTDWDSYETSWDFAFHPLVKNDICNVAITADPRTISDSYHSWVSECEQRFLGLKANEEELNRIFIDIYGLQDELTPEVSDKDVTVHRVYDSKEDVPESMKGSAYIRTKRDEIVSLLSYAIGCMFGRYSLDSEGLAYAGGEWDETKYITFMPDTDNIIPLTDEEYLEDDIITRLCTWLKVVYGEDTLEENLDFIAKALGNKGNTSREIIRNYFLNDFFKDHCQTYSVTGSGKRPIYWLFESGKQNGFKALIYLHRYNADTVGNLRIDYLHRMQRIYESEIGRMQDTIDHSSNAREVAAATKRREKLQKQLKECREYDEKIAHLALSRIELDLDDGVKVNYRKLQTAADGKFYEVLADSKNIMSKK

SEQ ID NO: 2964 - protein, 1214 aa, Salmonella enterica
MNTNNIKKYAPQARNQFRDAVIQKLTTLGISADKKGNLQIADAELVGETVRYGQFDYPKSTLTRRDRLVKRAREQGFDVLVEHCAYTWFNRLCAIRYMEIHGYLDHGFRMLSHPENPTGFEVLDHVPEVAEALLPEKKAQLVEMKLSGNQDEAIYRELLLAQCHALHRAMPFLFEAVDDEAELLLPDNLTRTDSILRGLVDGIPEEDWQEVEVIGWLYQFYISEKKDAVIGKVVKSEDIPAATQLFTPNWIVQYLVQNSVGRQWLQTYPDSPLKGKMDYYIEPAEQTPEVQAQLAAITPASIEPESIKVLDPACGSGHILIEAYNVLKNIYEERGYRARDIPQLILENNIFGLDIDDRAAQLSGFALLMMARQDDRRIFTRDVRLNIVSLQESLHLDIAKLWQQLNFHQQSQTGSIGDMFAENTVVPHTDSVEYQLLMRTLKRFVNAKTLGSLIQVPQEEEAEVKAFLDALYRLEQEGDFQQKAAAKAFIPYIQQAWILAQRYDAVVANPPYMGNGGMNSDLKTFAKTYFPDSKSDLFAMFMQHAFSLLKENGFNAQINMQSWMFLSSYEALRGWLLNNKTFITMAHLGARAFGQISGEIVQTTAWVICNRHEKNYRPDFFRLTDGNEKQKQSNLINRKFHFHNIIQENFKKIPSSPISYWVTEKITNNFQLGTPLYKISEARRGLASGNNEKFIREWTEVNKNSISILNIENANCKWFIHNKGGEAKRWYGNNSLIINWENNGHAIKNQEAKTSGDRGWRATSEEFYGKDGITWGGLTNAFLTFRWSDYGALFDTNKGPMMFPQENAYYLLGFLNSPLAIEYCKLLNPTISFQNADINRIPFFLPSHDTNNKIQEKVLECIDIAKNDWFNYEFNWGFKENPLLRVRSSIQLAFDSYKEKSNEYILKTKDIQLEINKHFCELGGLDLNDYNNDIHLLCNESYRYNESDNKESRFKSDTLSELLSYIIGCMMGRYSLDREGLVYAHEGNKGFAELVAEGAYKTFPADNDGILPLMDDEWFDDDVTSRVKEFVRTVWGEEHLQENLEFIAESLCLYAIKPKKGESALDTIRRYLSTQFWKDHMKMYKKRPIYWLFSSGKEKAFECLVYLHRYNDATLARMRTEYVVPLLARYQANIDRLNEQVDGASGGEATRLKRERDSLSKKFNELRSFDDRLRHYADMRISIDLDDGVKVNYGKFGDLLADVKAITGNAPEII

SEQ ID NO: 2965 - protein, 1226 aa, Pectobacterium wasabiae
MNTSNIKKYAPVARKQFRDAVMQKLTTLGIEADKKGNLQIAQATDLGDSVRYGQFSLDKSLTSRRERLVKRAEKQGYDVLVEHIAYTWFNRFCAIRYMELHGYLDHGFRMLSHPTLEGGFEVLDHVPEVAEALGLDKARPVEMKLAGDRDEELYRELLLAQCHTLHGAMPFLFEAVNDDIELVLPDNLTRTDSILRGLVDTIPEEDWEQVEVIGWLYQFYISEKKDDVIGKVVKSEDIPAATQLFTPNWIVQYLVQNSVGSQWLQTYPDSSLKGKMPYYIEPAEQTPEVQVQLAAITPSSIEPESIKVLDPACGSGHILTEAYNVLKAIYEERGYRTRDIPQLILENNIFGLDIDDRAAQLSGFAMLMLARQDDRRILSPGRGVRLNIVSLQESKLDVAELWTKLNFHQQVQRGSMGDMFAEGTALANTGSVEYKLLMRTLALFTSAKTLGSLIQVPHEDEEALKAFLDGLYRLEVEGDIQQKEAAAELIPYIQQAWILAQRYDAVVANPPYMGGKGMNSELKEFAKKQFPDSKSDLFAMFMQHAFSLLKENGFNAQVNMQSWMFLSSHEALRGWLLDNKTFITMAHLGARAFGQISGEVVQTTAWVINNNHTKSYQPVFLRLIDGSEEQKKTEFLEKKKRFNNILQDDFKQIPGSPIAYWIDKETLGSFLLHKKLGDAIALKAGMSTGDNTIFQRYWFEVSLNKTTIKKNKSMQHTVTAIDKWVPCSSGGEYRKWYGINELVVNWLNDGHHIRNYRFENGKVRSAVRNDEYYFREGVTWSKISQGNFCVRYRPEGFVFDDTGRCGFSNDKNELLYAAGLMCTPVANHYLSILAPTLSFTSGELSSIPFPTYEVQITELVRKAIDISRHDWDSKEISWDFKSLSLTENNKSARLRLIFNEKILSDAKVVELLLSIENDINDIFIEKVGLKKSLIDSVSKDNITLFCNPLYRYKNASNDEDKYNRYLTELVEDILSYIIGCQMGRYSLDREGLVYAHEGNKGFAELVAEDAYKTFPADEDGILPLMDYDWFDDDVASRVKEFVRTIWGDEHLQQNLDFIAETLCLYAIKPKKGESSLDTIRRYLSTQFWKDHMKMYKKRPIYWLFSSGKEKAFECLVYLHRYNEGTLSRMRTEYVVPLLARYQGNIDLINDQLKNAESGAANTRLKKELNGLTKKFNELRGFDDSLRHYADRRITIDLDDGVKVNYGKFGDLLADVKAITGSAPEEI

SEQ ID NO: 2966 - protein, 245 aa, Escherichia coli
MMGRYSLDREGLVYAHEGNKGFADLVAEGAYKTFPADSDGILPLMDDDWFEDDVTSRVKEFVRTVWGEEHLQENLEFIAESLCLYAIKPKKGESALETIRRYLSTQFWKDHLKMYKKRPIYWLFSSGKEKAFECLVYLHRYNDATLPRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 2967 - protein, 914 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLDHGFRMLSHPETPAAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNVVSLLESLHLDIAKLWQQLNFHQQVQTGSMGDMFAENTALTQTDSAEYQLLMRTLKRFVNAKTLGSLIQVPQEEEAELKVFLDALYRLEQEGDFQQKAAAKAFIPFIQQAWILAQRYDEVVTNPPYMGNGGMNSELKAFAKNNFPDSKSDLFAMFMERAFSLLKSNAYNAQINMQSWMFLSSYEKLREKLLKLKTFHTMAHLGAKAFSQISGEVVQTTAWVALNEHIDMFKPTFFRIIGGSEHEKQKTLIEKKDGIILHSQNNFMKIPGAPFVYWNVDKISKYFENTKTIGDLCDARKGMGTGDNASFVRAWHEVSLGNIGFNFDSRENASASNIKWFPYNNGGRYRKWYGNNEDVVNWYQDGVEVKATATIKNNGGHWSRYLVSLDRFFCQGLTWSDISSGNFGARYFDKGYLFSSVGMCVFSETHSIYNLLGVLNSSITQEILDSISPSLHYGVGEIKKIPLKIINNDDEIKELVQIYANDWGSVETSYEFLTLPIIANKSDAQSIRNNYSSLLEIQQKYIGKAFF

SEQ ID NO: 2968 - protein, 1228 aa, Ruminococcaceae bacterium
MNKGAIQRFAIWARNELIAQVSQRAYQYGITKEGCGEANAVTVGGRALTGDEQKQRKELVDQIRSKGYTQVMEEVAYTWFNRFIALRFMEVNNYLPSHIRVFSDSTGAFKPEILSDVLHLDLPGLNREKVAEYIESNDTEGLYRYLLLTQCNALNDPLPRMFEKMGGYTELLLPNNILKQDSVLGHMVADIPEKDWTDQVQIIGWLYQYYNSELKDDTFALLKKNVKITKERIPSATQLFTPDWIVRYMVENSLGRIYVDKRKNEGIYADGRGLDEMTWHEAESERIATETLIADKMGWKYYLPEAEQTQEVRKQLDEIQNEYATLDVKDIKVIDPCMGSGHILVYAFDVLMQIYEASGYSQRDAAQSILENNLYGLDIDDRAAQLAYFAVMMKARQYNRRVFSRGIQPHVYAIVESNGLDSSSVEYFTNNDPKLKKDFGTLMDELRDAKEYGSILNISQVDFAALYARVEEVRADISMFREIVLNSILPLIQAAEVMAQKYDVVVTNPPYMGISNASEKLNQYAKKAYPISRYDLSTICMEKTLSMCNKTGMMAMINIPVWMSKSSFEDLRYSLLTKHTFVNMLHCGRGIFGSDFGTTAFVIRKSFEKGYAATFHQLFDEMGAVDSVEQKERWFFERKGLYIAEQKKFLNIGSYPIAYSTSKRLLEILDTEKPLSDFAYPRKGLTTGDNDTFIRLWFEVSGQKFSMTGNGRKWFPMTKGGDFRRWYGNNDYVVNWENNGFALRNFKDEDGKLRSVLRNTQFYLRECISWNDTTATGKIAFRYQPEGYISNASGPCVFADHDLFYLFGLLNSIVSQKLLEILAPNMKFEVGQMALVPIIKKQSNYIDDLVRKTVDIVTSDWDSFETSWDFKLHPLVENQQYAATYHFDEQNSPAHHISAAYQMWVATTERRFQQLKTNEEELNRIFIDIYGLQGELTPEVEDKDVTVRKADLGRDIRSLISYAVGCMFGRYSLDKPGLVFAGYSKIEQTTKTLDGEDPELEKFAKQNADGSVSYGSYYHEVNQDNYKSFSIDTDNIIPICDDDYFDDDITGRFVKWVETVYGKETLEENLKFIADALGGKGTPREVIRSYFLNDFYADHCSTYSVTGSGKRPIYWLFDSGKKNGFKALIYMHRYQSDLLARMRTDYVHEQQERYRTQLTHLADAIEHAGAAERVKLTKQQKKLQEQALEIQKYEEKIHHLADQNIQIDLDDGVKHNYELFADVLAKIK

SEQ ID NO: 2969 - protein, 1175 aa, Holophaga foetida
MDRSKLKTYAPQARRDFIAAMKARAALLGITDKGIAPATIQGDSAIIQGQAFPKVVEVLRQRLALRIEGEGFEQVMEAMAYTWFNRFAALRYMELHGYLDHGYRVLSHPEGKATPEILEQAEHLDLPGLKREQVVDLKLEGKEQELYRLLLVAQCNALHQAMPFLFEAIEDETELLLPDNLLHSDSLIRKLVSNLDAEDCESVEVLGWLYQFYIAEKKDTVMARKSAVPTEDIPAVTQLFTPHWIVRYLVENSLGRLWLLNRPGSRLREQMPYYIEPDPKDAPETDFLKITKPEEIRLMDPAVGSGHMLTYAFDLLFLIYQEEGYAPTTISGLILRHNLHGLDLCPRAAQLAGLALVFKAREKSRRFFQVGQLVQPNIIELRDVCFVDNELRDYIQALGLGDLFSQPMLKLLHQFEEAKNFGSLIQPCLDEASIAFVRSAIEAKGIGGQLFLRETHLKVLRVLEQAEALTQRYHVVVANPPYMGSKNQTAALKGFLETNFEPFKADLFSAFFIRSRTLALSDGFLGFMSPFVWMFIASYENLRRELIERASITSLVQLEYSGFEGATVPICCFTLNNRYKPKHKGAFIRLSTFRGAENQAPRTLEAIRNKECGWFYSTATEEFQKLPGWPIAYWLTSRTRECFATNAPLESICNIREGINTGDNTRFLRYWSEVDLLRISFTTQPAGAVEQKWVPHKKGGYFRRWYGNAEFVLNWEGNGVDIHSFHNLPLSFNGAPMRGKAHFFKESLSWSRISSGSFAIRYYPAGFSYDSTAPSIFTSPEFTAFVLGFLNSEVVTCLLAALSPTLDFRLTNIGNLPLALKTGDSDSRDSVNRVVSACMDLSRADWDNFETSWDFRDHPLLRPGLKSATLEASWQNWERHSTAAFRRMQELETENNRLFIAAYGLDGELEPEVPEEKITLARADVRKDVAAFLSYALGCMMGRYSLDKPGLIYAHAGNVDFDASQFATFPADEDGIVPVTEFAWFPDDAATRFEAFVKTLWHGSTLEENLAWVAESLDTKKDETPRETIRRYYATGLYKDHLQTYKKRPIYWLFSSGKERAFQALVYLHRYHEGTLARMRTEYVIPLQGRISGRIEQLREDLPRATSAAHSKKLQKELDLLRKQQVELHTFDEKLRHQADRRINLDLDDGVKVNYGKFGDLLAEVKAITGGKDEE

SEQ ID NO: 2970 - protein, 1221 aa, Escherichia coli; identical to SEQ ID NO: 2958

SEQ ID NO: 2971 - protein, 1216 aa, Oribacterium sp.
MNKTAIKNFAIWARNKLIADISYRAGLMGITAEGIQKALPQSTRTTEFYDIGTAEPYSISGTEVKQREKLAELIRKKEKETNYKTAYKYVLEEVAYTWFNRLIAVRFMEVNDYLPSHIRVLSSDSGKTEPDLVTNPFDAGLSFTQAEQQEIIRLKQENKTDEAFRLLFIKQCNALNEILPALFEKTSDYTELLLNLSVVDRDSVLWHLVHDIPETYFDVNRGGQVEIIGWLYQYYNTEPKNEAFSKKGKISKEEVPAVTQLFTPDWIVRYMVENSLGRLWVEGHPNDELKAGWKYYLEEAEQESEVQAQLAEIRKEYAKLNPEDIKVIDPCMGSGHILVYAFDVLMQIYESAGYGQRDAAESILENNLYGLDIDDRAFQLAYFAIMMKARQYNRRILNREHKPNVYSIQESKGIDRNQLKFFGAGFREIEKKRAIEQMNGLLDTFKDAKEYGSILTVDQYDWELLDRFVSNIEVVGQMSMDTVGLDDTAEEVKQLIAQGKVLAQKYHVTITNPPYMGNNGMSVKLTDYLRKVYPNSKSDLYSVFIECCGYTTLKHGFRAMITQHGWMFLSSFEKLRLSVENADIICMSHLGARAFDEISGEVVQTTSFITRNSTYSGYKGTYVRLLTSTSESGKEQLFLSGNSRFYSGRECFDMIPGEPIAYWFSERLLRVFKNQALSDVAKPRQGLATGDNDTFLRLWTEVNIRRIGFGYQSRSDAKRSGAKWFPCNKGGSYRKWYGNNDYIVNWENDGFEIRNNYDKNGKLKSRPQNVDFYFREGITWSTIASGNLAMRYSPVGHMFETKGSVCFPNNKSQLLYLLGLTNTPIVSTILSVLSPTLDFHEGPLGKVPVIINGDYFKSVSERVNECIEVAKADWDSFETSWDFESHPLTKQVLSHSHWNAESVTVESCFRAWSDECDRRFEELKANEEELNRIFIDIYGLQDELTPEVEDKDVTVRRADLQRDIKSLLSYAVGCMFGRYSLDTAGLAYAGGTWDEQKYEKFKPDGDNVIPITDEEYLEDDIVSRLCEFLKVVYGEEKLEDNLDFIAKALGNKGDSSREIIRNYFLNDFIKDHCQTYSVTGSGKRPIYWLFDSGKNNGFKALIYLHRYNADTIGNLRIDYLHRMQRIYESEMSRMQDIIDHSTNAREVVQATKRREKLTKQLKECREYDEKLAHLALSRIELDLDDGVKKNYRKIQTANDEKFYEVLADSKNIMSKE

SEQ ID NO: 2972 - protein, 267 aa, Escherichia coli
MDINKRHQCEVITDLISYIIGCMMGRYSLDREGLVYAHEGNKGFADLVAEGAYKTFPADSDGILPLMDDEWFEDDVASRVKEFVRTVWGEEHLQENLEFIAESLCLYAIKPKKGESALETIRRYLSTQFWKDHMKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 2973 - protein, 838 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLEHGFRMLSHPETPTAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQQLNFHQQVQTGSMGDMFAENTALTQTDSAEYQLLMRSLKRFVNAKTLGSLIQVPQEEEAELKAFLDALYQLEQEGDFQQKAAAKAFIPFIQQAWILAQRYDAVVANPPYMGGKYLAPAVKNHLKENYSGYDKDLFSAFIIRNLQLSKNGAQLGFMTPFVWMFISSYEELRLQLINNETIISLIQLEYSGFDGATVPICTFTLQKNHISNFSGSYIRLSDFRGAANQGPRALEAINNKDCSWRYQTNQESFKKIPSNPIVYWIKPQTSILFTNKKIGELYEVKEGLGTRDDDIFLRRHWEVSRKKTKTDKSLKKWIKTDKGGSFRKWFGNDEFIMNWENNGYAIKNHRNADGSLKSRPQNTQYFFKDAISWNKIGSGETSFRIRDSIGGFNDAAPSIFGDNLTILIGLLSSSLYQYLIQLQGGTLNVTTGIIKTYH

SEQ ID NO: 2974 - protein, 1171 aa, Acinetobacter johnsonii
MNTSNIKKYAPQARNDFIAAMRKQAAKYGITADNILPAEQKGDLLLIGDQVFPLSVMKPRDKLIKRIQTSSFEQTIDYIAYSWFNRLCAIRYMECKGLLDHGRRVLSSADGCAGLPQILEECLDIDLPGLDASRVAELKLDGNKDEELYRELLLAQCHALNQVMPLLFEQVSDESELLLPDNLTKTDSLIRDLVSSIPEEDWSDVQIIGWLYQFYISEKKDQVIGKVVKSEDIPAATQLFTPNWIVKYLVQNSVGRLWMMAQPDSTLASEWEYYIQPAEQTDEVNAQLKQLIDVRISEDGDTLNPESITVLDPACGSGHILVEAYDCLKAIYLERGYRSRDIPRLILENNLYGIDIDTRAAQLSSFALLMKAREDDRRLFSNPPKLNIIALQDSQPERLEAFGQDLANTGIAQADLKELLDLFEHASTFGSLIQIPQTFAKKLPDLESKLNTALESGDIFAQQSAQELLPLVQQAKLLAKQYDAVIANPPYMGGKGMNTALKDFAKKKFPDSKSDLFAMFIERGFNWCKDNGFNSMVTMQSWMFLSSYEAMREKLLQYRTIQTMAHLGARAFPEISGEVVQTTAFVMQGKHLDGFKPVFFRLVDTAQDSKEIELKAGLNRFDSTVQDDFKKIPGSPIAYWVSEKVREIFETSPSMGEVADARQGLATADNNRFLRFWQEVNIQRVGFGIENREIAIRSRKKWFPYNKGGDFRKWYGNQEYLVNWENDGLEIRENVDENGKQRSRPQNTEFYFRPSVSWSDVTSSTNAFRYFPHGFIHDVKGQSAFSNSEAERYKLLSLLNSNFIKYLMPILNPTISFQVGNFNQLPYLNLSSDISRNIQIAKLDWDSYETSWDFTQNPIIRTQQPNLEQAFHTWQQQNADAVAEMKRLEEENNKLFIDAYGLQDELTPDVPDEQITLTRANREKDSQRLVSYAIGCMMGRYSLDEPGLIYAHAGNQDFDASRYQTFPADADGIIPLTEMHWFEDDATHRIQEFLTAVWGKDTLDANMQWLAESLDKKASETAEDTIRRYLASKFYKDHMQTYKKRPIYWLFSSGKQGAFQALVYLHRYNESTLARMRTEYVMPLISKMAAMVNSLQSEIENSDSAAEIKRKEKELQNLHKQQAELSSFEEKLRHYADQRISLDLDDGVKVNYGKFGDLLAEVKAITGGSGE

SEQ ID NO: 2975 - protein, 846 aa, Selenomonas sputigena
MNKNAIKKYAVWARRELIDRVSKKAMRYGIAPEIPADPEADSVEGRLLSDTEKKERRALIEKVAAHGYEQTMEEAAYTWFNRFAALRFMEVNGYLPSHVRVFTNDAGEFKPQILAEAIHLDLPGLDKEKVYALKEGNDEEALFRYLIIVQCNALNEILPGMFQRLEDFTELLLPDNLLREGSVIERLVKQGDAGSIPEEDWRDQVQIIGWLYQYYNTALNELVYDGNLSKEKIPKHLLPAATTIYTPDWIVRYMVENSLGRLWLEGHPNENLQGEWKYYLPEAEQEESVQKQLAEMRKESANRKPEDIRCIDPCMGSGHILCYMFDVLVKIYEDYGYTAREAAASIVQNNLYGLDIDDRAAQLSYFAVMMKARQYDRRFFSRGIQPNVMAIEESNGLATWAETAGDSLVSGQLTFEDDFIRMADYLIEIFQDAKEYGSILTVQADRYDALVDFIEKTGQETGNLLFRAWIDEVERRILPLIQQAKVFSQKYDVIVTNPPYLGSTRFSFKLNEYVKKYFPNEKSDLSMVMLKKSLQETAKTNGYVAFVTTASWMSLSSFEKLRSYMYKDCAIDTLVDCGTELFEGKVGHNSIVSWVVRKTKFNYRMTAVRLVDYCYSRRDEKEVEFFNKKNYFVATQENFSKIPGSPVAYWVSEAMLRCFGEKCIKDYGFAGIGMRTGDNERFLRLWYEVSANNFSITSKGVIKWIPYNKGGNFRKWYGNNEYVVNWENDGEEIKDNTRLNYPELGDNLGWKISNEKYYFKPGITWTGVTMAKFSCRIYPSGFIFDSGANGLFPYKKQDESYLAGFLNTKIANDILRIINPTINTGSGTVKSIPVIKSKTQQKKLMN

SEQ ID NO: 2976 - protein, 1169 aa, Acinetobacter junii
MNTSNIKKYAPQARNDFIAAMRKQAAKYGITADSILPAEQKGDLLLIGDQVFPLSVMKPREKLIKRIQTSSFEQTIDYIAYSWFNRLCAIRYMECKGLLDHGRRVLSSADGNAGLPQILEECLDIDLPGLNASRVAELKLDGNKDEELYRELLLVQCHALNQVMPLLFEQVSDESELLLPDNLTKTDSLIRDLVSSIPEEDWSDVQIIGWLYQFYISEKKDQVIGKVVKSEDIPAATQLFTPNWIVKYLVQNSVGRLWLMAQPDSTLASEWEYYIQPAEQTDEVNAQLKQLIDVRISEDGDTLNPESITVLDPACGSGHILVEAYDCLKAIYLERGYRSRDIPRLILENNLYGIDIDTRAAQLASFALLMKAREDDRRLFSNPPKLNIIALQDSQSERLQAFSQDLASTGIAQPDLKELLDLFEHASTFGSLIQIPQTFAKKLPDLETKLNTALASGDIFAQQSAQELLPLVQQAILLAKQYDAVIANPPYMGGKGMNTALKDFAKKKFPDSKSDLFAMFIERGFVWCKDNGFNSMVAMQSWMFLSSYEAMREKLLQDRTIQTMAHLGARAFPEISGEVVQATAFVMQGKHLNGFKPVFFRLVDTEQDQKENELKAGLNRFDSTIQDDFKKIPGSPVAYWVSEKVREIFILGKYVDDVAEPKSGLSTTDNNQFLRFWFEVSYLKIGFGITSIINTQDSDYMWFPFVKGGDFRKWAGNEEYVVNWKNNGRDIREKTKGAAGGRIVSPEFYFKTGVTWSGISSSLPSMRKMTNSIFGSGGKALFSNEHLDVFLGFMNSKIAISLLNIISPTLNYEAGHIGKLPVVKFDSIPINKVIQSLVDISRSDWDSYETSWDFTQNPIIRTGQLNLEQAFNTWQQQNADAVAEMKRLEEENNKLFIDAYGLQDELTPDVPDEQITLTRADREKDSQRLVSYALGCMMGRYSLDEPGLIYAHAGNQDFDASRYQTFPADADGIIPLTEMHWFEDDATHRIQEFLTAVWGKDTLDANMQWLAESLDKKASETAEDTIRRYLASKFYKDHMQTYKKRPIYWLFSSGKQGAFQALVYLHRYNESTLARMRTEYVMPLISKMSAMANSLESEIENSDSAAEIKRIEKKLQNLHKQQAELSTFEEKLRHYADQRISLDLDDGVKVNYGKFGDLLAEVKAVTGEK

SEQ ID NO: 2977 - protein, 1237 aa, Shewanella baltica
MNTAKLKKYAPQARREFITAVSKQLNQLGIYSDKQISEVKQEGSVLLIEGKAFELSVKIARERLVKKVQVMGYNQLVEQVAYTWFNRLCAIRYMEIHDYLGHGFRVLSHPNNPKGFEILDHAQDAIDELSSENQKLDRARIIELKLAGNKDEELYRELLLGQCHKLHEAMPFLFDALDDETELLLPDNLTRTDSILRGLVDGIPEEDWQQVEVIGWLYQFYISEKKDQVMGKVVKSEDIPAATQLFTPNWIVKYLVQNSVGRQWLQTYPDSAIKTQMEYYIEPAQQSEEVNQQLKAITPLSSNGEGIEPETIKVLDPACGSGHILIEAYNVLKAIYEERGFRSRDIPKMILENNLYGLDIDDRAAQLSGFALMMMARDDDKRIFTRNVRLNVLSLQESNHIDLPTLWKALNLSGSWQSGTSQGLFSDEEQDLSSFNADDCMDAGGRATQDAKADNRYQLLKRTLARFSQAKTFGSLIDVPSDEHDQLKELLSTLVELQESGDSMQKPAAKQLIEVIHQALVLSIRYDAVIANPPYMGAKGMNADLKDFAKKNFPNSKSDLFAIFIERGFSWLKEAGFNSMVTMQSWMFLSSYEQMRDSILSHATIENMVHMGNGVMKIAFGTNATIFRNTHFKGYRSSFSYVDNDDINEDGHPKEFPVINGRIRDVASDEFKNIPGSPIAYWVDRSVVDCFRKNKTIGDVSDVKQGLATANDDRFLRAWFEVDCSKISFPSSFEPNKKWFAFNKGGDFRKWYGNNYLVVNWENDGEEIKGFREGGKQKSRPQNTSYYFKQGVTWGQTSSGKSSFRWVDNGYIFAHISSMLFSSSDDEGKLKLAFLNSTSGIYLLELFSQSMGVEVGHIKSLPYIPVGDGEIISKINRLISIHKCDWDSHETSIGFNDHKFVAFKNKCLREIASYYLEFDLKIVDEIRLVETEVNSFFSQATGLSNVVLNDVDISEVSVSTNPHYLYPTDSNRIDRYTSESLVQLISYSIGCMMGRYSLDRDGLIYAHSVNEEFDKLAAEGAYVTYPSDEDGIVPLTDQEWFKDDATNRFREFVQVVWGEEHLQENLDFVAESLCLNAIKPKKSESALETIRRYLSTQFYKDHLKTYKKRPIYWLFSSGKQKAFECLVYLHRYNEGTLSRMRTEYVTPLLGKYDAYAEQLEKQIETADSTSEANRFKKELDALIKKQVELREFDDKLKHYADMRISLDLDDGVKVNYGKFGDLLADVKAITGSASEDN

SEQ ID NO: 2978 - protein, 1246 aa, Vibrio cholerae; identical to SEQ ID NO: 2910

SEQ ID NO: 2979 - protein, 530 aa, Escherichia coli
MKLWYEPSLRKINFSAKDRADALNSQAKWFPCQKGGSYRKWFGNHEYLVNWENDGRELLDFAASLYGSPTRTIKNIPFYFREGATWSTISSSDFSIRYSPTGFISETKGAVCFADDKDILLSILGFGNSKLVNYFLKSLSPTLDYHEGPIGKLPFKGKLKAQVLENVVNLIAISEEDWNTEETSWGFKKHPITKLDNLNYLQASFEAFKNDVQETIIRTQQLEEFNNKEIIREYGLESELNYKVSLEEITLTVNPDYKYSGTTDDKSKRMQSDSLSSLLSYAIGCMMGRYSLDREGLVYAHEGNKGFADLVAEGAYKTFPADSDGILPLMDDEWFDDDVTSRVKEFVRTVWGEEHLQENLEFIAESLCLYAIKPKKGESALETIRRYLSTQFWKDHLKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 2980 - protein, 634 aa, Escherichia coli
MNTNNIKKYAPQARNDFRDAVIQKLTTLGIAADKKGNLQIAEAETIGETVRYGQFDYPLSTLPRRERLVKRARELGFEVLVEHCAYTWFNRLCAIRYMELHGYLDHGFRMLSHPETPAAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQQLNFHQQVQTGSMGDMFAENTALTQTDSAEYQLLMRTLKRFVNAKTLGSLIQVPQEEEAELKVFLDALYRLEQKGDFQQKAAAKAFIPFIQQAWILAQRYDAVVANPPYMGGKGMNGELKEFAKNNFPDSKADLFAMFMQHAFSLLKENGFNAQVNMQSWMFLSSYEALRGWLLNNKTFITMAHLGARAFGQISGEVVQTTVWVVNNNHTEFYRPVFFRLINGSEEEKKVH

SEQ ID NO: 2981 - protein, 1246 aa, Vibrio cholerae; identical to SEQ ID NO: 2910

SEQ ID NO: 2982 - protein, 1157 aa, Alcanivorax pacificus
METSKLKKFAQFARRSLLEQVTAKLKLVLADESPARRERPQAIKKLEEAVTDQGKEQVIERVAYIWFNRFCALRFMDVNRYNRIGIVSPAEGQFQPEILADAKMGHIDEEMVSEATRQKIFTLLDGKTPSQDPQGEAYRLLVVAACNYWYSAMPFLFERIDDYTELLMPDDLLSGNSILAYTREAMTPDACEDVEVIGWLYQFYISEKKDQVFADLKKNKKVTPENIPAATQLFTPHWIVRYLVENSLGRLWMLNRPDSGLIERMDYYIKPEDPEADFLRISSPEEIKVCDPACGSGHMLTYAFDLLYAIYEEEGYESAEIPAKILTHNLYGIEIDERAGELAAFALTMKARARQRRFFRKPVQPNIVVLENVSFTESEMQDVATLVGKDLFTDELRETLCRFEQAKNFGSLIVPKLTDPSQTLSVLEDGGLCDDMLLKEVQARLVAVLRMAEVLSPKYHVVVANPPYMGRRSGMNDVLKKFINDFFIEGKADLYAAFLKRASLLGVERSLHGLVTMQSWMFLSSYKGIRELLVRNHTIDSVLHLGPRAFPEIGGEVVQVAATSFSKLRNLDNKPIFIRAVDRTAEEKSQALKDKRNFFSKVSQLEFLGIPDCPLPYWLPEQLIALFGRSKKVEDYSDQRQGLATGDDDRFLRTWPEVSSARTNWDAEKFPDQAFPWFPFIKGGSFRRWYGNNEHVIKFDQESFTALSQQGNCLPSRSYYLRESVVWSDIAGSAFAARFNPQGKVFATGALSAFPSQTPISSLLGYFNSNIHKEVMYALSSGMHYSVGYVDKSPYLHSDVPHSRVGEITKICVALSKSDWDAYETSWDFTSSPLLTLDHRAETLEASYTLLRTNWQRMTEEMQRLEEENSRIFIDAYGLHDELFPEVPLEEITLTCNPAYRYGVKGSEEDRETRLCADTMAELISYAVGCMFGRYALDKPGLILANQGETIADYLKQIPEPSFPADEDNVIPMLDGDWFTDDITERFREFLRIAFGEEHYEENLRFVEQALGKDIRKYFLKDFYNDHVRRYNKRPIYWLFSSPKGSFNALIYMHRYQPHTVGTVLEYLRDFKDEKLQARKNHLEAVSISAGASQGEKTKALKEIENINKILAELDDYERDVLYPLATEQMEIDLDDGVKANYPKFGDALKKITGLSQ

SEQ ID NO: 2983 - protein, 1246 aa, Vibrio cholerae; identical to SEQ ID NO: 2910

SEQ ID NO: 2984 - protein, 1246 aa, Vibrio cholerae; identical to SEQ ID NO: 2910

SEQ ID NO: 2985 - protein, 1159 aa, gamma proteobacterium
MDTSKLKKFAQAARQELLEQVGSKLAFVLKPESPARREYPAVVNELEKAMSAHGKAALIDQVAYTWFNRFCALRFMDVNGYNRVGVVSPAEGQVQPEILAEAKSGVLDDGQINAQTIEKIRGLLNGSIPSPDAQSEAYRLLIVGSCNALYDRMPYLFERIQDFTELLMPDDLLSDNSILTKMREVMTPESCTDVEIIGWLYQFYISEKKDEVFAGLKKNQKITAENIPAATQLFTPHWIVRYLVENSLGRLWMLNRPNSKLTEQMEYYIAPEEPESDFLKIGSPEEIKIADPAAGSGHMLTYAFDLLYAIYEEEGYDPNDIPGLILSNNLYGIEIDERAGALASFALEMKAAAKLGRRRFFRMDAKPNVCVLEDFTFTDSEMDDVMSIVGKDLYSADLRETLTQFEQAKNFGSLIVPKLKDPAETLRLIETKDLAGDMWLTEVHERLVRVLRMAEYLSPKYHVVVANPPYKKKGDLNGQLQSFLVEKFPDCFSDLYAAFIDRLNKLCRRHCLFAMIAMDSWLFGDDFTEMRIRLLSGAPFKQLAHLGPRAFDQIKGEVVQVASFVSQRHGDPSQVAQFFDLTDGQTSEEKASMLRKRHGKHLARGTDFSCLPRNVVAYFVSDHTRNAYAKGTPLKEIAEAFTGLQTGDNDRFIRCWPEVNSNSIANNNSYDVIGSDDHPWVRYIKGSDYRKWYGNGFLVLNWARNGQAVINHPSARPQNREHYFKPGLAYNTIAKKFSARRVYGGEVFDQKNSMFIAANDVSLDESLALLHSNSIVPLLRVVAAKDFGPGSMKLLPMPSDGIPLPAREITLQSVRLARADWDAYETSWDFSTLPLISHDHRGETLAERYASLRTHWQSMKDEMQRLEEENNRIFIEVYGLQDELSPEVPIEEITLTCNPAYRYGIKGTKEERETRLKADTMAEFLSYAVGCMFGRYSLDEPGLILANQGETLADYLARIPEPAFMPDDDNVIPLIDFEGDWFEDDISERFKQFLRVTFGDQHYAENVAFIEDALGKSIQKYFVKDFYNDHVQRYKKRPIYWLFSSPKGTFNALIYMHRYTSSTASVVLNEYLREFRTKLEARRDSNEQISISASSSQKEKTAALKMIDKLNKAIEEVNDYEREVLYPLAGQNIAIDLDDGVKHNYPLFGKALKKITGLS

SEQ ID NO: 2986 - protein, 1204 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLDHGFRMLSHPETPAAFEVLDHVPEVAEALLPENKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQQLNFHQQIQTGSMGDMFAENNALTQTDSAEYQLLLRTLKRFVNAKTLGSLIQVPQEEEAELKVFLDALYRLEQEGDFQQKAAAKAFIPFIQQAWILAQRYDAVVANPPYMGGKGMNGELKEFAKNNFPDSKADLFAMFMQHAFSLLKENGFNAQINMQSWMFLSSFEVLREWLIENKTFVNMIHLGSRAFAEISGEVVQTTAWVMNNYEINKYQPIFFRLIEGNESQKNKTLKKRESNYKDITVDDMKNIPGAPITYWLKGIHNFKRAKLAHYFLSGGRNKTHNNDLYVRYFWEVSLKEKKWVTYANGGESRKYYGNDQYVINWSDEAKLYYDSHGGLSNSKFWNKLGITWSLIGTKSISFRIKPKHLQYSSGSPVIFCEDLNQTYVTLAFLNSTVGQYYLSAISPTINTTVNDVLSLPVPELDCMHSDKIISLTESYINISSDDWNSLETSPEFKKNSLAFNIAKQKKIKKSCLYLQEKNNATLIKAQEIENEINKIFIRNYNLDEYSEIVKDRDDITLYINLKHLYGSDISDNIRQNRYFSDQLSEMMSYSIGCMMGRYSLDREGLVYAHEGNKGFSELVAEGAYKTFPADSDGILPLMDDEWFDDDVTSRVKEFVRTVWGEEHLQENLEFIAESLCLYAIKPKKGESALETIRRYLSTQFWKDHLKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 2987 - protein, 899 aa, Enterococcus faecalis
MDKKAIKKFAMESRVKLREGVINRLAKLGITESNIDPVIELGNDTITISSNEQRYTGKDVINRTKLVEALKAREKQLDLGEKKSKAIAFDNLVEEVAYTWFNRLIAIRFMEVNNYLPERQRILSSESGIREPDIITNLLSSNLYAEMDPDTKSRVVDLMSDNSAAAVDELYQLVFIKQCNSLNQLLPDLFEKIDDYTELLFTISYIDENGVIASLLSIPEEDFDVSKEGQVEIIGWMYQYYNTEPKAEAMKAQKKRKSRADEIPALTQLFTPDWIVRYMVENSLGRYYIDQKLAMPTETRTEKEIADEFGWKYYLPTAEQPENVQLQIQDERKDKNVIALQEIKLIDPSMGSGHILVYAFDVLIQLYVAEGFRERDAAVSILMNNLYGLDIDKRAFQLTYFALIMKGRQYSRRILSKGIKPNVYAIPNNLEISEAELQLLHIDFPNQQKAQEDLLQLINSFKNGADLGSLIEFKDIDFENLKVGFGNGSITFFDQMINEMIHVGELLQQKYDVGITNPPYMGSSGMNKNLSNFIKKAYPDSKSDLFGVFIERLKKMIKSSGYYSMITQHAWMFLSSFEKLRHKINQQTIINMIHLGTRAFEEIGGEVVQTTAFIMSPLEHKGHVGSYLRLVDFVNHGLKETKSLEAIEKRNVDYLYQTVQDNFAKIPGQPISYWVSENILYSFKNDKNIGDYGVSRNGLQPKQTDRFVRQWFEVEKNNINFGIINIEQTDTAEEKWFPYNKGGAKRKWYGNYDYVVNWYKNGHEIRNIKRNGKPYAVIPSQKYYFHESLTWPKITSGDISLRYRISGSIPADAGNSTFFKSTQNLFYILGLMNTKVGNYMLNLVNPTLNLQTSEFSSIPIKKIANKNEIISISKHSIDICKNDWDSFETSWDFDKHPLI

SEQ ID NO: 2988 - protein, 1196 aa, Pseudomonas syringae
MNTSHIKSYAPKARTAFIAAMTKRAALFGIRESSIPAMGIAPVEQKGDLVLIGDRALPASVIRPRAALVKKVEQLGFAQAMEQAAYSWFNRLCAIRYMELQDYLDHGRRVLSAADGSAGTPQILEDCLEIDLPGLDKQLITELKLDGNKDEELYRELLLAQCHALHQAMPFLFEAVDDATELLLPDNLTKTDSLIRELVSAIPEEDWANIEIIGWLYQFYISEKKDQVIGKVVKSEDIPAATQLFTPNWIVKYMVQNSLGAQWLATYPDSPLKAQMEYYIEPAEQTAEVNAQLAAITPESLNPEALTLIDPASGSGHILVEGYDLFKAIYLERGYRQRDVAQLILEKNLFGLDIDGRATQLTGFALMMKGRADDRRLFERGIKLNVMALVDSAGFDPEVLANGLKLADYGLQLGDLNELKRLFEHATTFGSLIQVPEGLAKKLLGLKQLCEATSLDLFVTESFKRLGPLVHQAELLAAQYDAVVMNPPYMGSSGMNSPLKKYAKDKFPEAKENLFACFIERCCLLAKDTGQSALVTMHNWMFLSSFQKMRERLLRMKTITTMAHLGAGAFGSISGEVVQAATFVLKNAPPRGYRPVFFRLLDGGEERKRTALRLGENRFAEAAQSEFEKIPGSPIAYWVTAKVRESFVEFPAASASLDPREGLATGNNDRYVRCWPEVSIEEIGLGCEDRTAAKETGRRWFPYNKGGELRKWAGNIWFLVDWLDDGEELQTKLHPSGARVWAHNFNLDFIFRPFLTWSDITSKGLSVRLYPAGFLFDATGLSAFAKDGAFGGAIERATALGNSHLGTMFAQILNPTLHFKSGNFGVLPVNETLDLSASVRQAVAVATKDWDAYERSWDFKSLPLLSATFDSTRNLEGSYTAWITQNRATIAEMQRLEEENNRLFIDAYGLADELTPDVPIEQITLTVNPAYRYGGKLSEAELWTRFREDSMQELVSYAIGCMLGRYSLDEPGLIYAHSGNQGFDPSRYTRFPADADGILPLTDKEWFADDAANRLIEFISVAWDKAHLEANLRFLADSLSPKKTESSRDTLRRYLCDNFFKDHLQTYKKRPIYWLFSSGKQKAFQCLVYLHRYNEGTLARMRTEYVIPLSAKLSSYAAKLEKDIEASNSTAEKKALEKQLSTLHNQQAELATFDEKLRHHADQRISLDLDDGVKVNYGKFGDLLAEVKAVTGDKAE

SEQ ID NO: 2989 - protein, 1224 aa, Escherichia coli; identical to SEQ ID NO: 2815

SEQ ID NO: 2990 - protein, 1188 aa, Pseudanabaena biceps
MDTSRLKRFAQFARRSLIEQVTSRLNLVLQPESMARREYGEAIADLEKEIKASSKEQVIDRVAYVWFNRFCALRFMDVNRYTKIGVLSPAEGQFQPEILAEAKMGHIDEDLVADAVVRDRIFALLNGTSPSPDPQTEAYRSLIVSVCNHFYKAMPYLFDRIANYTELLMPDDLLSGNSILAYTRETLTPDVCKDVEAIGWLYQFYISEKKDEVFDALKKNRKITPESIPAATQLFTPKWIVRYLVENSLGRLWMLNHPNSRLIEQMEYYIAPEQTETNFLRIAKPEDIKICDPACGSGHMLVYAFDLLYAIYEEEGYEPAEIPEKILTLNLFGIEIDERAGELAALALTMKATKHRRFFNKGIKPNICVLENVSFADDDVQGYMDFVGRDLFTAPLLRTLHEFEESNNFGSLIRPTVTDVAGMVEILRSKNVEGSLFFYRTHEKVLRVLRQADFLSSKYHVVIANPPYMGGKGMNNRMSAWVKDNYPDSKSDLFAMFMERNLELAVKNGLVAMVTMQSWMFLSSFEKLREKLIAKQDIATLIQIGYNSFPDLNSKVVQACAFVLVNSPHKNLGAYINLNDAPQSADKELVFIEKKKNNLIYRASVDDFKKIPSSAIAYWVSKRVLDIFATSEKLESLASPRQGLATADNDRFIKLWFEVKHNSIGFGLQNRKEAQDSKRKWFPYNKGGEFRKWYGNQEYIVNWKNDGYEIRNFGTENGGKSKSRPQNTDFYFQESVSWSKVSSSIFSLRFFPRGFIFADAGMSIFNLSQEVLKSILGVMNSPIMSNTVAAISPTLNFEVGQIKAFPINQEIINPNQDRIKSIDNIINISCSDWNSYETSWDFTTLPLLKVESDKYEVESNQNNKLHTSNSLLSTKYAQLRYHWQQTTLEMQRLEEENNRIFIEAYGLQDELTPEVPLKEITLTCNPHYRYDSNKSEAELETLLLADTMREFISYAVGCMFGRYSIDKEGLILANQGETIEDYLQKIPNPSFMPDRDNVIPILEGDWFTDDISEQFRKFLRLTFGEENYQTNLTFIEKALDKPIQKYFLKDFYNDHVKRYKKRPIYWLFSSPKGSFNVLIYLHRYRPDTASIVLNDYLREYRAKLTAHKKHLEAVSIDQNATQSEKTKALKTIENLRKIIDELEKYERDILYPLASQQLAIDLDDGVKVNYGKFGAALKKIAGLEATDD

SEQ ID NO: 2991 - protein, 1246 aa, Vibrio cholerae; identical to SEQ ID NO: 2910

SEQ ID NO: 2992 - protein, 1246 aa, Vibrio cholerae; identical to SEQ ID NO: 2910

SEQ ID NO: 2993 - protein, 1224 aa, Escherichia coli; identical to SEQ ID NO: 2815

SEQ ID NO: 2994 - protein, 1245 aa, Actinomyces sp.
MDININALESLATKSRARLIGQATGAIQRLLDDPLTEAEDRRRIERAVAHHGGVEGAAREAAYSWFNRLTALRYMDAVGVSGTHMVVTPTGASSEPECLSQARVGAFDPRVDRAPASPDADGRPGVAQRVGRLLFENRDVEAYVVLLSAYFDLWHPLIPDMFPAGDHWTNLVPPSDLLSASSVRADIVEGIAVGESGGPGVEVIGWLYQFYIAERKQQINDAKVKITSKELAPVTQLFTPHWIVRYLVENTVGAQWLRAHPGSPLRDRFDYLVAPVPGQEDQGMGIGDPKDFRVIDPACGSGHMLTYAFDVLWQMYVEAGYPKRRIAAAILDNNLFGAEIDARAVQLASFALMMKAVEHDPGFLERKLREQDRKAAGPGAGRPRITHVHSVVLEDLSPTEIAQAVRGAFGSEDSERASVGLEVNRVIEDLRNADTFGSLIRVPAGTAEIFEAIARSIEEGRRDVQLGSADTQQWREAAGICRVLEDSRYTTMVANPPYLVSKKFGDGLKEYARQSYPDSRQDLATMFMQHALTFTRKRASIGTLTLNSWMLTSSFERFRIRLLKNASIQSIAMLGRGLAGIQLDFCATVFWNACPRSDRTIRFITASEPATSPSNPIRIQRLQEAAQNPKSSDNIEVTYSRITRMPRSAFLHSISDQILEGFKTPLAEVARPRQGLATADNERFLRLWFEVSSSRSYLTATSREDADASGARWFPHNKGGSFRKWWGNQDYLVNWEDDGREIQEYRDPYTGKQRSRPQNIDFYFKPCVSWSNVSSGTPSFRLYNENFIFSHVGQALFSDTEHHPAIMSFANSTVVTKILEAIAPGTHFEVGQIKTLPWIEPESFDPTPIERLIEIFRDDWDARETSWDFQRPPYLVGDSSLLEELFAAWYERSVSTAREAQRLESENNRFWAGVYGLEDEVEIDVPLSRVSLTYNPRFPPAPSKGAERSEEEYRWLHYQRSATELVSWLIGVIMGRYSLDAPGLILADQGSTLDDFQARVPTASFMPDADGIVPITDSLFHDNADLRLTDALSALLGADSLGQNLDFLARCLAVKKPTSNGADFQPPRPVVDSRAALLKYMKSGFLKDHEQAYSNRPVYWMFSSPKGSFKALMYLHRYTPDTVGHVLTEYASEVVAKLADQIEVINRRLPDMGGSDRTRAQGKREKLRAQLHDVQGYIDSTLYPLSQRRIVLDLDDGVRVNRLKLAYGMREDLDELASPALQMPDDLKWMTDQKRKGNIWWSTQN

SEQ ID NO: 2995 - protein, 632 aa, Fusobacterium necrophorum
MYFYITKYCNKKIGEYIKLSDFKGVKNQPIKTLEAIQNKNCTWRYQANQKDFTKIPGSPIAYWVSDRIREIFEKEKKLGEVGDAKVGLQTGDNNKFVRLWHEINFNKIGFGMKSSEEALKSKKKWFPYNKGGEKRKWYGNQEYVVNWEKDGYEIKHFCDTNGKLRSRPQNTEYYFKKSISWSKISSGNFSMRFFPEGFIFADAGMSYFSENKLEYKLSICNSKIANMILNLLSPTLNYEVGHIASLPIKSTSKTNLENIEKIPESCIEISKIEGDSRETSWDFERLFLLNGKTVKEAYDNYCRYWKEQFVQMHKNEEELNRIFIDIYGLQEEMDEKVDFSDITLLKKEASIVENIDSTSSCGYLENRGVRLEFHSLELVKQFLSYAIGCTMGRYSLDKPGLIMANSDDVLNMSSNKITVSGVDGEIRHEILNPSFFPEEFGILSVTAEERFENDVVSRVIAFISAAYGKERLEENLEFITEILGKKAGESHEEVLRNYFIKDFYTDHCQRYQKRPIYWMLHSGKKNGFSALIYLHRYEKDTIARVRSDYLLPYQEFMEQQEAHYSKIASDEISTPKEKKDAQKKVKELHDILKELKDYANKVKHIAEQRISLDLDDGVKVNYEKLGSVLKKI

SEQ ID NO: 2996 - protein, 1173 aa, Acinetobacter radioresistens
MNTSNIKKYAPQARNDFIAAMRKQAAKYGITADSILPAEQKGDLLLIGDQVFPLSVMKPREKLIKRIQTSSFEQTIDYIAYSWFNRLCAIRYMECKGLLDHGRRVLSSADGSAGLPQILEECLDIDLPGLDASRVAELKLDGNKDEELYRELLLAQCHALNQVMPLLFEQVSDESELLLPDNLTKTDSLIRDLVSSIPEEDWSDVQIIGWLYQFYISEKKDQVIGKVVKSEDIPAATQLFTPNWIVKYLVQNSVGRLWMMAQPESTLASEWEYYIQPAEQTDEVNAQLKQLINVRISEDGDTLNPESITVLDPACGSGHILVEAYDCLKAIYLERGYRSRDIPRLILENNLYGIDIDTRAAQLASFALLMKAREDDRRLFSNPPKLNIIALQDSQPERLEAFSQDLASTGIAQADLKELLDLFEHASTFGSLIQIPQAFAKKLSDLESKLNKALESGDIFAQQSAQELLPLVQQAKLLAKQYDAVIANPPYMGGKGMNTALKDFAKKKFPDSKSDMFAMFIERCQALSKISGETAFVTPYVWMFISSYEELRKKLVSENTIKSLIQLEYNAFEPACIPVCAYTISKAHVKDYVGSYIKLSDFKGHENQAPKTIEAINNPDCGWFFTAKPDDFKKIPGSPVAYWVSDKVRSTFQSGMSIQRYAVPRQGLATGDNEKFLRIWYEVDHKLFSIRIDSDLNNSKWYPCNKGGAFRKWYGNNTYVVNWQNDGYEIKNFVDENGKQRSRPQNTSYYFREGVSWSTISSSALSMRYSPKGFLFETKGSVCFPENKLQLNLVLALMNSYVVKELLLAISPTLDFHEGPIGKVPVITELESSTKEYVDILVNIAKNDWDSYETSWDFAQNPIIRTNQSTLEQAFNAWQQQNTDAVAEMKRLEEENNKLFIEAYGLQDELTPDVPDAQITLTRADREKDSQRLVSYALGCMMGRYSLDEPGLIYAHAGNQDFDANRYQKFPADADGIIPLTEMHWFEDDATHRIREFLTAVWGKDTLDANMQWLAESLDKKASETAEDTIRRYLASKFYKDHMQTYKKRPIYWLFSSGKQGAFQALVYLHRYNESTLARMRTEYVMPLISKMAAMVNSLQSEIENSDSAAEIKRKEKELQNLHKQQAELSSFEEKLRHYADQRISLDLDDGVKVNYGKFGDLLAEVKAVTGEK

SEQ ID NO: 2997 - protein, 1246 aa, Vibrio cholerae; identical to SEQ ID NO: 2910

SEQ ID NO: 2998 - protein, 1196 aa, Bifidobacterium bifidum
MNTSKLQAFATDARRQLMNAVQARLDAALVPNSDAQVDDPRAFDFLKREIEQAGGSEQGRKHVVERYAYRWFNRIIAFRYMDVHGFTGTPVVSPAGLTSTNGLPEVLAAAKRGEYDSRVFSLRVNDKAKERIEGLLSGSIMADDPQGRAYGLLLQSECRFWNRNLPFMFENVGKEAGRVDELLMPADLLAEDSVLRNAVEAMTPEDCGVDDPSGNVEIIGWLYQYYISERKNEVMDGFKKNHKAGASEIPAATQLFTPDWIVRYLVQNTVGRLWMQSHPDSQLHKNWDYYIWPSENDSVGNEDILAIRTPEDLTVCDPACGSGHMLTYAFDLLYEIYEEEGYAPSDIPSLILKHNLYGMEIDERAASLAAFALTMKARSRSRRFFKKQVEPNIQRIVPIAFKEDEVAELNDLYQVNLDSTVWNTYAKADVYGSLIQPPQELVELAASSPESEDGIDTLFDPLLREHAEDVFTQTRYLARKYAAVVANPPYMGAKNMSGELKQFVQDHYEDGKADLFAAFILCNRQFIQHGAMLGMITMQSWMFLSSFEDLRRKLLDSSSIETMAHLGAGAFDSIGGEVVSTTAFTLKNGFSSGNGTYIRLVNVSGDDNQSNACINAIKGDVDYRFEVSQREFAQIPGSPIVYWLSEDVLSLFSLKSLSSKAVCKHGMSTGNNESMLRLWSEVSYKRVYLYCKTREEAYHANGWFPYNKGGEYRKWFGNRQFILRYDSMGQKRMLNLPGFRHDGRDYFFKPAISWSKISSGQPAFRLYREGFVFDVAGCSFFPCENTELLNLLGMVNSSTVQLLLSALSPTLNYEVGQIAKLPFCQLPDLAESIITQIINVSAKDWNSFETSWDFQRFTLLDPNQGAQVGDLLEEAVSHLREYWDCVSEEQRQREIRNNEMVADVYGVRDDVPCDVLLERVSLKRNVAFAYPKDTPEVRNEKFAQDVVKELISYAVGCMFGRYSLDKPGLILASQGETLDDYHAQIPNPSFGPDADNVIPVTETDCFEDDIVTRFRRFLTVAFGKENLGANIAYIEQVLGKSIRKYFVNDFYNDHVKMYSNRPIYWQYSSQTSNKGTFKALVYLHRYTPKTTNVVLNYLRDYANKIADIADNLEHSDRAADQKQAAKLRKAVLECKDYEDQTLYPLATRNLEMDLDDGVLVNYLRMGKALRAIPSIERKRKEVSTWTWPVHPLGEQA

SEQ ID NO: 2999 - protein, 1200 aa, Bacteroides ovatus
MDTNRIKRFATEARNILKAGIAAKITTLGFDKKGNVAEEHRPQLMQGGALWNGQFYTEGFYYQWMSLYNRIQQKGINEVYEEAAYTWFNRLCAIRILQKNNLCSPVLQYADAARTPIIVDEARQGHLPQMKEDLRQRIVELLDDDTKVTEQFALLITAWCHDNPILNQCFGSMADYTELLLPNDILAEGKFMDMLNHTEFITDEEFQSPELIGWLYQFYISERKDEVFAKKGKFEADEIPAATQIFTPNWIVKYMVQNTVGRIYLDNNPYETTLQKKWRYLVNQTEKPTPENLLKYNELTDLKVADLACGSGHILNECFDLFYDLYIAEGYGRGEAIENIFRHNLTGIDLDNRAKQLATFALLLKACQKDSSFADAHCLPNILTMPKPWNEETDENLNDFLSLYFQGENTSSQNEELAACFELMHNADSLGSIMKFDISDSTRLLVKQTTDYWCSQEIMPDAVRLQLPAFELILALTEKYDALVMNPPYMGGGNMNEVLSKYVKANYEEGKGDLFSTFMLLAIDRLADNGKYSMINMQSWMFLSSFEKLRTSLLENYHIENMLHLGPRTFDELSGEVVQNTSFVVAKNKSDEGGVYFRLVDGKNCAEKKDMFLQALQEHTAKVYYPNVPQSNFEKIPGCPIGYWVSPNILKIFTSNLALSAVCSPTQGLATADNARFLRSWFEVSRSRIGFGFENAASAARSRLKWFPYNKGGDVRRWYGLSLSENIIDWYNDGEILKSFKPAVIRNPGYYFTDGITFPRIGSNLFYARILQPGFIFDCNGPSCFPQEKKEYILGFLNSKVMQQLLFILCPTLSFQIGDSFKVPYIGKNNDYINHCVQQNINISKQDWDNHETSWDFETNPLLAVNENTYIDNIRHEEKLHEKETDKHICINPAAPQLGSLKWRMEQYKTKWEHLFMQLHENEEELNRQFIDIYGLQDELTPDVTLSEITILQQGEINIADDSLSWNDEVLMKQLISFAVGCMLGRYRLDKPGLHIAHPNPTDEETASYTFNGQSWEIDDDGIMPLMANDCGFSDNASYRFADFLRVVLGEELHVENLNYVEQCLGKTIEQYFVKDFWKDHKKMYQNRPIYWLFASKKGSFQVIAYMHRMNAYTVERIRAKYLLPFIEHLEQEINKLDLRRAELTTKESKQLQTLQKQLDECREYHERLQVVAEQAISFNLDDGVTVNYAKFGDVLQKIK

SEQ ID NO: 3000 - protein, 1246 aa, Vibrio cholerae; identical to SEQ ID NO: 2910

SEQ ID NO: 3001 - protein, 1200 aa, Parabacteroides sp.
MDTNRIKRFATEARNILKAGIAAKITTLGFNKKGNVAEEHRPQLMQGGTLWNGQFYTEGFYHQWMSLYNRIQQKGINEVYEEAAYTWFNRLCAIRILQKNNLCSPVLQYADAARTPIIVDEARQGHLPQMKEDIRQRIVELLDDDTKVTEQFALLITAWCHDNPILNQCFGSMADYTELLLPNDILAKGKFMDMLNHTEFITDEEFQSPELIGWLYQFYISERKDEVFAKKGKFEADEIPAATQIFTPNWIVKYMVQNTVGRIYLDNNPYETTLQKKWRYLVNQTEKPTPENLLKYNELTDLKVADLACGSGHILNECFDLFYDLYIAEGYGRGEAIENIFRHNLTGIDLDNRAKQLATFALLLKACQKDSSFADAHCLPNILTMPKPWNEETDENLNDFLSLYFQGENTSSQNEELAACFELMHNADSLGSIMKFDISDSTRLLVKQTTDYWCNQEIMPDAVRLQLPAFELILALTEKYDALVMNPPYMGGGNMNEVLSKYVKANYEEGKGDLFSTFMLLAIDRLADNGKYSMINMQSWMFLSSFEKLRTSLLKNYHIENMLHLGPRTFDELSGEVVQNTSFVVAKNKSDEGGVYFRLVDGKNCAEKKDMFLQALQEHTAKVYYPNVPQSNFEKIPGCPIGYWVSPNILKIFTSNLALSAVASPCVGLQTADNARFLRSWFEVSRSRIGFGFENAASAARSRLKWFPYNKGGDVRRWYGLSLSENIIDWYNDGEILKSFKPAVIRNPGYYFTDGITFPRIGSNLFYARILQPGFIFDCNGPSCFPQEKKEYILGFLNSKVMQQLLFILCPTLSFQIGDSFKVPYIGKNNDYINHCVQQNINISKQDWDNHETSWDFETNPLLAVNENTYIDNIRHEEKLHEKETDKHICINPAAPQLGSLKWRMEQYKTKWEHLFMQLHENEEELNRQFIDIYGLQDELTPDVTLSEITILQQGEINIADDSLSWNDEVLMKQLISFAVGCMLGRYRLDKPGLHIAHPNPTDEETASYTFNGQSWEIDDDGIMPLMANDCGFSDNASYRFADFLRVVLGEELHVENLNYVEQCLGKTIEQYFVKDFWKDHKKMYQNRPIYWLFASKKGSFQVIAYMHRMNAYTVERIRAKYLLPFIEHLEQEINKLDLRRAELTTKESKQLQTLQKQLDECREYHERLQVVAEQAISFNLDDGVTVNYAKFGDVLQKIK

SEQ ID NO: 3002 - protein, 1217 aa, Escherichia coli
MNTSNIKKYAPVARKQFRDAVMQKLTTLGIDADKKGNLQIAQATDLGDSVRYGQFSLDKSLASRRERLVKRAEKQGYDVLVEHIAYTWFNRFCAIRYMELHGYLDHGFRMLSHPTLEGSFEVLDHVPEVADALGLDKSRLVEMKLAGDRDEELYRELLLAQCHALHGAMPFLFEAVNDDIELVLPDNLTRTDSILRGLVDTIPEEDWKQVEVIGWLYQFYISEKKDDVIGKVVKSEDIPAATQLFTPNWIVQYLVQNSVGRQWLQTYPDSSLKGKMPYYIEPAEQTPEVQAQLAAITPSSIEPESIKVLDPACGSGHILTEAYNVLKAIYEERGYRTRDIPQLILENNIFGLDIDDRAAQLSGFAMLMLARQDDRRILGRGVRLNIVSLQESKLDIAELWTKLNFHQQAQRGSMGDMFTQGTSLANTDSAEYKLLMRTLALFTSAKTLGSLIQVPQEDETALKTFLGGLYRLAVEGDIPQKEAAAELIPYIQQAWILAQRYDAVVANPPYMGGKGMNGELKEFAKKQFPDSKSDLFAMFIERGFSWLKDAAYNSMVTMQSWMFLSSYENMRANILDKYTIETMVHMGNGVMKIAFGTNATVFRNVHIPSYQGAFSYTENDDINDEGYPKEFPVKNDRLKTAAADDFQKIPGAPIAYWLSESEVNLFDNKKISQIASTRLGMATADNERFLRFWHEVNFANIGFDFTDRIQAKKSGLKWFPYQKGGEYRKWYGNLDYVVNWFDDGREIQNFTDEKSGKVRSHNYNLDFIFKKGITWNALSSSKTSARVSESSLFDNAGSSLFVNNEDLYLPVLAFINSDIIISLIKAISPTLNYQPGDISKLPAFFDEKMIESLSLNTAELISLAKENWSQQENSYQFSFNQDAFQNGSLVNILKNQTEVFYQKLIKTHELECDNNKIFYEKCNILNENNLALAEITLENNVFQSLSSISKDEYNQFKAIQVINSLSLAIGCMMGRYSLDREGLVYAHEGNKGFSELVDEGAYQTFPADEDGILPLMDSDWFDDDVTSRVKEFVRTVWGEEHLQENLDFIAESLCLYAIKPKKGESSLDTIRRYLSTQFWKDHMKMYKKRPIYWLFSSGKEKAFECLVYLHRYNEGTLSRMRTEYVVPLLARYQGNIDLVNDQLKNAESGAATTRLKKELDGLTKKFNELRNFDDRLRHYADRRITIDLDDGVKVNYGKFGDLLADVKAITGSAPQEA

SEQ ID NO: 3003 - protein, 1154 aa, Lachnospiraceae bacterium; identical to SEQ ID NO: 2957

SEQ ID NO: 3004 - protein, 1246 aa, Vibrio cholerae; identical to SEQ ID NO: 2910

SEQ ID NO: 3005 - protein, 1203 aa, Bacteroides ovatus
MDTNRLKKFAIEARNILKAGIAAKLTSLGFDSKGGVAENLRPQLLQGGTLWNGRTLSEGFYHQWMRLYEEVQAKGVNEVYEQAAYTWFNRLVAIRILQKNGLCEPVSTYADSAHTPQIVNQARQGLFPPMEEASKRHLLELLDDDTKVTEQFAVLLVAWCHANPILQRCFGTMEDYTELLLPANILVENGFIDLLNHTEFITDEEFRSPELIGWLYQFYISERKDEVFAKKGKFEADEIPAATQIFTPNWIVKYMVQNTVGRIYLDNNPYTTLAYKEKWQYLVEPAEPTPAKAILHYNELTDLKVADLACGSGHILNECFDLLYDLYITEGYTRVEAITHIFQDNLTGIDLDPRAQQLSLFALTLKACQREHSFADAHCLPRVLTMPKVPLPLPTDTRLAVEIDAANILLKDADSLGSIMKFNLTPAAREWVASLVAENEAAALVVALTEQYDALVMNPPYMGGGNMNEVLSKYVKKNYEDGKGDLATVFVEMMAQRTSTHGRYAFIIPPSWMFLSTFEGLRKSIINNRTIDSLLHLSRGVFGADFGASSVVISNTKSSDACGIYFRLIERTFQEFDQKHLQLLFEKTLLNHDFRYLFADYSKDVEDVVYSEQGAKIYYPNVPQANFEKIPECPIGYWATRNLVLTFKNKLIKDVADPKAGLATGDNNTFMRLWSEVDYHNIGKGCKTTEDTKNCSVKWFPCLSGGHARKWSDYIEYVVDWENDGYNLKRFIGKNGKLASRPQNTRYYFKKGLTWNKISSNTFSVRYKRTGSIFDDTSRCAFIEEDDKFIFYLVGLLCSNVSFGYLKLFNPTMSFTNGDIQRIPIIDKCSDIIDDLVKQNIAISKLDWDSHETSWDFQQNELISLINFTEQDLTPESLIALCSTTAQSDAVRQQADESPRAIRMKDLIERYHKKWYTLFMQLHANEEELNRQFIAIYGLQDELTPDVSLNEITILQQGEVNTEGNSVKWHDEVILKQLLSYAAGVWMGRYRLGKPGLHIAHPNPTAEELAPYTYNGHTIEIDDDGIFPLMAADSGFTDNACLRTAQFVSDVFGAEYQVENLNYIEHTLGKTIEQYWQKDFWKDHKKMYQNRPIYWLFASKKGSFQCIAYLHRMTPYTPERIRSKYLLPFIETLGRKIADLTTRAADLSTAERKKLDTLNKQLEECREYHDRLAVVAEQAIPLDLDDGVVVNYAKLGDVVSKLK

SEQ ID NO: 3006 - protein, 1210 aa, Enterococcus faecium; identical to SEQ ID NO: 2960

SEQ ID NO: 3007 - protein, 1224 aa, Yersinia ruckeri
MNTSNIKKYAPVARKQFRDAVMQKLTTLGIEADKKGNLQISQATDLGDSVRYGQFTLEKSLTARRERLVKRAENQGYEVLVEHIAYTWFNRFCAIRYMELHGYLDHGFRMLSHKNPTLEGGFEVLDHVPEVADALGLDKSRLVEMKLAGDRDEELYRELLLAQCHTLQGAMPFLFEAVNDDIELVLPDNLTRTDSILRGLVDTIPEEDWAQVEVIGWLYQFYISEKKDDVIGKVVKSEDIPAATQLFTPNWIVQYLVQNSVGRQWLQTYPDSSLKGKMPYYIEPAEQAPEVQAQLAAITPSSIEPESIKVLDPACGSGHILTEAYNVLKAIYEERGYRTRDIPQLILKNNIFGLDIDDRAAQLSGFAMLMLARQDDRRILSPNRGVRLNIVSLQESKLDIVELWAKLNFHQQVQRGTTGQMFPEGPALANTDSAEYKLLMRTLALFTSAKTLGSLIQVPQEDEAALKAFLDGLYRLAVEGDIQQKEAAMELIPYIQQAWILAQKYDAVVANPPYMGGKGMNGELKEFAKKQFPDSKSDLFAMFMQHAFSLLKENGFNAQVNMQSWMFLSSYEALRSWLLDNKTFVTMAHLGPRAFGQISGEVVQTTAWVINNNHVAYYQPVFFRLIDGNEENKQAMLLERKHRFDSIVQNNFKKIPGASIAYWIKENLLHAFENSPKLNSIAEPRKGMVTADNPRFIRSWVEVCFGKLGINIKNREEAIHSEKKWFPYQKGGEYRLWFGNHEWVVNWENDGRELFNMQGNGYKVGSTNHNLEYIFKPAIVFSKITSSTPHFRYAPQGFLFDDASGLCAIKDEKQTFKLLAFLCSGVCSVFNNIINPTLNLQPGNVANLPAPLINESEYIALKLVSAFKEDWDSYEMSWDFKEDKLLKFKCNSLSEAYDKYLSYVDLTVDNILELHQQNDELFIKHLDLENIIYHKKTKSDISLTCNPFYSYSNDSELDRINKNKTTIIFELLNYILGCMMGRYSLDREGLIYAHEGNKGFAELVAEGAYKTFPADQDGILPLMDSDWFDDDVTARVKEFVRTVWGEEHLQENLDFIADSLCLYAIKPKKGESSIDTIRRYLSTQFWKDHKKMYKNRPIYWLFSSGKEKAFECLVYLHRYNDATLSRMRTEYVVPLLARYQGNIDLVNDQLKSAESGAITTRLKKELDGLSKKFNELRNFDDRLRHYADMRITIDLDDGVKVNYGKFGDLLADVKAITGCAPQEA

SEQ ID NO: 3008 - protein, 1213 aa, Pantoea sp.
MNTSNIKKYAPVARKQFRDAVMQKLTTLGIEADKKGNLQISQATDLGDSVRYGQFTLEKSLTARRERLVKRAEKQDYDVLVEHIAYTWFNRFCAIRYMELHGYLDHGFRMLSHPTLEGGFEVLDHVPEVADALGLDKARLVEMKLAGDCDEELYRELLLAQCHTLQGAMPFLFEAVNDDIELALPDNLTRTDSILRGLVDTIPEEDWAHVEVIGWLYQFYISQKKADVIGEVVRSEDIPAATQLFTPNWIVQYLVQNSVGRQWLQTYPDSALRVKMPYYIEPAEQTPNAQAQLADTPPSSIEPESIKVLDPACGSGHILTETYNLLKAIYEERGYRTRDIPRLILENNIFGLDIDDRAAQLSGFAMLMLARQDDRRILGRGVHLNIVSLQESKLDIAELWTKLNFNQQVQRGSMGDMFAEGATLANADSAEYSLLMRTLALFTNAKTLGSLIQVPHEDEAALKAFLDGLYPLANEGDIQQKEAAAELIPYIQQAWILAQRYNAVIANPPYLDLGNMNPALKTWLELKSPMTKQNLDICFLNTALHLSKPCGRSALITQRSWMFLSRMEEFRIQKLKSDTLESMIYLGPRAFPEIDGEKVQTTAFVFCKNKPNDYLTTFFNLTDEMGEKKADDLLKAKGKYIKCVNDFISLPGFPLAFWASEKLISTFSYGEGLGEIVEIRVGLDTGNNDIFIRSWFEVSTQKIGVNFKTHNDFLKNKKKWVFHAKGGTYRKWYGNIVDVLSFDQDSYNRLLNQGNKLPSRNYYFKKGLFYSRVSSNELSIRELPVGMVFNSASPSIFSDNENDLNFTHALLNSSSVNAILECLSPTLNFQAGELRKIPIFKEIDNDFINQNTSQLVDISRNDWNAKEVSFNFIASPLVNNELSIKSAFLKYNEECELNTEMMRKLEEKNNHYFAQALGLSSNIVSNVPVEKISLSGNIHYLYKSTADKNDLFRSETLSEFISYALGVMMGRYSLDRDGLVYAHEGNIGFAELVAEGAYKTFPADEDGILPLMDTDWFDDDVTARVKEFVHTVWGEEHLQENLDFIAESLYLYAIKPKKGESSLDTIRRYLSTQFWKDHMKMYKKRPIYWLFSSGKEKAFECLVYLHRYNEGTLSRMRTEYVVPLLARYQGNIDLVNDQLKSAESGAATTRLKKELDGLTKKFNELRSFDDRLRHYADRRITIYLDDGVKVNYGKFGDLLADVKAITGSAPEEI

SEQ ID NO: 3009 - protein, 1201 aa, Escherichia coli
MNTNNIKKYAPQARNDFRDAVVQKLTTLGIAADKKGNLQIAEAETIGETVRYGQFDYPLSTLPRRERLVKRAREQGFEVLVEHCAYTWFNRLCAIRYMELHGYLEHGFRMLSHPETPTAFEVLDHVPEVAEALLPENKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMASQDDRRIFTRDVRLNIVSLQESLHLDIAKLWQQLNFHQQVQTGSMGDMFAENNALTQTDSAEYQLLMRTLKRFVNAKTLGSLIQVPQEEEAELKVFLDALYRLEQEGDFQQKTAAKAFIPFIQQAWILAQRYDAVVANPPYMGGNYMETELKNFVSSYYPQGKADLYSSFMVRLLLQLKDNRTLSLMTPFTWMNLSSFEELRKIILTNFSIQSLVQPEYHSFFESAYVPICAFSISNTPLSWNAKFFDLSDFYGEKNQAPNFQYAIKNDNKCHWKYNRITTDFLCTPGYIIAYSLPDSALSCFKTSKKLHDVCNLKQGLITGDNERYLRFWHEISYNSFSLNEKRKKTKWFPYQKGGAYRKWYGNNDYVVDWENDGYSIKNFYNDKGKLRSRPQNIQFYCKEGLTWTSLTISSLSMRYVPNGYIFDAKGPMCFPKSSLDIWNILGYANSKVIDIFLKQLAPTMDYSQGPVGNVPFKFNDGDLNEIIKELVNIHKRDWDENETSFEFKRDMLVHFSRDINTIKGSFTLRQGENKKAINRTKFLEEMNNSFFINCFNLTDILSPEIELNKITLTHATIEIDIQKIISYAIGCQMGRYSLDREGLVYAHEGNNGFADLVAEGAYKSFPADSDGILPLMDEEWFDDDVTSRVKEFIRTVWGEEYLRENLDFIAEVLKPKKGESALETIRRYLSTQFWKDHLKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 3010 - protein, 1246 aa, Vibrio cholerae; identical to SEQ ID NO: 2910

SEQ ID NO: 3011 - protein, 267 aa, Escherichia coli; identical to SEQ ID NO: 2972

SEQ ID NO: 3012 - protein, 713 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLEHGFRMLSHPETPTAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQQLNFHQQVQTGSMGDMFAENTALTQTDSAEYQLLMRSLKRFVNAKTLGSLIQVPQEEEAELKAFLDALYQLEQEGDFQQKAAAKAFIPFIQQAWILAQRYDAVVANPPYMGGKYLAPAVKNHLKENYSGYDKDLFSAFIIRNLQLSKNGAQLGFMTPFVWMFISSYEELRLQLINNETIISLIQLEYSGFDGATVPICTFTLQKNHISNFSGSYIRLSDFRGAANQGPRALEAINNKDCSWRYQTNQESFKKIPSNPIVYWIKPQTSILFTNKKIGELYEVKEGLGTRDDDIFLRRHWEVSRKKQKLTRV

SEQ ID NO: 3013 - protein, 851 aa, Collinsella intestinalis
MDTKALEKFCPWARVELIDAVRLRCVRYALDDAGRAAHPADADVVAGTVLAPSEKAQRAALFERIERLNEERGGKGYAAFCEQQAYSWFNRFAAIRFMELHGYLSNNVRMLSAGSGAFEPECLRMASELDLPGLELAEVLDLITAGDDEVLFRRILVAQMNELADCLPTVFGHVDDADALTLPDNLLAHGEHDVLFHLVADIPEETWGDVEALGWMYQFYNSELKDAFFKSKRKAAAEDLAPATQLFTPDWIVRYMVENSLGRLWMLNNPGSRLREDMAYFIEPDAQHEDFIRIEGPEDITFCDPACGSGHILVYAFSLLFKMYAERGYRERDVPRLILTKNLSGMEIDERAAQIASLVLAMCAREHDRRFFTRGVTADIQVLSNIEIDVDALDPASALRQRPQLIEALAHLSEIGSLLSPSPEDLGALKSELMRNLSGDLFVSHTQTNIERAANCCETLSRTFDVVVANPPYMGSGNFNPFMSKWSKENYSSEKSDLCYMFIERIKNQRKHLGYAGIAASNSWMFLSSSEQSRRKVLEECNIITLVQLAQGGFKGIAAQVFAFILANRCDAPRRGTYIRLCDFRSPALQAEKTICAINDPSCKWSYKTDSSVFFDLPGTPIAYWATSALHDAFQCNSPIGSWLITRQGMSTADNDRFLREWWEPSYCTIAFGIRCSSEAQECGLRWFPYQKGGDYRKWFGNNDLVVDWKNDGEAIKNNADPRTGRIRSHNYNGNYSFKEGITWSDVSSGNIHLRLSEYGSLFDGRGAKGFAKSHQENLYALALLNSNIALKFLEFLAPTLTYQVGDVAKIPDPHLNIERSSAIANANVNLAKADWNTQETSWDFKRNPLI

SEQ ID NO: 3014 - protein, 1225 aa, Salmonella enterica; identical to SEQ ID NO: 2876

SEQ ID NO: 3015 - protein, 1205 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLDHGFRMLSHPETPTAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILTEAYNVLKAIYEERGYRTRDIPQLILENNIFGLDIDDRAAQLSGFAMLMLARQDDRRILGRGVRLNIVSLQESKLDIAEVWTKLNFHQHMQRGSMGDMFTQGTALANTDSAEYKLLMRTLALFTSAKTLGSLIQVPQEDEAALKAFLERLYRLAVEGDIQQKEAAAELIPYIQQAWILAQRYDAVVANPPYMGGKGMNGDLKEFAKKQFPDSKSDLFAMFMQHAFSLLKENGFNAQVNMQSWMFLSSYEALRGWLLDNKTFITMAHLGARAFGQISGEVVQTTAWVIKNNHSGFYKPVFFRLVDDNEEHKKNNLLNRMNCFKNTLQNDFKKIPGSPIAYWATLAFINSFLKLPALGTRAVKGLDTNGSIDVFLRRWPEVSINSFDALGKGNSKWFPIAKGGELRKWFGNHEYIINYENDGIELRKNKANLRNKDMYFQEGGTWTVVSTTGFSMRYMPKGFLFDQGGSAVFCENNDELSIYNILACMNSKYINYSASLICPTLNFTTGDVRKFPVIKNNHLEDLAKKAIEISKADWNQFETSWEFSKNKLIEHKGNVAYSYASYCNFQDKLYEQLVNIEKNINNIIEEILGFKIETTENSELITLNSNKIYRYGQSETNDTFLNRHRSDTISELISYSVGCQMGRYSLDREGLVYAHEGNKGFAELAAEGAYKTFPADNDGILPLMDDEWFEDDVTSRVKEFVRTVWGEEHLQENLEFIAESLCLYAIKPKKGESALETIRRYLSTQFWKDHMKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDIDDGVKVNYGKFGDLLADVKAITGNAPEAI

SEQ ID NO: 3016 - protein, 1171 aa, Nitratireductor indicus
MDTNALKKFAQSARNLLIDQVTARLDMVLAEGAAGRREHPKAVARLEAAANSNRQQVIEQAAYTWFNRFTALRFMDATGLTNPRVVSPADGATRPEILAEAMAGNLPDRARPEIAEYLNGTRPAHDGQAEAYRLLVIHACNEWHGAMPYMFERADMLDRAEDYTELLMPDDLLSPDSILARLREVMTEEACQDVEIIGWLYQFYISEKKDQVFAGLKKNQKITAENIPAATQLFTPHWIVRYLVENSLGRLWLLNRPQSKLAAKMDYYIAPEEPETDFLKITRPENIRICDPACGSGHMLTYAFDLLYEIYAEEGHDAAEIPGLILKHNLTGIEIDDRAGALAAFALSMKAAAMLGRRRFLRMEAKPDIVVLQDVRFTPAEMQDVAAVVGKDLFTDELRETLGQFEQAKNFGSLIVPKLRDPAETLRVVEARDFGSDLLLKEVQERVVAVLRMAEVLSPNYHVVVANPPYMGARNMNPVLKKWTDKTYPDSRTDLFALFMERSLAACMKSGYMAMINMQSWMFLSSFEKLRATILSKGTILTMAHLGERAFDTISGAVVSTTAFVCRNGSKDNYAGAFIRAVGGRNEAEKQEILLGVADGRSTDCLFHISQKELVGVPGSPIAYWLSKGVRDAFGSFEALRSISVPRQGNTTTDNEKFVRLWPEISKDSLGLDYESAEKFNADNKKWAPYNKGGGSRRWFGQNDSVVNWYKNGCEIKAIPHSVIANERSYFSPGLTWSTISTNDIGFRYFGNGFLFDNKGACIFVSDIMQQYLAALLNTKIFVSILYQINPTVSLQPGDVAKFPVIPIEVADSASTSANAISCINLTKSDWDAYETSWDFTTLPLLSPDHREETLAASYANLRVHWQGMTDEMQQLEQENNRIFIDAYGLQDELTPEVPVEEITLTCNPAYRYGVKGAEEEREARLLQDTVAEFLHFAVGCMFGRYSLDAPGLILANQGEGIEEYLARVPEPSFAPDRDNVIPVLDADWFADDIVTRTRDFLRVTFGEAKFRENLAFIESALGKDLRKWFTKDFFDYHVRRYKKRPIYWMFSSPRGSFNALIYMHRYRPDTVSVVLNQYVREFIHKLEVERARLEKLAVDPAATPAQQTRAQKETATVIKQIAELTEWERDVVYPMAQQKIAIDLDDGVKRNYPLFAGALKPIKGLEAADD

SEQ ID NO: 3017 - protein, 1201 aa, Escherichia coli; identical to SEQ ID NO: 3009

SEQ ID NO: 3018 - protein, 1155 aa, Acinetobacter baumannii
MNTSHIKKYAPQARNDFIAAMRKQAAKYGITADSILPAEQKGDLLLIGDQVFPLSVMKPREKLIKRIQTSSFEQTVDYIAYSWFNRLCAIRYMECKGLLDHGRRVLSSADGSAGLPQILEECLDIDLPGLDASRVAELKLDGNKDEELYRELLLAQCQALNQVMPLLFEQVSDESELLLPDNLTKTDSLIRDLVSSIPEEDWSDVQIIGWLYQFYISEKKDQVIGKVVKSEDIPAATQLFTPNWIVKYLVQNSVGRLWMMAQPDSTLASEWEYYIQPAEQSDEVNAQLKQLIDVRISEDGDTLNPESITVLDPACGSGHILVEAYDCLKAIYLERGYRSRDIPRLILENNLYGIDIDTRAAQLASFALLMKAREDDRRLFSNPPKLNIIALQDSQPERLEAFSQDLASTGIAQTDLKELLDLFEHASTFGSLLQVPATFAKTLSDLETKLNTATASGDIFSQQSAQELLPLVQQAKLLAKQYDAVIANPPYMGGKGMNAALKDFAKKQFPDSKSDLFAMFIERGFNWCKDSGFNSMVTMQSWMFLSSYEAMREKLLKDRTLSNMVHMGNGVMGIAFGTAATVMLNKHISDYEGSFSYCENDDVNEDGVPKQFPVQNERLKIAKSDDFQKIPGSPIVYWVSDKLRALFSLKKIGSLLKSDGQLLTGNNEKFLRNFWEINSNEIGHDKSWKLHHKGGDYRKWYGNVEWVVAWDKKTREHYRRDKIARIPKEEVWDLEGVTWSTITSANASFRKVLWFESFNKAAPTLLGKDSKDIDLCLGILNSKISEKLLKILNPTVNCLVEDIEAIPILKINSPDFLKNVRRCVLISKIDWDSYENSWEFNQNPIIRTNQSNLEQAFNSWQQQNTNAVAEMKRLEEENNKLFIDAYGLQDELTPDVPDEQITLTRADREKDSQRLVSYALGCMMGRYSLDEPGLIYAHAGNQNFDSNRYQKFPADADGIIPLTEMHWFEDDATHRIREFLAAVWGKDTLEANMLWLAESLDKKASETAEDTIRRYLASNFYKDHMQTYKKRPIYWLFSSGKQGAFQALVYLHRYNESTLARMRTEYVMPLISKMAAMVNSLQSEIENSDSAAEIKRKEKELQNLHKQQAELSSFEEKLRHYADQRISLDLDDGVKVNYGKFGDLLAEVKAVTGEK

SEQ ID NO: 3019 - protein, 774 aa, Escherichia coli
MNTNNIKKYAPQARNDFRDAVVQKLTTLGIAADKKGNLQIAEAETIGETVRYGQFDYPLSTLPRRERLVKRAREQGFEVLVEHCAYTWFNRLCAIRYMELHGYLEHGFRMLSHPETPTAFEVLDHVPEVAEALLPENKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMASQDDRRIFTRDVRLNIVSLQESLHLDIAKLWQQLNFHQQVQTGSMGDMFAENNALTQTDSAEYQLLMRTLKRFVNAKTLGSLIQVPQEEEAELKVFLDALYRLEQEGDFQQKTAAKAFIPFIQQAWILAQRYDAVVANPPYMGGNYMETELKNFVSSYYPQGKADLYSSFMVRLLLQLKDNRTLSLMTPFTWMNLSSFEELRKIILTNFSIQSLVQPEYHSFFESAYVPICAFSISNTPLSWNAKFFDLSDFYGEKNQAPNFQYAIKNDNKCHWKYNRITTDFLCTPGYIIAYSLPDSALSCFKTSKKLHDVCNLKQGLITGDNERYLRFWHEISYNSFSLNEKRKKQNGSHIKKVVHTVNGMVIMIMLLTGRMMVIPLKTFIMTKVNYAHALKTYNFIVKRV

SEQ ID NO: 3020 - protein, 321 aa, Escherichia coli
MLVHFSRDINTIKGSFTLRQGENKKAINRTKFLEEMNNSFFINCFNLTDILSPEIELNKITLTHATIEIDIQKIISYAIGCQMGRYSLDREGLVYAHEGNNGFADLVAEGAYKSFPADSDGILPLMDEEWFDDDVTSRVKEFIRTVWGEEYLRENLDFIAEVLKPKKGESALETIRRYLSTQFWKDHLKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 3021 - protein, 1210 aa, Enterococcus faecium
MDKKAIKNFAVNARRKLIDEVMTKAKRLGIDESKIEDVKKIDSNLQEIEKSGIRIQGKEIAQRNKLIAELKQRASVTSYSEAFQELIEEVAYTWFNRLIAIRFMEVNDYLPDTYRVLSSEISGKIEPDIITDIYDADIFEELSSNEQQQVRTWKTDNSAEAMDKLYQLIFIKICNQLNDYLPELFEEVEDYTELLFTASYIKKDGVIADLLSIPEDDFNVQAGGQVEIIGWLYQYYNSEPHNQVVNIYKGIVKKQDIPAATQLFTTDWVVRYMVDNSLGKYWLDHYPNSELRNKLKYLIPDKYAFEQATSVSNLKPEELKIIDNAMGSGHILVYAFDVLMEIYLTLGYSERDAARAIVEYNLYGLEIDKRAYQLSYFAIMMKGRQYDRLFLKKSLSPNLREFIDSPKVTDEYQERISELNNDKYSERWNEYKELIFDQFENGKELGSIIKLVDKNNQAITKEYLGKVREYISKFNEFTNMDILYGMKEIQEKYLHILDVAEMLVDKYVAVVTNPPYLNKMDKKLKKYVNDNYSDVKKDLFSVFIKLNSQMLIDNGYASFMTPFVWMFISSYEKLRSFLINERNISSLIQMEYSAFEEATVPICTFTIKNSNEQDGSYIKLSDFKGGMEVQKIKTLEAIHQHGECDYFYSTNQDNFKKIPGMPIAYWASDNVITDFAQGKLTNDVADAKQGLATGNNNKFLRYWFEVEFNKIKFDAKTLEDAKKSRKKWFPTTKGGRFRKWYGNNEYVVNWENDGDEIKNYVNENGKLKSRPQNLNYYFKKGITWSTLSSGQVSFRLQNQAIFETKGSVLFSKDITDFEEIFGYVNSKLVNHFLTFISPTLDYHEGPMGKLPFLKVTSERKLKKIREKVDENIDIARKDYNALETSYEFRRNILLSYMFKKDLSEAFNCLSRQLVNQFNTLKSNEEELNDIFINHYSLEKELTKEVQDEYISARLPDKAREIKDFISYSIGCIFGRYSLDEDGLIFAGGEWDPSRYQKFKPDTDNVLLITDDEYFKDSQIDIVNRFIDFVEITFGKETLEENLQFIADTLGGKGTSREIIRRYFVQDFYKDHLKTYSNRPIYWQLDSGKQNGFKALMYLHRYTPDQLGKVRTEYLHELQKAYDNRIELRQQQISTSDNPKERNAMTKEIVKIQKQLKEVREYDEKLGHLALKRIELDLDDGVIVNYDKLQRDPKTGEKFQIFAKGVKEPKK

SEQ ID NO: 3022 - protein, 1177 aa, Alcanivorax sp.
MSESMNKSALKKYAPQARLDFIATVTRRAELLGLNPESPAKVEKQGEALLINGRAFPAAYGQMRTTLEARIREQGFAQVMEAMAYTWFNRLVAVRYMELHGFLDHGYRVLSHPANTETGHTQPEILDHIADLDLPGLDKSVALELKLAGNKDEELYREVLLAQCHALHQAMPFLFESLDDATELLLPDGLLRTDSILGKLVTAIDEADWQDVEIIGWLYQFYISEKKDQVIGKVVKSEDIPAATQLFTPNWIVKYLVQNSLGRLWLMASPTSTLATKWEYYIQPADQTDKVNAQLDALIQTRIDEDGATLNPESLTLLDPACGSGHILVEAYDLLRDIYLERGYRRQDIPRLILEKNLYGLDIDDRAAQLAGFALLMKARADDRCLFGQPVALNLLALQEAKEGSAADLHSALNAPQIEYRKVSQLVETFEQAKTFGSLIQIPNELADTLPELKREIETIRGSGDLLGRDAAETLLKLVEQAEILDKKFDTVVANPPYMDSKGMGDDLKAWAKKTFPAGKSNLFAMFIERGFGWCKPAGFNSMVTLQSWMFQSTFSELRSRLLKKSTIDSLVQIGFNSFPELNSKVALGAAFSIFRSNVPFATGTFVNLNSAPRSADKGSVFRDRDDNIVFFVGQEAFQKIPDSPIAYWAPYERVFKYSPLNDFYESGGRCKTHNDENFVRFHWELESGSVGPNNRWRYYEKGGDFRKWYGNRLFVVDWSETARAYYARKGGLTREMYWNRQGITWSDIGIQSGFRLKLEDTEYSSVSPTIFPLGEKLDLRILLLLNSSLSKWVMSALNPGLHANPGEVLKLPNLLSGDPNTAEKAIHLAKDDWDSYEVSGEFSSSPLVQINSVSCRISDCARALIQGRQDRTNELRNLEEQNNKEIIDRLGLSDHVSPKVPLSEISLTGNLAYRGKGKNRSSGAEEHRKLVSEELASYAIGCMMGRYSLDTPGLIYAHAGNEGFDPSCYETFPADGDGIVPITDEAWFDDDGANRIREFVRVVWGEDTEAENMAWLAESLGSKASESADDTIRRYLSRDFYKDHLQTYKKRPIYWLFSSGKHKAFEALVYLHRYNAGTLSRMRMEYVVPLQSRMQARIDNLDQDIQASTSSAEQKRFQKQKDKLIKQLHELRRFDENLRHYADQRITLDLDDGVKANYGMFGDLLAEVKAVTGKKG

SEQ ID NO: 3023 - protein, 1246 aa, Vibrio cholerae; identical to SEQ ID NO: 2910

SEQ ID NO: 3024 - protein, 1246 aa, Vibrio cholerae; identical to SEQ ID NO: 2910

SEQ ID NO: 3025 - protein, 1215 aa, Escherichia coli
MNTNNIKKYAPKARREFMDAVAKRLNTFGITANKKGELQIAEANLQGSVLQIAGNSFDGKLAEPRKRIVARSQKLGYAQLIEQVAYTWFNRLCAIRYMEIHDYLGHGFRVLSHPDNPKGFEIIDHAQDAADELGLDRARIVELKLAGNKDEELYRELLLGQCHKLHEAMPFLFDALDDETELLLPDNLTRTDSILRGLVDGIPEEDWQQVEVIGWLYQFYISEKKDQVMGKVVKSEDIPAATQLFTPNWIVKYLVQNSVGRQWLQTYPDSAIKTQMEYYIEPAEQSDEVNQQLKAITPESIEPETIKVLDPACGSGHILIEAYNVLKAIYEERGFRSRDIPKMILENNLYGLDIDDRAAQLSGFALMMMARDDDKRIFTRNVRLNVLSLQESNHLDLPTLWKALNLSGSWQSGTSQGLFSDDVQDLSSFNADKRYQLLKRTLVRFTQAKTFGSLIDVPSDEYEQLKDLLNTLVELQESGDSMQKPAAKELIEFVHQALVLSIRYDAVIANPPYMGAKGMNADLKDFAKINFPNSKSDLFAIFIERGFGWLKKTGLNSMVTMQSWMFLSSYEQMRDSILNGRTLESMVHMGNGVMKIAFGTNATIFSNTHIKGYRSSFSYVDNDDIGDDGNPKEFPVNNGRLRDCASDEFKNIPGSPIAYWVDSSVVECFRNNKTIGDVSDVKQGLATANDDRFLRAWFEVDCSKISFPSYFDPNKKWFAFNKGGDFRKWYGNNYLVVNWENDGEEIKGFREGGKQKSRPQNTSYYFKQGVTWGQTSSGKSSFRWVDSGYVFAHISSMLFSSSDVDGKLKLAFLNSTSGIYLLELFSQSMGVEVGHIKSLPYIPVGDGEIISKIDRLISIHKCDWDSYETSFGFKAHKFVAIKKKSLREIANYFLEFDLKVIEEIRLAEAEINSFFSQVCGLSNVVSNDVEISEVSVSTNPHYLYPNDSNRIDRYTSDSLVQLISYSIGCMMGRYSLDREGVMYAHSDNEEFDKLTAEGTYFAYSSDEDGIIPLTDQEWFKDDATNRFREFVQVVWGEEHLQENLDFVAESLCLNAIKPKKSESALETIRRYLSTQFYKDHLKTYKKRPIYWLFSSGKQKAFECLVYLHRYNEGTLSRMRTEYVTPLLGKYDAYAEQLEKQIETADSTSEANRFKKELDALIKKQVELREFDDKLKHYADMRISLDLDDGVKVNYGKFGDLLADVKAITGSAPEVN

SEQ ID NO: 3026 - protein, 1195 aa, Bifidobacterium bifidum
MNTSKLQAFATDARRQLMNAVRARLDAALVPNSDAQVDDPRAFDFLQREIERAGDGEEGRRHVVERYAYRWFNRIVAFRYMDVHGFTGTPVVSPAGLTSTNGLPEVLAAAKRGEYDSRVFSAHVNDKAKERIEGLLSGSILADDPQGVAYGLLLQSECRFWNRNLPFVFENVGKEAGRVDELLMPADLLAEGSVLRNAVEVMTPEDCGVDDPSGNVEIIGWLYQYYISERKNEVMDGFKKNHKAGAEEIPAATQLFTPDWIVRYLVQNTVGRLWMQSHPDSQLYKNWDYYIQPSEDGSTENEDILNIQTPEELTVCDPACGSGHMLTYAFDLLYEIYEEEGYAPSDIPGLILKHNLYGMEIDERAASLAAFALTMKARSRSRRFFKKQVEPNIQRIVPISFEESDVVDLNDLYQVDLDFTVWNTYAKADVYGSLIEPPQELVDLAASAEDAEAETTLFDSLLRERVEGVFAQTRYLARKYAAVVANPPYMGAKNMSGELKQFVQDRYEDGKADLFAAFIYRLLGMVPEHGQLGFMTPYVWMFISSYEQMRQHIIRQEHISSLIQLEYSGFEGATVPICTFTLEKGHSDRKSAFVRLSDFVGAKQQGPRALGIIDAHNNEQSAHSGMRKYFFEVNQHEFAQIPGSPIVYWLGEQLRKTLINPASDTILFSDGLIKTGDNLQYLRLWWELISTNVNNKSRYRFCAKGGKERNYYGNLNNVVKWDEETRDYYRSDKVARISPKYLWDKEGITWTKISSRGGTFRLLRKEDIAETGGPSLFLKDNVDGNDLLSFIGVITSSLAPYILQGLNPTLNYQTGDVLRFPLPIKKEEALPSLVHSMIGSSKEDWDSFETSWDFQRFALLDPNQGSQAGDLLEDAVTHLREYWNRVSEEQRQREIRNNELVADAYGVRDDVPCDVPLERVSLKRNVAFAYPKDTPEARNEKFAQDVVRELISYAVGCMFGRYSLNKPGLILASQGETLDDFHAQIPNPSFEPDVDNVIPVTETDCFEDDIVTRFRRFLSVVFGKENLAANIAYIEQVLGKSIRKYFVNDFYNDHVKMYSNRPIYWQYSSQTNNKGSFKALVYLHRYTPKTTNVVLNYLRDYTGKIADIADGLERSDRTADKKQAAKLRKVVLECKDYEDQTLYPLATRNLEIDLDDGVLVNYLRMGKALRSIPAIEKKRKEVSTWTWPVHPLGKE

SEQ ID NO: 3027 - protein, 1217 aa, Escherichia coli; identical to SEQ ID NO: 3002

SEQ ID NO: 3028 - protein, 1225 aa, Salmonella enterica; identical to SEQ ID NO: 2875

SEQ ID NO: 3029 - protein, 1208 aa, Vibrio cholerae; identical to SEQ ID NO: 2909

SEQ ID NO: 3030 - protein, 1217 aa, gamma proteobacterium
MNTNNVKKYAPKARKAFIEAMSKQAAKYGITKKKIEPAEQKGDLVLIGDRPFPASVIKPRERLVMRIEQQGFDQVMEHVAYSWFNRLCAIRYMERKGFLDHGRRVLSSAEGSAADGSAGVPQILEECLDVELPGLDQAKVRELKLDGTKDEELYRELLLAQCHALHQAMPFLFEAVADESELLLPENLTKTDSLIRELVESVPDEDWDHIEIIGWLYQFYISEKKDQVIGKVVKSEDIPAATQLFTPNWIVQYLVQNSVGRQWLQTYPDSPLKEKMPYYIEPAEQIPEAESRLAEITPSDIAPESIKVLDPAAGSGHILVEAYKVLKAIYEERGYRTRDIPKLILENNLFGLDIDDRAGQLAGFALMMLAREDDRRVFSRNISLNVLSLQESSNVNLPSLWQALNLSGEWQSGTSQGLFEDGQQDLSAFAADNRYQLFQRTIERFKNAKTFGSLIDVPHDDCEELKGLFVTLRELDSSGDSMQKAAAGQLLPYVQQGVLLSQKHDAVIANPPYMGSKGMNADLKEFAKKEYPNSKSDLFAVFMERAFKLLNPTGFNAQVNMQSWMFLSSYEQLRSNLLEDHTFVTMAHLGARAFSQISGEVVQTTAWVLGKYHVDKYQPTFYRLIEGNEEDKKKSLLKRENQYSSTAQDDFKKIPGSPIAYWANRAAIESYTDNQTFADIAPFKSGMSTTNNDRFLRLWHEVDYCNLKLDSKSLEEAQASQKKWFPYKKGGAYRKWAGNDDYVVNWFNDGEEIKESVVNNPSDPNTTHWSRRIFGVPYFFKPSLTYSRISSSDFSVRYSSGGAIFSDASNGCFPKSNHLLFLAFLNSDFAKELLQFLCPTINFMAGDVQKLPSPLGITWGRDEESLVEKCIQIAQEDWDSQETSWALKWCNHDRKYIQKHIANKNALWIEKKNDLAKMESMLDAKFNLHFGNETIEERHSVYANYLHNDLEENEFVCVETQKIISFSFGAMFGRYSLDREGVVYARSGNEGFAELVSEGAYKTFPADDDGIIPLTDQEWFPDDATNRFREFVKVVWGEEQLHKNLDFVAESLCLHAIKPKKSESSMDTIRRYLSTQFYKDHLKTYKKRPIYWLFSSGKQKAFECLVYLHRYNEGTLARMRTEYVIPLTAKMASYAQKLETDKEASGSAAEVKRLEKEIAQLHKQQAELSEFDEKLRHYADQRISLDLDDGVKVNYGKFGDLLAEVKAITGESPEALS

SEQ ID NO: 3031 - protein, 1208 aa, Acetivibrio cellulolyticus
MNKTALKKFAIEARNDLRDKVKTKAFQYGITEESINNKNTVPSNDFFKDGKNALTREEKDQRDKVKSLMETKGFNQVIEEVAYTWFNRFTALRFMEIHNYLPSKVRVLSSINEGSVEPDIIREALNVDLNVDKEIVYNLKMSTENDATDKLYKYLILAQCDVLSVTLPFLFGKTDDYTKLLFPDGLLAEGSFLRKMTDTEALPESDWNQVEIIGWLYQYYIAEKKDEVFKNLKKNVKISKENIPAATQLFTPHWIVRYMVENSLGRIWVESYPETTLKGEWKYYLEEAEQEEEVKKQLEEIRYKNVNPEEITFLDPCCGSGHILVYAFEVFYAMYLEKGYVESEIPKLILEKNLYGLDIDDRAAQLASFAVMMKAREKSRRVFRQEIKLNICAIQESNWLTDNGKWLVMSGRRDTNSIDAIVELLIDKNAIELEKQQQRATIEYLAEIFMDAKEFGSILDVKPVELHFLEKRLNQLETEPGDLFEMLAKQEILEKLPGIICQAKIMGKKYDVVCTNPPYMSISGMGVRLNNFVKKNYPDSKSDLFAVFIEKSVRLLKANGFQTMITQHSWMFLSSFEKLRERVFRYEILNMAHLGSKAFEEIGGEVVQTTAWVLRNCNIEKYESSYFRLVDFTSQGEKEQAFLTGRNKYLSKKNLAFKIPGMPIAYWASLNFIRSFEKEKLSDKYKIYLGMRTGNNEKFLRYWHEINDYLFGKNFKSALDARTSGLKWFPYSKGGSFRKWYGNYEYVVNWKENGKEIKEETKIKYPYLGDNLGWKISGEAYYFLEAITWSRIGTNNFGTRYLPHGFLFDTASPCIFTSNNDRLYILAFFCTKIFTKYLEFLNPTMAFQIGDIGNIPISFPDSSEQKIRIDELVKNSISISRTDWDSFELSWDFSQHPLLIQKGENKTIESAFATWSEFAEKQFNQLKANEDELNRIFIEIYGLQDELSPEVDEKDVTVRKVDQVRDIKSFISYSVGCMFGRYSIDEEGLIFAGGEFDTSRYKTFPADQDNVLPVVSDTYFEDDIVSRFIEFVEVTFSKETLDENLKFIAETLSKKAGETDKETIRRYFLNDFYKDHVQTYKKRPIYWMITSGKSKAFNALIYMHRYDKTTLSRVRTDYLHVLQTRLNAQREKLLSIINGNESEKEKSKAKKELKTIEKQIEELKDFDEVLHHMADKQIEIDLDDGVAVNYMKFKDLLLDIKLKDSEEE

SEQ ID NO: 3032 - protein, 1204 aa, Fusobacterium sp.
MNKSNLKKFAIGARQELREKTKAQLKRLGMEEKKIEEGKDMGSQVEIYGKLYSKSSYQHLLVKYHSLGYEELVEESAYLWFNRLTALAYMELHDCFSEHMIFSKGSKGEPSILDEYFQADFFQKMPLEKQEELHQLRDQNTSDSLETLYSILMEEKCEELSKIMPFLFSKKGKYADILFPSGLLMQDSVLKKLQAILLEIQEEDQSIPVEILGWLYQYYNSEKKDEVFAGLKKNQKVTKENIPAATQLFTPHWIVKYMVENSLGKLILEYIPNMESIKKDWNYYIETEIESSSEKLSIEGIKILDPAMGSGHMLTYAFDILFDVYQELGWSKKESVLSILQNNLYGLEIDDRAGQIAAFALLMKGKEKFPRLFQVLEREENFEMPVISLQESNAISKRMYTMLEESPTLQDLLKGFENAKEYGSILKIDSFAESILQEEYQKLQEKIQNQGQFSLLKNNEFLEGDLEEDLERLERIIRQYKIMIQKYDVVITNPPYMGGRGFSPKLKNYTEKNYKDSKSDLFSVFMEVCQGFTKKNRYTAMITMQSWMFLSSFETLRNHMITKTEIQTLNHLGTRAFSELAGEVVQTVSWVQKHKTPEKKGTYIRLVDYNNGEEKEREFFNKENYYQANQKDFTKIPGSPIAYWVSDRIREIFEKEKKLGEVGEAKQGLATADNNRFVRLWHEINFHTIGFGMKNSEEALNSKKKWFPYNKGGEKRKWYGNQEYVVNWEKDGYEIKNFKNSVVRNPSYYFKKSISWSDITSSGNSFRLYPEGFIYDVTGMSYFIEDKFLTYLGIFNTKIYSKLTKLINPTLHLQIGDMIKMPYFQIQNPLFEQLVSLILWISFEEWASRETSWDFERLTLLNGENLSKAYKKYCTYWESKFFSVHSSEEDLNRILLESYSLQEEMDEKVGFSDITLLKKEASIVENIDNATSCGYLENRGAKLEFHSLELVKQFLSYAIGCIMGRYSLDKSGLIMANSDDVLSMSSNKITVSGVNGEIRHEILNPSFFPEEFGILSVTTEERFENDIVSRVIAFISAAYGKEHLEENLEFITEILGKKAGESHEEVLRNYFIKDFYTDHCQRYQKRPIYWMLHSGKKNGFSALIYLHRYEENTIARVRSDYLLPYQDFMEQQEAHYSKIASDEVSTPTEKKDAQKKVKELHDILKELKDYANKVKHIAEQRISLDLDDGVKVNYEKLGSILKKI

SEQ ID NO: 3033 - protein, 1210 aa, Enterococcus faecium; identical to SEQ ID NO: 3021

SEQ ID NO: 3034 - protein, 1246 aa, Vibrio cholerae; identical to SEQ ID NO: 2910

SEQ ID NO: 3035 - protein, 1225 aa, Salmonella enterica; identical to SEQ ID NO: 2876

SEQ ID NO: 3036 - protein, 1246 aa, Vibrio cholerae; identical to SEQ ID NO: 2910

SEQ ID NO: 3037 - protein, 1215 aa, Fusobacterium nucleatum
MNKSSLKIFAIEARKELMEKMRTRLEILGITKNGIEKAKVIGKEVEVKGTLYPKESYDSLIRKYKQVGYEELIEESAYTWFNRLTALAFMEANGYIEEKMIFNNGVKNEPAIIDNYYEFEFFKNLDNNLQKELHNLRDENTPNSIEKLYSILMEEKCEDLSNIMPFMFKKKGTYSDILFPTGLLMENSLLVRLRKEIGEEAPIELIGWLYQYYNSEKREVVYNGSMKKSKINKEYIAPATQLFTPDWIVKYMVENSLGKLALESTGINENLKNNWKYYIDSEKEENSEKIKIEDIKILDPAMGSGHILVYAFDLLFEMYENLGWSTKETVLSILRNNLYGLEIDERAGQLASFALMMKAREKFSRLFSVLKREEDFKLNTLILEESNSLSERIRNKIKANNLNNLNKIIQEFEDAKEYGSILKLESIDKEILEKEFNILKESFNNNEQETLIFNEDEMIIDINEELELIVSLIKQHIIMINKFDITVTNPPYMGNSRMNGILKEYIDKNYSDVKSDLFAVFFIKCCEITKRKGYLGFMSPFVWMFIKSYEELRKIFINGKTISSLVQLEYSGFDDATVPICTFVLQNSYTDKKGEYIKLSDFKGAKNQPIKTLEAVKNPNCNWRFQAKQKDFEKIPGSPIAYWVSDKIREIFEKNQKLGEVGEAKQGLATADNNRFLRLWNEVNYNKIGYSMSNSQEALESKKKWFPYNKGGEFRKWYGNQEYLVNWENDGYEIKNFYDEKGKLRSRPQNTEYYFKESISWTDITSSGNSFRYYPKGFLYDVTGMSYFIDESKQKNLLGILNNKLIYIITKILNPTLHLQIGDLIKVPYFTIKNEKFNILVQQNIDISKEEWDSREISWDFEKLSLIDGKDLKTTYENYCNHWRDNFVQLHKNEEELNRFFIEIYDLQDEMDEKVAFEDITILKKEATIIQIDNSVPKNFSSESEKYLYDRGVSLEFNKDELIKQFLSYAVGCIMGRYSTNKSGLIIANSDDILELSENKFIVKGTDGEIRQEVERKFLPDEFGIIPITDEKDFSNDIVEKIKEFIKFVYGEDNLKDNLNFIAEALGNKDNKPAEEIIRAYFIKDFYADHLQRYQKRPIYWLMNSGKKNAFSCLFYMHRYEPLTVARVRADYLIPYQEMLENKRKFIERQLSDDDISAKEKKNIEKQLKELDTLLKELREYANEVKHIAEQKIPLDLDDGVNVNYEKLGTILKKR

SEQ ID NO: 3038 - protein, 1215 aa, Fusobacterium sp.
MNKSSLKIFAIEARKELMEKMRTRLEILGINKNGIEKAKVIGKEVEVKGTLYPKESYDSLIRKYKQVGYEELIEESAYTWFNRLTALAFMEANGYIEEKMIFNNGVKNEPVIIDNYYEFEFFKNLDNDLQKELHNLRDENTPNSIEKLYSILMEEKCEDLSNIMPFMFKKKGTYSDILFPTGLLMENSLLVRLRKEIGEEAPIELIGWLYQYYNSEKREVVYNGSMKKSKINKEYIAPATQLFTPDWIVKYMVENSLGKLALESTGINENLKNNWKYYIDSEKEENLEKIKIEDIKILDPAMGSGHILVYTFDLLFEMYENLGWSTKESVLSILKNNLYGLEIDERAGQLASFALMMKAREKFSRLFSVLKREENFKLNTLIIEESNSLSERIRNKIKNNNLNNLNKIIQEFEDAKEYGSILKLESIDKEILKREFNILKESFNNNEQETLIFNEDEMIININEELELIENLIKQHTIMTDKFDITVTNPPYMGNSRMNGILKEYIDKNYPDVKSDLFAVFIKKVISFNKENGFISLVSPYVWWFIKSYEELRNYILNHLTFYNLIQLEYNAFEGATIPVGTFVLKNKIIPNYKMIGIKLSDFKGIENQPIKTLEAIKNPNCNWRFQAKQKDFEKIPGSPIAYWVSDKVREIFKKNQKLGDIGEAKVGLQTGDNNKFLRLWNEVNYNKIGYNMSNSQEALKSKKKWFPYNKGGEFRKWYGNQEYLVNWENDGYEIKNFYDEKGKLRSRPQNTEYYFKESISWGLITSAGSSFRYFPKGFIFDISAVSYFIEKKEREILGILNSKYFLELSQIINPTINFSNGVFALLPALFVENEKFNNLVQQNINISKKEWDSRETSWDFEKLSLIDGKDLKNAYENYCNHWRDNFVQLHKNEEELNRLFIEIYDLQDEMDEKVAFEDITILKKEANIIQIDNSIPKKFSTESEKYLYDRGVSLEFNKDELVKQFLSYAVGCIMGRYSINKSRLIIANSDDILELSENKFIVKGSDGEIRQEIESKFLPDEFGIIPITDEKDFSNDIVEKVKEFIKVVYGEGNLKDNLNFIAEALGNKDNKPAEEIIRTYFIKDFYSDHLQRYQKRPIYWLMNSGKKNAFSCLFYMHRYKPLTVARVRADYLIPYQEMLENKRKFIERQLSDDNISAKEKKNIEKQLKELDTLLKELREYANEVKHIAEQKILLDLDDGVNANYEKLGAILKKR

SEQ ID NO: 3039 - protein, 519 aa, Acinetobacter lwoffii
MNTSNIKKYAPQARNDFIAAMRKQAAKYGITADSILPAEQKGDLLLIGDQVFPLSVMKTREKLIKRIQTSSFEQTIDYIAYSWFNRLCAIRYMECKGLLDHGRRVLSSADGSAGLPQILEECLDIDLPGLNASRVAELKLDGNKDEELYRELLLAQCHALNQVMPLLFEQVSDESELLLPDNLTKTDSLIRDLVSNIPEEDWSDVQIIGWLYQFYISEKKDQVIGKVVKSEDIPAATQLFTPNWIVKYLVQNSVGRLWMMAQPDSTLASEWEYYIQPAEQTDEVNAQLKQLIDARISEDGDTLNPESITVLDPACGSGHILVEAYDCLKAIYLERGYRSRDIPRLILENNLYGIDIDTRAAQLSSFALLMKAREDDRRLFSNPPKLNIIALQDSQPERLDAFTQDLASTGIEESDLKELLDLFEHSSTFGSLIQIPQAFAKKLPELETKLNTALDSGDIFAQQSAQELLPLVQQAKLLAKQYDAVIANPPYMGNKYLNPNLKTYLKKNYLGYEKDLFSA

SEQ ID NO: 3040 - protein, 631 aa, Acinetobacter lwoffii
MVWMFISSYENLRTYFIDQAIIYSLIQLEYNASGEVRVPLCAFILSKQHIANFIGSYIRLTEFPGYDVQPVKTLEALKNPKCGWFYTAKPDDFKKIPGSPLAYWVSEKVREIFEKSPSLGEVADARQGLATADNNRFLRLWQEVNIQRISFGMENREQAQFSAKKWFPYNKGGEFRKWYGNQEYLINWENDGKELFDFIPKSVIRNPSYYFKPSVGWSKITSSLFSMRYFPTGFIFADAGMSVFAEDSTIKKVMGCLNSKVSETLLSNMSPTLNFEAGTISKFPLIEDINNYQEVIDRLITQSKTDWDSYETSWDFTENPIIRTGQPNLEQAFNTWQQQNADAVAEMKRLEEENNKLFIDAYGLQDELMPDVPDEQITLTRADREKDSQRLVSYALGCMMGRYSLDEPGLIYAHAGNQDFDASRYQTFPADADGIIPLTEMHWFEDDATRRIQEFLTAVWGKDTLDTNMQWLAESLDKKANETAEDTIRRYLASKFYKDHMQTYKKRPIYWLFSSGKQGAFQALVYLHRYNESTLARMRTEYVMPLISKMAAMVNSLQSEIENSDSAAEIKRKEKELQNLHKQQAELSSFEEKLRHYADQRISLDLDDGVKVNYGKFGDLLAEVKAVTGEK

SEQ ID NO: 3041 - protein, 1184 aa, Lactobacillus casei
MDKKAIKTFAIQARRSLIESIKLKLENLGITKDGVAEKMSQSTNEIEYYGDKGLSITGQDIRRRRELVARLKGMAKQEEWSDALTDLIEEVAYTWFNRIIAIRFMEVNEYLPSGVRVLSSETKLKVPDILREAFEIEDDLGGYSVDEHEIIQKALDTEDPTDMDAAYVILFTKQANALNHYLPELFEKTDDFMQLLFTPSYSSGVIKDLVDDIKEDDFDVDKGGQVEIIGWLYQYYNIEPHDKVVNINGGPIKTNDIPAATQLFTTDWVVRYMVDNSLGRLYLEYFPDSPIKANLTYLLPGPIETRTDSFDLSKLKVLDDAMGSGHILVYAFDLLIQMYEEQGYGKRDATDAILAHNLYGLEIDKRAYQLAYFALMMKARQYNRRILSKPVRHNLHVFESTVDVPNEVFEKMNASKDTLGDLHTLVSIFKQAKLLGSIMHFEKKFDFDALFSAVNSLPDSTQLDLFGLQAAKNSLLGILKIAQVLQTHFDVVATNPPYLNRMNGDLKKYVKKYYKAYSGDLFSVFIWKNIEMTKQDGYSAYMTPFVWMFIKTYEGLRKSILDSKQISSLIQMEYSAFEEATVPINTFVLKNDMSADSTGTYLKLSDFKGGMEVQRRYVLKAVADPSVSYLYRTKQTNFEKIPGSPIAYWASNNLIRSFEIGTPLKDLVQPKVGLQTGDNNRFLRQWYEVEPFRISFTSTSTEDALKSGEKWFPYNKGGSYRKWYGNYDYVVNWQDDGYEIKHFVDFNGKVRSRPQNTDYYFREAITWSDVTSGHFSMRYRKEGSIFDVVGMSLFSSDTKRLLQILLFSNTKVMNYIMSFLNPTIHASIGYVSLTPIIFTENTAAFDLANQCLANTEKDWNSYENSWSFQKIPLLDNIADHHRNWTVEGAFKQWQKEADDRFNQLKANEEELNRIFIDLYGLQDELSPEEEDKDVSVRRACLPRDIKAFMSYFIGCVFGRYSIDTPGLAYAGGDWDASKYKTFIPNEDDVILLTDDDYFGDDRDVMNRFKEFLTTSFGSENLNENLKFIADALGKRGESSEEKIRAYLRDDFFKKDHLSTYQKRPIYWEFNSGRNGGFKALMYLHRYDRNTVAMIRTKYLHPLQEAYERKLVQQKKLEEDEQQTRQKNKYKKRITTITKELDELIKYDEKLQHVANLHIDLDLDDGVLVNHAKAQADTKILTPLK

SEQ ID NO: 3042 - protein, 1201 aa, Escherichia coli; identical to SEQ ID NO: 3009

SEQ ID NO: 3043 - protein, 1177 aa, Acinetobacter sp.; identical to SEQ ID NO: 2770

SEQ ID NO: 3044 - protein, 1246 aa, Vibrio cholerae; identical to SEQ ID NO: 2910

SEQ ID NO: 3045 - protein, 1159 aa, Holdemania filiformis
MDKNAIKKYAVWARTELIERVRQRALKYEVAADADANADSASGKVLTDIEKTQRAAGIARMREKGYEYVIEEVAYTWFNRFAALRYMEVNNYLPTRVRVFTDENGNFKPQILAEAIHLDLDGLDMEKVYALKEAENNDELYKYLLITQCNALSAVLPQMFKPVDERCKEEKNDYTILLFPDNQLREGSVVEQMIAKIPEDNFDVNSENGQLEIIGWLYQYYISERHEEVVNISNKGAIKKEDIPAATQLFTTDWVVRYIVDNSVGRYWIERNPESALANELEFYVRPQNLSSLEALKKVSPEEITFFDPCIGSGHFAIYAFDVLMKIYTEYGYSQRDAVAAIVEKNIYGLDIDDRASQLAYFSIMMKACQYDRRFFTRNIQPHILSITESNQLDSYCVDYFCNGDTSLKEMMSEIEKCMHNAKEYGSLLTIPDLDFCKLRIRLEEIKEDISIVREATIAQIKPLIDVAEILSQKYAIVATNPPYLNRYNETLKTFILDKYKDYSGDLFSVFMYHNFNFTLPDGYCGFMTPFVWMYIKSYEKLRKYIINNKGIATLIQMEYSAYEEATVPVCAFVLANECDVEVGEYFDLSKYVGGMEVQKKKVLEAIANPKCGYFHEFEKRNFERIDGNPIAFMASERLLQIFETAKPLKQIAEPKVGLQTAKNDIFLRLWFECDFTKIGFGYTNLEDTQNGLHKWFPYNKGGAFRRWYGNRNYVINWENDGEKVRVYPGAVIRNPQFYLKPCITWSDITSASFSGRYCEGGFLFDVKGSSGFPEVKNLNYVLGFLNSKISQKCIKILNPTISTQVGDMARIPVYFEQSHKEEIDRLVCECIEISKRDWDSDELSWDYKRCPLIQKNMTLQQAYSSWKQKNEASFVRLKSNEEQLNQIFINIYGLGGEVTAEVDDKSVEASCKHMTKEQAVKSLISYAVGCMFGRYSLDKEGLVFAGGVWDTSKYKIFPVDKDNIIPICDDEYFDDDITGLFVKFIETVYGRDTLEENLCFVADALGGQGTPKDIIREYFVSDKGFYADHCNMYTVTGAGKRPIYWLFDSGKKNGFKALVYMHRYQPDTIARMRTDYVHEQQSRYRTAITDLENRIVDATTSERVRLNKQLSKLHDQSEEIRKYEEKIHHLADQYIAIDLDDGVKVNYAKFQDVLAKIK

SEQ ID NO: 3046 - protein, 1208 aa, Enterococcus faecium
MDKKAIKNFAVNARRKLIDEVMTKAKRLGIDESKIEDVKKIDSNLQEIEKSGIRIQGKEIAQRNKLIAELKQRASVTSYSEAFQELIEEVAYTWFNRLIAIRFMEVNDYLPDTYRVLSSEISGKIEPDIITDIYDADIFEELSSNEQQQVRTWKTDNSAEAMDKLYQLIFIKICNQLNDYLPELFEEVEDYTELLFTASYIKKDGVIADLLSIPEDDFNVQAGGQVEIIGWLYQYYNSEPHNKVVNIYKGIVKKQDIPAATQLFTTDWVVRYMVDNSLGKYWLDRYPNSELRNKLKYLIPDKYAFKQATSVSNLKPEELKIIDNAMGSGHILVYAFDVLMEIYLTLGYSERDAARAIVEYNLYGLEIDKRAYQLSYFAIMMKGRQYDRLFLKKSLSPNLREFIDSPKVTDEYQERISELNNDKDSERWNEYKELIFDQFENGKELGSIIKLVDKNNQAITKEYLGKVREYISKFNEFTNMDILYGMKEIQEKYLHILDVAEMLVDKYVAVVTNPPYLNKMDKKLKKYVNDNYSDVKKDLFSVFIKLNSQMLIDNGYASFMAPFVWMFISSYEKLRSFLINERNISSLIQMEYSSFEEATVPLCTFTIKNSNEQEGSYIKLSDFTGGMEVQRVKALEAINHYESCNYFYCTNQNNFKKIPEKPIAYWAGKNLFRNFEILPSINEFVDVNQGLITSNNDKFLRLWWEVEFDKIKFNAKSLKCFVNSGKKWAPYNKGGSYRKWYGNYDYIVNWENNGAEIKNFIDDKGKVRSRPQNIKHYFFEALTWSEITSSRFSLRYREYGSIHGNKGMSAFSTNHLSMMNILAVVNSKVGDYILNILNPTISLGVGDFKRFPIKVINSIDIDKISENLVDIYKKDWDSYELSWNFNRHPLLKNIFKDNILRQSIKDLEQDCVKNIEVAIENEEYLNVWVINEYGLNSELSYSVNSSDVGLRKGTTKSEIKSFISYSMGVIFGRYSIDEDGLIYAGGEWDPSRYQKFKPDADNVLLITDDEYFKDSQIDIVNRFIDFVEITFGKETLEENLQFIADTLGGKGTSREIIRRYFVKDFYKDHLKTYSNRPIYWQLDSGKQNGFKALMYLHRYTPDQLGKVRTEYLHELQKAYDNRIELRQQQISTSDNPKERNAMTKEIAKIQKQLKEVREYDEKLGHLALKRIELDLDDGVIVNYDKLQRDPKTGEKFQILAKGVKEPKK

SEQ ID NO: 3047 - protein, 1211 aa, Fusobacterium sp.
MNKSSLKIFAIEARKELMEKMRIRLEILGITKNGIEKAKVIGKEVEVKGTLYPKESYDSLIRKYKQVGYEELIEESAYTWFNRLTALAFMEANGYIDEKMIFNNGVKNEPAIIDNYYEFEFFENLDSDLQKELHNLRDENTPNSIEKLYSVLMEEKCEDLSNIMPFMFKKKGTYSDILFPTGLLMENSLLVRLREEIGAEAPIELIGWLYQYYNSEKKDEVFEGLKKNKKITKENIPAATQLFTPDWIVKYMVENSLGKLALESTGINENLKNNWKYYIDSENEENLGKIKIEDIKILDPAMGSGHILVYAFDLLFEMYENLGWSTKETVLSILKNNLYGLEIDERAGQLASFALMMKAREKFSRLFSVLKREEDFKLNTLIIEESNSLSERIKNKIEANNLNNLNKIIQEFEDAKEYGSILKLESIDKEILEREFNILKESFNNNEQETLIFNEDEIIIDINEELELIGNLIKQHITLTNQYETVVTNPPYMGGKGFSPKLKTYVEKNYKDSKSDLFAVFIERCNEFTKKNCYTSMITMQSWMFLSSFETLRKNIIEKTEIKSLNHLGTRAFSEIGGEVVSTVAWISKKISPKNEGTYIRLVDYNNAELKEQEFYNRANYFQAKQKDFEKIPGSPIAYWISDKIREIFEKNQKLGDIGEAKQGLATADNNRFLRLWNEVNYNKIGYNMSNSQEALESKKKWFPCNKGGSFRKWYGNQEIIVNWEKDGFELKDFKNSVIRNPSYYFKEALTWSTISSSDCSFRYSPIGNIFETKGSNYFVKDYKNFYYLFGFLNTKIVNYLLKIISPTLDYHEGPMSNLPVTLEDSSIKLEIINNFIIENLNISKEEWDSRETSWDFEKLSLIDGKNLKTAYENYCSHWRENFVQLHKNEEELNRLFIEIYDLQDEMDEKVSFDDITILKKEANIIQIDNSIPKEFSTESEKYLYDRGISLEFNKDELVKQFLSYAVGCIMGRYSINKTGLIIANSDDMLELSENKFIVKGTDGEIRQEIESKFLPDEFAIIPITDEKDFSNDIVEKVKEFIKYVYGEENLKDNLNFIAEALGNKDNKPAEEIIRTYFIKDFYSDHLQRYQKRPIYWLMNSGKKNAFSCLFYMHRYEPLTVARVRADYLIPYQEMLENKRKFIERQLSDDDISAKEKKNIEKQLKELDTLLKELREYANEVKHIAEQKITLDLDDGVNVNYEKLGAILKKR

SEQ ID NO: 3048 - protein, 1202 aa, Clostridium butyricum
MDKNKVKSFAIWARRSLIAAVSEKANRIGISEGKIEEATAVQGGFIVEGKEELHYFPKSHRDALVSQVREKGFEQVMEEVAYTWFNRFMGLRYMEVNDYLPTGVRILSSSIEGKIEPDVLTKVSEIIDELGLNANEIYDLLDTGDTLDREKAYRIILVKQCNELGKIIPQMFEKISDYTELLLPDNLLEDSSVIRKMVEDIEESDWLEEVEIIGWMYQYYISEKKDVVFADLKNNVKITKENIPAATQLFTPKWIVKYMVENSLGRLWLEGHSNEELQKEWKYYLQESEQEPEVEEELNKIREEHAKLKPEDIKVLDPCMGSGHILVYAFDVLYEIYKTSGYSEREIPRLILQKNLYGLDIDDRAAQLAAFALIMKARHYNRRLFREIGREGLELNLCSIEESNEISNDIIEYFSNGNENLEKEFRYLIEKFIESKEYGSIIRLDKVDFTMLNKRLVEIESENNFIFGDYREIILNKVYKIIKQSEIMTSSYNICVTNPPYMGSKGMSDKLFKYVDINYKKSKRDLSTVLMEKCSEFTCNSGYLAMINIPTWMFLTSYSEFREELINNEIFINLIHLGRGVFGSDFGTVAFVLSKYSSKKFKGLFKKLYNKAGDVESLQEKKKRFFEDVNIFINTTGSFSSIPSMPIVYWASSEIVKLFKKRDVVSNYADVKKGLTTAKDDTYLRLWHEISNEKFVLFSNSNSKWHPITKGGSYRRWYGNNEYVVNWENNGMELKSFKNSVIRNEQYYFRDGITWTYITNGKFNLRIFDNRNIITAAGPGIYGDNIKYLLGYLNSSVAQYLINMIGGQTITYEVGEVANIPIKSVKNAEVEQYVDKCINIAKQDWDQYEQSWDFKNHQLLECVNENGSHKIETIFSDWENRSKETFKELKDVEEKLNKIFIDLYGLSNELKVEIEDKDITIRKADIERDIKSFISYSVGCILGRYSIDSEGLIYAGGDFSDKWNLADSKVSKIEKDDEGNIISDSWVDSRFMPDKDNIIPITEDEYFEDDIVSRFIDFVRTVYGNDTLEENIDFIADSIGRKASETARQAIRRYFIKDFYKDHLKIYQKRPIYWMFESGKNDGFKCLVYMHRYNDQTVAKVRTDYIHTLQRKYESEINRLQLVVDSEDYTAKDRTSAKKKIDRISKQLEECKEYDQVVAHLANEKISIDLDDGVKVNYAKFQDVKVINSKGKEVKMNLLSKI

SEQ ID NO: 3049 - protein, 1177 aa, Acinetobacter baumannii
MNTSNIKKYAPQARNDFIAAMRKQAAKYGITADRILPAEQKGDLLLIGDQVFPLSVMKPRDKLIKRIQTSSFEQTIDYIAYSWFNRLCAIRYMECKGLLDHGRRVLSSADGSAGLPQILEECLDIELPGLNASRVAELKLDGNKDEELYREVLLAQCHALNQVMPLLFEQVSDESELLLPDNLTKTDSLIRDLVSSIPEEDWSDVQIIGWLYQFYISEKKDQVIGKVVKSEDIPAATQLFTPNWIVKYLVQNSVGRLWMMAHPESTLSIDWEYYIQPAEQSDEVNAQLKQLIDVRISEDGDTLNPESITVLDPACGSGHILVEAYDCLKAIYLERGYRSRDIPRLILENNLYGIDIDTRAAQLASFALLMKAREDDRRLFSNPPKLNIIALQDSQPERLDAFSQDLANTGLAQADLKELLGLFEHSSTFGSLIQIPAAFSQKLPELESKLNTALESGDIFAQQSAQELLPFVQQAKLLAKQYDAVIANPPYMGGKGMNTALKDFAKKKFPDSKSDMFAMFIERCQALSKISGETAFVTPYVWMFISSYEELRKKLVSQNTIKSLIQLEYNAFEPACIPVSAYTISKAHVKDYVGSYIKLSDFKGHENQAPKTLEAIQNPSCGWFFNAKPDDFNKIPGSPVAYWVSSKTIETFEDNKSLSFLAEPKAGLATGDNTKFQRIWFEVSFQNISFNCKSCSESKILSSKWFPCHSGGEFRKWYGNHETVVNWKNDGEEIRNFRHEDGRQKSRPQNTQFFFKQGLTWTKLSSTFFAVRFRPPGFIFDDTGRSAFFAHSEHELPTLAAVNSKAGQYFLSILNPTMSFTSGDVGKVPLNLSFGDLHTSRVENLIQIAKTDWDSYEISWDFTQNPVIRTGQPNLEQAFNTWQQQNADAVAEMKRLEEENNKLFIDAYGLQDELTPDVPDEQITLTRADREKDSQRLVSYALGCMMGRYSLDEPGLIYAHAGNQDFDASRYQKFPADADGIIPLTEMHWFEDDATHRIQEFLTAVWGKDTLDTNMQWLAESLDKKSSETAEDTIRRYLASKFYKDHMQTYKKRPIYWLFSSGKQGAFQALVYLHRYNESTLARMRTEYVMPLISKMAAYANSLETAKESSDSAAEIKRIEKKLQDLHKQQAELSSFEEKLRHYADQRISLDLDDGVKVNYGKFGDLLAEVKAVTGEK

SEQ ID NO: 3050 - protein, 574 aa, Cellvibrio sp.
MEKYFFQASAEDFKKIPGVSIAYWTSKSIIQSFESGSRLGDHLDTAQGMKTLDNERFIRRWQEVSFSKITKKTVSDKQWVPINHGGGFRKWYGFHESVLKWFNDGEEIKSLAKEKYNSVTRTVTGMGHYFENGITWSAISSDLISVRKFGEGFIFTNAGMCAFGSEKKQDISMALLNSKVGVEVLKILAPSVNFGPNQIGEIRIIDLNESAHIVHINSKKLVVLSSEDWDFYETSWDFTNPPLLKLYHRQHLISATYMRLHSYWRDMTLKMQRLEEENNRIFIDAYGLQEELTPEVASKEITLTCNPYYRYSGNKSEDELSALLQSDTMKELVSYTIGCMMGRYSLDEPGLIYAHSGNEGFDPTRYQKFKADDDGIIPLTDKEWFSDDAANRLEEFIATAWDAAHLEENLGFLADNLSPKKGESSRETIRRYLCDSFYKDHTQTYKKRPIYWLFTSGKQKAFQCLVYLHRYNEGTLARMRTQYVIPLTAKLAAHVNKLEQDKDASTSTPEIKKLEKEIATLHKQQAELSTFDEKLRHYADQRIPLDLDDGVKVNYGKFGDLLADVKAIMGGANE

SEQ ID NO: 3051 - protein, 617 aa, Cellvibrio sp.
MNTSNIKRYAPQARNNFIAAITKQAAKYGITESGIEPLEQKGDLALIDGRPFPASIIKPRAALVQKIKQLGFTQVIEQVAYSWFNRLCAIRYMELKDYLEHGRRVLSHPDQIGSFQILDDCLDIDLAGLDQTKVRNLKLDGTQDELLYRELLLAQCHALHKAMPFLFEAVDDETELLLPENLTKTDSLIHELVNEIPEEDWQSVEIIGWLYQFYISEKKDEVIGKVVKSEDIPAATQLFTPNWIVKYMVQNSLGAQWLATYPESPLKAQMEYYITPAQQTDEVNAQLKAITPSALNPEELTLIDPACGSGHILVEAYDLFKAIYLERGYRQRDIAQLILEKNLFGLDIDQRAAQLTGFALMMKGRDDDRRLFEQDIKLNVMAMVDSTGFDVDALVGGVNLAQYGLEVNDLIELKNLFEHATTFGSLIQVPSGLKEKLPALKQLSESNSDDLFVKESLENLQVLVKQAELLAQQYDSVVANPPYMGGKGMNTQLRDFAKNNYSNSKSDLFAMFIERNLDLAAGGGAVAMITMQSWMFLSSYESLRSRILNQHTILSMAHLGARAFDSIGGEVVSTTAFVLGNVHKPDYQGAYMRLVDGNSEAEKMEMMAKAIVQGRTV

SEQ ID NO: 3052 - protein, 1208 aa, Faecalibacterium prausnitzii
MNKAAIKNFAIWARNKLIADVSYDARLIGITEDGIAKPLPQSFGGTQFFDIGTAEPYSISGEAVRQRDKLIEVIQQKEKDTDYKTAYQYVIEEVAYTWFNRLIAIRFMEVNDYLPSHIRVLSSESGKLEPDLVTTPFDAELPFTAEEEAQIFQLKQDNKLDEVFRILFLKQCNALNEILPALFEKTKNYTELLLSLSVIDQDGVVYHLIHDIPEDDFNIERGGQVEIIGWLYQYYNTEPKAAAFAKSGKITKEEIPAVTQLFTPDWIVRYMVENSLGRLWVEGHPECDLKENWKYYLEEAQQEPEVQVKLAEIRKEYAALNPEDIKLIDPCMGSGHILVYAFDVLMQIYESAGYSQRDAAKSILEHNIYGLDIDDRAYQLAYFAVMMKARQYNRRILNGENTCHVYAIQESNSINRAHLKYFGAGMDDIEKNAAKMQLEGLLDTLTDAKEYGSILNVESYNWDLLRRFVAAEDTDGQISMDSVGVEDTAEQLNRLIDIGETMARKYWVTCTNPPYAGTSKLDKRVNAFLKDNYVDSKADLYAVFIEHCKEMIVANGFQAMITQHSWMFLATFEKLRKKMLQMDIVNMAHLGARAFEEIGGEVVQTVAFVQRESYVPEYNGSYCRLISATTPKGKEELFIKKDTLYTANQADFKNIAGSPIAYWTSSHVFKLFSEDCLRSHIDARNGMSTTDNNRFLRFWPECSFEKNGFSSKSAEQAKVSQKKWFPYNKGGEFRRWYGNNSYVVNWFNDGEEMKKCVTENYGSYSKELRSEDKYFAEGISWSALSSGNISMRYSEPGYIFDSKGSKAFMRDETNVFLILSYLNSCVAQHFLGILSPTLDYNNGNIEKLPYISTKNDDVIIDLGIDAEEQSKADWDSFEVSWDFKKHPLLRNVSTIYEAFTLWQSECEDRFNQLKTNEEELNRIFIDIYGLQDELTPEVEDKDVTVRKADLQRDIKSLLSYAVGCMFGRYSLDVEGLAYAGGEWDSSKYQSYIPDEDNVIPITDEEYLDDDIVSRLCAWLKAVYGADTLEENLDYIAKALGNKGSTSREIIRNYFLNDFFKDHCQTYSVTGSGKRPIYWLFDSGKQNGFKALVYLHRYTPDTIGNLRIDYLHKMQRVYESEINRMQDMMDHSGNAREVAAASKRKDKLAKQLKECREYDEKISHLALSRIELDLDDGVKVNYRKLQTAQDGKFYEVLADSKNIMVKEKK

SEQ ID NO: 3053 - protein, 1195 aa, Fulvimarina pelagi
MSVDLSRLKSYAPQARKDFMKAVTERAARIGITANGIVEAERRGDVVVIGGAAYDKTFGKQRDALVSKVKIEGFDQVIEGIAYTWFNRLVALRFMELHEYLDHGFQIVGPGKAGGPLPEALVNAELLNLPRLPVEHVREMKITGDYEEKLYRAILIAQCNALSETMGFMFEKIGDATELLLPDNLLATDGLVRKLVQNSDAESWQNVEVIGWLYQFYISEKKDDVFKALKKNVKISAANIPAATQLFTPHWIVRYLIENSLGRLWLLNNPSSKLAEKMDYYIAPQEPETDFLKIGSPEEIKICDPACGSGHMLTYAFDLLYSIYEEAGYRSRDIAACILEKNLQGIEIDGRAGALSAFCLVMKARAQDPRFFKRRVAPRICILEDVAFSETEKEDVIAVAGKDLFSCKFWETLSQFEQAKNFGSLIVPKLRNPVETLRVIEARDFESDLLLKEVQARVTTVLRMAEALSPKYHVVVANPPYMTLGNANSFLNKWTKSTFPNSSGDLFSAFIERGLMLALDCGYSAMITMQTWLFISSYKKLREIMISNSQFIGLINIGYNTFPEMNSKVALGAAFVINKSTSDIAGTYIDLNKAPQSVDKEGVFLKEKIGSENQYLRRMSVFQKIPGSPFAFWVTEPVYKAFNGEIIGEKFEVKGGMSTSDNDRFLRIWSEVSQIHCSLPLDKEPAENARWFPYNKGGGFRKWFGNWEYLVNWENEGSDIKHAVCNNPKDPDTTHWSRRIFNTEYFFQRGLTWGDVTTGPFSARLLERGAISDSVGIAAYRCQSETVEWAALAALNAKTLKFFTDILCPTIHFNSGPMSKIPLPEKDGWVSEGSKLAQTLTLLARSDWDAYETSWDFTTLPLLSSDYRSATLEDSYTTLRSHWQSMTDEMKALEEENNRIFIDAYGLQDEIDEKVLIEEITLTSNPAYRYGVKGTSEEREELLKRDTMRELISYAIGCIMGRYSLVEPGLAYANAGNIGFDPTKYGHFPADDDGIVPVADIEWFRDDAAARFFEFISQTFSGEKLGENLDFIADAIEPIRKLSATDTVRKYIARSFFKDHLKTYKNRPIYWLFSSGKERAFECLVYLHRYNEGTLGRMRAEYVIPLQTKMQNRIQTIGGEIGRGDLSSAQMKARTKELATLEAKKTELDRFEADLRHMAEERITLDLDDGVKVNYGKFGTLLAETKLVCGTKDAE

SEQ ID NO: 3054 - protein, 1224 aa, Escherichia coli; identical to SEQ ID NO: 2815

SEQ ID NO: 3055 - protein, 1276 aa, delta proteobacterium
METEAGQQLEGIYGWLPEGRFADPTRYPAVKQIPEAAETRRSLEAYAEEEKNTGLSPRDARIKLVRETAFTWLNRLVALRMMEERGIIKSTVGRLDKSNSFIYWLTADGNDEMYALHQKGALPLNAMGEGPSDVAYRQFLLWQCGQLAGDVSVLFDPENLSSRLFPRPSVLKKLMESMNKEDLAEAWRTGNEETIGWIYEGFIEEENKAVFEKFGKGKKVKADEIGAATQRFTPRWIVRFLVENSLGRLWMEMHPDSRLKEKLEYFVPTQAIERSAESAKDITFLDPSCGSMHFGLLAFDIFFEMYREELAKAGQPGWPDKPSVASIKEIPASIIDNNIYGIDIDFRAVQLSALTLFLKARSLNKKCTFSDNNLACANVKAITGGRLEEFIKQSQFSHPIYERILRVIAVRMKDSDQLGSLLRLEKDLEFLIGEERKKVDKNKQLQFPFPGLPRDQFETKEGVEEFFEILFEQLLRHLDFFVQSSRATGVDPGHFAAEAAKGLRYLRLVSRQYDVVATNPPYLSRRNMSSFIAKHLDENYPNTKSDLYSAFIIRCLELAISVGKVAMVTQQSFMFIKAYEKMRKDLRKIAFVDSMAHLGPKAFPNITGEKVNTTAFILCKETSKQKRLEHQGIYFRLVRERDSQAKWRRFEEAVACLSCGKHSPIVFSYRQIDFDPIPSTPWVYWITEGIRTLFLNRPKFASFAKPWVGLQTSDNVRFLRFWWESGINQIAFVSSVKDAVESGKRWIPHMKGGEHCRWYGNQEFIVNWFDNGMEMKTYAEELKQRVKSPPGNGPLRDFPYYFLPGVTWTHTTAKGLNARYMPPGFICNVEGMACYPELEFGLVELSLAILNSKLACYITNQLNPTIHYGAREIGDLPSPSNLHAAAGMIRLSIQRAINLAKADSEENETTFDFIVPPDWPDGIQHVAERHASLSEIEQEINVEVFRFYNIDDRDRQAIETELFENIASLELDEAEETEQEGLRKNESMQPSWSCLDLSKMWISYAFGTVLGRYGIGQADGFGRGNFDGETAAAIRTLMDEDAVMVSEAGHPQDITARTLRCLELMRGKETAHALIREVAGSDGDPEELLRGFLDRFTGKPEVSFWRHHFQLYRKRPIFWPLQSPKRKFAVWVFQERFTTDTLFKVRSEFVDPKIRWLEARIREFKEKAEGSTGAEKRGAEKEVSQLSDILDDVQEFSKRLDAVIQGGYTPHIDDGVLLNAAPLWELLPSWPDTKKAWQELEKGKYDWAHQAMDHWPDRVREKCKTNKSFAIAHGLE

SEQ ID NO: 3056 - protein, 1210 aa, Enterococcus faecium; identical to SEQ ID NO: 2960

SEQ ID NO: 3057 - protein, 1171 aa, Lactobacillus johnsonii
MDKNKIKKFAINARKSLRDTTEVQLANLGITDEKINDELSISTKDKKYYVDDNENNALTGKQIGWRKDVVNELKNRGYDDDPKTVFDDFIEEVAYTWFNRIIAIRFMEVNNYLPSRVSVLTSEEGKAEPDIINEAMEIEDDLGGYSDSEKELISTALTERTPELMDKLYAMLFIKQCDALSDILSGLFEKTNDYLKLLFTPNYNRGVIQDLINEIPASYFDVNEEGQVQIIGWLYQYYNNEPHEKVVNMNGKAIKKDEIPAATQLFTPDWIVRYMVDNSLGKYYLERHENSQLKDELKYLLPSKIESVNNDQDISEYKFLDNAMGSGHILIYAFDLLMKMYLEEGYSKRDAAQKIIENNIFGLEIDKRAFQLAYFALMMKGREYDRRFFRRNVANNLYYFEDLHVSEDFYNFIDNEKTKEDLKKLAEVFADATELGSIIKIDQDIDTNNLKSTIKKIDFDDSLDVFGNKRTKDKILKILSIVRIMTNKYETVVTNPPYMNKFDKKLKKYLRNNYKDYSKDLFSVFIYHNMHLLRDGGYSGYMTPLVWMFIKSYEPLRKDIIDNVNINSLIQMEYSAFEEATVPINTFILKKADEKSGTYLRLSNFKGGMAVQEQKVLEAIANPEVKYLYRAAQDNFDKIPGSPIAYWAIQSLYEDFKIGKKFNGETKKGVLTGNNKLYLRLWYEVLHSKLSCNMESYKDMINSNFKWFPVTSGGQKRKWFGNFDTVVNLENGGEDIKENVKNYRLREPKYYFKEALTWTEVTSGIFNCRYVPTGILFGNGGPVAFINNNDLYYYLGLLNSKVAMAVLSFIAPTINFGPEQIKKIPILYCTKITVVNNIVKNNISIAKQDWDAFETSWDFKRSPLLVNKAATLEQAYNNWSQEALDRFNQLKANEEELNRIFIDLYGLQDELTPEEDDKEVSVRKADQVRDIKAFLSYFIGCIFGRYSLDQDGLAYAGGDWNASLYSTFKPNKENIILLTDRQYFDDERDIIVRLREFLSTTFDPDRLTDNVNFIAQTLDPKKFERGVSSEQIIRDYFANDFYKDHAKIYQKRPIYWEFNSGRNKGFKALMYLHRYTPEQLAMVRQYLHDLQPAMNDLIEIDNDLLDQETTASAKSKYRKIISTLNKQMNELVKYDQVLDHLSQSPVDLDLDDGVLANHDKLQQGEKLLTNL

SEQ ID NO: 3058 - protein, 1222 aa, Thiothrix nivea
MNTGKIKIYAPAARRAFIAAVTQRLNLFGISADKQGKLRVEPATVTGSVLQIGGQSFDAGLARPRERLVARAQAQGMTFLVEQVAYTWFNRLCAIRFMELQGYLEHGFRVLSHPEQAKGFQVLDHVPEVAAALGLDVEHLVGLKLAGNQDEALFRAMLLGQCHALHQAMPFLFEALDDDTELLLPDNLTRTDSLLRPLVDNIPEDDWQQVEIIGWLYQFYIAERKDEVIGKVVKSADIPAATQLFTPNWIVQYLVQNSIGRQWLQTYPASSLKARMPYYIEPAQQTAEVAAQLAALTPESLDPEQLKVLDPACGSGHILVEAYQVLKAIYEERGYRSREIPQLILEKNLFGLDIDDRAAQLAGFALMMLARADDRRIFTRQVRLNVLAMQASLLSSAASSPPSPALPPQGGQGAGADLPGLWRALNLRGDWQKGTSADLFGGGQMQLADAANDPVYQLLLTLVGLFREAKTFGSLIDVPARLLPELQALQTLLEELAERGDTMQQPAARTLLPLVRQAIILAQRYDAVVANPPYMGSKGMNADLKTFAGKHYPNSKADLFAMFMERAFELLKANGYNAQVNMQSWMFLSSYEKLRESLLDTRTFITMAHLGARAFGQISGEVVQTTAWVLATSHLANYQPVFFRLIEGNEEEKQHALLARENRHSHTKQTDFNKIPGSPIAYWIRDNVINVFQSTQLLGNESDVRQGLATADDDRFLRYWSEVGYKKIEFYSGQGSKWCPFTKGGAFRKWYGNNEYIVNWQDNGFELKAFERSVIRNEYTYFEEGLTWTLISSGSTAFRFVPKGSVYGHKGPCIQSKKNHQILLLLNSCVSKYILNIFSSGLGFEVGHLNKFPVILRDNQFYSDLIKVAKEDWDSFETSWDFAENPLLAAKRESVKLAFDAWQAANKAAVTEMQQLEEENNRLFIDAYGLQDELTPDVPLEQITLTVNPRYRYGGNASDAELAQRFQSDTCAELLSYAIGCMMGRYRTDRPGLVYAHAGNADFQKIYGEGGSFPPDDDGIIPITDQEWFADDATNRFREFVRVVWGETRVQENLDFVAMSLTQYALKPKRDESSLDTIRRYLATQFYKDHLRTYKKRPIYWLFSSGKQKAFECLVYLHRYHEGTLARMRTEYVTPLLGKYSHYAAQLEQQADSADSTAEKNRLKKELVELEKRRAELRAFDDQLKHYADRRIKLDLDDGVKVNYGKFGELLAEVKAVTGGKE

SEQ ID NO: 3059 - protein, 1204 aa, Escherichia coli; identical to SEQ ID NO: 2986

SEQ ID NO: 3060 - protein, 1160 aa, Brevibacterium mcbrellneri
METTPLKSFATWARRELITQVSARLTAVLAPGSPERVENQRAVTMLERDITAAGGGAKGKDAIADRVAYTWFNRIIALRFMDANGYTGVGVVSPAHGQQTGQPEILADAKRGSIDPAVVSNKRTVDTITGLLDGTRPSADAQGEAYTLLLAEYCRFWNRSMPFMFEREGDYTELLIPANLLAADSILARAAAVLSEEVCRDVEVIGWLYQFYIAERKDEVFAGFKKGNKAGAAEIPAATQLFTPHWIVRYLVENSVGRLWMLNHPESRLIDQMDYYIAPVDEETDFLKIADPEELTVIDPACGSGHMLTYAFDLLYAIYEEEGYAPSEIPGLILAQNLYGTEIDPRAGSLAAFALTMKARAKQRTFLTKGLAPAITVIDSISFTPDELDLLVTRNGDLRAEEGVWNQFAEANVLGALILSDLGQTQRLSHRLETLDEANDLVWSATLNRASKVLRQATALSRRYAVVVANPPYMGSKNMGATLADFASGKFPDSKSDLFAMFIERGFEFLKPGGLSAMVTMQSWMFLKSYAGLRKQLLNDRHLECMVHMGNGVMGIAFGTAAAIWRSTPGEGVSSFSFVSTLDLYGDKPRVFPVPNSRHTEMSLRELSSIPGSPIAYWASSALRATFQTGRTIESVAPVRQGFQTGDNDRFMRFWHEVSRTRIAFDSESTEEFHACGARFAPYLKGGPLRKWFGNDEYIVAFSPHDFSELSKLGNKLPSRNLYFKDSITWSAMSSSDFGARYAGVGSTFSAKGACAFPVDRYSRSLTLAVLNSSVARQLLEFMGATMDFNVGSLREIPLPAEIPLDDRDRISSLVELLVHLHQQDWNLSESAPGYEENALIKRGGVGRLASLVDGHFADWRAYSAQVNEAQEALDAIIAKSYGLEPSGELNVTLNNLVVGTQGRAERNVQLRDMIADLVSFAVGCMFGRYSLDETGLVLADQGATVQDYFAKVPQPRFTPDADNVLPIVDGDWFEDDIVARLRQFLRVAFGEQYFEENLRFVEESLGVKTLREYFITRAGRSKFYDDHVKRYKKRPIYWLFSSPKGSFNALIYMHRYTPSTVSTVLNEYLREFESKLEANLQHQERLAAGEGTPREKAAALKEAERLRKVLVELSEYEHDVLYPLASQQIAIDLDDGVKANYPKFYPALKKIAGLEATDA

SEQ ID NO: 3061 - protein, 1188 aa, Escherichia coli
MNTNNIKKYAPQARNDFRDAVIQKLTTLGIAADKKGNLQIAEAETIGETVRYGQFDYPLSTLPRRERLVKRARELGFEVLVEHCAYTWFNRLCAIRYMELHGYLDHGFRMLSHPETPAAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQQLNFHQQVQTGSMGDMFAENTALTQTDSAEYQLLMRTLKRFVNAKTLGSLIQVPQEEEAELKVFLDALYRLEQKGDFQQKAAAKAFIPFIQQAWILAQRYDAVVANPPYMGGKGMNGELKEFAKNNFPDSKADLFAMFMQHAFSLLKENGFNAQVNMQSWMFLSSYEALRGWLLNNKTFITMAHLGARAFGQISGEVVQTTVWVVNNNHTEFYRPVFFRLINGSEEEKKSALISRKNMFNHTLQNDFKKIPGEPIAYWVSDIYRDIFTQSPALSSIAKPRQGLATSDNNRFLKLWYEPSLRKINFSAKDRADALNSQAKWFPCQKGGSYRKWFGNHEYLVNWENDGRELLDFAASLYGSPTRTIKNIPFYFREGATWSTISSSDFSIRYSPTGFISETKGAVCFADDKDILLSILGFGNSKLVNYFLKSLSPTLDYHEGPIGKLPFKGKLKAQVLENVVNLIAISEEDWNTEETSWGFKKHPITKLDNLNYLQASFEAFKNDVQETIIRTQQLEEFNNKEIIREYGLESELNYKVSLEEITLTVNPDYKYSGTTDDKSKRMQSDSLSSLLSYAIGCMMGRYSLDREGLVYAHEGNKGFADLVAEGAYKTFPADSDGILPLMDDEWFDDDVTSRVKEFVRTVWGEEHLQENLEFIAESLCLYAIKPKKGESALETIRRYLSTQFWKDHLKMYKKRPIYWLFSSGKEKAFECLVYLHRYNDATLSRMRTEYVVPLLARYQANIDRLNDQLDEASGGEATRLKRERDSLIKNSANCAAMTTACVTMLI

SEQ ID NO: 3062 - protein, 1159 aa, Geobacillus thermoglucosidans
MNKTELKNFAIFARRNLLEKVTLRAKLFGIDEKNGLEMREEFGQLYVNGHPYELKMKSAFQSLAKQLEVKGYKQLIEEVAYTWFNRIIAIRYMEVNDYLPERVNVLSSSTGKTEPDILSQFETMDLDIDVTEIKDLINQGETEKAYRKLFIAQCNALHKILPFLFEKINDYTELLLPDFLLDSESVIKKLVNNEALTESFQEVEVIGWLYQFYNTELKDQVFANLKKNKKIEKYDIPAATQLFTPKWIVQYMVENSLGQLWLEANPDSPLKQSMRYYIELAEQDEEVKQKLEEIRYKNVNLEEIKIIDPCVGSGHILVYAFDLLYQMYEEAGYPSSDIPQLILEKNLFGLDIDDRAAQLASFALMMKAREKSRRIFRKKVKLNIYAIQESNHLDKEGIAQLLGQNEEEKEEIRSVIDTFIDAKNFGSILQPPKIDYKKYLNRLEELGEAQLTSETFEAYEQIPAFRYLLKTARVLSSQYDIAITNPPYMGSKGMNKKLGDYLRKYFPDSKTDLFAVFMERLSLFILTKGFNATINQHSWMFLGSFEKLRRKVLTNTTIFSMLHLGPRAFEEIGGEVVQSTSFILRKPKLRNFRATYYRLVDYNSPESKELAFKNRQNVYSQNQEIFLDLPGFPIAYWSSNKVIEIFKNYNKISEVAEPKQGLATGENDKFLRIWHEVSIQKIGFNFSNAQEANNSKKIWFPCNKGGKFRRWYGNNIYIINWARNGEEIKKHRGSVIRNESYYFKEGMTWSTISTSSLSMRLSEEGFIFETKGSMCFPRNYSNLKYLLGYFNTKLVNHFLNILSPTIDYHEGPLGKIPVKLVENNQIEQLVDKCVFISKKDWDSFETSWDFERHPLLTYREGSTLLSDAFNNWTTHTETQFTKLKANEEELNRIFIELYGLQDELTPEVPDEEITIRKADRVRDAKSFLSYFIGCVMGRYSLDVDGLAYAGGDWDESKYKTFKPNKYGLMLLTDEHYFEDDVIARLCEFLSVTFGAETVEENLQWLAESLELKRNETAEERLRRYFLDEFFKDHCQVYQKRPIYWLVDSGKQKGLRTLIYMHRYRPDTMATIRFNHLQEIQTKYHNEINAIELRMVNPNLSATEKRELEKRKTAYQKRLEELLEFDKKLAEYANAQIDIDLDDGVKVNYEKFKGVLAPIK

SEQ ID NO: 3063 - protein, 1246 aa, Vibrio cholerae; identical to SEQ ID NO: 2910

SEQ ID NO: 3064 - protein, 1210 aa, Enterococcus faecium; identical to SEQ ID NO: 3021

SEQ ID NO: 3065 - protein, 1210 aa, Enterococcus faecium; identical to SEQ ID NO: 3021

SEQ ID NO: 3066 - protein, 1208 aa, Vibrio cholerae; identical to SEQ ID NO: 2909

SEQ ID NO: 3067 - protein, 1163 aa, Sporosarcina newyorkensis
MNKSALKKFATEARKELLKRVELQARKLGITAESIQKANVESSDAVFIDGKQLLDTERRQRNKLIARINEIGFDRVIDETAYTWFNRFIALRYMEVNDYLPTKVRVLSSNSGSAEPDMMKEALSLDLDLDKEKVYEMKMNNETDELFKYLIKIHCNDLNRYMPFMFETIEDYTAILFPEGLLGTDSFVRQMTDTEIIPEDNWTKVEIIGWLYQYYISEENERVIKAKKRYKAEELPFATQLFTPEWIVRYMVQNALGRYWIESHPEHRDLIQNWEFYLENPNPEADFEKKLAPYINKELNVEDIKCFDPAMGSGHILVYMFDVLHEIYSKCGYMEREIPRLIIEKNLYGLDIDDRAYQLASFSVVMKALQYNKRFLRSVERDGLTMNLASIQETNMLSDEEVAFLAGESSGEQFDKMKEFIDQFKHAKAIGSLIKIESYNAEFLQQRLKTIEQQSGNLFELDMKDRTLALFRNLIKQATLMDLKYDVFITNPPYAGNSYVTTEVSTYLTKEYPDVKSDLFSSFIEYSFHATKESGQMGFMTPFVWMFISSYEMLRQKIINDRSISSLIQLEYSGFDGATVPICTFTLRNYQSSIEGEYVRLSDFRGAENQPTKTLEAVQNPSVPYRYSFDQENFSKLPGNPIAYWYSKQKVKAFYDSGRLDDFGETGKGIGTGNNDRFLKLWYEVEANKFLLLNKQPDSNSKWFPYNKGGEFRKWYGNNEFVINWENDGEELKKFPNSYLRNQKDYFKSGLTWTKVTSSKFSLRYFGDGFLFDDGGCCFFANDPKMHFYILGLLNSKVFNLIGEINPTLNFQPGDIAKAPILISNESTQREVMNIVNENIQISKEDWDNFETSWDYQKHPLLISAKDTLTIEIAFKLWDECAKNQFYQLKKNEERLNLIFNELYNLQDEQSPEVLDRDVTVRKANLERDIKGFISYVIGCSFGRYSLDEEGIIYAGGDFDSSRYQTFSADEDNILPILQGAYFEDDIVTRFIDFVRITFSEETLEENLDFVADAIGRRKNETAREALRRYFLNDFYKDHVQVYKKRPIYWLFTSGKEKAFNCLIYMHRYDKTTLSRIRTDYLHEVQTRLDAEKNNLLEIINGDSTAREINSAKRELKSLDKKIDELKAYDELLHHMADMQIEIDLDDGVKVNYEKFKGLVAKI

SEQ ID NO: 3068 - protein, 1246 aa, Vibrio cholerae; identical to SEQ ID NO: 2910

SEQ ID NO: 3069 - protein, 1246 aa, Vibrio cholerae; identical to SEQ ID NO: 2910

SEQ ID NO: 3070 - protein, 1246 aa, Vibrio cholerae; identical to SEQ ID NO: 2910

SEQ ID NO: 3071 - protein, 1246 aa, Vibrio cholerae; identical to SEQ ID NO: 2910

SEQ ID NO: 3072 - protein, 1218 aa, Desulfotomaculum gibsoniae
MNKTAVKNFAIWARNKLIAEITYKAGLLGITDSEVKSPLPQSTQVVQFFDIGTREPYSITGVEIEQRKKLAEIIQRKAGQTDYKTAFQNVVEEVAYTWFNRLIAVRFTEVNDYLPTHVRVLSSESSNKVEPDLITNPMDAELDYTPYEKDRIMQLKSDNQLDELFRMLFIKQCNALNAILPELFEKTHDYTELLLNVSFTDQDGVVYHLVHDIAEDDFNVAKEGQVEIIGWLYQYYNTEPKEETFALLKKNVKITKERIPTATQLFTPDWIVRYMVENSLGRLWLERERASSGLSDEYLNGSYFGWKYYLEEAEQEPEVEAQLSQIREEYKSIKPEDIKIVDPCMGSGHILVYAFEVLMQIYESYGYSRRDAAKSIIENNLYGLDIDDRAYQLAYFAVMMKARQYHRRILNGETKCHVYSIQESNGINRGHLQYFGAGMSDIEKDSALTQIQHLLDTMTDAKEYGSFLNIENLDWTLLNTFVGSRNVNDQLTFDTVGLNDTQSQLCQLVEIAAVMANKYDVVVTNPPYMGSSSMGAKLSDFVKREYPDSKSDLFAVFIQRCGQITKKNCYQAMITQHAWMFLSSFEKLREKILRKNIVNMVHLGARAFEEIGGEVVQTTSFVFRNSHLKKYQGSYVRLVDYSSQKEKESAFIDKHNLHTANQENFSKISRMPIAYWVSDNIIGTFEYKDIPKIAEGRMGLTTGNNDYYLRLWYEVSSRDIGFNHTRSQAKQSCLKWFPYNKGGSSRKWYGNREYVVNWLADGNELQTKMHPDGKRIWAHNFNLEYIFKKHISWSDISSGSISFRAYEEGFLFDSSGAAAFVDDSQYYSLLGYLNTNIVDNLARILNPTFHFKLGDFINLPYKIIKNINVDNLVKQNIQLSACDWDSFETSWDFVTHPLIAYKIVAGYAEAPMEKSKYKIKDAFASWESSAEALFNQLKKNEEELNRIFIEIYGLQDELTPEVEDKDVTIRKADLVRDIRSFISYAIGCMFGRYSLDVNGLAYAGGEWDDSKYSTFIPDKDNILPITDGEYFEDDIVGLFCTFLKKTFGTETLEENLDFIAKALGNSGNTSRDVISNYFLKDFFKDHCKIYQKRPIYWLFDSGKADGFKALVYLHRYNEDTIGKLRIDYLHRMQRIYESEIAGMQETIENSPNAREVSAATKRKEKLVKQLKETKEYDEKIAHLALARIAIDLDDGVKVNYEKVQTGTDGQKLNVLAKI

SEQ ID NO: 3073 - protein, 1246 aa, Vibrio cholerae; identical to SEQ ID NO: 2910

SEQ ID NO: 3074 - protein, 1210 aa, Enterococcus faecium; identical to SEQ ID NO: 3021

SEQ ID NO: 3075 - protein, 1236 aa, Vibrio shilonii
MNTNKLKTYAPKARLAFMDAVKKRAAVLGIYENKISEATTQGTDTLIEGRIFTRKQGQQRQQLVKRIEALGGGKDGYNQFINEMAFTWFNRFTAIRFMEVNGYLDHGFRMLSKEEGSEFGQGFEILAHAADVAEDLGLNKSDIVEMLLAGDKEEELYRELLLAQCHQLSKIMPFMFEKLDDATELLLPDNLTKTDSILKELVNDVPEDNWREIEVIGWLYQFYISEHKDAVIGKVVKKEDIPAATQLFTPNWIVKYLVQNSLGRQWLATYPDSELKDKMEYFITPAEQSDEVIEQLKAITPTSIDPEQIKVLDPACGSGHILVEVYEVLREIYLERGYRLREIPELILTKNIYGLDIDDRAAQMAAFAVLMKAREDDRRIFSRVDDNRIQLNIHSIQSTEHLDINKLWQDLDLDENKQAGSMNDLFAEPQLEIAEPSTENKKYLELLRYLKQKFIDAKNLGSLIEIDSQRYDTLSKLKTKLEEKEKDSNPTVRETSETLLPIINQSLTLSTKYDVAVANPPYMGSKGMNSVLKDFAKKNYPNSKSDLFALFIERGFKWLKQQGYNSMVTMQSWMFLSSFEKMRQGLLKNSTIETMVHMGNGVMKIAFGTNATIFRNSHINGYISSFSYCENEDINEHGVPFDFPVQNNRLKNTPSDEFQKIPGNPIAYWIEESVFKLVKNSQTLGNIALARMGLATGNNAKYVRLWHEISHDNFGIGLESRQDSQKSQLRWFPYSKGGSYRKWYGNNEHVVDWFDDGKQLQTTMHPDGKRIWAHNFNLDTIFQDSITWSDITSGNLSVRYNDCGFLFDGAGTSAFFQSQEHKISVIGYLNTHFANGFSKVLNPTMHFQTGDFRNMPVPEIIHCKEWKETALKLIDIHKADWDSKETSWGFTSNELIKHRNKKTEYSFTSLVEYRENVVSNAFKLEKWLNDSLSSSIGLSEPVLDSAILSSITLFANPSHCYANDKTATEQINLVQSSTISELLSYSIGCMMGRYSLDREGLVYAHSGNKGFKELVADGAYKTFPADDDGIIPLSVEEWLFEDDATSRFRDFVKTVWGEEHLQENLDFVAESLCLDAIKPKKNESSMETIRRYFSTQFYKDHLKTYKKRPIYWLFSSGKEKAFECLVYLHRYNESTLARMRTEYVTPLMGKLETQHSVLTESRTNASSTEQRRIDKELKSIEKKQSELRAFDEELKHLAEMKISIDLDDGVKVNYGKFGNLLADVKAIHGKNPEELK

SEQ ID NO: 3076 - protein, 1130 aa, Brachybacterium paraconglomeratum
MDTAPLKSFATSARTELIREVSARITAVLAQGSPERVEQLRAVTALERVIAAGGGGDKGRAHVADKVAYTWFNRIIALRFMDANGHTGLGVVSPATDQVGQPEVLAAAKRGQIDGDVVKGASAATIAGLLDGTRQPRPGVDAQAEAYALLLADYCRYWNKAMPFMFEREGDYTELLIPANLLAEGSVLNRSVKVLTEEVCQDVEVIGWLYQFYISERKDEVFAGFRKNKKAGADEIPAATQLFTPHWIVRYLVENSVGRLWMLNHPESRLIDQMDYYIAPVDEETDFLKITTPEDLTVIDPACGSGHMLTYAFDLLFAIYEEEGYTPSQIPSLILTNNLYGTEIDPRAGALAAFALTMKAAAKRKLFLKNPVEPAICVLEPISFSADELSYLVTRDGERYAEEVFWNQFAVADTFGSLIQPDPALTVRLADHLATLDAEGDILRADALDRAQEVVRQAKFLSPRYSALVANPPYMDARNMGGVLYDFVVEYFPEGFTGIDLAFVLRSRSLVQRKGFLGLLSMDSWLGNVECGEFRDVVRETLLPRTVLHLGPRAFPEIAGEVVQVSATVFQNAAPAAVKSTFIAATGGATTEAKVAQFRDPSRRYVHTLDWFDVFPGRVFTPYAASESAHSTFASAPTMSSIAEVRTGLQTGDNAGFLRQWFEVSYSSVHVDGFAGTSRWVPYVKSSSPTRWFAREDLVVDWRGDGDDIRAHPSSVVRNAAYYFRRGLSYGGLAGHLKARLVPAGAIFDQKNSMVFPVGATTTGQLLALMNSPAFEVLARLVSPKGFGVGTLARLPIPKEALAAPRIEAIAERAAELSRTGFDRSETSRGFVGLDSIFMGAERHSSLRVGVEAIQETDTRIKSELRNIEAENARIFQAALLAVPEEPPAEVRAAPPYPGASIAQDLASYAVGCMFGRYSLDESGLILADQGVTLQDYLARVPTPTFMPDADNVIPIVDGDWFEDDIVERFRQFLRAAFGEQHFEENLRFVTKSLGVKNLRDYFVKSFYKDHVQRYKKRPIYWLFSSPKGSFNALIYMHRYTPSTVSTVLTYLREYVTKLESALQQAERAGNAKEADRLRKILVELNEYEHDTLFPKASENVVIDLDDGVKANYPKFGAALKKIPGLGGGE

SEQ ID NO: 3077 - protein, 1225 aa, Salmonella enterica; identical to SEQ ID NO: 2876

SEQ ID NO: 3078 - protein, 1219 aa, Eubacterium cellulosolvens
MDKTAIRNFAIEARKILMKSAITEAGFYGITEDGCKDPVQKGNDFEVYETVAGTENRIFGDDIKRRANLVQAIRDLGFEQVIEETAYTWFNRIIAIRFMEVNNYLPTRVRVLSSETGSGTPDIITQADTVELNLTSDELEKIQTAKRENRYDDAFRMLFIKQCNELNAILPGLFEQTDDYMELLLKITYTSDGVIRMLVDSIPEDDFNVETEGQVEIIGWMYQYYNTELKDDTFAKLKKNIKITKERIPAATQLFTPDWIVRYMVENSLGRVWIEHLRAVNPSVDEKAKAEEFGWKYYLPEAEQEDDVQAQLVEIRKTYKDLTPQDITCIDPCMGSGHILVYMFDVLMDIYRSEGFSEREAVFDILEKNIRGLDIDRRAYQLSYFALMMKARGYNRIFFRGHEDTNGNRVQAVPQVYAIEESNFVDREQLKYFGAGLDELSKNNAFNQLNGLIDSLKDAKEYGSILNIENYDWNLLRTYVAGINEEGQSSLFGYMAYQSSALLKRLISVGEVLACRYDSVVTNPPYMGSNGMDKSLTDYLVSNYPETKYDLSTVMMERSLKYAKHGGYISMINIPVWMFLSSYEKLRKRLLNDCTFANMAHFGRGVFGSDFGTTSFVIRNLKQDNYCGYYKKLYKRQGAVDSLDEKLEMFFDEQLNYYTKQEDFYLIPGYPIAYWVKNKELFTVGEPLEIIANPRQGLKTLDNERFLKNWYEVDFTKVGFDFSSLEEAKASKKKWFPINHGGEYHKYYGNNCILVNWENDGEEMKKLAIDKYNSITRTITNMGSYFKEGITWTVISSASTSFRRYYKGFIFSNSGQSIVPETPELLDYLTGLLNTKIIQYILAVLSPTLGFESGYLKKIAIRVDDNYKQEVETLTREAIQISKEDWDSFETSWDFKKHPFIQYKTTGLIKDAFENWREVTNQRYRRMKDIQQRLNEIFIDIYGLSDELTPEIDERDITLSMADKKEDAESFVSYLVGCIFGRYSVDTDGIAYAGGEWETDGYKTISVDMDNIIPITDEEYLEDDIVNRICSAIADIYGEENLDANIAFIADSLDVSGANPKDKLRHYFQGNFFKKHCSTYSFGSSGRKPIYWMFDAGKQNSFKCLIYLHRYEEDTVGLIRSDYLSKVQNAIENALKNAEYAINTSGSAVDRAQATKKRDKYIKQLAEIRAYYPALSHIALQRIGLNLDDGVKANYAKFQGIEVSVEGEKKQKVDLLAKI

SEQ ID NO: 3079 - protein, 1222 aa, Pseudoalteromonas luteoviolacea
MNTKNLKAYAPKARREFIAAVKKRAAQFGIYEDRIEEVRIEGGAAIIEGRAFTRKEGEQRKRLESKVLVRGYDMFIREMAYTWFNRLAAIRYMELHDYFDHGFRVLSNPSNPDGLPEILSHASDVADSLALDKSHIIELQLAGDKEEELYRELLLGQCHHLHKIMPFMFEALDDATELLLPNNLTKTDSILKGFINDIPEEDWQEIEVIGWLYQFYISEHKDAVIGKVVKSEDIPAATQLFTPNWIVKYLVQNSVGRQWLATYPDSELKGKMEYYIEPAEQSDEVIEQLKAITPTSIDPEEIKVLDPAAGSGHILVEVYEVLREIYLERGYRLREIPELILTKNIYGLDIDDRAAQLAGFALMMKAREDDRRIFQRVEDGEVSLNVFSLQSTEGLDINTIWKGLDLEGNQQIGSTGGLFDELSVAPDDLIPANAGIYKEYFELLQMLKTAFLQAKTLGSLIQIDAKHLDNLFSLKQLLLEKLANSDTQSKPEVEKTLPIVNQAIVLAQKYDAVCANPPYMGSKYQTPIVKQYLKDNFKGYEKDLFSAFIIRNLQLAKNNGELGFMTPFTWMFIAAFESLRNHLINKEIISSLIQLEYSGFEGATVPICAFTLTRSNIEDYRGSYIKLSDFKGANNQAPKVLEAIDEPDCGWLYSVNQKSFNVIPSSPIAYWASTDLLKMFEEIKVENFSVAESSQNLTGNNERFLRFSWEVNSNTIGIEKKWLFYAKGGGFRRWFGNLDNVINWSDEARSFYKKEKVPRIIPEYLWYKPGVTWGFITSSIPSFRLLPKAATFDVGGSSIFFKDDNNINFFLGLFNSKVTLDIVGIYNPTLNYQLKDIRNLPVPALSPELKDEISMLVQHCIDISEKDWSRLETSNSFKSIEFDSTHGLLKQNYLKLEGKWQEEVSRLKEFETKLNKIFISSYGLCDEINYKVENKRISLSINPDYQYGGGSSENRFRLKSDKSVQLLSYSIGCMMGRYSLDHEGLVYAHSGNDGFKDLETKGAYKTFPADDDGIIPLASEEWLFDDDATTRFKDFVKTVWGDEHLSENLEFVAESLCLHALKPLSTKKGGGESAMDTIRRYFSSQFFKDHCKTYKKRPIYWLFSSGKEKAFECLVYLHRYNEGTLSRMRTEYVTPLMGKYDAQLARLSDDMVNATGSEARRIEKDIKALEKKQAELRTFDEQLKHYAEKRITLDLDDGVKENYGKFSNLLADVKAIHGKAVK

SEQ ID NO: 3080 - protein, 1204 aa, Clostridium perfringens
MDKSKIKSFAIWARRRLIESVSDKASKIGIFENEIKDVVAVQGGFKIVGSEEILPLSKEHRDALVSQIKDKGFEQVMEEVAYTWFNRFMGLRYMEVNEYLPSGIRILSSEVEGKSEPDVLSKVSEIIDELELNGEEMYSLLDSGKNEDREKAYRIILVKQCNELGKIIPQMFEKISDYTELLLPDNLLEEGSVIRRMVSDIEEEDWKEEVEIIGWMYQYYISEKKDEVFAGLKKNIKITKENIPAATQLFTPKWIVKYMVENSLGRLWLEGHPNEELKRHWKYYLEEAEQEPEVQEELNKIREEHSKLTPEDLKVLDPCMGSGHILVYAFDVLYEIYKTAGYSEREIPRKILQNNLYGLDIDDRAAQLASFALIMKARHYNRRLFREIQREELDLNLCSIQESNGIEKEAIEYFSNGNKELQEDVEYLVKVFTDAKEYGSILEVEKVNFEAVKERLKEIGQEDNLMFGDYRKILLEKLPTLVKQAEIMSRKYEICVTNPPYMGRKGMGKKLAEYLDFNYLEAKGDLYSALVLKLSKLTKLKYFYSAIVPQSIMFLSSFEEIRKNIYETSTINNMVHLGMGTFGADFGTTTYCIQKLNMKKYKGTYIRLSDFKNVDDKNSEFFNISHRYVISIGEIEHIAGKPIAYWVSKRMIGNFNQNSLSSYSKCCKGIDTGNNEKFLRYWYEINIKKAFLYNEKYCLSEISKWFPYNKGGATRRWYGNNEYVINWFDNGKEVIQYPKSNIRNINFQLKKGITWTTTSSSFFTARISEEGHLFDSKGCMSFPLDNNDINYILALMNSKPAYEFLKIITPTVDYNPGPVGKIPTIMQNEDSIYELTEYNIKISKNDWDSFETSWDFEKHPLLKYLNNSDDNKISSAFSKWEEECENNFNQLKSNEEELNRIFIDIYGLQDELTPDVEDKDVTIRKADRERDIRSFISYAIGCILGRYSIDADGLIYAGGDFKDKWDLENKKVRKIEKDEDGNIISDSWVDATFLPDRDNIIPITEDEYFEDDMVSRFVDFVRTVYGEDTLEENLDFISDSIGRKGNETSRATIRRYFLKDFYKDHLKVYQKRPIYWMFESGKNNGFKALVYMHRYDEQTVAKVRTDYLHTLQRKYEAEIERVKLTMDSSEATAKEKTDSKKKIDKIMKQIEECKEYDEVVAYLANEQINIDLDDGVKVNYAKFQGVKIINSKNKETKMNLLAKI

SEQ ID NO: 3081 - protein, 1210 aa, Enterococcus faecium; identical to SEQ ID NO: 3021

SEQ ID NO: 3082 - protein, 1208 aa, Vibrio cholerae; identical to SEQ ID NO: 2909

SEQ ID NO: 3083 - protein, 1224 aa, Escherichia coli; identical to SEQ ID NO: 2815

SEQ ID NO: 3084 - protein, 1246 aa, Vibrio cholerae; identical to SEQ ID NO: 2910

SEQ ID NO: 3085 - protein, 1246 aa, Vibrio cholerae; identical to SEQ ID NO: 2910

SEQ ID NO: 3086 - protein, 1223 aa, Fusobacterium ulcerans
MNKNSLKIFAIEARKELMRKMEVRLKILGINKNNLDIPVILGSQVEVKGNLYSKSSYNKLIEKYKELGYDELIEESAYIWFNRLIALAYMEANKYIDEKMVFSNGSKIEPAIIDEYLEANFFQKLEREEQKKIHELKDKNTLESLEKMYSILVEEKCEELSSIMPFIFSKKGGYSDILFPSGLLMDNSVLVKLRYEIEESKENGLVPIELIGWLYQYYNSEKKNEVFEGLKKNKKITKENIPAATQLFTPKWIVKYMVENSLGKLAIESLGVDSEIKKNWKYYIETEKDINVEKIKIEDIKILDPAMGSGHMLTYSFDILFEIYENLGWSKKDAVLSIMKNNILGLEIDERAAQLASFAIMMKAKEKFPRLFKVLEKLDGEEKFKLNILVIKESNNISTRTRKLIAENSLKNLAIMLDNFYDAKEYGSILKIEDIDTKKLEEEFKSLNEILKNQGQTSMFRGNDILDGNIDEDFKKIKGMIHQQKIMADKYEVVITNPPYMSSSGMDEKLKKYVEKNYKNSKSDMFSLFIEKCEEFTKENMYTSMITMHSWMFLSSFENLRKNIIENTEIQNLTHLGTRAFADIGGEVLQTVAWVSKNKMPEISGNYIRLVDYNSAEWKENEFFNPLNKYKAYQKDFEKIPGNRLGYWLSKKEVKIISSSETMETISYPATGMQTGNNSYYTRDWSEVSINNINFKPSGYDFRDKKWALYQMGGDSRKWYGNLDSLINWKDNGKEVKNEKSAVIRNEKFFFKKGFSWKRITSGVNTIRLLKPDFIFDQAADSVFLKQDKNFLYTMSFFNMKIMKRIFEFIAPTLNLTSGTVKEIPIYFTEDLEVFKKINCLTEKCINISKQEWDFRETSWDFEKLSLIDGENLESAYDSYCNYWRNQFVQMHKNEEELNRIFINIYELQDEMDEKVEFEDITLLKKEATIKKIVTNSIQIEEGFEEMEKTSEGYLFNRGVELEFNKEELVKQFLSYTIGCIMGRYSIDKPGLIIANSDDNLIIEGNKVVIKGTDGEIRHEIEESRFFADVYGIIPVTEEEVFENDIVKKVIEFVKILYGEKNLKKNLEFIAEALGKKKDETAEEVLRKYFIKDFYDDHLQRYKKRPIYWMLNSGKKNSFSCLVYLHRYEENTIARMRTDYLTPYQEIIENQRSYYEKIVIDGKTIPKDKKIAEKKLKELENNLKELREYANEVKHIAEQKIVLDLDDGVKVNYEKFGKILRKI

SEQ ID NO: 3087 - protein, 1161 aa, Roseobacter sp.
MDTNALKKFAQSARNLLIEQVRSKLDLLLDPASPARREHPQAMKELDAAIARDGKAQLIEQVAYTWFNRFTALRFMDANGYTTVGVVSPAEGQTRPEILAEAMAGNLPEDAPGSIAALLDGRTPSSDPQAEAYRLLLVHACNQWHGPMPFLFEELDDYTELLMPEDMLSQSSILAELRKVMTEDACQDVEIIGWLYQFYISEKKDQVFAGLKKNQKITAENIPAATQLFTPHWIVRYLVENSLGRLWLLNRPGSKLAERMDYYIAPEEPEMDFLKIAKPEEIKVCDPACGSGHMLTYAFDLLYAIYEEEGYDATEIPALILTHNLTGTEIDDRAGALAAFALAMKAAEKLGRRRFLRMETKPDICVLKKVSFEPAELQDIEAMVGRSLFTADLRATLTQFEQAKNFGSLIIPKLKDPQECLRVVEEQDLGGDMFRAKLRERLLTVLRMSEALSSKYHVVVANPPYMGGKGMNGPLGDYAKKEYPDSKSDMFAAFIERGFDFIQRNGYSAMVTMQSWMFLSSYEKLRIKLNEQSHIVNMAHMGNMVMGIAFGTSATVWKQGQNTSQPGNFFYVDYEDLSEEKIPVTFPPQNERNSKQRDRGWFYRASANDFEKIQGIPIAYWASARVRNVFAKNKNISEGFDARQGMATGDNDRFIRIWSEVSIGNFEEFSGSMESAFQSGSRWFPYNKGGDYRKWYGNRIFAINFNRADFEVLAKMGNHCPSRQFYFREAISWSRIGSSLNSYRYYDRGFLFDQAGHSIFHEDGSALENICLMLNSKMFSAVAKIVNPTLNLEVGNIGRFPDLSNTAKQNRHIFKDLIALSRSDWDAYETSWNFTSLPLLSSDHRGETLADSYATLSAHWQSMTDEMQRLEEENNRIFIDAYGLQDELTPEVPLNEITLTCNPAYRYGIKNDDAANETRLRADTMAEFLSYAVGCMFGRYSIDTPGLILANQGETLADYLARVPEPTFMLDEDNVIPVLDADWFADDITDRFRLFLRTTFGEAHFRENLRYIEDALGKDIRKYFTKDFYADHVKRYKKRPIYWMFSSPKGTFNALIYMHRYRPDTVSVLLNDYLREFISKLEGERGRLEKLSDDPSASQGQRTKALKDMAVIAKQIDELNEWERDVVFPLAQAKIEIDLDDGVKANYPKFGAALKKIVGVS

SEQ ID NO: 3088 - protein, 1224 aa, Escherichia coli; identical to SEQ ID NO: 2815

SEQ ID NO: 3089 - protein, 1173 aa, Paenibacillus elgii
MNKTALKNFAINARKELIEKIKAKAFKIGITEESIKKAQFESSDAIYIDGKQLSATERKQREKLITRIKEIGYKQVVEEVAYTWFNRFTALRFMEVNNYLPTKVRVLSSSNSDSPEPDIIKEALTVDLDIDKELVYELKLNNKTEELFKYLVIKQCNGLNKILSFMFETIDDYKEILFPDGLLAKDSFLREMTDVTIIPEADWEQVEIIGWLYQFYITEEKDRVFKAKEKYKSDEIPLATQLFTPRWIVQYMVQNTLGRFWIESHPENRDLIGGWRYYLESQEDKQENAVSKALRVEDIKCLDPAMGSGHILVYMFEVFYEVYCKSGYMEREIPKLIIENNLYGLDIDDRAYQLACFSIIMKAMQYNNRFLRVIEKEGLTINLASIQETYILHSKDVEYIAGEGSGINIEKTKEFIDQFKNAKTIGSLLKVTEYDSIFLKDRLEKIQKDPIDDIFMEESRVKADRLLPALLKQAEIMKMHYDIVVTNPPYMGNRYMNDELSSFLNREYPDSKSDTFASFMEIDHYLKPESFLSMINQHSWMFLSSFEQLRKKVIKKKTIYSMLHLGTRAFEEIGGEVVQTTAFVLRNSLDEKFKGQYVRLVEFQDSKEKMLKTRKAIENPSVNYRYIATMNEFDKIPGEPLAYWVSAKVKVLFSNGTKLSEVAVPKQGLATANNNRFLRQWNEVAFDKINFDAKNIEDAQSSGFKWFPYNKGGEFRKWFGNNYFIVNWENDGYEIKNFKDEKGKVRSRPQNTNYYFREGVTWSDISTSNFGVRYSNQGFIFDVSGSMAFPLKENLLYISAFLCSKIAYEFLLILNPTMHFQTGNIADLPIIFTTDTEVKNKINELSRKNIECSKAEWDSFEISWDFKTHPLLQYKSLSLIEHAFEKWDIFSKEQLLQMKSREEELNRLFIDIYGLQDEMTPIVEDTDITLRNADRVRETKSFISYAVGCMFGRYALDTEGLVYAGGRFIPEVYLKFPVYEDNIIPILEVAYFNDDLTSRFIDFVRETFGKENIEENIEYIAYSLGKKEAETARETIRRYMLNDFFKDHLQTYQKKPIYWLFTSGKQKAFNCLIYMHRYDKSTLSRIRTDYLHELQIRLDAEKKSLLDIINGDGTTKEISNAKKELKSLDLKIEELRAYDEKLHHMADMQIEIDLDDGVTVNYAEFEGLLAPIK

SEQ ID NO: 3090 - protein, 1224 aa, Escherichia coli; identical to SEQ ID NO: 2815

SEQ ID NO: 3091 - protein, 1190 aa, Vibrio cholerae; identical to SEQ ID NO: 2955

SEQ ID NO: 3092 - protein, 1246 aa, Vibrio cholerae; identical to SEQ ID NO: 2910

SEQ ID NO: 3093 - protein, 1246 aa, Vibrio cholerae; identical to SEQ ID NO: 2910

SEQ ID NO: 3094 - protein, 1169 aa, Geobacillus sp.
MVMHKTELKNFAISARRELIEKVALRAKLFGIDEKNGLKIEEKFGQLIVNGETYPLNWRLAFQSLARQLEIKGYQQLIEEVAYTWFNRIIAIRYMELHGYLPERVNVLSSSTGKVEPDILTEFESMDLDVDKDQIKRLIREGDTEQAYRKLFIAQCNALHHILDFLFEKINDYTELLLPDYLLDSESIISKLVKNDALTESFQEVEVIGWLYQYYNTEPKEKVFANLKKNKKIEKYDIPAATQLFTPKWIVQYMVENSLGQLWLEANPNSPLKEKMRYYIEPAEQEEDVKQKLEEIRYKNVNLEEITIIDPCCGSGHILVYAFELLYQMYEEAGYPSGDIPQLILEKNLYGLDIDDRAAQLASFTLLMKGREKSRRILRKKVNLNIYAIQESNQLDSESIARLLGENEKEYFEIKTTIGMFFNAKNLGSIIEPYNLDYGKYLKRIDKLNNDQISIENYHVYDQLNEIKILLNLAKIISSEYDIVVTNPPYMGHSGMNSDLSKYIKEHFPNTKGDLSTVFMEVSLKFAKENGFVSQINIPSWMFLGTYEKLRVNLINNKTFYSLLHLGRGIFGADFGTTSFVIRNCSIKNFIGTYKRLFESQSAVDSLERKKIRFFEEKPYFTKQTNFLKINGTPFTYWAKDIDFKIFTENPKITDVAKAKQGLATGDNNRFLRYWFEVNKSRIGFGYKSSSEAKESNKKWFPYNKGGEFRKWFGNNQYVVNWENDGEEIKNFKDEKGKLRSRPQNTDFYFKEAITWSKVTIGGFSVRYIPNGFLFDVAGCSIFLDENETEKEIYYYLGLLNSKVTRRILQFLSPTVNYEVGHISNIPIKKDDNSRIYSLVKECFGIAKDEWDSKETSWDFKTHSFLKFNKDNNLISMAFDDYRDYRNKQISQMKANEEELNSIFINLYDLQTELTPEVPEEQITMHKANRIDDTKSFLSYFIGCIMGRYSLDVEGLAYAGGEWDESKYQTFKPNKYGLILLTDEYYFEDDIIARLREFLSVTFGEETVEENLQWLAESLEMKRNETAEERLRRYFLDEFFKDHCQVYQKRPIYWLVDSGKQKGLRTLIYMHRYQPDTMATIRFEHLQEIQTKYNNEIDAVNLRITNPNLSATEKRELEKRRERFQKRLEELLEFDKKLAEYANAQIVIDLDDGVKVNYAKFEKVLAKIK

SEQ ID NO: 3095 - protein, 1218 aa, Escherichia coli
MNTSNIKKYAPVARKQFRDAVMLKLTTLGIDADKKGNLQIAQATDLGDSVRYGQFSLDKSLASRRERLVKRAEKQGYDVLVEHIAYTWFNRFCAIRYMELHGYLDHGFRMLSHPTLEGSFQVLDHVPEVADALGLDKARLVEMKLAGDRDEELYRELLLAQCHALHGAMPFLFEAVNDDIELVLPDNLTRTDSILRGLVDTIPEEDWKQVEVIGWLYQFYISEKKDDVIGKVVKSEDIPAATQLFTPNWIVQYLVQNSVGRQWLQTYPDSSLKGKMPYYIEPAEQTPEVQAQLAAITSSSIEPESIKVLDPACGSGHILTEAYKVLKEIYEERGYRTRDIPQLILENNIFGLDIDDRAAQLSGFAMLMLARLDDRRILSLGRSVRLNIVSLQESKLDIAELWTKLNFHQQVQRGSMGDMFAEGTALANTDSVEYMLLIRTLALFTSAKTLGSLIQVPQEDEVALKAFLDGLYRLEAEGDIQQKEAAAELIPYIQQAWILAQRYDAVVANPPYMGGKGMNGELKEFAKKQFPDSKSDLFAMFMQHAFSLLKENGFNAQVNMQSWMFLSSYEMLRGWLLDNKTIITMAHLGARAFGQISGEVVQTTAWVICNRNEDNYKPVFFRLIDSNEDYKKNALLQRSGCFKDVAQHELKKIPGAPIAYWLTDSFRKVFEDSTPLGEIAPVRQGIATANNDRFLRTWTEVCFENIGLYFQNRESAKKSNRKWFPYNKGGEYRKWYGNNEYVVNWYNDGEELENYKPKAVIRNPNYFFRDSITWSFISSTSFGVRFSDAGAIFDVGGSSAFPESKDMYWLASYLCSKQCFIFMGIMNPTLNFQVGNVSALPIIENKISKFKDALSEISRELISIHRDDWDLFETSWSFKKNPLSGKTSKSISDSFKGYISEASESIKKALTLESKSNEIWLDAYQLKHEIDYQVTKEQITLSVNTLYRYGIDNTQRLQSDTIVELISYIIGCQMGRYSLDREGLVYAQEGNKGFVELVAEGAYKTFPADEDGILPLMDSDWFDDDVTSRVKEFVCTVWGEEHLQENLDFIAESLCLYAIKSKKGESSLDTIRRYLSTQFWKDHMKMYKKRPIYWLFSSGKEKAFECLVYLHRYNEGTLSRMRTEYVVPLLARYQGNIDLVNDQLKNSESGAATTRLKKELDGLTKKFNELRNFDDRLRHYADRRITIDLDDGVKVNYGKFGDLLADVKAITGSAPQEA

SEQ ID NO: 3096 - protein, 1225 aa, Salmonella enterica; identical to SEQ ID NO: 2876

SEQ ID NO: 3097 - protein, 876 aa, Collinsella stercoris
MDTKALEKFCPWARIELIDAVHLRCVRYALDDAGRAAHPADADVIGGTVLTPSEKTQRAALFERIERLNEERGGKGYAAFCEQQAYSWFNRFAAIRFMELHGYLSNNVRMLSAGSGAFEPECLRMASELDLPGLELAEVLDLITAGDDEALFRRILVAQMNELADCLPTVFGHVDDADALTLPDNLLAHGEHDVLFHLVADIPEEAWDDVEVLGWMYQFYNSELKDDFFKSKRKAAVEDLAPATQLFTPDWIVRYMVENSLGRLWMLNNPGSRLREGMAYYIEPDAGHEDFIHIEGPEDITFCDPACGSGHILVYAFELLFRMYAERGYRERDVPRLILTKNLSGMEIDERAAQIASLVLAMCAREHDRRFFTRGVKADVRVLGGVDIDVDALDPASALRQRPKLIEALAHLGEVGSLLAPSPEDLGALKSELMRGLSGDLFVSHTQAGIERAAELCETLSRTFDVVVANPPYMGSSSFNPFMSKWMKKNYPDFKSDLFAAFISRIGSLCATHGEAGIMSPFVWMFIGSYEKLRNVMIDEKTLTSLVQLEYSGFSGATVPICTFTFHNSHVDGYMGGYVRLSDFVGAAVQGPKTLEAIQNPDCGWFYRADASTFHDIPGSPIAYWASDAVRRVFEYGEPLGNDTPTHLGMATCNNERFLRYWWEPSNELVGTPDDFSKGSSQRRWAPYNKGGIYRKWSGNDEYVVDWKDSGRYINSCGAVMVKESLRFQEMTSWSRVSSGMLAVRYKKPGYLFDMTGPGAFGNHSDLIWRTAFLNSSTSMYVARFMSASLDFQPGQIAQYPIIEEDSSIKLVMPLAYDCIDLSQLDWNDREAAWDFKRSPLIPNSDAEAAPHPKAGLSYHLMPVSAKITENPGDKS

SEQ ID NO: 3098 - protein, 1188 aa, Glaciecola punicea
MDTSKLKKFAQFARRSLIEQVQSKLKLVLAADSAARREHPKAIKELEQKLNQHINNKEDEKQLIEQVAYTWFNRFCALRFMDVNRYNRIMVLSPISGQFQPELLAEAKAGHLDDVVFNGKIRERIQGLLSGSVPSRDGQAEGYRMMIVAICNDYHRLMPYLFQRIEDYTELLMPDDLLSGNSILAYTREAMTPENCESVESIGWLYQFYVSEKKDLVFEELKKNKKITPENIPAATQLFTPHWIVKYLVENSLGRLWMLNNPNSKVIDQMEYYIKPLEKETDFLRISNPEEIKLCDPAVGSGHMLTYAYDLLYAIYLEANYDATDIPELILTKNLFGIEIDERAAELAAFALSMKAMKGNSADDSNNRRRFFRNPIKPNICRLEKVKIDADALDEYMDFIGRDLFTQDLRKTLSEFEEADNFGSLIQPTLKNPTEILEIFEAKNAQVDLFLKNTHESVIKILQQTKYLSPIYHVVSANPPYMGRNGMNSRLSNWAKDNYPKSKSDLFAMFIERNLNLILESGYSGMINMQSWMFLSSFEKLRVKMFAQSTIVSMVHLGSKAFDSIGGEVVSTTAYILQNTVKVDRKGDYFRLVDGKSEAEKNRAFSEAIRKIDCGSNYRASTKDFNRIPGSPVVYWASDKVITAFESEVVEDNFLAKKGMAIGDNNRFLRLWSEVENKDIEFNAQDEEDTKIKKWYPCLHGGAFRKWSSNKEFVVNWIANGFEPKSAITEKTGDHWSRYIISTKLFFKEGINWSAISSSSFSARYHEKGFAFTSASMTAFPKLEIDPKVLLLFINSEVGKLFLSFLSPTLNFGIAEIKKLPFIINDRQSNLIAIAEQLVVLSTEDWDEHETSWSFKSSPLLNFSHIPLSDSYNRLREIWRTRTQNMKELEERSNQIFINVYGLENDLKPDVMISKISLFCNPSFRYKNSSNTNEAEGELLADTARDFISYACGCIFGRYSLDKEGLVLANQNDTIKNCMKEVVLPEFMPDEDNVIPIIDFELEKDKDEYWFEDDITERFIEFLQVSLGEKHLATNLDFIEKAIGKKIKSYFARHFYTDHVRRYKKRPIYWMFSSPKGSFNALIYMHRYQPDTASIVLNDYLREFRTKLEARKQSYEQVEISASASQKDKTQAIKAIAKINKVLEEINDYEHDVLYPLAGEKIEIDLDDGVKHNYPLFGNALKKVTGLS

SEQ ID NO: 3099 - protein, 913 aa, Enterococcus faecalis
MDKKAIKKFAMESRVKLREGVINRLAKLGITESNIDPVIELGNDTITISSNEQRYTGKDVINRTKLVEALKAREKQLDLGEKKSKAIAFDNLVEEVAYTWFNRLIAIRFMEVNNYLPERQRILSSESGIREPDIITNLLSSNLYAEMDPDTKSRVVDLMSDNSAAAVDELYQLVFIKQCNSLNQLLPDLFEKIDDYTELLFTISYIDENGVIASLLSIPEEDFDVSKEGQVEIIGWMYQYYNTEPKAEAMKAQKKRKSRADEIPALTQLFTPDWIVRYMVENSLGRYYIDQKLAMPTETRTEKEIADEFGWKYYLPTAEQPENVQLQIQDERKDKNVIALQEIKLLDNAMGSGHVLVYAFDVFMQLYVAEGFRERDAAESILINNLFGLEIDKRSYQLAYFAIMMKGREYSRRILTKNVKLHLHQFIDSDDIPNEYFERLEEISSLPSDEFIEKSNLLKLILDMFLHATEIGSVLNIQNISQSEINELRQLTCAFEDFSNMDILYQLPEAHEKVNHILNILEVLSFRYTAVVTNPPYLNKMSAILSKYVKDNYPEVKTDLFSVFIKMNSQMLTDGGYAGFMTPFVWMFIKSYEELRNFLIANKNISSLVQMEYSAFEEATVPVCCFTIKNAKSEPIGNYFKLSDFRGGMNVQKEKVLEGIRNPDVNYLFQTNQNNFTKIPGSPISFWVSENLIHDFVVGKRMDEIVEPKVGLQTGDNNQFLREWWEVDINRIKFDATSVSDSVNSGKKWFPYNKGGAFRRWYGNYDYVVNWENDGQEIRNFVDDKGKLRSRPQNTEYYFKEAITWPLITSGGLSARYREQGSIHDVSGMSAFSSNQTNVYYALGLVNTPIGNNIFKILNPTINSQIGDFQNIPVIVKIENTRIIELVKSNINLAKKDWNQQDDRWEFEKHPLI

SEQ ID NO: 3100 - protein, 1178 aa, Pseudoalteromonas flavipulchra
MDTSKLKKFAQYARRSLIEQVQSKLKLVLAEDSAARREYPHAVKELEAKQKEFGDDKLLIEQVAYTWFNRFCALRFMDANQYNRIMVVSPIAGQFQPEILAEAKAGHLDDSVFDAKSRDKIRGLLSGAIPSRDGQAEAYRLIIVAMCNAYHRLMPYLFERIEDYTELLMPEDLLSGNSILAYTREAMTPDNCESVESIGWLYQFYISEKKDQVFEGLKKNKKITPENIPAATQLFTPHWIVKYLVENSLGRLWMLNNPSSKVIEQMEYYIKPVEEESDFLKISTPEELKICDPAAGSGHMLTYAYDLLYAIYLDANYDPVDIPELILTKNLYGIEIDERAAELAAFALSMKAMKGNPFDDSNNRRRFFRNPIKPNICRLEKVEIDDADLEAYIEFAGNELFTPDVLATLKEFEEADNFGSLIQPTLKDPTKLFEKLTSKDAQVDLFLKDTHESILKILKQAKFLSPIYQVVIANPPYMGLRGMNQRLAKWANEVYPRSKYDLFSMFIERCFKLALSKANLAMITMHSWMFLTSYERMRVSLIREKTLLTMAHLGSRGFDSFGGEVVQTTAFVFSNDKNLEYLGEYLDLTSGKSESEKSNHFRKCLKTGASRYRVKGSDLKAVPGSPYAYWVTENVRNIFSEYKSVGSVADTRQGMATSNNALFVREWFEVDTKNTCRDAVDRKSASLRNEKWFPFIKGGGFRKWYGNLEHVVNWYKDGEEILTYASELYGSPTRTIKSIGRYFQENIGWSRISTGKLSLRYFPAGCIFSDAGSCIFFDEKNYKNQVLAQLNSSITMLFAKTLSPTLTFEAGQIAKYPFLKTEKSVDELVNSLVDIHKYDWDSEETSMDFKLPRILENNENETLLSGLFDSLNVKQKCIIDEVSLKEKQLNELFAREFNLENEISYHVPLEEITLSCNPYYRFGSNLSEESLNSRLKYETLKELISYAIGCLFGRYSIDKKGLILSNQGDSLDEYLNEIPSPSFMPDEDNVIPIIDFEGDWFEDDITERFKEFLKITFGEKNFTENLAFIEEAIGKDIKKYFVKDFYADHVKRYKKRPIYWMFSSPKGSFNALIYMHRYQPDTVSIVLNDYLREFRTKLEARKESYEQVEISASASQKDKTNAIKAISKINKVLEEINDYEHDVLYPLAGEKIEIDLDDGVKHNYPLFGKALKKVTGLS

SEQ ID NO: 3101 - protein, 1202 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLDHGFRMLSHPETPAAFEVLDHVPEVAEALLPENKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQKLNFHQQNKTGSIGDMFAENTALAHTDSAEYQLLMRTLKRFVNAKTLGSLIQVPQEEEAELKAFIDELYRLEQEGDFQQKAAAKAFIPYIQQAWILAQRYDAVVANPPYMGNGGMNSDLKVLAKTHFPYSKSDLFAMFMQHAFYLLKNNGYNAQVNMQSWMFLSSYEDFRTWLLDCKTFITMAHLGARAFSQISGEVVQTTSWVIKNSSTKNYKPVFIRLVDGNEEQKIKELLSYKKHFYSISQNDLKKIPGYPISYWLGQNINIFDNDKIANSWFSGGRIKTHNGDKYIRYIWETSRLSSKWKKLIKGGDYKKHFGNEIFLVDWSVNAIKFYEKNGGIYPSKFRDKAGICWSKITSGQASFRVKSEDVEYDSASPVIFNDKFNSDLYTLALLNTKVFNVLLKALNPTINTQVNDVMSLPFIKMEAAVQEKIETNEQLLINIAMHDWNSQEISFDFMVNYLVSESRASSEVASSYAIARKKWQDAFNKTKELEEENNHLVITSSNFNGINEELIDSEITLVSNPYYKYGDSTTNNETRLLSDSIADVLSYSIGCMMGRYSLDREGLVYAHEGNKGFAELAAEGAYKTFPADNDGILPLMDDEWFEDDVTSRVKEFVRTVWGEEHLQENLEFIAESLCLYAIKPKKGESALETIRRYLSTQFWKDHMKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 3102 - protein, 1195 aa, Johnsonella ignava
MNKTAIKNFAIWARNKLIADVSYDARLIGITEDGIAKPLPQSFGDTQFFDIGTAKPYSISGEAVRQRDKLIEVIQQKEKDTDYKTAYQYVIEEVAYTWFNRLIAIRFMEVNDYLPSHIRVLSSESGKLEPDLVTTPFDAELPFTAEEEAQIFQWKQDNKLDEVFRILFLKQCNALNEILPALFEKTKNYTELLLSLSVIDRDGVVYHLIHDIPEDDFNIECGGQVEIIGWLYQYYNTEPKAAAFAKNGKITKEEIPAVTQLFTPDWIVRYMVENSLGRLWVGGHPDRGLKENWKYYLEEAQQEPEVQVKLSEIRKEYAALNPEDIKLIDPCMGSGHILVYAFDVLMQIYESAGYSQRDAAKSILEHNIYGLDIDDRAYQLAYFAVMMKARQYNRRILNGENTCHVYAIQESNSINRAHLKYFGAGLDDIEKNAAKMQLEGLLDTLTDAKEYGSILNVESYNWDLLRRFVAAEDTDGQISMDSVGVEDTAEQLNRLIDIGETIARKYWVTCTNPPYAGTTNLSAKLNTYIKKYFPDSKSDMFAVLIERCYQFTLDSGFQSMITQHAWMFINSYENLRKKIYEKRFMSLVHLGIKAFEEIGNDVVQTCAFVIQGKYIDGYSSRFVRLVDCKNYNEKEQEFLAGNYRYMAEVANFRKIPGMPLAYWVSSQFIKNFNSAKYIENYGVLTGSQNITGDNEKYLKCFWEIENYQIGKRWHFYAKGGDYRQYYGNLTFVVDWSDTARLFYANNKTSNLLSEEFWFKPGVTYSAITSRGTGFRYLPEGCIFDKGGPSINLRKNIPEILALLNTNVAKYYFWVFNPSINLQVKDVKSFPIILPEDSSLTEMANTNLKLCEYDWNAFETSWEFKKHPLVSESEKEKSKTIQQCFNQWKADCEIRSTELRENEERLNQSFIDAYGMRDEVDAAVEERDVTVRKADLQRDIKSLLSYAVGCMFGRYSLDVEGLAYAGGEWDSSKYQSYIPDADDVIPITDEEYLDDDIVSRLCDWLKVVYGADTLEENLDYIAKALGNKGSTSREIIRNYFLNDFFKDHCRTYSVTGSGKRPIYWLFDSGKQNGFKVLVYLHRYTPDTIGNLRIDYLHRMQRVYESEINRMQDMMDHSENAREVAAAGKRKDKLAKQLKECREYDEKISHLALSRIELDLDDGVKVNYRKLQTAQDGKFYEVLADSKNIMAKQRGKA

SEQ ID NO: 3103 - protein, 1246 aa, Vibrio cholerae; identical to SEQ ID NO: 2910

SEQ ID NO: 3104 - protein, 1246 aa, Vibrio cholerae; identical to SEQ ID NO: 2910

SEQ ID NO: 3105 - protein, 1193 aa, Enterobacter sp.
MNTNNIKKYAPQARNQFRDAVIQKLTTLGISADKKGNLQIADAELVGETVRYGQFDYPKSTLTRRDRLVKRAREQGFDVLVEHCAYTWFNRLCAIRYMEIHSYLDHGFRMLSHPDNPNSFEVLDHVPEVAEALLPEKKAQLVEMKLSGNQDEAIYRELLLAQCHALHRAMPFLFEAVDDEAELLLPDNLTRTDSILRGLVDGIPEEDWQEVEVIGWLYQFYISEKKDAVIGKVVKSEDIPAATQLFTPNWIVQYLVQNSVGRQWLQTYPDSPLKSKMDYYIEPAEQTPEVQAQLAAITPSSIEPESIKVLDPACGSGHILIEAYNVLKNIYEERGYRARDIPQLILEHNIFGLDIDDRAAQLSGFALLMMARQDDRRIFTRDVRLNIVSLQDSLHLDIAKLWQQLNFHQQSQTGSMGDMFAENTALAHADSAEYQLLLRTLKRFVNAKTLGSLIQVPQEEEAELKAFLNALYRLEQEGDFQQKAAAKAFIPYIQQAWILVQQYDAVVANPPYMGSKGMNGELKEFAKNNFPDSKADLFSMFMQHAFSLLKENGFNAQINMQVWMYLSTFKKLRKHILINHTIINMLHLGARAFEQISGEIVQTTAFVISKTNYYDYKPKFIKLTSLNASSKAVALYNNEFHYNIYTQKDFFSIPSNPICYWISPDILLGFKKWAAISDYACCLSGLITKGTDEFIRFKHEVNVNKINEFLTNSREPIGNKKWVPLIHQISNMAFLGESDSLVDYKDNGSHYSKPGNGSLRNKESYFQECISWADVSSGNYSFAKFPKGYIPNSTSHFMILKNNKDSNFLLGFLNSNYARYIFNIINPSIHLNPGEVASLPIPQNAQAQDWSHIDKILILKKEISLFDERSIFFNAHKLLCKKLKMKDSFKFNEEELTKKEKEINDLTILNEEKVCNIVGIAYSKPKAIVNSILLKELIIRYISVNIGCMMGRYSLDREGLVYAHEGNKGFAELVAEGAYKTFPADNDGILPLMDDEWFDDDVTSRVKEFVRTVWSEEHLQENLDFIAESLCLYALKPKKGESALDTIRRYLSTQFWKDHMKMYKKRPIYWLFSSGKEKAFECLVYLHRYNDATLARMRTEYVVPLLARYQANIDRLNEQVDGASGGEATRLKRDRDNLSKKFNELRSFDDRLRHYADMRISIDLDDGVKVNYGKFGDLLADVKAITGNAPEVI

SEQ ID NO: 3106 - protein, 1210 aa, Enterococcus faecium; identical to SEQ ID NO: 3021

SEQ ID NO: 3107 - protein, 1246 aa, Vibrio cholerae; identical to SEQ ID NO: 2910

SEQ ID NO: 3108 - protein, 1188 aa, Bacillus cereus
MNKTAIKNFAVSARTKLMDAVKQKAYELGITKTEIKEPETYEDGFRINNKFFKSYELEQRRKLIQKIEEKDYKQVIEEVSYTWFNRFIAIRFMEVNEYLPTGVRVLSSAQEGKNEPDVIGEVTNIAEDLDLNLDIVYRLQDENKTEDLFKYILIKQCNKLGEIMPMMFETIQDYTELLLPDNLLGEGSVVRNLVSMINEEDWKEQVEIIGWLYQYYISEKKDEVFADLKKSKKITKENIPAATQLFTPKWIVKYMVENSLGRLWLESHPNEDLQQKWKYYLEEAEQEPDVQEQLEKLKNKELSPEDITVLDPCMGSGHILVYAFDVLYSIYQHAGYSEREIPQLILEKNLYGLDIDDRAAQLAYFSLMMKARSYNRRVFRRPLGLNVCSIQESNGVSQEAIDYFVGDSLDRDEVEYLVGVFKDAKEYGAILDVKVIDFEALERRVKEIGENEGFSDIFILQYRDALLERMPNLIKQAEIMNRKYDVVVTNPPYMGIKGMNEALSRFIKKHYAASKSDLFAVFMEKLGRYTKEKGFHAEINQQTWMFLTSFESLRNNFLDNYTIYSMLHLGAGAFEEISGEVVQSTAFVTRNIHTDDNYKAIYFKLNEVKGHTEKELAFIQHSQNIQYIITQKIFNKLPGRTLSYWVSERLIDIFTLDSKVSDIADPKVGLQTGDNNLFLRLWYETKSSKIHFGSKNAYDAENIGLTWFPYSKGGGFRRWYGNNEYVVNWYKNGEEIRNFKDSKGKLRSRPQNKEYYFREGITWSDISTGLFSVRFLPVGFIFDTTGKSMFANGSEDNILMLGFTNSKVFQYILDVSCTGMHYNNGIIAKLPMIINPEMQRRTKPIIENNITISRLDWDFFETSWDFKQHPFVNAKGNVNSLVSIFNEWKLFTNEQFNELKENEEELNRIFIEIYGLQNELTPEVDEKDIKIRKADKEIDIKSFISYAVGCMLGRYSLDQEGLVFAGGEFDESKYKTFKVDADNIIPITDDEYFEDDIVSRFIEFVRVTFSEETLEENLDFIAEALNKKANETSRQCIRRYFLKDFFKDHVKTYQKRPIYWLFDSGKNDGFKALVYMHRYDVGTVAEVRTDYLHTLQRKYEAEIARRDVLLESDASTKDKTRAKKEKEKLQKQLLECQQYDQVIAHIANQKITIDLDDGVQVNYAKFQNVELPQGEGKKPLKANLLANI

SEQ ID NO: 3109 - protein, 1210 aa, Enterococcus faecium; identical to SEQ ID NO: 3021

SEQ ID NO: 3110 - protein, 1225 aa, Salmonella enterica; identical to SEQ ID NO: 2875

SEQ ID NO: 3111 - protein, 1246 aa, Vibrio cholerae; identical to SEQ ID NO: 2910

SEQ ID NO: 3112 - protein, 1246 aa, Vibrio cholerae; identical to SEQ ID NO: 2910

SEQ ID NO: 3113 - protein, 267 aa, Escherichia coli; identical to SEQ ID NO: 2972

SEQ ID NO: 3114 - protein, 713 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLEHGFRMLSHPETPTAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQQLNFHQQVQTGSMGDMFAENTALTQTDSAEYQLLMRSLKRFVNAKTLGSLIQVPQEEEAELKAFLDALYQLEQEGDFQQKAAAKAFIPFIQQAWILAQRYDAVVANPPYMGGKYLAPAVKNHLKENYSGYDKDLFSAFIIRNLQLSKNGAQLGFMTPFVWMFISSYEELRLQLINNETIISLIQLEYSGFDGATVPICTFTLQKNHISNFSGSYIRLSDFRGAANQGPRALEAINNKDCSWRYQTNQESFKKIPSNPIVYWIKPQTSILFTNKKLVNSMRLKKVLVHVMMIYFCVDTGKYQEKKQKLTRV

SEQ ID NO: 3115 - protein, 1225 aa, Salmonella enterica; identical to SEQ ID NO: 2876

SEQ ID NO: 3116 - protein, 1153 aa, Bacillus cereus
MNKKALKEFAVYARNELREQIALRAQAFGITSEGSPVFVTGTDYVEINGKKYPVSYKNSIQKLLKEVETKGYDSVIEEVAYTWFNRLIAIRYMEVHNYLPSKVRVLSSETKGKVDPNILTEYQYTDLPVNKDEVASLLAQGNREEAFRKLLVAQCNELNGMMDFLFEKLEDYTELLLPESLLHADSLINRLVSDLEEGDFQEVEVIGWLYQFYMSEKKERVGGLKNTAVKKEDLPVVTQLFTPKWIVQYMVQNSLGKLYDEWEPENNLAKEWEYYLKSSEKLPIPDVKSLEDIKVIDPACGSGHILVYAFDLLYDMYLEAGYSERDIPRLIIEKNLYGLDIDKRAVQMASFALMMKGQEKYRRFLKKADDLKLNIYEFVDSGFISDEALAFFAEKVGDVSWIATLQEQFKNAKQFGSLIVPKEAASCYFEYITLIKSYNSLETTDLFEEAYIVELEEKLIPLLEQASLLALKYEVVVTNPPYHNKFNTILKKFMSENYKEYKSDLYSAFIYRCTQMTLSNGFSGLMTPFTWMFISSHEKLRNYIINEQSISSLIQLEYSAFSEATVPICTFVIHNQNRVSLGEYIRLEEFKGAEIQPIKVREAVENRVNYRYSFSTEEFTNIPGSPIAFWVSERLKFIFKNYQPLEYFAEVRAGMTTGDNETFLRLWHEVVYEKVDFGTFHMDSTVANQRKWFPYNKGGAYRKWFGNQEYVVNWENDGELLRKFPKSVIRNAGYYFKEGITWSDISSSHFGVRYIPGGFIFANSGSMLFADSDMLKYLMCLLPTKVTSYLLKTYSQTMHFEVGHIKKIPVLYNKDIQERVEGIFNINVNISKEDWDISETSWYFRKQVFLTHCEQVRTLEKCYANWEGYAEKKFRQLQQNEEELNKIFIDLYGLQEELTPEVPDGEVTIRRADRVRDTKSFLSYCIGLMMGRYSLDIDGLVYAGGEWDASKYKTFQPDSDGIIPLTDTEYFEDDVVTRLQELLVIMFGQDTLAENLRWLAESLTMKNNETPVERLRRYFFDEFYSDHCKIYQKRPIYWMADSGKKKGFRALFYLHRYTPETLATMRFSYVQNLQEKLSQEQKRLDQDLVNPDLTAAMKKRYNKQLTTIKAQQDELIDFDKKMAELANGRIALDLDDGVVVNYNKIESVLAKIK

SEQ ID NO: 3117 - protein, 1198 aa, Lactobacillus rhamnosus
MDKKAIKTFAIQARRDLIKSIRLKMENLGITETGVEEKSAASTNEIEYYGDKGLFISGQDIKRRRDLVSRLKTMAKQEEWRDAFSDLIEEVAYTWFNRIIAIRFMEVNDYLPSDVRVLSSETKLKVPDILREAFNIEDELGGYSSDERAIIQKALDTEEPSDMDAAYVILFTKQANALNQYLPELFEKTDDFMQLLFTPSYSVGVIRDLVDDIREDDFDVDKGGQVEIIGWLYQYYNTEPKETAVASPKSHKFRGREIASATQIFTPDWIVKYMVQNSLGKYWIQVLKARGDDRDESKIAMAYGWQYYMVDAPQSDEVNIKIENLNARLKETDVQEIRFLDPAMGSGHILVYAYELFMDIYKSEGFSQREAATSIIQKNLYGLEIDERAFQLAYFAITMCFRKYNRRALNQDVPANLKVFNLNLPSTGQLSLAKDYVSKGSFSELSSLFSTFQHATETGSLMQLNKAQEEALDQIVSNLSKGETPIYLHGLTQMLSNVLQVANILKSKWNVIVTNPPYMGSARMNKYLSSYIDKNYRAGKSDLFSAFMDRFYNQVTPEGYCAMVTMQSWMFLKSFEALRVEFLNSHTISNLMHMENGVMGIAFGTAVTIARGQKIDDFVGTYHQIKTQDASNKVPASLPIHGNRFNRTKQTNFEKIPGNPIAYWAPKKFFKIFLDNPNIGKFGNSRNGLQPKKSSEFVRQWFEVIFSNINFGALSIQDTLNSSEKWVPYNKGGAFRKWYGNYDFVVNWFHNGQAIRAITRNGKPYAVIPSQKYYFKESLTWPKITSGKISARYREPGSIPADAGNSTFFDDSSFLFYVMAIINSPVGYYVLNLINPTLNLQTSDFSVFPIIINSKIRINSIVNENINLCKVDWNSFESSWSFNILPLLAYIAEHHRNWTVEAAFNQWKEEADKRFKQLKANEEELNRIFIDLYGLQDELAPEEEDKDVSVRRADLSRDIKAFMSYFVGCVFGRYSIDTPGLAYAGGDWDDSKYKTFLPNEDDVIVLTDDDYFGDNRDVVNRFKEFLSATFGAEHLDENMQFIVVALGKRGSSSEEIIRAYLRDNFFKKDHLSTYQKRPIYWELNSGRNGGFKALMYLHRYDKNTMAMIRTKYLHPLQEAYERRLDQLKSFEANEQQTRQRNAIKKQITTITKQLDELVKYDEKLQHVANLHIDLDLDDGVLVNHAKAQADTKIFTPLK

SEQ ID NO: 3118 - protein, 743 aa, Lactobacillus rhamnosus
MFTPSYSVGVIRDLVDDIREDDFDVDKGGQVEIIGWLYQYYNTDPKDNAFKKKKYLTSDIPPVTQLFTPDWIVKYLVENSLGRYWIRVLLDRGDKRTSAEIAESFGWHYFMPDAKQNDSTSHPNMAEKRIEDITFVDPAMGSGHILIYAFDVFLQIYQAEGYSRREAAQKIVKDNLFGFDIDRRAFQLAYFAMMMKLRCENRRTFDLHLKPNIFEVPTTTLTPDDFSETINANKTDNEKLKEFLTKFNKGKELGSLIDFSADIFKNALINEIIHKQFTGQLTFDTSNQLTHRHELKSLVRVGMGLSNKYTISVTNPPYMGSGKMPKPLSDFVGKNYPASKSDLFAVFIERLQHMTKQDGFFAMITQHQWMFLSSFKSLRERMINWPIINMAHLGTRAFEEIGGEVVQTTAFIIQKQASSNFIGTYERLVDFDSQTRKEKAYLAAVKDPKIKYVYRTKQTNFEKIPGTPLAYWVPGSLLNVFSKEKISDFAFAGIGMRTGDNKRFLRRWSEVCITNSKLNEASVESTFSGIRWIPYNKGGNYRKWYGNNEYVVNWLNDGQEIKDNTKKTYPELGDDLGWKISNEKYYFRPGITWTGVTSGTFNARFYPDGFIFDSGANGLFPFDANNTWSILAFLNSSVGNYLLKLLNPTINTGSGNIRSLPFLASSFSSNIDDIVQNSVSLSQEDWDSCETSWNFCKVVLTNHIAEHQKSPPTKFLTLVEFCDKYVPIQFRRLIFYGKLSKTR

SEQ ID NO: 3119 - protein, 1241 aa, Haloarcula japonica
MSTTHGQPGLSSDQRSNIRSAILSTRHTLEDELRRQLEKYGIYEDKKLPLENLTHLSVEEIHTRRTLNAAIQRELESTEGDLERSITNYVHEATKTYLNRFVALKIIEVRGLVEETITERPEYGNRSYMHHTVAEIAGELTNAPDDGFGATLDLAYQEIGAEIRMIFEESEHTAIDLDAQVREEVLDDLDLIDDEAWESDEALGWVYQYFGEEEREDIDERIDEENYKIAGTDIATKTQLFTPRYIVEWMVDNSLGRTWLEMQGERTNIDDEKNCFYLSPLQDSLIERETKAVEDITVLDPACGSGHMLFYAFDVLYQMYLEEGEIPEKYIPREILRNNLYGIDIDSGAAQIAALSLYLKAKARAPNIDVDQINIVSADAVLINGEKKQEVLNRSQSELEKEILEQIWTSFEHIREWGSLVRVEERIEGIIDEYRDELEAAGQSKFTQSGGLEKQASVVSFSDNESESWDAVKERLLENTREIARIALNEDNPIDEMFASEVSKTVELLDVLIRDYDVVVANPPYMGSAKMGDNLKQYVKDGYVGTRDLYAAFIQRSWEFAKDDGYASLVTPENYMFSYSYRKLRRILLQNHQFVEGVHLSRYGFDQQKDAYTIPFLLRNSEPGELTETRFYRMTHEQDQYENYEKKIQGLNYLVKQIRKGDDPDDIYIINSNDFLSIGRQPFLYWFGDSLLNLFSQYPAIEESVEVKQGLATGDDDRFVRKHWEVPSEELKSYYVPYQKSGSSSPYYDTQRDYLDWENDGKEVKEYSGSRPQNPDYYFREGISFRGFGNYAVARQKPDDTIFYHKSHFVYSPEISDKYLLGYGNSTLVRFLLNGINPSLNFEVGDVKRLPIDPEPAEQEKVEDLVNQALERRERLVSLDETSDQFDPELFTDCVQGGVRELLYHKDQLNAEVGLIHGLIDPVIYDEYSIPTEERDRLYNNLPNNLSTYPIVENLETNYGTFGDEVPKKTLTLDEYENLLSDISEGPEDIRDAAEDLEISPLTIADARYIKNLYDDERLEQSVGYVLSFCLGLLFGRWDVNKDIETVDDGIISFNESANQNVSEQISSCLETVFDDGSSVQSSLEDSLGTSLEDWLRESFFRYHHCKEYRRRGQRIPIYWQLESPDGAFSCFVYYHAIDSNTLPKLRGQYLDQRIDELENELETLNAQTSGNNPDKDLLNRKEKVQKDLNDTKEFRDTIDKMIDDGVTVDVEKGIWENIKEWDQYEILETGLPKLKSSYSR

SEQ ID NO: 3120 - protein, 743 aa, Lactobacillus rhamnosus; identical to SEQ ID NO: 3118

SEQ ID NO: 3121 - protein, 1198 aa, Lactobacillus rhamnosus; identical to SEQ ID NO: 3117

SEQ ID NO: 3122 - protein, 1225 aa, Salmonella enterica; identical to SEQ ID NO: 2876

SEQ ID NO: 3123 - protein, 1206 aa, Vibrio tubiashii
MNTNNVKKYAPKARKAFIEAMSKQAAKYGITKNKIEPAEQKGDLVLIGDRPFPASVIKPRERLVKRIEQQGFDQVMEHVAYSWFNRLCAIRYMERKGFLDHGRRVLSAADGSAGVPQILEECLDVELPGLDQAKVRELKLDGTKDEELYRELLLAQCHALHQAMPFLFEAVADESELLLPENLTKTDSLIRDLVASVPDEDWDHIEIIGWLYQFYISEKKDQVIGKVVKSEDIPAATQLFTPNWIVQYLVQNSVGRHWLQTYPDSPLKEKMPYYIEPPEQSPEVMSKIADITPSEVSPESLKIADIACGSGHILVETYRVMKAIYEERGYRSRDIPQLILENNLFGLDIDDRAGQMAGFALLMLAREDDRRIFSRNIRLNILSLQESANVNLPSLWRSLNLTGEWQSGASQGLFEEEQQDLSSFAADNRYQLIQRTLERFKKAKTFGSLIDVSHDDYEELKELFQTLCELEIAGDSMQKAAASQLIPFVHQSIVLSQKYESVLANPPYMGSAYYNSTLKDFASLKFDEWGGDLFTCFIKQSLDMIAREGSVALITIGTWTFLPTFEAMRRQLLDCCIFTSIIDNGRGVWGSDHGSLMFSAKKIDGDLCGNKVATKYLSRGKGKVQQVNVIRSKYLSDKPLYIEQDLFKKIPGYVISVGATPELLNQFLESHRLRDLADARQGIKTGDIAKYLRYWHEVSYSNIKFDCNSSDESMVASEQWYPCNKGGEFRKWYGNQDYVLNWKSDGFEIRNFKDESGKLRSRPQNTHLFFKEGITWSTVTMGRPSFRYSKPGRIFESGGSTIFTNEDIYYLLGVLNSKLGEVSVGILSPKVSLGEGAVSKFPIPDLSSDKKDKISECAKTLVQIFSTIDSWDESTFDFTGLFDFPSQDNLEVYATRWIEKYKSILNDIKRQEDLINSIVLGSGFEKNTDEVDPQDYGLPEINSSVIVERIVSFAIGCMMGRFSLESKGVVYADSNEEKGNSSSFELIKTTSNFSVDEDGIIPITGIEWFPDDAANRLHEFLMSVWPKDRLGENVDFVANSLCNSSMKAKQNESTSDTIRRYLSTQFYKDHLKTYKKRPIYWLFSSGKQKAFECLVYLHRYNEGTLARMRTEYVIPLTAKMAAYAQKLENDKEASGSAAEVKRLEKEIAQLHKQQAELSEFDEKLRHYADQRISLDLDDGVKVNYGKFGDLLAEVKAITGEAPEALS

SEQ ID NO: 3124 - protein, 1246 aa, Vibrio cholerae; identical to SEQ ID NO: 2910

SEQ ID NO: 3125 - protein, 1246 aa, Vibrio cholerae; identical to SEQ ID NO: 2910

SEQ ID NO: 3126 - protein, 1225 aa, Salmonella enterica; identical to SEQ ID NO: 2876

SEQ ID NO: 3127 - protein, 395 aa, Escherichia coli
MKSLSPTLDYHEGPIGKLPFKGKLKAQVLENVVNLIAISEEDWNTEETSWGFKKHPITKLDNLNYLQASFEAFKNDVQETIIRTQQLEEFNNKEIIREYGLESELNYKVSLEEITLTVNPDYKYSGTTDDKSKRMQSDSLSSLLSYAIGCMMGRYSLDREGLVYAHEGNKGFADLVAEGAYKTFPADSDGILPLMDDEWFDDDVTSRVKEFVRTVWGEEHLQENLEFIAESLCLYAIKPKKGESALETIRRYLSTQFWKDHLKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 3128 - protein, 817 aa, Escherichia coli
MNTNNIKKYAPQARNDFRDAVIQKLTTLGIAADKKGNLQIAEAETIGETVRYGQFDYPLSTLPRRERLVKRARELGFEVLVEHCAYTWFNRLCAIRYMELHGYLDHGFRMLSHPETPAAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQQLNFHQQVQTGSMGDMFAENTALTQTDSAEYQLLMRTLKRFVNAKTLGSLIQVPQEEEAELKVFLDALYRLEQKGDFQQKAAAKAFIPFIQQAWILAQRYDAVVANPPYMGGKGMNGELKEFAKNNFPDSKADLFAMFMQHAFSLLKENGFNAQVNMQSWMFLSSYEALRGWLLNNKTFITMAHLGARAFGQISGEVVQTTVWVVNNNHTEFYRPVFFRLINGSEEEKKSALISRKNMFNHTLQNDFKKIPGEPIAYWVSDIYRDIFTQSPALSSIAKPRQGLATSDNNRFLKLWYEPSLRKINFSAKDRADALNSQAKWFPCQKGGSYRKWFGNHEYLVNWENDGRELLDFAASLYGSPTRTIKISLFILEKVQLGRQFRLVIFQLDIAQLVLYQKPKVLFVLLMIKIFYYRS

SEQ ID NO: 3129 - protein, 1203 aa, Lactobacillus reuteri; identical to SEQ ID NO: 2833

SEQ ID NO: 3130 - protein, 1246 aa, Vibrio cholerae; identical to SEQ ID NO: 2910

SEQ ID NO: 3131 - protein, 1246 aa, Vibrio cholerae; identical to SEQ ID NO: 2910

SEQ ID NO: 3132 - protein, 1204 aa, Escherichia coli; identical to SEQ ID NO: 2986

SEQ ID NO: 3133 - protein, 1210 aa, Enterococcus faecium; identical to SEQ ID NO: 3021

SEQ ID NO: 3134 - protein, 1246 aa, Vibrio cholerae; identical to SEQ ID NO: 2910

SEQ ID NO: 3135 - protein, 1224 aa, Escherichia coli; identical to SEQ ID NO: 2815

SEQ ID NO: 3136 - protein, 1178 aa, Sphingobium indicum
MDTSKLKKFAQFARRALITQVSSKLESVVAENSAARREHPDAMRKLESAIAKDGKDQVVERVAYTWFNRFSALRFMDVNELNPVRVVSPTTGQFQPEILAEAKAGHMDEDRVPDRIRDKVRSLLDGRTPSTDAQTEAYRFLIVAICNDLHKAMPFLFERIDDYTELLLPDDLLSNASILAYVREAMTPDVCEDVEVIGWLYQFYISEKKDEVFAGLKKNKKITAENIPAATQLFTPHWIVRYLVENSLGRLWLLNRPNSNLAAQMDYYIAPEEPETDFLRISRPEDIRICDPACGSGHMLTYAFDLLYAIYEEEGYEATDIPGLILTNNLYGIEIDDRAGALAAFALAMKAATKLGRRKFLRQAVQPNICVLQDVRFTASEMQDVAAVVGSDLFTADFRETMGQFEQAKNFGSLIVPKLRDPAEVARVVRLKDFGGDLLLREVKERVLKVLEMAEVLSPKYHVVVANPPYMGASNMNGVLKDWTAKAFKRSKADLYAMFIDRNRDLIRKGGYFGMITMHGWMFISTYSKLREFIVKSNTLVSMAHLGTRGFDSIGGEVVSTTAFVQRNVRPKQDLGTYVRLTDAPSERAKAELFRSAKKSLNNGPRFEARTSDFEKIPGSPIAYWLPETARKLFKEGDAFGDFLDARIGLATGRNDYYLRFHYEVSTKNVAFSCGDRSEAKATGKKWFPFNKGGSLRKWYGNCEFVVNWENDGHELQTTMHPSGERIWAHNFNLDYIFKPMVSWSDITTEGLAVRFYPKGFIFDSTGVSAFEKGSGQSQKCIGAICNTKLGTYFSEVLNPTHHFTPGDFSRFPVPRGLVDSSHDENVARATSIAKSDWDAYETSWDFATLPLLSPDHRAGTLEGSYARLRAHWRGMTDEMQRLEEDNNRIFIDAYGLQDELTPEVPIEEITLICNPAYRYGVKGSEDDRETRLRADSIAEFLSYAVGCMFGRYSLDAPGLILANQGEALADYLARVPVPTFEPDVDNVIPVLDGDWFADDIAERFRKFLRVTFGEPKFQENLAFIEGALGKDIRKWFTKDFFDYHVRRFKKRPIYWMFTSPKGSFQALIYMHRYRPDTVSVVLNDYLREYRNKLEAHRKAQEAQSINPEVTPGQRTKALKEVGEATKVIEELDGYERDVLYPLATQKIEIDLDDGVKANYPKFGAALKPIKGLSDADD

SEQ ID NO: 3137 - protein, 1246 aa, Vibrio cholerae; identical to SEQ ID NO: 2910

SEQ ID NO: 3138 - protein, 1246 aa, Vibrio cholerae; identical to SEQ ID NO: 2910

SEQ ID NO: 3139 - protein, 1225 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLDHGFRMLSHPETPAAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNVVSLLESLHLDIAKLWQQLNFHQQVQTGSMGDMFAENTALTQTDSAEYQLLMRTLKRFVNAKTLGSLIQVPQEEEAELKVFLDALYRLEQEGDFQQKAAAKAFIPFIQQAWILAQRYDEVVTNPPYMGNGGMNSELKAFAKNNFPDSKSDLFAMFMERAFSLLKSNGYNAQINMQSWMFLSSYEKLREKLLKLKTFHTMAHLGAKAFSQISGEVVQTTAWVALNEHIDMFKPTFFRIIGGSEHEKQKTLIEKKDGIILHSQNNFMKIPGAPFVYWNVDKISKYFENTKTIGDLCDARKGMGTGDNASFVRAWHEVSLGNIGFNFDSRENASASNIKWFPYNNGGRYRKWYGNNEDVVNWYQDGVEVKATATIKNNGGHWSRYLVSLDRFFCQGLTWSDISSGNFGARYFDKGYLFSSVGMCVFSETHSIYNLLGVLNSSITQEILDSISPSLHYGVGEIKKIPLKIINNDDEIKELVQIYANDWGSVETSYEFLTLPIIANKSDAQSIRNNYSSLLEIQQKYIDKAFFLEKNNNIRYLEAYNINKNDYQEISERELTLFINPYYKFSNIKDDNLICKAQQSDTSQSLLSYSIGCMMGRYSLDREGLVYAHEGNKGFADLVAEGAYKTFPADSDGILPLMDDDWFEDDVTSRVKEFVRTVWGEEHLQENLEFIAESLCLYAIKPKKGESALETIRRYLSTQFWKDHLKMYKKRPIYWLFSSGKEKAFECLVYLHRYNDATLPRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 3140 - protein, 1188 aa, Sporolactobacillus vineae
MTEQTKNDPIDKKAIKSFAVAARRKLIEGVEQKAYAFGITKQQIQNADSVKINGFPMDETQQKQRKHLVEKIKHSGFNEVIEEVAYTWFNRFIALRFMEVNDYLPSGIRILSSIDGKRDPDILSNIELVADELQLDRNKVYDLQDRNALDQLFKYILIHQCNELSQMMPSIFEPIDDATELLLPDHLLREGSVIRKLVDEIKEENWKHQIEIIGWLYQYYISEEKDQVFARLKKNIKIGKEDIPAATQLFTPKWIVQYMVENSLGRLWLESHPDQEMRQQWPYYLDEAQQEAEVQKKIDAQKNHQLSPESIKFLDPCMGSGHILVDAFDVFFSIYQKAGYSVRDIPRLILEKNLYGLEIDERAKQLAYFSLMMKARHYDRQLFQKPVHVHVYAIQESNSITQDEIDLVAGDNSDRNQVVALVNLFKDARLYGSILKVPGEIDLDLLRSRLKALREDKSHNLFIEEFQQRNLKLFENMLEQATMLSMKYDVVVTNPPYMGRKGMNDKLSIYIKKHYPDESADLFAVMMERCRCFSEKKGFISMITQQSWMFLSSFEKMRIHLLNQEQIYSMVHLGARAFAEIGGEVVQSTMFVSHHYYIPNYQGTFIRLVDFKSANEKRKQFNNNRFYYTRSQSAFSDIPGSPIAYWASDQVRKIFRENPKLGDVAEPRQGMATADNNRFLRLWHEVNFNRIGFNYKSREEALRSKQKWFPYNKGGAFRKWYGNMEYVVNWKNDGEEIKNFVIKRYPYLNGNYEYVVKNMKYYFREGITWTAISRKHFSVRYVDKGSIFSNAGMMIFTRNKVELLFLLGLVNSKQAFMLISQLSSTLNFDQGVVRRIPVNEGNSDAVINLVNKNINIATIDWYSFETSWDFKQHPLIEFRNGAATIDEAYNNWAREAERRFTTLKANEEELNRIFINLYGLQDELTSEESDDEVTVRRADRERDVKSFLSYCVGIMFGRYSLGEDGLIFAGGTFDRNRYRTYKPDKDNVIPITDETYFEDDIVGRFIDIVKRIFGEQTLEQNLDFIAESLKKKSGETARQRIRRYFLKEFYKNHVQIYKKRPIYWLFDSGKENGFKALIYLHRYEPGLVARVRTDYLHAMERKYEEEMQRLDLQMEAEAPERDKVRARKQKEKLQKQLEECRQYDQVVAHVASQQIPLDLDDGVKVNYAKFQNIDVPGKKVKVNLLAKI

SEQ ID NO: 3141 - protein, 1246 aa, Vibrio cholerae; identical to SEQ ID NO: 2910

SEQ ID NO: 3142 - protein, 1166 aa, Streptomyces sp.
METAPLKSFAAWARAALIREVAARISVVLAPASPEQVEQRTAVAALEKAVNAAGGGGTGRAAVADKVAYTWFNRIIALRFMDANGYTGIGVVSPERGREGGQPEILAEAKRGNIDSTVVTNMRTAETVTNLLNSTRRSDDPQGEAYSLLLAEYCRHWNRSMPFMFEREGDYTELLMPANLLADDSVLARAVTVLTEDVCQDVEVIGWLYQFYISERKDEVFAGFKKNKKAGAAEIPAATQLFTPRWIVRYLVENSLGRLWLLNRPASRLADQMEYYIAPVDEETDYLKVSSPEKLKIIDPACGSGHMLTYAFDLLYAIYEEEGYAPSDIPALILSNNLYGTEIDPRAGALAAFALTMKGRARQRTFFNRDVEPNICVLEPVSFTSGELDALVTGSGDRADEEAFWNQFAHADTFGALIRPKRAMVESVGEHFPVSDSADHGLFAQDLRERAEIVIKQAAYLSQPYDVLIANPPYMGGKNMASRLAQYVKEEYPSTKSDLFSMFIERSFGMVAVGGYSAMVTMEAWMFLLTYKELRETIVTRKSIRNMVHMPYVGKGSTSMGINFGTAATVIQNVPDPRAKATFQCVRYYETDSTGVPLTFPVTNERYALFAPSEFTVVPDTRIAYWLSAQMLKAFSLGRPLAQVGVPRQGMATADNERFLRLWTEVSVDRFGHGLTREEAAGSAFKWFPYNKGGDYRKWYGNHDWVVNWEHDGRELMAERPKAVIRSPQLYFRPSVSWSKVGTGLPAFRFFPTGFIFADAGSSIFGSERDLLHLAAICNATVAREMLAATSPTLNVEVGTLAQLPVVDVSDTAVSSVQELVDIHRADWNSRETAWEFGALDIVAGGESLLRKAVANALESGTAVSARARALESQVNAEVADAYGLASEVDVDVSLDRVTLHCNPVARFGEGKSSAQQEKLYAQQRANDLVSYAVGCMLGRYSLDEPGLILANQGDTLQDYLAKVPNPSFQPDEDNVIPIVDGDWFEDDIVARFRQFLRAAFGEEHFEENLRFVTESLGVKDLRDYFVKSFYKDHVQRYKKRPIYWMFSSPKGSFNALIYMHRYTPSTVSTVLNEYLREYKAKLEASRQHHERLSAGTGTPREKAAAQKEVDRLRRVLLELDEYEHDVLYPLATQQVQIDLDDGVKANYPKLGAALKKIPGLEASNG

SEQ ID NO: 3143 - protein, 1225 aa, Salmonella enterica; identical to SEQ ID NO: 2876

SEQ ID NO: 3144 - protein, 1210 aa, Enterococcus faecium; identical to SEQ ID NO: 2960

SEQ ID NO: 3145 - protein, 530 aa, Escherichia coli; identical to SEQ ID NO: 2979

SEQ ID NO: 3146 - protein, 634 aa, Escherichia coli; identical to SEQ ID NO: 2980

SEQ ID NO: 3147 - protein, 378 aa, Escherichia coli
MPLLDLHKTEIASLSKENVDISKIDWDSFELSWNFKKHPLISREASIEKSYKYNLIENKKRIDKTKENEEVINNIFACGLGLTDIIYNTVPIAEVTLNCNPLYRYGNIKDDKTLHLRFQSETLSELISYSIGCMMGRYSLDREGLVYAHEGNKGFADLVAEGAYKTFPADSDGILPLMDDEWFDDDVTSRVKEFVRTVWGEKHLQENLEFIAESLCLYAIKPKKGESALETIRRYLSTQFWKDHMKMYKKRPIYWLFSSGKEKAFECLMYLHRYNDATLPRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 3148 - protein, 635 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLDHGFRMLSHPETPAAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFVLLMMARQDDRRIFTRDVRLNIVSLQESLHLDIAKLWQQLNFHQQVQTGSMGDMFAENNALTQTDSAEYQLLMRTLKRFVNAKTLGSLIQVPQEEEAELKVFLDALYRLEQEGDFQQKAAAKAFIPFIQQAWILAQRYDAVVANPPYMGGKGMNGELKEFAKNNFPDSKSDLIAMFMQRAFSLLKENGFNAQVNMQAWMFLSSFESFREWLLDNKTLITMAHLGSRAFSQISGEVVQTTSWIIKNNHIKDYLPVFFRLTDGNEEQKKKNL

SEQ ID NO: 3149 - protein, 1225 aa, Salmonella enterica; identical to SEQ ID NO: 2876

SEQ ID NO: 3150 - protein, 1251 aa, Glaciecola polaris
MKLADHVDHLRELIEAAFDKQFARLGFSKTKQMDAIQVEKLPEEVKAKRERFAVMLDNHIGETGGYDSAREKLLDELTFTLFNRLAAIKVMEAASLFPPILTKQKEHGDRSFGHKAWLEMNPHMRDEELEGIRDYLKSAFDELGQTLPLYSKTYPYALLPDAISLNDIIDAFNTVDTDAQANESSEETIWQSDDVLGWMYESYNNAKKKAHKDSGDKTEYNKVSLQSQVYTPRWVVQFLVENSLGKMYLEMYPHSEIKQRYKIANAPTTQTRTPKPLHEVRTIDPACGSGNFLLYAFDFYYELYLDQIENYGADYDEKDIPKLIIENNLHGIDLDDRAIQLAQLGLFIKAKKKRRTVGELHFKVVSSDFYLPEYEAVKHIFEQGNLVSAQQREFIEKVWADLMQAYKFGSLIHIDKELKEQLSQVKELALGETFDSTQKLKKKIVEGDLFAAADYAEHQEFAENFFANLFAAVEQYARTERNTFLSGKTRDAITFLELLTTEYDVATANPPYTDSGDFGPDLRVFVDTNFKKTSKFHTNLYSAFMKRCFELTSRDGYIAMVHPNTFMFIKTFDGVRKFIINNLHLEILVDYGLDRVNLFGGDVLLDSNCFYVLSKNNRNDKKSIFIDVDTRIQEKHKKESFTNALSDIVRDVENSQVFKIFQSEFLLIESLPFIYWISEDLREKFTKSPLHKVADVVSGVKTGNNNGALRLWWEVDRKDIYDGIGDKKWVLYTKGGKFKKWQGNNWLCVDWNNNCSYIKKQNSYNIPPENISFSEGINYSGSGQKGVCFRFLEKNVLFDMGSSAVFPKFDVFYALSVLNSKLAFYMADCLNPTVNKQPNDVKRIPLAPPTSESIGYLKSLSESNISIYQHLERFSLLEMRYSNSPIDMFFQGTIRNSIKDFLNYENAILSRVLVQEAMVDEEVFKLYNLTENDKKMVLAKQGHSVGGLPVCSKAREEFISKTNELENFTVTITSEFIHSLPVIDFSPEKREVIESHFAGLYQKNNDLEEFCIRHQINPINVWYWFKQSKVIPKQRMQTLAMEFLADIIREILMEDEDGIIPLVPNAGEKVLLDRIEEKFLEKGFSTAQYSSFESVLGRPINDYLNKNFFAELSDHLNLFMYLPKTPFIWHLTSGPEQGFDCYIIIYKWNRDNLLRLRSVYIENRERALQNRQSDIAGNESAEAQNEKERIFKQLKEIDAFKKKIDELLAEGYNPILDDGVGKNIAPLQKKKILAYDVLNAGQLKKYLNADW

SEQ ID NO: 3151 - protein, 378 aa, Escherichia coli; identical to SEQ ID NO: 3147

SEQ ID NO: 3152 - protein, 635 aa, Escherichia coli; identical to SEQ ID NO: 3148

SEQ ID NO: 3153 - protein, 245 aa, Escherichia coli
MMGRYSLDREGLVYAHEGNKGFADLVAEGAYKTFPADSDGILPLMDDEWFDDDVTSRVKEFVRTVWGEKHLQENLEFIAESLCLYAIKPKKGESALETIRRYLSTQFWKDHMKMYKKRPIYWLFSSGKEKAFECLMYLHRYNDATLPRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 3154 - protein, 635 aa, Escherichia coli; identical to SEQ ID NO: 3148

SEQ ID NO: 3155 - protein, 1225 aa, Escherichia coli; identical to SEQ ID NO: 3139

SEQ ID NO: 3156 - protein, 1188 aa, Microcystis aeruginosa
MDTSRLKKFAQYARCYLREQMTTKLEVVLAENSAARRENPKAISKLAEKIEFLGKEQLIEQVAYTWFNRFCALRFMDSNRYHSIRVVSAAEGQFQPEILAEAKTGHIDEEMLNKQVRKQIFDLLSGTAPSYDAQGEAYRLLIVGVCNYYHQLMPYLFERIDDYTELLMPDDLLSGNSILAYTREAMTPENCESVEVIGWLYQFYISEKKDEVFEGLKNNKKITPQNIPAATQLFTPHWIVRYLVENSLGRLWMLNRPQSRLVESMSYYVDSGKWEVGDGYLKINSPEDIKICDPACGSGHILVYAFDLLYAIYEEEGYTANEIPSKILTHNLYGIEIDERAGSLAAFALTMKAREKERRFFRKPIQPNICVLKKVEFSEKELQLYLDFVGRDLFTAPLLETLHEFKEADNFGALIRPTVTDVQGMIGLLNERNVASQLLLYKTHEKVMDVLNMADFLSPKYHIVVANPPYMGNKGMNNRLKAFLQDNYSEVKSDLFSAFMVRCLELCKNNGFTGFMTPFTWMFLSSYEKLRKHILDNCTLTSLVKPSYTAFFDSAIVAICAFTINKHHNDNYKGAFFDLDYLGTAEEQSPRFLQRKRENQYYRASASDFKKIPGSAIAYWVSDRVLEIFATSEKLENIAKAVVGLQTGDNDRFLRLWFEVEYQNIGFNLENRKQAQESQKKWFPYNKGGEFRKWYGNQEYLVNWENDGQEIANFKPRAVIRNPSYYFQESITWSFVSSSCFGVRFSPKGFIFDVGGSSLFTEQENMMFLTSLLCSKIAFDLMKIMNPTLNFQVGNVASIPIVKNNNSLIETVGFKSISLSRQDWNSYETSWDFTTLPLLRVGSENLEQNPRFPLSTSLKETYQNLRQKWQEMTLEMQKLEEENNSIFIEAYGLQDELTPEVLLKEITLTCNPHYRYKKEVGSEKWEVRNKEENITHFPIDEDLEKRLLADTIKEFISYSVGCMFGRYSLDKEGLILANQGETLQDYLKQIPNPTFPPTETNVIPILEGDWFSDDITEKFWQFLRLTFGEKNYQQNLNFIEEAIGKSLEKYFLKDFYDDHTKRYKKRPIYWLFSSPKGTFNALIYLHRYRPDTVNIVLNSYLREFRLKLEVKLDTFQQIEISTSATKTEKTKALRESEQIKKMIGELETYEQETLYPLAIAQKEIDLDDGVKVNYTKLGKALKNITGLG

SEQ ID NO: 3157 - protein, 1246 aa, Vibrio cholerae; identical to SEQ ID NO: 2910

SEQ ID NO: 3158 - protein, 1246 aa, Vibrio cholerae; identical to SEQ ID NO: 2910

SEQ ID NO: 3159 - protein, 1201 aa, Enterobacter hormaechei
MNTSNIKKYAPVARKQFRDAVMQKLTTLGIEADKKGNVQIAQATDLGDLVRYGQFSLDKSLISRRERLVKRAEKQGYEVLVEHIAYTWFNRFCAIRYMELHGYLDHGFRMLSHPTLAGGFEVLDHVPEVADALGLDTSRLVEMKLAGDRDEELYRELLLAQCHALHGAMPFLFEAVNDEIELVLPDNLTRTDSILRGLVDIIPEEDWEQVEVIGWLYQSYISEKKDDVIGKVVKSEDIPAATQLFTPNWIVQYLVQNSVGRQWLQTYPVSNLKGKMPYYIEPAEQTPEVQAQLAAITPSSIEPESIKVLDPACGSGHILTEAYNVLKAIYEERGYRTRDIPQLILENNIFGLDIDDRAAQLSGFAMLMLARQDDRRILGRGVRLNIVSLQESKLDIAELWTKLNFHQQVQRGTTSQMFPEEMTLANTDSAEYKLLMRTLALFTSAKTLGSLIQVPHEDEVALKGLLDELYRLAVEGDIPQKEAAAELIPYIQQAWILAQRYDAVVANPPYMGGKGMNGELKEFAKKQFPDSKSDLFAMFMQHAFSLLKENGFNAQVNMQSWMFLSSYEALRGWLLDNKTFITMAHLGARAFGQISGEVVQTTAWVMSNNHFERYQPVFFRLIEGNEELKKTVLLERENRFDNTLQEDFKKIPSAPVAYWLTPSIIDVFFRGEALRNISIPRQGNTTTNNEKFVRSWFEVNFDKIGLGYSSAKDFSEHKKKWCPYNKGGGSLKWYGLNESIVNWEDGGEQIKAIPHSVVANESNYFKPGITFSTVSSSGYGFRLFDNGFIFDNKGASIFIDGEKRLYLLAILNSKIFELTVHSITPTISLQPGDVAKLPVIEGDSTQMEKVISLSKEAVMKSKQSWDDKELSWDFKRPNFISNTALDEVLSNSINKYIISCQNHADCISDIENEINIELINIYDIREDVISNVVSGSDYINLTAMIGELISYIIGCQMGRYSLDREGLVYAHEGNKGFAELVAEGAYKTFPADEDGILPLMDSDWFDDDVTARVKEFVQTVWGEEHLQENLDFIAESLCLYAIKPKKGESSLDTIRRYLSTQFWKDHMKMYKKRPIYWLFSSGKEKAFECLVYLHRYNDATLSRMRTEYVVPLLARYQGNIDLVNDQLKSAESGAATTRLKKELDGFTKKFNELRNFDDRLRHYADRRITIDLDDGVKVNYGKFGDLLADVKAITGSTPQEA

SEQ ID NO: 3160 - protein, 1171 aa, Marinobacter sp.
METAKLKKFAQFARRSLIEQVSAKLKLVLAEENPARRERPQVIKKLEEAVAEQGKEQVIERVAYIWFNRFCALRFMDVNRYNRLGIVSPAEGQFQPEILADAKMGQIDEEMVAEAIRRRIFAFLDGKTPSQDPQGEAYRLLVVAACNYWHGAMPFLFERIDDYTELLMPGDLLSGNSILAHTREAMTPDACQDVEVIGWLYQFYISERKDKVFEGLKKNTKITAENIPAATQLFTPHWIVRYLVENSLGRLWMLNRPNSRLVEQMDYYIKPAPAADGSDQPETDFLRINKPEEIKICDPSCGSGHMLTYAFDLLYAIYEEEGYEPTDIPTKILTNNLFGIEIDERAGELAAFALIMKARAKQRRFFRNPIQPHICVLENVHFDEGELNEYMDVIGHDLFTNELRDTLDQFEQAKNFGSLIVPKLSDPAETLRLVEARDFSGDLLLNDVQARVVAVLRMAEALSPKYHVVVANPPYMGGKGMNGKLQDFAKECCPDSKSDLFAMFIERGFNLVPRLGYSAMVTMQSWMFLSSYEKLRVKLAENSSINAMIHMGNMVMGIAFGTAGTVWKSRGMVSDKGAFCFVDYEDLDGEGKPLVFPPHNERNSVAANDGWLYRASAEDFEKIPASPIAYWVSDEVRDIFYDNKALKEIIAPKQGTSTGDDETYVRFWHEVDETLIGFNYSTLTAALNSEKRYFPLDKGGEFRRWYGNNEKVIKLGRKSYHELLELGNHLPSRDKYFLSGITWSKITSFKISVRYDDVGFVFSSVGLKGFPTLKDEHRSIAYMNSKLVSVFTEILSPTLSIVSGDIEKLPYKFVSDNLLPTNTSNLIALAKSDWDAYETSWDFTTLPLLQPDYRAETLELTYTALHTHWQGKTGDMQRLEEENNRIFIDAYGLQDELTPEVPLEEITLTCNPAYRYGGKASVADRETRLRADTVAEFLSYAVGCMFGRYALDKPGLILANQGDTIEDYLKQIPEPSFPADDDNVIPMLDGDWFNDDISERFREFLRITFGEEHYEENLRFVEQALGKDIRKYFLKDFYNDHVRRYKKRPIYWLFSSPKGSFNALIYMHRYRPDTVSVVLNDYLREFRTKLTSRRDHLEAVSISASASSAEKTKAIKDIEKISKIIVELGDYERDVLYPLATRQVEIDLDDGVKVNYPKFGDALKKITGLSG

SEQ ID NO: 3161 - protein, 1221 aa, Escherichia coli; identical to SEQ ID NO: 2958

SEQ ID NO: 3162 - protein, 716 aa, Lactobacillus casei
MPRDDFDVEKEGQVEIIGWLYQYYNEEPHDQVVNINGGPVKTDDIPAATQLFTTDWVVRYMVDNSLGKKYLEHYPDSPVKGKLKYLLPGDITPDQSDFDITRIQVMDNAMGSGHILAYAFDVLMAMYEDQGYAKREAANSIIQNNLFGLEIDQRAFQLSYFSLMMKLRQYDRQALNGGVMPNIHVFVAAPTVTEEFLHALKASSEVVDEIKDIAAHFMDAKTLGSIIELPANYDYAGMRNALEPVATAQKISLFGNQQTAQQLLEIIATAETMTQRYDVVVTNPPYLNKMNSTLKKYVKKHYKDYSADLFSVFIWHNINMTKVNGYAGYMTPFVWMFIKSYEKLRTALLSNVKIDSLIQLEYSAFEEATVPINTFVLKNTKNDETGTYLRLSDFTGGMEVQRQKVTAAIVDPSVNYLYRTNQTNFNKIPGEKIAYWATTTIYSAYQHGTLQKVATPRLGMATADNTRFLRYWYEIDSRDICFSAQSRKDAVATKKKWFSYEKGGEYRKWYGNNQYVVNWKNDGYQIRHFAGEEGKIRSHNYNLDYIFNPGITWNALSSGSFSSRIVLEGHLFDNAGSMMFLKNPQDIWYLQGLLSTPVVAQLLTLLNPTMNYQPGTLSELAVIKDANKYGIISDKSHACYQLSKEDWAYQESVPDFSTLFLLAHIAEHTVLVICHIHRRISKIRVTAKHPFKKLATWWHKIQNVPKKCQAFGLGGH

SEQ ID NO: 3163 - protein, 1207 aa, Lactobacillus casei
MDKKKIHDFAVKARRELIESVELKLTQVGITRDGVKEKLPTSTAEIAFYVPNDTEGVSGRDTSRRVSLVQLLQTAAAKDDWHTAYDNLVEEASYTWFNRIIALRFMEVNHYLPSRVAVLSSEEGRAEPDILAHALEIEDDLGGFSDEQRDLIQHAQETQEPAAMDNAYRLLFLKQANALNANLPHLFEKTTDAFQLLFTPSYQNGVIKELVTEVPRDDFDVEKEGQVEIIGWLYQYYNEEPKDVAFKKSKYAVSDIPAVTQLFTPDWIVKYLVENSLGRYWIDVLHTRGNQRSEQDIAQSFGWRYFMPAAQQTEDVQQQLLAINSHLSDKKLQQITFLDPAMGSGHILIYAFDVFMQLYQSEGYSAREAANSIVTNNLFGLDIDRRAYQLAYFAVMMKLRQYDRRALTQSVEPQLSDIPKTNILNDDLNELTRAYANQLSQQQAKSFQGTVKEFNRGDVLGSLIKPILDQEILSELQASAATEPESTQLSFATTNFNFEEMSRITRVLTILAAQYTIVVTNPPYMGSGKMTPSLSKFVKREYPDSKADLFAVFMELAQKLNVQNGYHALITQHQWMFLSSFEKLRVKLRKNVLVNMAHLGTHAFEDIGGEVVQSTAFVMKNASIPSYVGTYERLVSAPSQTAKEDSYLEMVKDPTCRGLYRTNQTNFQQISGNPISYWASTKDFQNFYNLPALSSLSLVKKGMFTGNNSMFIRQWTEISYPRLCFQLEAVAEVPTNGYVPLNKGGAYRKWYGNHTDCIRFDSDAYNRIQKNGGHRSPDLYFRPNLTWTKITSGAPSFRYSKKGYINNDASMIVYQQGAITLFQILSVVNSKIASHYLSLLNESMNYTAGDIARIPLTSKIPDRAVQIVRECIQQSTDDWNSQEISWSFLCVPFLCNIAEHNRNWTVEAAFNQWKQEAQDRFDQLKKNEEELNKIFIDLYGLQDELSPEESDKEVSVRKADRKADLGRDIRAFMSYFIGVTFGRYSLDTPGLAFAGGDWDASKYTSYQPNADDVIVLTDSDYFGDDRDIMHRFREFLTVTFGKEHLEENLTFIAKALGKAGDTAEDQIRSYLFNDFYKNHLTIYQKRPIYWQLDSGRQGGFKALMYLHRYDGDTMAMIRTSYLHTLQAAYEKRVTTLDTFIASETNTRQKNQLIKQRDHTRKQLEELVKYDAQLQHVANMHIAIDLDDGVVVNHQKVQADVKLLTPIK

SEQ ID NO: 3164 - protein, 1210 aa, Enterococcus faecium; identical to SEQ ID NO: 2960

SEQ ID NO: 3165 - protein, 1253 aa, Glaciecola lipolytica
MKLADHVDHLRELIEAAFDKQFSRLGFSKTKQMDAIQVEKLPEEVKTKRERFAVMLENHIGETGGYESAREKLLDELTFTLFNRLAAIKVMEAASLFPPILTKQKEHGDRSFGHKAWLEMNPHMRDEELEGIRDYLKSAFDELGQTLPLYSKAYPYALLPDAISLNDIIDAFNVVDTDAQANDSSEETIWQSDDVLGWMYESYNNAKKKAHKDSGDKTEYNKVSLQSQVYTPRWVVQFLVENSLGKMYLEMYPHSEIKQRYKIANAPTTQIRAPKPLHEVRTIDPACGSGNFLLYAFDFYYELYLDQIENYGADYDEKDIPKLIIENNLHGIDLDDRAIQLAQLGLFIKAKKKRRTVGELHFKVVSSDFYLPEYAAVKHIFEQGNLVSAQQREFIEKVWGDLMQAYKFGSLIHIDKELKEQLSQVKERALGETFDSTQKLKKKIVEGDLFAAADYAEHQEFAENFFANLFAAVEQYARTERNTFLSGKTRDAITFLELLTSEYDLATANPPYTDSADFGPDLKEFIEDNYKKPHKFNTNLYATFIKRCCELTDKDGKVAMVHPPTFMYIKTFEDVRKYMIEKTSIDLFVEWGYLGMFHQSARVDAAMYVLDKNKQEKDSTFIKLNHIYEGKRYNAFVEAYDNLIDGVAYQNNYTIPQSKLKIIKSWPFIYWISDDFRQKFKSESVKDLLKNCQGLATANNNRFLRFWWELSSSDFNIDGNDWVYYAKGGPYKKWSGNLWLMVNWKSSGQDVKNYTDDKGKQKSRPQNEAVYFKEGITYSASGSKGPSYRILPKGCIFDVGGSSIFPIKKYKNTHYILAFFNSVLSNYIIECLNPTVNKQVGDIERIPFVIPDKTQETLIEFLSQRNVSISREIRATELFDGEYDKSPLLSFHSGDWRSAITSLLNRENHFRTQILINEAIINETIFEIYNLTEHDKAMVLAKEGVSIGGLPVTSEARKDYLAETEATKTFPLDATREFIEALPIKEFRVEEREAIESGFGSLYQSNNDLEEFCIRHQVNPINVWYWFKQSKVIPKQRMQTLAMEFLADMVREILMEDEDGIIPLVPNAGEKVLLDRIEEKFLEKGFSTAQYSSFDSVLGRQIHDYLNKYFFAELSDHLNLFMYLPKTPFIWHLTSGPEQGFDCYIIIYKWNRDNLLRLRSVYIENRERALQNRQSDIAGNESAEAQNEKERIFKQLKEIDAFKKKIDELLAEGYNPILDDGVGKNIAPLQKKKILAYDVLNAGQLKKYLNADW

SEQ ID NO: 3166 - protein, 335 aa, Oribacterium sp.
MGKLISNKYAAWKQECEDRFQQLKANEEELNRIFIDIYGLQNELTPEVADKDVTVHRVFDSKENMPESMKGSNYVRTMRDEIVSLISYAVGCMFGRYSLDVEGLAYAGGEWDSSKYQSFIPDADNVIPITDEEYLDDDIVSRLCDWLKVVYGADTLEANFDYIAKALGNKGSTSREIIRNYFLNDFFKDHCQTYSVTGSGKRPIYWLFDSGKQNGFKALVYLHHYTPDTIGNLRVDYLHKMQRIYESEINRMQDMIDHSTNSREVAAATKRKEKLQKQLKECREYDEKIGHLALSRIELDLDDGVKKNYRKVQTASDGKFYEVLADSNNIMAKEK

SEQ ID NO: 3167 - protein, 888 aa, Oribacterium sp.
MNKSSIKNFAIWARNKLIADISYRAGLIGITADGIKNALPQSIGTTEFYDIGTAEPYSISGDAVKQRRKLVEVIRQKEKDTDYQTAYKYIIEEVAYTWFNRLIAIRFMEVNDYLPSHMRVLSSDTGKLEPDIVTNPFDAELDFTGDEEHIIMQLKNDNQLDDLFRMLFIKQCNSLNALLPALFEKTQDYTEILLNLSVIDQEGVVYKLVHDIDEDDFNIEKGGQVEIIGWLYQYYNTEPKAAAFAKNGKITKEEIPAVTQLFTPNWIVRYMVENSLGRLWLEGHPDCGLKENWKYYLEEAEQEPEVQKKLAEIRREYSVLNPEDIKMIDLCMGSGHILVYAFDVLMQIYESAGYSQRDATKSILEHNIYGLDIDDRAYQLAYFAVMMKARQYNRRILNGENSCHVYTIQESNGINRAHLKFFGAEMDDIEKNAAKMQLEGLLDNFTDAKEYGSILNVESYNWDLLRRFVAAEDTAGQISMDSVGVEDTAEQLNRLIDIGEMMARKYWITVTNPPYARISNLSAKVNNFVKKNYPDSKADLFAVFIERCRQMTADNGYQAMITQHSWMFLSSFEKLREKMMLTETVNMAHLGARAFEEIGGEVVQTTAFVRCANHIDGYKGTYCRLIDPTSQQGKEDMFLAGKNRYVAIQSNFAKIPSSPVAYWVSRELFDCFDGKTISQIGTLAQGLITGDVNRFTRFWYEVNIQSFIGSATKTSDVIELKRKWVPYNKGGAYRKWRGNDEYIVNWANDGFEIKHFVDDEGKLRSRPQGVDHYFKEVITWSKITSAKISFRFKPHGQISSEAGMTIIVPQKYEAYILSFCNSCVAESILKIVSPTLNCELGDIGCLPVHIVDDQLPQIDKCVLGCETISKSDWDSYETSLDFKRNPLV

SEQ ID NO: 3168 - protein, 1246 aa, Vibrio cholerae; identical to SEQ ID NO: 2910

SEQ ID NO: 3169 - protein, 530 aa, Escherichia coli; identical to SEQ ID NO: 2979

SEQ ID NO: 3170 - protein, 634 aa, Escherichia coli; identical to SEQ ID NO: 2980

SEQ ID NO: 3171 - protein, 267 aa, Escherichia coli; identical to SEQ ID NO: 2972

SEQ ID NO: 3172 - protein, 693 aa, Escherichia coli
MIQKLTTLGIAADKKGNLQIAEAETIGETVRYGQFDYPLSTLPRRERLVKRAREQGFEVLVEHCAYTWFNRLCAIRYMELHGYLEHGFRMLSHPETPTAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQQLNFHQQVQTGSMGDMFAENTALTQTDSAEYQLLMRSLKRFVNAKTLGSLIQVPQEEEAELKAFLDALYQLEQEGDFQQKAAAKAFIPFIQQAWILAQRYDAVVANPPYMGGKYLAPAVKNHLKENYSGYDKDLFSAFIIRNLQLSKNGAQLGFMTPFVWMFISSYEELRLQLINNETIISLIQLEYSGFDGATVPICTFTLQKNHISNFSGSYIRLSDFRGAANQGPRALEAINNKDCSWRYQTNQESFKKIPSNPIVYWIKPQTSILFTNKKLVNSMRLKKVLVHVMMIYFCVDTGKYQEKKQKLTRV

SEQ ID NO: 3173 - protein, 1251 aa, Vibrio cholerae
MKLADHVDHLRELIEAAFDKQFARLGFSKTKQMDATQVEKLPEEVKAKRERFAVMLDNHIGETGGYESAREKLLDELTFTLFNRLAAIKVMEAASLFPPILTKQKEHGDRSFGHKAWLEMNPHMRDEELEGIREYLKSAFDELGQTLPLYSKTYPYALLPDAISLNDIIDAFNAVDTDAQANESSEETIWQSDDVLGWMYESYNNKKKAEFKDEQKNNKAKTEYNKVSLQSQVYTPRWVVQFLVENSLGKMYLEMYPYSEIKQRYKIANAPTTQIRSPKSLHEVRTIDPACGSGNFLLYAFDFYYELYLDQIENYGAAYDEKDIPKLIIENNLHGIDLDDRAIQLAQLGLFIKAKKKRRTVGELHFKVVSSDFYLPEYEAVKHIFEQGNLVSAQQREFIEKVWADLMQAYKFGSLIHIDKELKEQLSQVKELALGETFDSTQKLKKKIVEGDLFAAADYAEHQEFAENFFANLFAAVEQYTRTERNTFLSGKTRDAITFLELLTTEYDVATANPPYTDSADFGPDLKQFIEDNYKKPYKFNTNLYATFIKRCCELTDKDGKVAMVHPPTFMYIKTFEDVRKYMIEKTSIDLFVEWGYLGMFHQSARVDAAMYVLDKNKQEKDSTFIKLNHIYEGKRYNAFVEAYDNLINGVAYHNNYTIPQSKLKIIKSWPFIYWISDEFREKFEHSSFDDTAMVVSGVKTGDNDRLLRFWWEVDPSDISVAYLEDKKTWVPYSKGGDFNKWFGNIWLCVNYKNDGQEIKKSKNYNLLLPSKSFKKGITYSATSTKGVSFRLLEEHCLFDMKGSSIIFADSTKTEYGLALLNSKLSSYIANCLNGTVETQVGDIKRIPYAEKNKNKIEKLSTDSINIKKHLQQYSLVEYLFKASPLDIYARDLDYKNSIFSYLIYENHLLAQVLINEAIMNELIFQVYNLTEQDKLMVLAKEGQSIGSLPVSNEARDAFLAEEATIEFPMDTIRDFVGSLQTREFSDEERELVESEFLNLYQDNNDLEAFCIRHQINPINVCYWFKQSNKIPLQRMRKLAMEFLANMIREILTEDEDGIIPLVPNAGEKVLLDRIEEKFLEKGFSSAQYSSFDTLISRPIHEYLNRSFFTELSNHLNMFPNLPKTPFIWHLTSGPEQGFDCYIIIYKWNRDNLLRLRSVYIENRERALQNRQSDIAGNESAEAQNEKERIFKQLKEIDAFKKKIDELLAEGYNPILDDGVGKNIAPLQKKKMLAYDVLNAGQLKKYLNADW

SEQ ID NO: 3174 - protein, 588 aa, Methanoplanus limicola
MTSENKIIAESESKSRSSNPVPNFYRASAEDFRKIPGSPIAYSLSNNIRNIFCAKPPLGNIVPTRVGLMTSDNDKFMRFFWEVTLNSICFNALNKEEVFRSKKKWVPHNKGGQFRKWSGNQEYLLSYDKKSRDLLKRIGNHLPSEKLYFKPAVSWSEITSSSTAFRYYPNGFTFNIKGMCAFPDLKCTIEQILVLGNCKFTNHIIKIINPTISFGAGNFNSLPSAFIENSKIEENAQSLICYAKNDWDSYETSWDFENLPLLRAEFKCLTVEESYSRVRAHWQEMTDEMQKLEEENNRIFIEAYGLEDELTPDVPLSEITLTCNPYYRYKGDKSEEELEALLLADTMKELISYAVGCMFGRYSVDKPGLILANQGEAIKDYLEKVPVPSFMPDDDNIIPVLDDEYFTDDIVTRFKEFLKVAFGPENLSQNFDFIAGGLSGKGSLNQAHGSGSGSASSESVIRNYFIKDFYRDHLKRYKKRPIYWMFSSGKSQGFNALIYMHRYDKSTLAKMRTDYLLELESKLISERGMLSDTSAGNKKRIDKINKQIAEIKEYDELLNNRALAMIEIDLDDGVAVNYAGFEGLVQKI

SEQ ID NO: 3175 - protein, 611 aa, Methanoplanus limicola
MDKAKVLAFSGTLRNSLLEETKKRAAHFGIFPGETLEVEREFEDSVIIGGKIFSVKIKKQREVLVREIRQKGYMQVIEEITYIWFNRFVAIRFMEANGYMPVRVFSSKDEGRNEPEILTKALNLKFLHLDRDYVLDLKSEGEDEELYRYLIMRLCNYLHITMPFMFENIEDYSELLFPERLLHTDSLLGCLNDIISEDDWREAEIIGWIYQDYIADKKDELMKAKKAYAPNQIPAVTQLFTPKWIVQYLVENSLGRLWMLNRPDSGLCEEMEYYIIPEEKEKDFLRIFSPEEIKVCDPACGSGHMLVYAFDLLCSIYEEEGYSESEIPEIILKNNLYGIEIDGRAGSLAAFALVMKARKRNKKFFDSPVQPNICVLENIEFDDEELKDYMASVGNNLFSTGLKETLLQFKETDNFGSLIRPAATGTDPSETLRMLKEKNLSSSLTLFATHKKVKRALEQADYLSRKYHVVVANPPYMGNKGMNSDLKKFAKDNYPESKSDLFAMFIERNLDLSVKKGLIAMITMQSWMFLSSYEKLRDRILDNETILTMAHLGPRAFDSIGGEVVSTTAFVIENNHKPDYKGAYIRLVDGRNEDEKKRSLREAVVQSGKII

SEQ ID NO: 3176 - protein, 1112 aa, Methanoplanus limicola
MTVLTDTERKGLEKSVLDAHRKAEAGAVNALNYLGVEADKKPFHLSDAEAELRRRLRSEMRRLGSYDVLISSVAYEQWHRMLFARFLLENDLLIHPKFKVPVSFSDITEIADEKGSEAWEVAAEFASHMLPGIFRQDDPFLMVKFSPEDRISLQGVLDGISSESFMAEDALGWTYQFWQSEKKKEVNDSERKIEGYDICAVTQLFTEPYMVKFLLENTLGAWWLSLHPDSGLKSEWEFYRSEVEHDFSGWPSDIDELKVLDPCCGSGHFLVRAFHMLLSMRREKGEEDEAAISAIISKNLHGLELDPRCIQIATFALALEAWKEGFSPTDSYLPVPNLACTGIPIKAEKEDWLKLAGGDGMLESALENYYELFKNADSLGSLIQLDTSQNNKSGKTGKSGKHNISDKSGKKFSSGTDNSFTQSLIDQDTLMEKLEQALKKETAAGDPVAETFGETANAIMKAAHLLNSRYDYVVTNVPYLARGKQSEIIRNFCDLNYPLSKIDISTVFLERCLSLVKKRGRVSIVLPQNWLFLTRYRKFRENLLKNEICEMIGKLGSGAFETISGEIVKAILINLIHISPPKDQILFGFDVSNKICASDKAASLISENIMHIEQAKQLENPDSRIVLCEKSTTGKLLSEYAESYSGLFNGDSPHFLKFFWEIYQLNELWCFQQTTVNKNVTFGGLNLIIYFNFAEGHLREEAWIRREKLHDSDKRGNKVWGKIGITISQMNKLPISLYIGTTFDSNSAVICPFNQDLVLPIWTYCQTEDYYNEVRKIDQALKVTNQTLAKVPFDLEYWQKVAAEKYPDGLPEPYSDDPTQWLFHGHPKPSESPLHVAVARLLGYRWPAETDTEMELSSEARDWIKESEKLLSFADDDGIVCIPSVRGEGRMDERVREVLKAAFGSEWSARHEEKMLADLGYVKKDGSLKGDLEKFLRDEFFKSHCKLFHNRPFIWHIWDGEKDGFSVLVNYHKLDRRNLERLIYSYLGPWISQQEREKADNKAGAEKRLVAAKELKRRLELILEGEAPYDIYVRWKPLHEQAVGWEPDINDGVRLNIRPFVEAEVLRSKITAIKWGKDRGKDAVPNCSGTVERHNDLHFTLEEKRKARKEAE

SEQ ID NO: 3177 - protein, 1246 aa, Vibrio cholerae; identical to SEQ ID NO: 2910

SEQ ID NO: 3178 - protein, 1224 aa, Escherichia coli; identical to SEQ ID NO: 2815

SEQ ID NO: 3179 - protein, 1246 aa, Vibrio cholera; identical to SEQ ID NO: 2910

SEQ ID NO: 3180 - protein, 1246 aa, Vibrio cholerae; identical to SEQ ID NO: 2910

SEQ ID NO: 3181 - protein, 1179 aa, Bacillus cereus
MNKTAIKNFAVSARMKLIDAVKQKAYELGITETEIKEPETYEDGFRINNKFFRSYELEQRKKLIQKIEEKDYKQVIEEVSYTWFNRFIAIRFMEVNEYLPTGVRVLSSTQEGKNEPDVIGEVTNIAEDLDLNLDIVYRLQDENKTEDLFKYILIKQCNKLGEIMPMMFETIQDYTELLLPDNLLGEGSVVRNLVSMIDEEDWKEQVEIIGWLYQYYISEKKDEVFADLKKNKKITKENIPAATQLFTPKWIVKYMVENSLGRLWLESHPNEDVQQQWKYYLEEAEQEPNVQEQLEKLKNNELSPEDITVLDPCMGSGHILVYAFDVLYNIYQHAGYSEREIPQLILEKNLYGLDIDDRAAQLAYFALMMKARSYNRRIFRRPLELNVCSIQESNGIPQEAIDYFVGDSLDRDEITYLIRVFEDSKEYGSILEVLSIDFVSIEKRMIEIQEMQEVKDIFSLQYSDILLIKIPQLIKQAKIMSSKYHVVLTNPPYMGSKGMNEQLKKYCTKFFKKGKRDLFAVLMLKCFNFTKEGGYISNINQQSWMFLSSYEEIRKYFLSESTICSMIHLGSGSFEEINGEVVQSTSFVLKKQVVKNYQTPFIRLVEYNDSQEKKLSFLEKKERYIVAADLFLNVPGYQIAYWATQKMLVAFSENKVLGDLYDPRQGLATGDNDRFLRLWHEVDKVRINWGALSISDAHESKIKWFPHNKGGRFRKWYGNNEYLISFNIESYNTLAKQGNCLPSKQLYFKSGITWSRTTSNLLGVRLHNQGTIFDCEGCFLSAGNTRDDYYLMAFLNSNVAFVFLEKINPTLHFQVGDVRKIPLMTFNNLLEAKMDLITSCISISKRDWDSFETSWGFIRHPMLTHKNSSRRLSEVLDYWSVFAEQQFNQLKANEEELNRIFIEIYDLQDDLTPEVKEKDIVIRKADKERDIKSFISYAVGCMLGRYSLDQEGLVFAGGEFDESKYKTFKADTDNIIPITDDEYFEDDIVSRFIEFVRVTFSEETLEENLDFIAEALNKKANETSRQCIRRYFLKDFFKDHVKMYQKRPIYWLFDSGKNDGFKALVYMHRYDVGTVAEVRTDYLHTLQRKYEAEIARRDVLLESDASTKDKTRAKKEKEKLQKQLLECQQYDQVIAHIANQKITIDLDDGVKVNYAKFQNVELPQGEGKKPLKANLLAKI

SEQ ID NO: 3182 - protein, 1246 aa, Vibrio cholerae; identical to SEQ ID NO: 2910

SEQ ID NO: 3183 - protein, 536 aa, Salmonella enterica
MQSGDNEKFYRLWHEVNNSEIVRNISALTNTKGKKAWVPLQRGGDARKWYGNNLYIVNLSDEGADIKRTKNASLRNADHYFNISATWNRLSQTRFYVRHVEQGYAFDDLSPFANSYLAEKHYEHLGLLASSAARYLISFISTGRKTEVGHVSQIPLPTTFNSGEAVSTICKKLIELSKNDWNSYEESAGFIKPSLLDNVDKINSLCNLYKKQCASWQRSIFEMQRLEEENNRLFIEAYSLQTELTPEVSINEITLTCNPYYRYGGNRTDEELKAMLQSDTVAELISYTIGCIMGRYSLDREGLVYAHAGNEDFKALVEEGAYARFPADSDGILPLTVEAWFEDDIAARVVEFVRTVWGVEHLEENLQFIADSLCLAAIKPVKKGGETSRETIRRYLSTQFFKDHLKTYKKRPIYWLFSSGKEKAFECLVYLHRYNETTLPRMRTEYVTPLLGQMDSRIERLRLQQNEAETAEAKRIGKEIDSLTKQLTELRSFDDQLKHYADMKIQLDLDDGVKVNYGKFGTLLAEVKAITGDKAE

SEQ ID NO: 3184 - protein, 675 aa, Salmonella enterica
MNTANLKKIAPRARTAFITAIKARAAEFGITAKGHIEPVISGEVLQVAGFTHPSSCASALKRLQQRLANDSYETLIEHVAYTWFNRFCAIRFMELKSEEGYLEHGVRLLSHPSQPLGFEVLDRAPEVIDNLITEGVALDKSALLDLLLAGNEQEALFRELLLGQCHRLHQAMPFLFEAIDDETELLLPAGLTRTDAFWRELVDKIPEADWQQVEVIGWLYQFYILDEKERVDKKVKAGKVVNPTEIPAKTQLFTPNWIVQYLVQNSIGRYWLQTYPNSRLQQSMHYYVVHGNQSTELKDKLSYFAPDSIDPESIKVLDPACGSGHILVESYNLLYRIYEERGYRSREIPELILKHNLFGLDIDERAAQLAGFALLMRARQDDRRLFTRGIRPHIHALQESRHLNISNLWQMLNLNTDWTAGQVQDMFTVLPQSLVASNPHFSLLNDLYLRFLDAKTLGSLIELPTEQKQIIHEFYAILQDLSISGDAMQKTAAKALLPLLAQADVLCRHYDAVIANPPYMGGNSMNYGLKKFAEEKFPDSKLDMFTMFIERGFKLVGEGGFNAMVTMETWMFLSSYKKFRLNISSCSSIVTLTHLEKMLMGIAFRTVATVWKNIKGDKTPGIFSFVGKDDVNKNGIPFHFYFRLRIMAFHFYFRLRISDYHIFPVIVLRISLEHQ

SEQ ID NO: 3185 - protein, 1251 aa, Vibrio cholerae; identical to SEQ ID NO: 3173

SEQ ID NO: 3186 - protein, 830 aa, Collinsella aerofaciens
MNDSALKSFCTWARTELIKGVEAQMVRYGITEPAPAPAGSETVNSLPLSPAEIEQRDELLRMQAEVGHEALRDRAAYTWFNRIVAIRFMDAYGWLPSRMRMLSRADGSHGSEAVENALDVEITTADTDRIAELKMAGLDEPLWRYLFVAQCEELADCLPGVFERVGGAMELLLPQGLMMADSVVGKLNAVLTDEDWREGVTVLGWMYQYYNADVKDEFFKSKRKAAAADIAPATQLFTPEWIVRYMVENSLGRLWMLNNPGSSLRERMEYYIEPDAEHEDFIRISSPEEITLCDPACGSGHILVYAFELLFHMYEERGYREREIPELILTKNLAGMEIDSRAAQIAELALAMCAREHDRRFFGRGVRADVTVLSSIPLGEDELPGNKKLAEELSHLGEIGSLLNPSEDEIDELKAAAASCSDDLFASATKTKLESAVAICEKLSRRFICVVANPPYMGSSSFNPFMSKWIKKNYPDVKSDLCTCFIERGFNLVEDKGYAAMVTMQSWMFLGSFEKMRAKVIDNKTIVSMAHLGPRAFDAIGGEVVNVTADVIYNQHSDAEGAYVRLVDINGSEAKRLKLVEAIQNPDCGWFYRCDAGTFKQIPGTPIAYWASDALLDAFGNAKQLSEYGKPRQGLATGENARFVREWWEVDDCKSVYSCGSIQESIENACKWFPYNKGGDFRKWYGNNECVINWESNGHLVREFAGSVIRNPDCFFMPSITWSKISSGSIAFRFKPAGHIFDVAGTSVFSDEESLKYLQGACNSSVIMRVASMLSPTLNFEVGQIATYPIIQNKEQEPLVNDMVDSCRELSKTDWDSFETSWDFKHNPLV

SEQ ID NO: 3187 - protein, 322 aa, Collinsella aerofaciens
MATLLQDKYEARKAEVNARFEQLRANEEELNRIFAKIYNMEGEVPIEVEDKYVSVARIFDTADEIPESYKGNKYVRTKRDEITSLLSYAVGCMFGRYSLDVDGLVLADQGTTVDDYLAKMPDPAHVTFMPDADNVLPITDDEYFDDDIVRYFIDFVRTVYGEETLERNLAFIAEALGGKGTSREVIRTCFLKDFYKDHCQTYKKRPIYWLFDSGKKNGFKCLVYMHRYQPDLLARIRTDYVHEQQERYRAQIGYANDALVSAERGERVRLDKRIKKLNDQLKETIAYEEKLHHLADQMIKIDLDDGVKVNYAKFQDVLAKIK

SEQ ID NO: 3188 - protein, 1210 aa, Enterococcus faecium; identical to SEQ ID NO: 3021

SEQ ID NO: 3189 - protein, 1246 aa, Vibrio cholerae; identical to SEQ ID NO: 2910

SEQ ID NO: 3190 - protein, 1200 aa, Bacteroides sp.; identical to SEQ ID NO: 3001

SEQ ID NO: 3191 - protein, 1222 aa, Vibrio cholerae
MNTNNIKKYAPKARREFMDAVAKRLNTFGITANKKGELQIAEANLQGSVLQIAGNSFDGKLAEPRKRIVARSQKLGYAQLIEQVAYTWFNRLCAIRYMEIHDYLGHGFRVLSHPASHPDNSQGAGATNKGRFEIIDHAQDAADELGLDRARIVELKLAGNKDEELYRELLLGQCHKLHEAMPFLFDALDDETELLLPDNLTRTDSILRGLVDGIPEEDWQQVEVIGWLYQFYISEKKDQVMGKVVKSEDIPAATQLFTPNWIVKYLVQNSVGRQWLQTYPDSAIKTQMEYYIEPAQQSDEVNQQLKAITPESIEPETIKVLDPACGSGHILIEAYNVLKAIYEERGFRSRDIPKMILENNLYGLDIDDRAAQLSGFALMMMARDDDKRIFTRNVRLNVLSLQESNHIDLPTLWKALNLSGSWQSGTSQGLFSDDEQDLSSFNADNRYQLLTRTLARFTQAKTFGSLIDVPSDDYEHLKELLSTLVELQESGDSMQKPAAKQLIEFVHQALVLSIRYDAVIANPPYMGGKGMNADLKDFARKYYPNSKSDLFAIFMERAFKLLSQYGFNAQINMQSWMFLSSYEQLRNNLLEDHTFITMAHLGARAFSQISGEVVQTTAWVIRQQHLKQYQPKFFRLVDGNEEEKKKALLDRENEFEATAQDDFKKIPGSPLAYWLTTEEIKLFSEYEQIGSIATARQGMATGDNEKFVRYWHEVSHLECNFNAKNKSEHWSTFKRWVPFNKGGTLRKWYGNHENILAFSQEDYSELKKMGNHCPSEDLYFKPSVSWSKVSSDNFSVRYYPEGFIFADAGMSIFSEDKLNSIAGVLNSKITKILASAISPTLNYEVGVIRQLPIISINDSLVLKAINISKRDWDEYEFSWGFKMNPLLKYKGDLIRQACEFLVGENKKITEDLFNVEVEINQALEIGTNIKVSPVELNEITLFANPLFRFNRTNHSESLNLLVSSITTELVSYSIGCMMGRYSLDLEGLVYSNSSNEGFDKLVAEGAYSTFPADEDGIIPLTDQEWFKDDATNRFREFVQVVWGEEHLQENLDFVAESLCLNAIKPKKSESALETIRRYLSTQFYKDHLKTYKKRPIYWLFSSGKQKAFDCLVYLHRYNEGTLSRMRTEYVTPLLGKYDAYAEQLEKQIETADSTSEANRFKKELDALIKKQVELREFDDKLKHYADMRISLDLDDGVKVNYGKFGDLLADVKAITGSAPEVN

SEQ ID NO: 3192 - protein, 1190 aa, Vibrio cholerae; identical to SEQ ID NO: 2955

SEQ ID NO: 3193 - protein, 1246 aa, Vibrio cholerae; identical to SEQ ID NO: 2910

SEQ ID NO: 3194 - protein, 1210 aa, Enterococcus faecium; identical to SEQ ID NO: 3021

SEQ ID NO: 3195 - protein, 1200 aa, Fusobacterium sp.
MNKSNLKLFAIEARNELMEKMRTRLDILGITKKGIEKAKVVGREVEINGSLYPKESYNSLVRKYKQIGYEELVEESAYTWFNRLTALAFMEANEYIEEKMIFNNGLKNEPGIIDNYYDFEFFKNLDSELQKELHNLRDENTANSIEKLYSILVEEKCEELSAIMPFMFKKKGTYSDILFPTGLLLENSLLIRIREEIGKEAPIELIGWLYQFYNSEKKDEIFAKKEKISKENVPAVTQLFTPDWIVKYMVENSLGKLALESTGINESLKTNWKYYIESELDESSEKIKIEDVKILDPAMGSGHILVYAFDLLFEIYENLGWSTKDSVLSILKNNLYGLEIDERAGQLASFALMMKAREKFSRLFSVLKREETFKLNTLIIEESNNLSEKIKNKVKDNNLNNLSKIIEDFEDAKEYGSILKLETIDKETLEKEFNLLKESLDNEQGTLIFNEDELDINIEEDLELIESLIVQHIALTNQYEAVVTNPPYMGGKGFSTKLKAYTEKNYKDSKSDLFAVFIERCNEFTKKNCYTSIITMQSWMFLSSFETLRKNIIEKTEIKSLNHLGTRAFSEIGGEVVSTVAWISQKKSPKNDGIYLRLVDYNNADLKEEEFFNKANYFQAKQKDFEKIPGSPIAYWVSDKVREIFEKNQKLGEVGEVISGMTIGKNDLYLRKWYEVNNYKINLRKLKIDEINLEKNPWIPYSKGGEIRRWYGNNEWIVNWRCSNKFNRAKTTLKHLYLKEALAWNFISSSNFSMKYLENGYLWDIAGSPCFFKKELVNYVLGFLLTNFSQNILNIMNPTINYQAVDIQNMPFLYAENKANEINNLVQQNIDISKEEWDSRETSWDFEKLSLVDGKDLRTAFENYCSHWRDNFVQLHKNEEELNRLFIEIYELQDEMDEKVSFDDITILKKEAKIVEIDNSKAREFSSESERYLYDRGVSLEFNKDELVKQFLSYAIGCIMGRYSTNKPDLIMANSDDVLELSSNKFLVKDTNGDIRQEVETEFLPDEFGILPITAEKDFSNDIVERVKEFVKFVYGEESLKDNLNFIAEALGNKDNKSAEEILRAYFITAFYKDHLQRYQNRPIYWLMNSGKKNAFSCLFYMHRYEPLTVARVRADYLIHYQEMLENKRKFIERQLYAEDITAKEKKNVEKELKDLDVLLKELREYANEVKHIAEQKIVLDLDDGVNVNYERLGAILKKR

SEQ ID NO: 3196 - protein, 1251 aa, Vibrio cholerae; identical to SEQ ID NO: 3173

SEQ ID NO: 3197 - protein, 1181 aa, Aurantimonas manganoxydans
MSVDLSRLKAYAPQARKDFRKAVMERAARIGITAGGIVEAQRQGDVFVVGGTAYDKTFGKQRDALISKVKTEGFDQAIEGIAYTWFNRLVALRFMELHEYLDHGFQIVGPGTAGGTLPEALVNAELLNLPRLPINSVREMKIAGDYEEKLYRAILIAQCNALSETMGFMFEKIGDATELLLPDNLLATDGLIRKLVQNSDTASWQDVEVIGWLYQFYISEKKDDVFDKLKKKNIKITAANIPAATQLFTPHWIVRYLVENSLGRLWLLNNPSSRLAEKMDYYIAPEEPETDFLKIGSPEEIKVCDPACGSGHMLTYAFDLLYMIYEEAGYRARDIPALIIEKNLQGIEIDDRAGALAAFSLTMKARVQDSRFFTRSAEPQICVLEDIVFTETEMRDVSAVVGNNLFTDELGETLGQFEQAKNFGSLIVPKLRDPAETLRVVEAREFGGDLLLKEVQERVVAVLRMAEALSPKYHVVVANPPYMGGKGMNGKLVNWAKEHYPNHYSDLMTCFMDRASILCLENGKWGMINLPSWMFLSSFEDTRRQLINHLTVESLLQLGRGIFGSDFGSVAFVVSKRQHFPGHKGTYRRLFERHVDVRKPETIRDLFLDRDVGYFPLSQEEFRKIPGLIFAYWISEKERDLYSSGELLKDISAPRKGMDTGENEHFLRFWHEVSQDRADLTGGQEQGRRWVPYNKGGEFRRWYGNRDIVLNWEGNGSEVKSRLTWKKKKPTIRNSKHFFEEGFTWTTVSSGGFSARYSPKGAVFDNGGCTLFADSDLWKFGAFLNSTVMSRYLEFLSPTLNFQPGDIGAALFPKAVLPKVAPATALVSYARADWDAYETSWDFTTLPLLSLAHRGETMEDSYATLRDHWQSMTDEMQRLEEENNRIFIDAYGLQDELTAEVPIEEITLTCNPAYRYGVKGTEDERKDLQQRDTIRELISYAVGCMMGRYSVAEPGLVYANAGNVGFDPSRYGGFHADDDGIVPVTDVEWFPDDATTRFIDFLRLTFGEERLGGDLDFVADSLEPKSKTSASETIRKYISRAFFKDHLRTYKNRPIYWLFSSGKERAFECLVYLHRYNESTLGRMRAEYVIPLQTKMQNRIQTIEGEISRGDLSSAQMKARTKELAVLEAKKAELDRFEANLRHVAEERIALDLDDGVKVNYSRFGDLLAATKLVCGTKDEG

SEQ ID NO: 3198 - protein, 1159 aa, Sinorhizobium meliloti
MDTTKLKKFAQFARRTLIAQVSAKLDSVLAPDAAARREHPEALKKLDAAIARDGKGQVIERVAYTWFNRFSALRYMDVNEVNPVRIVSPLSGQFQPEILAEAKAGNIDEERIPEKIRAKVRALLDGRIPSPDAQAEAYRLLLVAICNDWYRAMPFLFERIDDYTELLLPEDLLSNASILTYLREAMTPDVCQDVEVIGWLYQFYISEKKDDVFAGLKKNLKITAENIPAATQLFTPHWIVRYLVENSLGRLWLLNRPGSKLAERMDYYIAPEEPETDFLTFGKPEEIRVCDPACGSGHMLTYAFDLLYAIYEEEGYDPPQIPVLILKHNLTGLEIDDRAGALAAFALAMKAAARLGRRRFLRMEAKPEIVVLQNVTFAAAEMADVAAVVGRDLFTDNLRDTLMQFEQAKNFGSLIVPKLRVSADTLRVVEGRDFSSDLLLKEVQDRVLAVLQMAEALSPKYHVVVANPPYMNVNGMNPKLKSYLQTAYPNSKSDLMTAFMERAIAALLPDGIYGMINLPSWMFLGSFEKLRLALVERTSIVGLLHLGRGIFGSDFGSVAFLVRKTTPTENTIGLYRRLFEKHVQVRTPSEIEALFLDPSYGGFTFKQTDLLSIPGNPIAYWLSEEMLHAFKENERLGEHCDICVGLQTGDNSKFLRYWHETDQRLRKGATNLGWKWVPYTKGGEFRKWYGNKDYVLNWSNDGQEIRAHPSAVLRNHRRYFENGITYTNLSSGSFSARLKDDFGIFDQKGSVFLPHDADETNSILAFLLSKPCAKILEILCPTLDFNPGSLVNLPIRDEIRDARVQRNASAAIQLGKSDWDAYETSWEFTTLPLLSPDHRAETLEGTYARLRAHWQSMTDEMQRLEEESNRILINAYGLQDELTPEVPIEEITLTCNPAYRYGVKGAEAEREARLLSDTMAEFLHYAVGCMFGRYSLDMPGLILANQGDGMEDYRAKVSNPTFEPDVDNVIPVLDGEWFADDIAARFRRFLRVTFGDEHFQENLAFLEEALGKDIRKYFTRDFFNDHVKWYKKRPVYWLFSSPKGTFNALMYMHRYRPDTVSVVLNDYLREFRSKLEAHRRAQEALSISGDASPAQKTKALKEIEATAREIEELDAWERDVLFPLATQKIEIDLDEGVKANYPKFGAALKPIKGLSDSDD

SEQ ID NO: 3199 - protein, 1167 aa, Sphingobium yanoikuyae
MDTNALKKFAQSARNLLIDQVTARLDMVLAAGAAARREHPKAIAKLEAAANSNRAHVIEQAAYTWFNRFTALRFMDVTGLTNPRVVSPADGATRPEILAEAMAGNLPDRARPEIAEYLNGTRPAHDGQAEAYRLLLIHACNEWHGAMPYMFERADMLDRAEDYTELLIPDDLLSPNSILARLREVMTEEACQDVEIIGWLYQFYISEKKDQVFAGLKKNQKITAENIPAATQLFTPHWIVRYLVENSLGRLWLLNRPGSKLAERMDYYIAPEEPETDFLKVGKPEEIKVCDPACGSGHMLTYAFDLLYAIYEEEGYEADKIPALILANNLTGVEIDDRAGALAAFALAMKAAAKLGRRRFLRMEAKPDICVLQDVKFTEAELQDVAAVVGKDLLTDELRETLGQFEEAKNFGSLILPKLRNAAETLRVLEARDFGGDLLLNEVQERVVAVLRMAEALSPKYHVVVANPPYMNAKGMNPSLKTWTNVAYASSKADLMTMFMDRAEQLVLRGGYWSMINIPTWMFLDSFAELRHGLVKKQSIKTLLHLGRGIFGSDFGTVAFTVRNSAPSGGVATFRRLFERHVDVRSKQEIEELFLDKEYNRFEIDPQKFQKIPGTPFAYWASEQVFNAFSDYPSVKSIAKAFRGISTGDNERFSRFWHEVSSLELKTDASSREEASQSGKRWFPYNRGGSFRKWFGLGAEIIDYEDGGKNMISANERGETPGFRHDGAQGYFLNTVTWGALTAGTTSFRRLPHGYVLGHKGPGIVADPEFDHILLQFLNSRAAEKLLGYVSPTLDTNISHILGLPFKGIVNTSVEEADLIALSKSDWDAYETSWDFTTLPLLSPDHSGATLEDSYATLRNHWQSTTDEMQRLEEENNRMFIDAYGLQDELTPEVPIEEITLTCNPAYRYGVKASKEDREARLREDTVAELLHYAVGCMFGRYSLDAPGLILANQGEGIEDYLARVPEPTFAPDRDNVIPVLDADWFADDIVTRARDFLRVTFGEAKFRENLAFIEAALGKDLRKWFTKDFFDYHVRRYKKRPIYWMFSSPKGSFNALIYMHRYRPDTVSVVLNQYVREFIHKLEVERARLEKLAVDPAATPAQQTKAQKETATVIKQIAELTEWERETVYPMAQQKMAIDLDDGVKRNYPLFAGALKPIKGLEAADD

SEQ ID NO: 3200 - protein, 1186 aa, Pseudomonas fragi
MNTNNIKSYAPKARTAFIAAMTKQAALFGIRESKITGICIAPLEKKGDLALVGEHAFPASIIRPRAALVKKVEQIGFAPTMEQAAYSWFNRLCAIRFMELKDYLDHGLRVLSHPEQQGSFQILDDCLDIDLPGLDKQRITELKLDGNKDEVLYRELLLAQCHALHQAMPFLFEAVDDATELLLPDNLTKTDSLIRELVSAIPEEDWASIEIIGWLYQFYISEKKDQVIGKVVKSEDIPAATQLFTPNWIVKYMVQNSLGAQWLATSPDSPLKAQMEYYIEPAEQTHEVKMQLAAITPDSLNPEELTLIDPASGSGHILVEAYDLFKAIYLERGYRQRDVAQLILQKNLFGLDIDGRAAQLTGFALMMKGRADDRRLFERGVKLNVMALVDSAGFDAEVVANGVTLADYGLQMGDITELKRLFELATTFGALIQVPDGLAKKLPGLKQLCEASSQDLFVADELMQLRPLVLQAQLLAAQYEAVVANPPYMGSKFFTSILKNFVNDVYPEGKADLYAAFTLRNIELARENGHVGMITIPNWMSLSSFEQLRSAIHRDAPILNLVHNGRGVWGSDFGSCSYVLKKCSPRNLAGRFLRLFEKQGSVSSNEELEHRFHEYPRYSASNASFRGIPGGVIGFTLSARALATFTNEPPLCASFTPRQGLITGDNERFLRFWQEVDLGRFAQPEDAVHRKWYAYQKGGPYRKWYGNHEYVVDWENEGRAIKTLFDENGKLRSRPQNTQFFFLDGASWTSVTIGAFALRHVPRGYIFDQKGPMCFPLGNLPVEGLLGFGNSVVMQRLLIEIAPTVDYSQGPVGNVPFNPAAAQSAVATAARAVIQCKRDWDAYERSWDFQSLPLLTASSDPTPTLESSYAAWTRKNRDTIAEMQRLEEENNRLFIDAYGLADELTPDVPIEQITLTVNPAYRYGGKLSEAELWTRFREDTCAELVSYAIGCMLGRYSLDEPGLIYAHCGNQGFDPSRYTTLPADADGILPLTDKEWFADDAANRLIEFVSVAWDKAHLEANLRFLADNLSPKKSESSRETLRRYLCDNFFKDHLKTYKKRPIYWLFSSGKQKAFQCLVYLHRYNESTLARMRTEYVIPLTAKLNTHAKKLEQDIEASTSTAEKKRLEKELATLHNQQAELASFDEKLRHHADQRISLDLDDGVKVNYGKFGDLLAEVKSITGEQAE

SEQ ID NO: 3201 - protein, 1153 aa, Lactobacillus helveticus
MDKNKIKKYAINARTELINAIKVKLSTLGIDENEIQDKLSISTPDKEYYVDDNEANALTGAQIGWRKDIVAELNRHGYQEDSKTAYKDFVEEVAYTWFNRIIAIRFMEVNNYLPSRVRVLSSEEGRNEPDIINEAMEIGDDLGGYSIEEKELITTALTEKTPELMDSLYTMLFIKQSDALSEILPGLFEETSNYLKLLFTPHYDRGVIKELVNEIPEEYFDVKREGQVQIIGWLYQYYNNAPHEEVVNMNGKAIQKDEIPAATQLFTPDWIVRYMIDNSLGKYYLERHPDSTVKHELKYLLPDEIKAINENQDIIDYKLLDNAMGSGHILVYAFDLFMKMYIEQGYSMRDAAQKIIENNLFGLEIDKRAFQLAYFSIMMKGREYDRRFLRRNPTTNLYYFEDLHVSDEFYNFISDKVVRANLKKVVKDFSDATELGSIIKIDESIDLDSIEEVVAGLDFESGLDVFGYKKIQQQILKTLKIIKVMATKYETVVTNPPYMNKFDKTLKKYLRDSYKNYSKDLFSVFIYHNVHQLVKGGYAGYMTPLVWMFIKTYEPLRHDIINNFKIDSLIQMEYSAFEEATVPIDTFVLKNSDDDKVGTYLRLSNFKGGMIVQEQKVLEAIGDPKVKYLYYTDQSNFDKIPGSPIAYWISQKSFKLFSKEKLGDISQTRLGMATSDNKKFVRFWYEIDLNNIGFNYKNRQVAEESAKKWFPYDKGGEFRKWFGNNYLVVNWEKDGIEIRNFKNKNGKVRSHNYNLDYIFKSGLTWSALTSGNLSIRYTMVGHLFDNAGSKLFTNDSNIFRILGYLGSVVSNYYVSILNPTMNIQPGTISELPYINNDDIAIDKLVNLNIRLSKLDWDAFETSWDFKKSPFLTQNAASLHQAYNSWSNEALTRFNQLKSNEEVSVRKADQVRDIKAFLSYFIGCVFGRYSLDQDGLVYAGGDWDDSKYTTFKPNKENIILLTDRQYFDDDRDIIVRLKEFLTKTFDPETLTENMDFIAQTLEPKKFERGTSAEDIIRTYFLNDFYKDHAKIYQKRPIYWEFNSGRNKGFKALMYLHRYNTEQLPMVRHYLHELQPAMNDLIEVDQNLLDQETTASAKSKYRKTIATLNKQMNEIMKYDQILDHLSQNPVDLDLDDGVLVNHDKLQQGEKLLSKL

SEQ ID NO: 3202 - protein, 1246 aa, Vibrio cholerae; identical to SEQ ID NO: 2910

SEQ ID NO: 3203 - protein, 1179 aa, Faecalibacterium prausnitzii
MDKNAIKKYAVWARKELISRVAQKAQQYGITETEMVDAGADSVNGKVLSAEEMQQRRALIAQINEKGYQQVMEEVAYTWFNRFSALRFMEVNGYLPSHVRVFTDENNAFKPQILAEALHLELDKLDKDKVYALKETEQTEELYKYLLIVQCNALNSILPGMFQTIADYTELLLPDNLLREGSVIEQMISQIPEDNWQDAVQIIGWLYQYYNSEKKDDVFAALKKNVKITKENIPAATQLFTPDWIVRYMVENSLGRLWVEGHPDAKAQLLPTPEEQAAYTVGNRDPEDTKWHYYLEEAQQEPQVQAQLAEIRKQYADLTPEQIKVIDPCCGSGHILAYLFDVLMQIYENYGYTPRDAVTSILQNNLYGLDIDDRAAQLAYFAVMMKARRYDRRFFSHTTQPHVYAIEESNRIEKPDVEYFCNGKLELKDAMHIILTQLYDAKEYGSILTIPPQDWDALYARFDEVADESSFHRESIRKKLLSLVQVAQTLAQKYDVVVTNPPYMGSSGMGAKLAEYVKKNYPDSKSDLFAVFIEVCSRMAKQNGHQAMITQHAWMFLSSFEKLREKMMLTETVNMAHLGARAFEEIGGEVVQTTSFVRVRTHIDNYKGVYCRLIEPTTQQGKEDMFLACENRYIANQDNFAKIPGSPVAYWIGQDVFRVFSEKSVRDYAEPRHGMSTGNNDVCLKLWFEINRRKICFDASSLEEFDSSNCKFAPYKKGGSFRLWYGNNDYVIAYDKKSRQIMESLPGYRSSSTGFFFKPSINWSDVSTSAFGMRVSPRGFAFDGRGASMFCNNDVMMYIAALLASKFTTYILNILNPTLTFNIENVAAIPVIIDKNKKKQIEFTAADNIRLSKTDWDSFETSWDFTRHPFIKAITKYPNMMDIGNIYLAECYDIWAGECEERFEKLKANEEELNRIFIDIYGLQDELTPEVEDKDVTVRKADLGRDVRSFISYAVGCMFGRYSPTYDGLAYAGGTWDDGKYNIYKPDADGIIPICDDEYFEDDMMGRFVEFVRVVYGDGSLEDNLRFIANALGGKGQPKEVIRNYFLNDFYADHCKIYQKRPIYWLFDSGKKNGFKCLIYLHRYQPDTIARIRTDYVHEQQARYRTAIEGLEKQVAAATSTSERVKLTKQLNKVQAQDTELHQYEEKVHALADQMIKIDLDDGVKHNYEIFKDVLAKIK

SEQ ID NO: 3204 - protein, 1179 aa, Acinetobacter sp.
MNTSNIKKYAPQARNDFIAAMRKQAAKYGITADSILPAEQKGDLLLIGDQVFPLSVMKPRDKLIKRIQTSSFEQTIDYIAYSWFNRLCAIRYMECKGLLDHGRRVLSSADGSAGLPQILEECLDIDLPGLDASRVAELKLDGNKDEELYRELLLAQCHALNQVMPLLFEQVSDESELLLPDNLTKTDSLIRDLVSSIPEEDWSDVQIIGWLYQFYISEKKDQVIGKVVKSEDIPAATQLFTPNWIVKYLVQNSVGRLWMMAQPDSTLASEWEYYIQPAEQTDEVNAQLKQLIDVRISEDGDTLNPESITVLDPACGSGHILVEAYDCLKAIYLERGYRSRDIPRLILENNLYGIDIDTRAAQLASFALLMKAREDDRRLFSNPPKLNIIALQDSQPERLEAFSQDLASTGIAQTDLKELLELFEHASTFGSLIQIPQAFAKKLPDLESKLNKALESGDIFAQQSAQELLPLVQQAKLLAKQYDAVIANPPYMGGKGMNTALKDFAKKKFPDSKSDLFAMFIERGFAWCKDSGFNSMVTMQSWMFLSSYEAMREKLLQDRTIQTMAHLGARAFPEISGEVVQTTAFVMQGQHFNGFKPVFFRLVDLAQDSKEVALKDGFCRFDNNIQDDFKNVSGSPIAYWVSNNIYSFFKESPNICKFSDPRQGMATTDNATYLRSWHEITFEKMGINCKSAVYGNKEGLYWFPYNKGGEVRRWYGNQHHVVRYENDGQDLIDLVTDKYPKISDPEFVIKNRKYYFNESITWTDLTSTILSARYQPPGAIFDVSGHSTFISNKKTQKVILGFLNSKLGHDLSRMLNDSFHFQVGDYKKLPYPEKVEESFNEDNISELIEIAKIDWDSYETSWDFTQNPIIRTNQSTLEQAFNTWQQQNADAVGEMKRLEEENNKLFIDAYGLQNELTPDVPDEQITLTRADREKDSQRLVSYALGCMMGRYSLDEPGLIYAHTGNQDFDASRYKTFPADADGIIPLTEMHWFEDDATHRLREFLTAVWGKDTLDTNMLWLAESLDKKASETAEDTIRRYLASKFYKDHMQTYKKRPIYWLFSSGKQGAFQALVYLHRYNESTLARMRTEYVMPLISKMTAMVNSLQSEIENSDSAAEIKRKEKELQNLHKQQAELSSFEEKLRHFADQRIHLDLDDGVKVNYGKFGDLLAEVKAITGEK

SEQ ID NO: 3205 - protein, 1171 aa, Bacteroides sp.
MDTNRLKKFAIEARNILKAGIAAKLTSLGFDNKGEVAENLRPQLLQGGTLWNGRTLSEGFFHQWMRLYEEVQAKGVNEVYEQAAYTWFNRLVAIRILQKNGLCEPVSTYADSAHTPQIVNQARQGLFPPMEEASKRHLLELLDDDTKVTEQFAVLLVAWCHANPILQRCFGTMEDYTELLLPANILAENGFIDLLNHTEFITDEEFRSPELIGWLYQFYISERKDEVFAKKGKFEADEIPAATQIFTPNWIVKYMVQNTVGRIYLDNNPYTILTYKEKWQYLVEPAEPTPAEAILHYNELTDLKVADLACGSGHILNECFDLLYDLYITEGYTRVEAITHIFQDNLTGIDLDPRAQQLSLFALTLKACQRDHSFADAHCLPRVLTMPKVQLSLPTDTRLAVEIDAVNTLLKDADSLGSIMKFDLTSVAREWVASLVAENEAAALVIALTEQYDALVMNPPYMGSSKMNKNLYNYIQSKYPDGKTDLCNTFMFVGMNSLSPNGKMGMINMQSWMFQSSFLNLRKYFLNSYNFDSLLHLEKHFFEELSGDVVKVVSFICSKHPPLYNGVYFRLTDGKCEDKRLNFLSKSNVFTNVSQFGFESIPGIPMGYWATSKMLKCWDKYTQISTKMVTREGMAPASSDRFIRLWHEVSKRKTDFVLSDNKSTSQKKWFPYNKGGEKRKWYGNFEYLVEYENDGYNIKHNYDIKTGRLRSHNYNGDLAFKEGITWSVLCDAAFAVRYTPCGFLWDSAGAMGFTEENLVYYLGLLNSNVIDKFLRVLAPGLKFNVGDINRLPLIEKTSAVIEYAVQHSVYISKLDWDSHETSWDFQQNGLISLIDFAEQDLTTESLIALCSTTAHSDAVTQQADKNLRAVRLQDLMERYHQKWSTLFMQLHANEEELNRQFIDIYGLQDELTPDVPLNEITILQQDEVSIEGNALKWHDEVILKQLFSYAAGVWMGRYRLDKSSLHIAHPNPTAEELAPYTYNGHTIEIDDDGIFPLMAADSGFTDNACLRTAQFVSDVFGAEYQVENLNYIEHTLGKTIEQYWQKDFWKDHKKMYQNRPIYWLFASKKGSFQCIAYLHRMTPYTPERIRSKYLLPFIETLGRKIADLTTRAADLSTAERKKLDTLNKQLEECREYHDRLAVVAEQAIPLDLDDGVVVNYAKLGDVVSKLK

SEQ ID NO: 3206 - protein, 1213 aa, Proteus mirabilis
MNTNNIKKYAPKARREFMDAVAKRLNTFGITANKKGELQITEANLQGSVLQIAGNSFDGKLAEPRKRIVARSQKLGYAQLIEQVAYTWFNRLCAIRYMEIHDYLGHGFRVLSHPDNPKGFEIIDHAQDAADELGLDRARIIELKLAGNKDEELYRELLLGQCHKLHEAMPFLFDALDDETELLLPDNLMRTDSILRGLVDGIPEEDWQQVEVIGWLYQFYISEKKDQVMGKVVKSEDIPAATQLFTPNWIVKYLVQNSVGRQWLQTYPDSAIKSQMEYYIEPAQQSDEVNQQLKAITPETIEPETIKVLDPACGSGHILIEAYNVLKAIYEERGFRSRDIPKMILENNLYGLDIDDRAAQLSGFALMMMARDDDKRIFTRNVRLNVLSLQESNHIDLPTLWKALNLSGSWQNGTSQGLFSDEEQDLSSFNADNRYQLLTRTLARFTQAKTFGSLIDVPSDEYEQLKELLSTLVELQESGDSMQKPAAKQLIEFVHQSLVLSIRYDAVIANPPYMGAKGMNADLKEFAKKQYPNSKSDLFAIFMERAFKLLSQYGFNAQINMQSWMFLSSYEQLRSNLLEDHTFITMAHLGARAFGQISGEVVQTTAWIIRNKHIKKYQPTFYRLIEGNEEEKQKALLSRDFEFSITKQDDFKRIPGSPIAYWVSDNAKISFSWGTLVSCNYELIQGMITGNNEQFVRSWVEISKSKFSYFSNNTDCWVPYNKGGEARKWYGNHELVVDWRDEGLSFTRNRGTNSHLYFREYASWSYLNSGFPAARLYPDGFLWDVHGSGAFPLNGVNPKKLVALLCSKVGAYLLSVLNPTMSFQVENISALPWNEEKLEGISTCDLEEAVKISKEDWDSHEVSWAFCNLKIVSIDNNSKKVEESVDAVFSYWEQKTQTLRLIEERINTSLIKIYNLESELSPDVPLESVTLTWNPAYVYGPKKVNEEIMKQHVSGTMTELVSYSIGNMMGRYSLDREGLIYAHSANEGFDKLVAEEVYKTFPADEDGIIPLTDQEWFKDDATNRFREFVQVVWGEEYLQENLDFVAESLCLNAIKPKKSESALETIRRYLSTQFYKDHLKTYKKRPIYWLFSSGKQKAFECLVYLHRYNEGTLSRMRTEYVTPLLGKYDAYAEQLEKQIETADSTSEANRFKKELDALIKKQVELREFDDKLKHYADMRISLDLDDGVKVNYGKFGDLLADVKAITGSAPEVN

SEQ ID NO: 3207 - protein, 1132 aa, Bacteroides sp.
MEDRELFPEVIRRRVEHGNLSYAHKQWLEEHTDERNMERMGLKHFLEDKFQELSGNYKIPLYSPDYAYAMLPTADELFEIITAFNEIEQDADCGADIWKGDDILGWLYENFNTVEKLALKDSGDKTEYDKVSLQSQVYTPQWVVKFLVDNTLGKMYLEMYPDSNFIYDENGKVKYLIANAPISQMRHPKKLEELKLIDPACGSGNFLIYAFLLFYDLYLNQIDQYDADYSRRDIPKLIVENNLYGVDLDERAVQLTQIALFIKAMQLKGRRGAMPAYTHVVSTHFELPEYNQVEAAFMLGSDWNEKQQKTIRSIWEDLRAAYKFGSLIRVEEQLDALLPVDSSDMFANQWKANMFDFKHQMITTLRNQVHQWTGEGSNEYSLAKANDAITFLDILSMKFDVAVANPPYTDSGDFGAELKEFVGANYSKPLKFNTNLYACFIKRCCELAGDDGKVGMINPPTFMYIKTFEDVRKYIVEKTFISLFVEWGYLGLFSQSARVDSAIFILDKSVRQEESTFIKLNDLYEMKRKEVLFDAYYDFCNGIQNPRVYQLPQSKLKEIKSYPFIYWISDEFRESFNTCSFNEISNVVEGCKTANNYKFLRFWWERNERHIVSRTYPIYAKGGEFCKWYGNLWLVLLWGENGTYLKGDIKATPNNEQYYFSEGITFTGAGSKGVSFRYLPKDSVFDTGSRSIFSDKVSVYILLSILNSSLGSYVLDCLNPTVNTTVGDIKRMPYKSPDVCHGGILNSLSESCVNIKRHLCKYNIREFNYEGSPIANLKNINDSIAIFYKNESALLTLVLLNESVIDVVVFDVYELSVHDRQMVIDKEGIPVGDYSVSSQAKEAYKEWLSTNTEFPASSEVLEHIDSLEINEDQPHIDDFESLYQNNNGWEEFCIKHEMNPIEVWYQFKNASILPPQRTQVLAFELITDVIRSVLAKDDDGVIPLTERMGEEQLAGRIEQELVERGYNSAQISQIIQLLGTPLDKYLQDKFFKQLSDHLNLFMYLPKTPFIWHLTSGPHHAIELYISIYKWSRDTVFRIKSVYIANRGTALNDRLSGIDVSTANGQLEAAELKEQLKELKVFAEKIDELLASGYDPKLDDGVGKNIAPLQKAGLLSYEVLNAGQLKKYLNADW

SEQ ID NO: 3208 - protein, 1225 aa, Salmonella enterica; identical to SEQ ID NO: 2876

SEQ ID NO: 3209 - protein, 1194 aa, Pseudomonas fuscovaginae
MNTINVKNYAPKARTAFIAAMTKRAALFGIRESNIPAMGIAPLEQKGDLALIGDSAFPASIIRPRAALVKKVEQLGFSQAIEQAAYSWFNRLCAIRYMELKDYLVHGRRVLSAADGSATAPQILDDCLDIDLPGLDKQHITELKLDGNKDEELYRELLLAQCHALHQAMPFLFETVDDATELLLPDNLTKTDSLIRELVSAIPEEDWANIEIIGWLYQFYISEKKDQVIGKVVKSEDIPAATQLFTPNWIVKYMVQNSLGAQWIATYPDSPLKAQMEYYIEPAEQIDEVKTLLAALTPGSLNPEELTLIDPASGSGHILVEAYDLFKAIYFERGYRQRDVAQLILEKNLFGLDIDGRAAQLTGFALMMKGRADDRRLFERGVKLNVMALVDSKGFDAEVLANGARLADYGLQLGDITELKRLFEHATTFGSLIQVPEGLTKKLPGLKQLSEATSQDLFVTDEFMSLRLLVRQAELLAEKYDAVVANPPYMGGKFYCTALKNLVNESFKAGKADLYSAFTLRNIELAKQNGHIGMITIPNWMFLSSFESLRDAILNNAPIVSLVHNGRGVWGSDFGSCSYILRRSSLQSLHGRFLRLFDKQGSVSSVNELERRFHVNRRYSTSNADFKKIPGNPIGYWLSDKARSTFERSKSLSVIAPAKQGLATANNDRFVRNWSEVSLASVDFCSRSLDEAQQSSAKWFPYNKGGEFRRWYGNQEHLVNWANNGAEIRGFTDVDGKQRSRPQNTQCYFRTSVSWSDITSGIPSFRYFPEGFIYDVTGMSAQPESKAQTLSVLAYANTPIVTWFIKTLNPTLHFQVGNFSSLPFLETAFESRDFQFVEKLINAAKSDWNAYERSWNFQSPPILTASPEHASTLESSYTAWITQNRDTIAEMQRLEEENNGLFIDAYGLADELTPDVPIEQITLTVNPAYRYGGKLSEDELWTRFREDSMRELVSYAIGCVLGRYSLDEPGLIYAHSGNQGFDPSRYGSFPADADGILPLTDKEWFADDAANRLIEFISAVWDTPQLEANLRFLADNLSPKKTESSRETLRRYLCDNFFKDHQQTYKKRPIYWLFSSGKQKAFQCLVYLHRYNEGTLARMRTEYVIPLTAKLNTYANKLEQDIEASTSTAEKKRLEKELATLHNQQAELATFDEKLRHYADQRISLDLDEGVKVNYGKFGDLLAEVKAVTGDKAE

SEQ ID NO: 3210 - protein, 1234 aa, Lachnospiraceae bacterium
MDKTSIKNFAIWARNKLIADIGYKASLMGITEDGISEALSQSTPSTEFYDIGTDNPYAISTNQIKQRKRLVEVIRKKEADTDYKTAYKYIIEEVAYTWFNRLIAIRFMEVNDYLPSRMRVLSSVSGKHEPDIVTNPFEAELELSDDDREKINTYKSDNNIDELFNLLFIKQCNALNTILPALFEKTDDYTELLLNLSVIDRDGVVYKLVTDIAEDDFNIEKGGQVEIIGWLYQYYNSEPKAAAFAKKGKISKEEIPAVTQLFTPDWIVRYMVENSLGRLWVEGHTDEELKANWKYYLDEAAQEAEVKKQLTKIRKEYSKLSPEDIKIIDPCVGSGHILVYAFDVLIQIYESAGYSTRDAAKYILEHNIYGLDIDDRAFQLAYFAIMMKARQYNRRILNGEYKPNIYSIKESNGINREQLNYLRSGCSEDERNKALEQIGILLDTFKDAKEYGSILNVEEFDAELLERFISQSEPDGQISMHNMGIEETVQELRQIIAVGKVLSDKYHTVVTNPPYAGTSNLSLKLNAYIKENYPDSKSDLFAVFIERCSEMTGENGYQAMITQHSWMFLSSFEKLRKKMMQSEIINMAHLGARAFEEIGGEVVQVTAFVRCIEHIKDYRGTYCRLIEPTSQQGKEKMFLDGENRYVTVQDNFKKIPGEPVAYWSSYNLIDKFILGYKLSDLCETRKGLATSDNNRFLRLWYEPIFSKVGFSLLDNRETIESAFKWFPINKGGEYHRWYGNKEYVINWQNDGYEIRNFRNNNGKLLSRPQNTKYNFKSALTWSKITTSVFSARFSERGFLFDDAAAICFHKDTQRLKYILGFLNSKCCQLVLNILNPTINIQIGDIGNIPIIESHQEPVIRLSECCIDISKSDWDSYETSWDFVTHPLIKPALAENNSNRSQTLIADCYSAWVDECEARFNKLKANEEELNRIFIDIYGLQDELDADVADKDITVHRIFDTKEDILESMKGSNYVRTKRDEVISLLSYAVGCMFGRYSLDVEGLAYAGGEWDDSKYISFKPDDNNIIPITDEEYLDDDIVTRLCTWLKAVYSESTLEANLDFIADALGGKDNTSREIIRNYFLNDFFKDHCSTYSVTGSGKRPIYWLFDAGKKNGFKALIYLHRYNADTIGNLRIDYLHLLQRIYESESKRMQSTIDSANSPREVALASKRKEKLQKQLKECHEYDEKIAHLALSRIELDLDDGVKVNYRKIQTDRDGKFYDVLADSKNIMSKEK

SEQ ID NO: 3211 - protein, 1246 aa, Vibrio cholerae; identical to SEQ ID NO: 2910

SEQ ID NO: 3212 - protein, 1208 aa, Roseburia inulinivorans
MNKAAIKNFAIWARNKLIADVSYDARLIGITEDGIAKPLPQSFGGTQFFDIGTAEPYSISGEAVRQRDKLIEVIQQKEKDTDYKTAYQYVIEEVAYTWFNRLIAIRFMEVNDYLPSHIRVLSSESGKLEPDLVTTPFDAELPFTAEEEAQIFQLKQDNKLDEVFRILFLKQCNALNEILPALFEKTKNYTELLLSLSVIDQDGVVYHLIHDIPEDDFNIERGGQVEIIGWLYQYYNTEPKAAAFAKSGKITKEEIPAVTQLFTPDWIVRYMVENSLGRLWVEGHPECDLKENWKYYLEEAQQEPEVQVKLAEIRKEYAALNPEDIKLIDPCMGSGHILVYAFDVLMQIYESAGYSQRDAAKSILEHNIYGLDIDDRAYQLAYFAVMMKARQYNRRILNGENTCHVYAIQESNSINRAHLKYFGAGMDDIEKNAAKMQLEGLLDTLTDAKEYGSILNVESYNWDLLRRFVAAEDTDGQISMDSVGVEDTAEQLNRLIDIGETMARKYWVTCTNPPYAGTSKLDKRVNAFLKDNYVDSKADLYAVFIEHCKEMIVANGFQAMITQHSWMFLATFEKLRKKMLQMDIVNMAHLGARAFEEIGGEVVQTVAFVQRESYVPEYNGSYCRLISATTPKGKEELFIKKDTLYTANQADFKNIAGSPIAYWTSSHVFKLFSEDCLRSHIDARNGMSTTDNNRFLRFWPECSFEKIGFSSKSAEQAKVSQKKWFPYNKGGEFRRWYGNNSYVVNWFNDGEEMKKCVTENYGSYSKELRSEDKYFAEGISWSALSSGNISMRYSEPGYIFDSKGSKAFMRDETNVFLILSYLNSCVAQHFLGILSPTLDYNNGNIEKLPYISTKNDDVIIDLGIDAEEQSKADWDSFEVSWDFKKHPLLRNVSTIYEAFTLWQSECEDRFNQLKTNEEELNRIFIDIYGLQDELTPEVEDKDVTVRKADLQRDIKSLLSYAVGCMFGRYSLDVEGLAYAGGEWDSSKYQSYIPDEDNVIPITDEEYLDDDIVSRLCAWLKAVYGADTLEENLDYIAKALGNKGSTSREIIRNYFLNDFFKDHCQTYSVTGSGKRPIYWLFDSGKQNGFKALVYLHRYTPDTIGNLRIDYLHKMQRVYESEINRMQDMMDHSGNAREVAAASKRKDKLAKQLKECREYDEKISHLALSRIELDLDDGVKVNYRKLQTAQDGKFYEVLADSKNIMVKEKK

SEQ ID NO: 3213 - protein, 1205 aa, Salmonella enterica
MNTNNIKKYAPQARNQFRDAVIQKLTTLGISADKKGNLQIADAELVGETVRYGQFDYPKSTLTRRDRLVKRAHEQGFDVLVEHCAYTWFNRLCAIRYMEIHGYLDHGFRMLSHPDNPTGFEVLDHVPEVAEALLPEKKAQLVEMKLSGNQDEAIYRELLLAQCHALHRAMPFLFEAVDDEAELLLPDNLTRTDSILRGLVDGIPEEDWQEVEVIGWLYQFYISEKKDAVIGKVVKSEDIPAATQLFTPNWIVQYLVQNSVGRQWLQTYPDSPLKGKMDYYIEPAEQTPEVQAQLAAITPASIEPESIKVLDPACGSGHILIEAYNVLKNIYEERGYRARDIPQLILENNIFGLDIDDRAAQLSGFALLMMARQDDRRIFTRDVRLNIVSLQESLHLDIAKLWQQLNFHQQSQTGSMGDMFAENTALAHTDSAEYKLLMRTLKLFVNAKTLGSLIQVPQEEEAELKAFLDTLYRLELEGDFQQKAAAKAFIPYIQQAWILAQRYDAVVANPPYMGGNYMEAELKNYVSTKYPQGKADLYSSFMIRLIHQTKKNGALSLMTPFTWMNLSSFEEARKEILTTCCLHSLVQPEYHSFFESAYVPICAFTIFKFQSSWNATFFDLSEFYGERNQAPNFHYAIHNNDCNWKYKRSTHDFLSTPGYIIAYSLPNSALHCFKTSPKLNSVSNLKQGLITGDNDSFLRYWHEISLNLFSYNINNIKPKWFPYQKGGTYRKWYGNNEYVVDWENEGYKIRNFYNDKGKLRSRPQNIQFYCKEGLTWTSLTISSLSMRYVPNGYIFDAKGPMCFPINAADIWDILGYTNSKIINIFLKHLAPTMDYSQGPVGNVPFKSPTRNITNIIKELVTIHKNDWDTNEISFEFQTNILVKLANDYKKISDGYTFRENENKKIIYRVKELEEYNNSSFIDLFELNDILSPEVNLSDITLDRAAQENDIIKMISYSIGCMMGRYSLDREGLVYAHEGNKGFAELVAEGAYKTFPADNDGILPLMDEEWFDDDVTSRVKEFVRTVWGEEHLQENLEFIAESLCLYAISPKKGEPALDTIRRYLSTQFWKEHMKMYKKRPIYWLFSSGKTKAFECLVYLHRYNDATLARMRTEYVVPLLARYQANIDRLNELVDGASGGEATRLKRERDSLSKKFNELRSFDDRLRHYADMRISIDLDDGVKVNYGKFGDLLADVKAITGNAPEVI

SEQ ID NO: 3214 - protein, 1187 aa, Acidovorax sp.
MNKSNLKSYAPQARKDFIAAVTARANLLGLSDKVGTLEVAPAQTQGDVTVIAGQAWPAKVNAQRNKLIERIRKDGFAHTMEAVAYTWFNRFAALRYMELHDYLGHGHRALSSTSGGLPDILTHATDLTSELPGLNAVRVTELKLAGNRDGELYRMLLVAQCNALSRAMPFLFERIDDDSELLLPDNLLRSDSVIAKLVAEIPEEDWAEVEIIGWLYQFYISEKKDQVIGKVVKSEDIPAATQLFTPNWIVQYLVQNSVGRLWLMANPQSTLAKEWPYYITPAEQTPEVQAQLDALIQTRVREDGDTLNPESITVLDPACGSGHILVVAYDVLKAIYLERGYQPRAIPRLILEKNLYGLDIDDRAAQMAGFALLMKARADDRRLFTATDNAGNLQPPKLNVLSLQESKGLSVDELATHLAPFKVQRATIAALVETFEHAKTFGSLIQIPHALKTHLAVLPEAMTSAKHSEDMYASAAADDLLPLVQQAQVLTMQFDAVVANPPYMGGRNGMNDALKSFSEANFPSGKADIYAAFIDRGMVALRPGHGSLAFITMEGWMFLPSFEELRKKIQKESSIATLLHLGPRAFETISGEIVRVVAFTVTQKSLAGDGVIDCFRLVKPKTETEKRDAFLSERSSIKFVQKNFSRIPEGRMAYWLSPSVIACFDKGRNIESIAPVRQGFQTGNNDKFMRFWYEISQSKMMFDASCKEDVFSSGRKWVPYNKGGEFRKWFGNNDYVVAFDKKNYETLAISGNCLPSRNFYFQQGITWSAMGGTFGARLSPKGFTFSAKGASAFPSAVDSPLVLSLLNSKVANAMFEFLAPTLDFNVGAIRLIPIPDLSTDSIAEIGKRVQALISIAESEWDSSETSWNFKCPELIRDRLASARLAWEALQDRRCAEIRQADQLTSEVDSFLIAAYGLGEESSLAGSKSDFAYLAPVEATQTEKLISYAIGCMMGRYSLDEPGLIYAHAGNVGFEPARYATFPADADGIVPITDELWFADDAPSRIREFLRAVWGPDTLEENMAWLAESLGTKASETPDETIRRYIADKFFKDHLQTYKKRPIYWLFSSGKQGAFQALVYLHRYHEGTLARLRAEYVVPLTGKIQSRIEMLQKDAAAASSTTARNKLNKEIEKLTKKHAELLAYDEKLRHYADMRIKLDLDDGVKVNYGKFGDLLEGVKIVTGGSSDD

SEQ ID NO: 3215 - protein, 1177 aa, Desulfonatronospira thiodismutans
MHPLEKALRSRLERTIERARQEAEAGAVSALEQLGVQEAAPYKHLSKEDRVLRRKLRAHARHLGNGRNAKGEQEIDRLIEEVAYEHWHRMLFARYLAENNLLIYPDPVEPVSITLEECQDLAADEGATNGWELASRYAARMLPQIFRPDSPVFELTLPPENQQRLERLVEDLPREVFTASDSLGWVYQFWQSRKKEEVNASEVKIGAKELPAVTQLFTEPYMVAFLLDNSLGAWWVKMCSEGSDQPAVEARNMLQNAQSEDELRVFFSRPGFTLSYLRFVKDDESSWTPAGGTFDNWPDTLKGFKTLDPCCGSGHFLIAQFLMLVPMRMELEGLSAREAVDKVLAENIHGLEIDQRCVQLAAFSLALAAWTYPGAGGYRPLPELNLACSGLAINARKEEWLNLANGDVKLRYTLDQMYDMFKNAPVLGSLLNPTRIAEQSYWTRENYQRALELVQKIMSREKGDYEKFEMGVVAQGIAKATTLLAEKYHFVVTNVPYLARGKQDEALKEFCQEYYKEAKNDLATVFLDRCLEFCINNNLVNQGQDRRQGVSSGNVSAVFPQNWLFLTSYKKFREKLLKQDVWQLIARLGPGAFETISGEVVKAILLSISRSLKIEKPSTLMLKKDMLQDAHSNMIRGLDVSDFHPAQEKAKQIYEMDINSVEQVKQLDNPDATIKLGNRSRFGIVRDFANCFQGLTTGDDLRLKRLFWEFIQNSDNYTYWQLLQAPSHGRSLYGGRHNLVDVRITTGELKTGALRGKDAWGKWGIAIDRVGSLSPAIYCGDYFHSLVPVIIPKFKVNLSFFLSFAKSSTLKKVAEETNQALSVDNGYFEKFEFDLNHWSKVAQEEYPHGLPQPYSDDPTQWIFHGHPCGSVIWDEDKKWTAHGPLRIEANVLHVAVARLLGYRWPAELDPEMELADEQRWWVQKAGELLPLADEDGIVCIPPVRGEAAAADRLFEILVRSYGSEWSNNILNQLLTEAGNAGKTLESWLRDKFFAQHCRLFHHRPFIWHIWDGLRDGFSALVNYHRLDFKNLETLTYTYLGDWIARQKQAVSEGVDAAEEKLAAAESLKKKLELILEGENPYDIFVRWKPIEKQPIGWNPDLNDGVRLNIRPFMTVGDVSKKGAGILRDKPNIKWNKDRGKDVQSAPWYHLFKGERINDHHLNLQEKFKSRGNNNEYN

SEQ ID NO: 3216 - protein, 1216 aa, Oribacterium sp.; identical to SEQ ID NO: 2971

SEQ ID NO: 3217 - protein, 1224 aa, Escherichia coli; identical to SEQ ID NO: 2815

SEQ ID NO: 3218 - protein, 1246 aa, Vibrio cholerae; identical to SEQ ID NO: 2910

SEQ ID NO: 3219 - protein, 1176 aa, Acinetobacter baumannii
MNTSNIKKYAPQARNDFIAAMRKQAAKYGITADRILPAEQKGDLLLIGDQVFPLSVMKPRDKLIKRIQTSSFEQTVDYIAYSWFNRLCAIRYMECKGLLDHGRRVLSSADGSAGLPQILEECLDIDLPGLDASRVAELKLDGNKDEELYRELLLAQCHALNQVMPLLFEQVSDESELLLPDNLTKTDSLIRDLVSSIPEEDWSDVQIIGWLYQFYISEKKDQVIGKVVKSEDIPAATQLFTPNWIVKYLVQNSVGRLWMMAQPDSTLASSWEYYIQPAEQSDEVNAQLKQLIDVRISEDGDTLNPESITVLDPACGSGHILVEAYDCLKAIYLERGYRSRDIPRLILEKNLYGIDIDTRAAQLASFALLMKAHEDDRRLFSNPPKLNIIALQDSQPERLEAFSQDLASTGIAQTDLKELLDLFEHASTFGSLIQIPQAFAKKLPDLESKLNKALASGDIFAQQSAQELLPLVQQAKLLTKQYDAVIANPPYMGGKGMNAALKDFAKKKFPDSKSDLFAMFIERGFGWCKDSGFNSMVTMQSWMFLSSYEAMREKLLKDRTLSNMVHMGNGVMGIAFGTAATVMLNKHISDYEGSFSYCENDDVNEDRVPKQFPVQNERLKTAKPDDFKKIPGSPLAYWVSDRISFSFEKGPLIKDIAQARQGLITADSDRFLRLWTEINIQKLGLCIKDRVEAKNSRKKWFPYNKGGEFRKWYGNQEYVVNWENDGVEVRNNIDANGKQKSRPQNTEFYFLPSLSWTAITSSRFSVRRDFGGAISSNAGMSVYADDNILKKLSVLMNSALCDYFLQIISPTLNFGAGDIGKVPALINLIDDEDKIYLHHDELINISKKDWDSYETSWDFTQNPIIRTNQSNLEQAFNTWQQQNADAVAEMKRLEEENNKLFIEAYGLQDELTPDVPDEQITLTRADREKDCQRLVSYAIGCMMGRYSLDEPGLIYAHAGNQDFDASRYQTFPADADGIIPLTEMHWFEDDATHRIQEFLTAVWGKDKLDANMLWLAESLDKKASETAEDTIRRYLASKFYKDHMQTYKKRPIYWLFSSGKQGAFQALVYLHRYNESTLARMRTEYVMPLISKMAAYANSLETAKESSDSAAEIKRIEKKLQDLHKQQAELSSFEEKLRHYADQRISLDLDDGVKVNYGKFGNLLAEVKAVTGGSGE

SEQ ID NO: 3220 - protein, 1177 aa, Acinetobacter baumannii; identical to SEQ ID NO: 2770

SEQ ID NO: 3221 - protein, 235 aa, Magnetospirillum sp.
MMGRYSLDEPGLIYANSGNVGFDPSRYTAFPADDDGIVPIMQTDWFDDDATNRVVEFIKVAWSPETLAENLKFVADSLGGKSGELPIDTIRRYLSTDFFKDHLKTYKKRPIYWLFSSGKEKAFEALVYLHRYNEGTLSRMRMEYVTPLQGRIASKIDQLGRDIDAAASTAAQNKLRKEQEKLKKQQAELVKFDEELRHYADMRIKLDLDDGVKVNYGKFGNLLAETKAITGGSDE

SEQ ID NO: 3222 - protein, 1224 aa, Escherichia coli; identical to SEQ ID NO: 2815

SEQ ID NO: 3223 - protein, 1246 aa, Vibrio cholerae; identical to SEQ ID NO: 2910

SEQ ID NO: 3224 - protein, 1296 aa, Bacteroides sp.
MISQGGKKILERFVSTAKNLLMQNITELLQQHYGIWADGHTIAVEKLANQDTDIVHTARMLRERLKHLQAALPETEEDKDRLAVGQLIAEQAFTQLNRFCALRMCEERDLILESIRGGYDAVGFQSYDAIAQTIGVSKYNRYRWYLHSIFDELSIELPAVFDRYSPYGLVFPDESTLLKLIELINDSQLSDWYDEQNGTTVNFWKEDETLGWMFQYYNSLEERRKMRDESNKPRNSREMAVRNQFFTPEYVVRFLTDNSLGRIWYEMTGGQSRIGEEQCQYMVRRPNEEMKERAIKEPTEILSLDPTCGSMHFGLYLYEVYEYIYTDAWDNYPELLHKYRELHTRESFLREVPRLILTHNIYGCEIDPRALQIAALSLWLRAQRSYGEMGIDATERPLITKSNLVLAEAMPGNKRLLKGLMEELDAPMQRLITKIWDKMKFVGEAGLLFKMEKEIEEDIEYLRKNWSKVNQSRNADLFATEEERARIDAENEARKLLRQNKSAFFEEITDRLKEALEQLSAKLSEEEGYENALFSEDATRGFAFIELCQKRFDCIVMNPPFGEGSENTSSYLDNNYPAWCRNLVCAFFDRMQEMLDADGRLGAIFDRTVMIKSSYEDFRKRNLCGYITNCADIGWGVLDASVETSTLVLNKHSSDVEGVFMDILDVNAEEKNAQLIALIHAMCDGDEVKWSYIASSKDFANLPNAIIGYYFDVNILSVFKMQNMEERNLVSKKGHDLAANIYPRLYYEITNTLGFSLMYNGGAFSMFYFPYNDVVFWNEEIIRNNSLCNLRSLHLQKLGTVGYGKRGDILDAHVLKKGFIFTREGIGVPNLSISDGYSALAYLNSIVAQYTINLYCAQHKGNGYVNILPMPDYDKSLSDIESIVNSIIDIKRHWFSLDETNLEYHGLIAQMSISDSIEDSINRMQEGITADYQHYQELVKENDNLWMDLANIDRESEFRQTLNEYKNRRPYEELLSIDNASNQNIIDKKVIAQEIVQELVGMAFGRWDTAYAQKVKQIPEFGDVFDALPFMPTVSLSEIPSDYALQIPEDGILNNQADSPDSLVNRVRDVMQHIWGKHADELEYELCQLIGCKNLQVYFEAPTGFFDYHFKRYTKSRRKAPIYWPLSSEDGSYTYWVYYPKLSRNTLPSLLIKLRSEDEQLRSGINAAMAGHDKAQESSLRAKQAQVEGMMEEINQILASGYEPNHDDGVPVTSAPMLKLVAHRGWNNECKDNLEKLTKGEYDWSHLAMSMFPARVTQKAKKDWCLALTHGLEHLCENKPKEKKARKKKDNNQTLF

SEQ ID NO: 3225 - protein, 1246 aa, Vibrio cholerae; identical to SEQ ID NO: 2910

SEQ ID NO: 3226 - protein, 1224 aa, Escherichia coli; identical to SEQ ID NO: 2815

SEQ ID NO: 3227 - protein, 1251 aa, Vibrio cholerae; identical to SEQ ID NO: 3173

SEQ ID NO: 3228 - protein, 1180 aa, Methylophaga aminisulfidivorans
METGKLKKFAQQARRSLIEQITAKLKLVLAGESAARREASEAVGRLEVAIDTQGKEQVIERVAYIWFNRFCALRFMDVNRYTRIGVVSPSEGQSQPEILAEAKMGHIDDDVVSDATRQQVSALLSGKSTSHDPQGEAYRLLVVAACNYWNQAMPFLFERIDDYTELLMPDDLLSDNSILEQTRQAMTEEVCQDVEVIGWLYQFYISEKKDLVFEGLKKNKKVTPENIPAATQLFTPHWIVRYLVENSLGRLWLLNRPHSKLAEEMDYFIKPQEPETDFLKINSPEDIKICDPACGSGHMLTYAFDLLYAIYEEEGYQPSDIPEKILTHNLFGIEIDERAGELAAFALTMKARAKQRRFFSKGIKPKICVLENIHFEEQELDEYIDFIGRDLFNAPLQTTLRQFEEADNFGSLIRPDVTEVDGMLRILESKNVSGQLFISMTHQKVLQALRQADYLSPKYHVVLANPPYMGGKGMNGRLGAWLKDNYEDVKSDLFSAFIVRNTEMTLPKGQLGFMSPFTWMFITTYEKLRDFLINSRTITSLVQLEYSGFDGATVPICTFTVENAHHPKFKGGYVRLSDFRGSENQGSRALEAIKNPGCGWFYRASAATFQKIPSSPIAYWATESQIRMFETCPSLSEVAKIAEGTTTGDVNRFLKMWHEVSNLKIGFGFKESQSAADSEFKWFPYNKGGEYRKWYGNNEFLVNWENNGQALKSYGGSFIRGEKYYFLPGVTWSKVSSGALSFRFFSEGFLFDTGGLCLFSEKISYCLSILNSKASLAIMKLLAPTLNFTVGTVSSIPVLQSVSGVESLSSTLIEHAKSDWDSYETSWDFTSIPLLNPDYRQPTLKATYQKLRAHWREMTLEMQRLEQENNRIFIEAYGLQDELTPEVPLNEITLTCNPHYCYGKDKSEGELEALLRADTMHELVSYAVGCMFGRYALDMPGLILANQGETIEDYYEKIIDHKKQESHEKKGKENFRDFRAFRGSCLFPADEDNVIPMLDGDWFTDDIVDRFREFLHVAFGDEHYEENLKFVEYALGKDIRKYFLKDFYNDHVKRYKKRPIYWLFSSPKGSFNALVYMHRYRPDTVSVVLNDYLREFRTKLTSQKTHLEAISISASASQSEKTKALKDIENLSKMIAELEEYERDVLYPLATEQVEIDLDDGVKVNYPKFGQALKKVTGLS

SEQ ID NO: 3229 - protein, 1224 aa, Escherichia coli; identical to SEQ ID NO: 2815

SEQ ID NO: 3230 - protein, 1246 aa, Vibrio cholerae; identical to SEQ ID NO: 2910

SEQ ID NO: 3231 - protein, 1177 aa, Photobacterium sp.
MDTSRLKKFAQYARRSLIDQVESKLKLVLADESQARRESPSAVAELEKKLKQHGQDDKAREQLVEQVAYTWFNRFCALRFMDVNQYNRIMVLSPLPGQFQPEILTEAKAGHIDEGIVNKATQEKTFGLLGGSIASRDGQSEAFRLLIVAVCNDLHRIMPYLFERIEDYTELLMPDDLLSGNSILAYTREAMTPEACESVESIGWLYQFYISEKKDQVFDGLKKNKKITPENIPAATQLFTPHWIVRYLVENSLGRLWMLNNPDSKVIDQMDYYIKPAEVETDFLRISSPEDIKVCDPACGSGHMLTYSYDLLYAIYSSTGEYDDSEIPELILTKNLYGIEIDERAAELAAFALTMKALKGDPLGKSNNRRRFFRNPVKPNICRLEKVIFSDDELNSYIDFAGKDLFSQELRLTLKEFEEADNLGSLIQPTLKMPADTLAIFEGKDVSGELFLADTHQSILTVLQQADYLSPKYNVVVANPPYMGSKGMNNRLSKWAKDNYPDSRSDLFSMFIERDLKLVVKSGYSAMINMQSWMFLSSFEKLRLKLLEESTIVSMCHLGTRAFDSIGGEVVSTTAYVLRNGIDISFKGDYIRLVEGRSEKEKEQSLLEAVANKTCDYLFQVSANHFNAIPGSPIAYWVETKIIETFSSAQPFGRVGKTRRGLQTGDSDRFIRRWYEVSLDNIGRGLTKEAAEKSGCNWFLFNSGGTFRKWYGNIEDVVNWGKDGQEIKASGKAIIPSEDLYFKKAITWPKVSGGRCSFRWFPDGIIPGDAGPCFYDESSSEDAVLCFSNSKVALSFLQFLSPTLNFEVGVMAKMPLIVPATDELKLTRNESIKIHKEDWDSSEMSCDFTFSPVAAYRHRQTRLEDSYQQLRTNWNDVTLRMKRIEEDNNRLFINLYGLSDTLTPDVPLSEITLSFNPHYRFGTDKTELELESLIKKDTLIAFISYAVGCIFGRYSLDKEGLILANQSDTLECYLKQVPQPSFMPDKDNVIPLIDFDGDWFEDDITERFNEFLKVTFGEEHFTENLTFIEDAIGKDIKKFFLKDFYTDHVKCYKKRPIYWMFSSPKGSFNALIYMHRYRTDTVSVVLNDYLREFRTKLQARKESYEQIEISASASPGEKTKAIKAIQNVNKVLDEINDYEHETLYPLAGKPPEIDLDDGVKHNYPLFGKALKKVTGLS

SEQ ID NO: 3232 - protein, 1246 aa, Vibrio cholerae; identical to SEQ ID NO: 2910

SEQ ID NO: 3233 - protein, 831 aa, Fusobacterium sp.
FEDAKEYGSILKLESIDKELLEREFNLLKESFNNNEQETLIFNEDEIIIDINEELELIGNLIKQHITLVNQYETVVTNPPYMGGKGFSPKLKTYVEKNYKDSKSDLFAIFIERCNEFTKKDCYTSMITMPSWLFLSSFESTRSYIISNLKIQSLLHMGRGIFGIDFGSVAFTLKKELPNKEKGSYYRLHKRNFQHIYYNDIEKIFLNSKEDFNYKYNFDLYRDDEGVNIIPNFSIENGQQIKFQAKQKDFEKIPGSPIAYWVSDKVREIFEKNQKLGEVGEAKVGLQTGDNNKFLRLWNEVNYNKIGYNMSNSEEALESKKKWFPYNKGGEFRKWYGNQEYLVNWENDGYEIKNFYDGKGKLRSRPQNTEYYFKESVTCSAISSSQNSIRYCPNGSIFDVNLRVYFLERDKNLKLLSILNSKIFQKFGEILSPTLALNANDLDRIPVIFNSDTNLVEENISISKEEWDSRETSWDFEKLSLIDGSIDLKTAYENYCNHWRDNFVQLHKNEEELNRLFIEIYDLQDEIDEKVAFEDITILKKEAKIIEIDNSVPKDFFSESEKYLYDRGVSLEFNKDELVKQFLSYAVGCIMGRYSINKSGLIMTNSDDILELSENKFIVKSTGGEIRQEVESKFLPDEFGIIPITDEKDFSNDIVEKLKEFIKCVYGEENLKDNLNFIAEALGNKDNKSAEEIIRTYFIKDFYSDHLQRYQKRPIYWLMNSGKKNAFSCLFYMQRYEPLTVARVRADYLIPYQEMLENKRKFIERQLSDDDISAKEKKNIEKQLKELDTLLKELREYANEVKHIAEQKIPLDLDDGVNVNYEKLGAILKKR

SEQ ID NO: 3234 - protein, 1223 aa, Clostridium perfringens
MDKSKIKSFAIWARRRLIESVSDKASKIGIFENEIKDVVAVQGGFKIVGSEEILPLSKEHRDALVSQIKDKGFEQVMEEVAYTWFNRFMGLRYMEVNEYLPSGIRILSSEVEGKSEPDVLSKVSEIIDELELNGEEIYALLDSGKNQDREKAYRKILVKQCNELGKIIPQMFEKISDYTELLLPDNLLEEGSVIKRMVSDIEEEDWKEEVEIIGWMYQYYISEKKDEVFAGLKKNIKITKENIPAATQLFTPKWIVKYMVENSLGRLWLEGHPNEELQRHWKYYLEEAEQEPEVQEELNKIREEHSKLTPEDLKVLDPCMGSGHILVYAFDVLYEIYKTAGYSEREIPRKILQNNLYGLDIDDRAAQLASFALIMKARHYNRRLFREIQREELDLNLCSIQESNGIGKEAIEYFSNGNKELQEDVEYLVKVFTDAKEYGSILEVEKVNFEAIKERLKEIGQEDNLMFGDYRKMLLEKLPTLVKQAEIISRKYEVCVTNPPYMGSKGMNKQINDYVRKTYPKSKSDLYTVMLERCLKLSRKNGFISNITQQSWMFLTSYESLRKSIITSKVIQNMIHLGPRAFEEIGGEVVQTTTFVIRNFYTRNFESKFIRAIEVLDAKEKERYVSNIIINNNKKIFEVSNNVFINIPNNIIAYWISKKLFEILENEKSLSEFANVRKGLITSDNDRFLRLWHEIDNISLGIGFKSDEKAKESKRKWFPYVKGGKFKKWYGNYEYVLNYYNDGEELKAWVEELTKTKPGGRIINKEYYFKPGITWSSIGTSKTSFRYVDYGSIYSNTGMGIFSESIGYEYLISLLNSKVCESLLNIISPTMGFEAIYLSRIPIKESININIKYKSESCYQLSKNDWDSFETSWDFEKHPLLKDLGNINDNKISSAFSKWEEECENNFNQLKSNEEELNRMFIDIYGLQDELTPDVEDKDVTIRKADRERDIKSFISYAVGCILGRYSIDADGLIYAGGEFKDKWDLENKKVRKIEKDEDGNIISDSWVDATFIPDSDNIIPITEDEYFEDDMVSRFVDFVRTVYGEDTLEENLDFIADSIGRKGNETSRATIRRYFLKDFYKDHLKVYQKRPIYWMFESGKNNGFKALIYMHRYDEQIVAKVRTDYLHTLQRKYEAEIERLRLTMDSSEATAKEKTASKKKIDKIMKQIEECKEYDEVVAYLANEQINIDLDDGVKINYAKFQGVKIINSKNKETKMNLLAKI

SEQ ID NO: 3235 - protein, 625 aa, Actinomyces neuii
MRTGRFFDALKGKNRDRVYQKRVDDLEAIPGSPIVYWLPDALLDAFRNGTPLGEIASPRQGLATADNDRFLRLWWEVGQANSYLHAKDKQDAIDSGKKWFPHNKGGSFRKWYGNQDYVVNWENDGEEIINFVDEAGEQRSRPQNTEFYFKPCISWSDVSSGTIAFRAYPEGYVFDAAGPSIFPDREEQLTLISFLNSGVASELLTAFSSGLHFSVGHVSKVPIPKESIPNTKIIDELISLFKSDLMETETANSFSANLSHIHQDLSRTFEIDFQRAIENTNYARLLELQNNNHWANVVGIERPEESLSLNQVSLLQNPYFAFAPEKGQTRSEEEYRWLFFQRAAQELISYIIGLWFGRYSLDKPGLILADQGASLQDYLAQVPEPTLIPDDDGIIPFTDGYFADDALLRVQEAIKAIYGEENLEENLAFLVQCLNVKSSGKKSEFTAPTLPTNYREGLFKYLDKEFLKTHEAMYSNRPIYWMFQSPKGYFKALIYQHRYTAATAGQVLAKYAVPYRNALTTEVKDLQAQLDSAARSQQAALRKRLKWVETALADVTAYIDDSLYPLSIRKVSIDLDDGVRVNYNKVAYGISGNREQLKKSALRPQKGFSDWYKKRKKAGTQFWQE

SEQ ID NO: 3236 - protein, 591 aa, Actinomyces neuii
MSVLSLESLATSARTSLTDQVAVRLSSLLASPDTDAHVRTSLTNAITGFGQDGVVERAAYSWFNRLTAARFMDAHAYSGTYQVVTPPPGSNQPECLVQARQGSFDYKIDPQVQSQVTDLLLAGKDRQAYVTLLTAYFQLWSKAMPAVFPHANSWVNYLAPGDLLSATSVRLDIVQAMDQDACKDVEVIGWLYQYYISQVKAEINDSKKKITAKELAPVTQLFTPHWIVRYLVENTVGKQWLRAHPSSPLREQMEYLVPSAQGQEDAGLAIGDPTEFRIVDPACGSAHMLTYTFDLLWQMYVEAGYSSSKIANLIFTHNLTGIEIDRRAVQLASFALAMKAQEHDRRYLERSGVASPNIVHIRSVAIPPISPEQYQRICDQLAGSAEQLPSLKELNKLIDQLGEASTFGSLIQPPAGAYEVLQQLTNVADPALMGTDPDELAAAATIVKALHNSQYTAVVANPPYLGSKHHSPLLKKFLGKKYTAHKADLITCFMTRGRTLVQDAGAWGMLTLNNWMFLSSFENSRKQLLNENTISTFKCSAEAYVVSLWIFAFLRVSTRLPLKEQKYNSSILQIVLKLPRTKCVPEDFSMR

SEQ ID NO: 3237 - protein, 1210 aa, Enterococcus faecium; identical to SEQ ID NO: 2960

SEQ ID NO: 3238 - protein, 1201 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLEHGFRMLSHPETPTAFEVLDHVPEVAEALLPENKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTPNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFALLMMARQDDRRIFTRDVRLNIVSLQESLHLDIAKLWQQLNFHQQVQTGSMGDMFAENNALTQTDSAEYQLLMRTLKRFVNAKTLGSLIQVPQEEEAELKVFLDALYRLEQEGDFQQKTAAKAFIPFIQQAWILAQRYDAVVANPPYMGGNYMETELKNFVSSYYPQGKADLYSSFMVRLLLQLKDNRTLSLMTPFTWMNLSSFEELRKIILTNFSIQSLVQPEYHSFFESAYVPICAFSISNTPLSWNAKFFDLSDFYGEKNQAPNFQYAIKNDNKCHWKYNRITTDFLCTPGYIIAYSLPDSALSCFKTSKKLHDVCNLKQGLITGDNERYLRFWHEISYNSFSLNEKRKKTKWFPYQKGGAYRKWYGNNDYVVDWENDGYSIKNFYNDKGKLRSRPQNIQFYCKEGLTWTSLTISSLSMRYVPNGYIFDAKGPMCFPKSSLDIWNILGYANSKVIDIFLKQLAPTMDYSQGPVGNVPFKFNDGDLNEIIKELVNIHKRDWDENETSFEFKRDMLVHFSRDINTIKGSFTLRQGENKKAINRTKFLEEMNNSFFINCFNLTDILSPEIELNKITLTHATIEIDIQKIISYAIGCQMGRYSLDREGLVYAHEGNNGFADLVAEGAYKSFPADSDGILPLMDEEWFDDDVTSRVKEFIRTVWGEEYLRENLDFIAEVLKPKKGESALETIRRYLSTQFWKDHLKMYKKRPIYWLFSSGKEKAFECLVYLHRYNDATLSRMRTEYVVPLLARYQANIDRLNDQLDEASGGEATRLKRERDSLIKKFSELRSYDDRLRHYADMRISIDLDDGVKVNYGKFGDLLADVKAITGNAPEVI

SEQ ID NO: 3239 - protein, 1246 aa, Vibrio cholerae; identical to SEQ ID NO: 2910

SEQ ID NO: 3240 - protein, 1246 aa, Vibrio cholerae; identical to SEQ ID NO: 2910

SEQ ID NO: 3241 - protein, 1213 aa, Fusobacterium necrophorum
MNKSNLKKFAIEARQELREKTKAQLKRLGIEEKKIEEGKDMGSQVEIYGKLYSKSSYQHLLVKYHSLGYEELVEESAYLWFNRLTALAYMELHDCFTEHMIFSKGNKGEPDILDEYFQADFFQKMPLEKQEELHQLRDKNTSDSLETLYSILMEEKCEELSKIMPFLFSKKGKYADILFPSGLLMQDSVLKKLQVILLEIQEEDQSIPVEILGWLYQYYNSERREVVYDGSMKKSKIKREFIPAATQLFTPDWIVRYIVDNTVGRLAEEQFSISKDIIKKWQYYIAPEIVSKNEKMQIESLKILDPAMGSGHMLTYAFDILFDVYQELGWSKKESVLSILQNNLYGLEIDDRAGQLAAFALLMKGKEKFPRLFQVLEREENFEMPVISLQESNAISKRMYTMLEECPTLQDLLKGFEDTKEYGSILKIDSFEESILQEEYHKLQEKIQNQGQFSLLNNNEFLEGDLEEDLERLEHIIRQYKIMIQKYDVVITNPPYMGNARMNPKLKTYIEKYYPNVKTDLFSVFFIKCCEMTTEKGYLGFMSPFVWMFIKSYEELRTLFIHSKTIISLVQLEYSGFEDATVPICTFILQNTVIKKIGEYIKLSDFKGVKNQPIKTLEAIQNENCTWRYQANQKDFTKIPGSPIAYWVSDRIREIFEKEKKLGEVGDAKVGLQTGDNNKFVRLWHEINFNKIGFGMQNSEEALKSKKKWFPYNKGGEKRKWYGNQEYVVNWERDGYEIKHFCDTNGKLRSRPQNTEYYFKKSISWGLITSSGSSFRFYPEGFIYDVSGMSYFIEDKFLTYLGILNTKIYSKLTKLINPTINLQIGDILNLPVANIQNPLFEQLVSLILWISFEEWASRETSWDFERLTLLNGENLSKAYKKYCTYWESKFFSVHSSEEDLNRILLESYSLQEEMDEKVDFSDITLLKKEASIVENTDSAASCGYLENRGVRLEFHSLELVKQFLSYAIGCIMGRYSLDKPGLIMANSDDVLTMSSNKITVSGVNGAIRHEILNPSFFPEEFGILSVTTEERFENDVVSRVIAFISAAYGKEHLAENLEFITEVLGKKAGESHEEVLRNYFIKDFYTDHCQRYQKRPIYWMLHSGKKNGFSALIYLHRYEKDTIARMRSDYLLPYQEFMEQQEAHYSKIASDEISTPKEKKDAQKKVKELHDILKELKDYANKVKHIAEQRISLDLDDGVKVNYEKLGSILKKI

SEQ ID NO: 3242 - protein, 1246 aa, Vibrio cholerae; identical to SEQ ID NO: 2910

SEQ ID NO: 3243 - protein, 1118 aa, Xanthomonas vesicatoria
MMQALDKDLRSALEKTVKAARTVAETAANAAVEQLGVGHDKPEAFLSNDEKALRNRLRTHGKQLGDARDSKSTNPTYGKQAVQHLVQEVAYQHWHRMLFARFLADNNLLMYDSVAVTIEECDELAPDEGAKSGWELAGRLAARMLPQVFKPGSPVFELTFAPEHQSELERLLKHLPDAVFKASDSLGWVYQFWQADNKERINKSEVKIGADELPAVTQLFTEPYMVAFLLHNSLGAWWATRHPCKPCPVNLDYFRTLEDGTPAAGKFEGWPDSLADFKLLDPCCGSGHFLVAAFLMLVPMRMAAEGLTAKEAVNRVLAENIHGLELDPRCVEIAVFAVALEAWRYPDASGRPLGVGEIPAPNIACCGLKVAAKAQDWEALVPDEAPNAEYVRQELRQLHASFSDAPLLGSLLDPARSLKNDLATSSYETLRALLRKALATERPANLLAEDDDRWDLALSAQGLLEAARLLDARYHLVITNVPYLSRAKQSDVLKDYCERHYQEAKNDLANVFLERCLELARDAGVTQIVMPQNWLFLAGYKKQREKLLKTTLWNLLVRLGPGAFETIGGEVVNVILMTHTRKQPTPNFMLRGIDVSTSRPAQQKAKNLVTEPLASVSQSNQLSNPDSRVALSDIQSGSLLADIGDFGKGSTTGDSPRFLIEFWQIARLQPSNVPWVDSPTPRAPWSGRSLVTTVCLDDPNLNAQLGCWLRGNAVWGRRGVAVNKMKELEPFLYSGEVFDDNVCPIVPGDESLIPAIWAFVSDPSYREAVREVDRALKVTAGTLTKVPFDATYWSQVAKEKYPTGLSKPYSDDPTQWLFHGHPRSASDPLQVAVARLVGYTWPAESDDKMELSDEARGWVSRSKTLASHADKDGIVCIPPVGREASASDRLLNLLVDAYDADWSNDVLAQLLTAADHAGKSLETWLRDKFFTQHCALFGNRPFVWHIWDGLRDGFAALVSYHKLDYKTLEALIYTYLGDWISRQKRDAESGVDGAQEKLAAADALKKRLELILAGEAPYDIFVRWKPIEQQPIGWNPDLNDGVRLNIRPFLSVADVGKKGAGVLRDKPKSLHWEKDRGSDVPSAPWYELGLQYGGKVGDRINDHHLSLADKRKAREKAK

SEQ ID NO: 3244 - protein, 732 aa, Lactobacillus zeae
MFTPNYNQSVIKNLVTMISEEDFDVSKEGQVEIIGWLYQYYNSEPKDEAFKKKKYDSSEIPAVTQLFTPDWIVKYLVENSLGRYWIRVLHARGDKRSASEIASNFAWKYFMPEAKQEQDLAQPEFAEKKVEAITFDDPAMGSGHILIYAFEVFLQIYESEGYSRRDAAKSVVENNLHGFDIDRRAFQLTYFAVMMKFRAENRRALRLDLRPNVFEVPTTGLTLADFGIEKDTNKQITKNLAELLANFKNAKELGSLLDFSTVQLNDELINSIVSTKRVGQLSFDESQSLEHHNELSKLIAVGTALQNRYVINVTNPPYMGSGKMPSILSRFVSKHYPASKSDLFAAFIERLHGMTDEDGLFAMITQHQWMFLSSFKALRERMMNWPIINMAHLGTRAFEEIGGEVVQTTAFVIQKHPESEYVGTYERLVNFDSQSKKQKAYLEAVKTPSLNYVYRTNQTNFEKIPGSPIAYWASKNLIIDFEKGVNLDTIVDPKAGLTTGDNALFLRQWFEVSSENIFFNAHSNEEATKSSARWFPYNKGGSYRKWSGNYDFVVDWKNNGVAIRNFTRGTTQIKSRVMSSDTYFHSAITWSLITSGGFSIRYRRSGSIHDSAGKEAFGSESNLLLVLGLLNSKLGDYIFKLLNPTINMQIGDFRNFPVLKINSQLNICGIIKQNIELSDLDWNVDETSWDFLTNPLSASIAEHNRASPTKSLHFKVICDKYVPTMQGGCING

SEQ ID NO: 3245 - protein, 1185 aa, Lactobacillus zeae
MDKKAINKFAVEARRELITDISLRLRNLGITESGIAAKEERSTSQIEFYGPDVPPVIGEDIKRRQALVNRLTAMAKDKSLKDAIKDLTEEVAYTWFNRIIAIRFMEVNGYLPSGVRVLSSETHRNEPDILRDAFDAEDALGGYTPDERNLIRKAQETELPKDMDSAYAMLFTKQANALHKNLPELFEKTDDFMQLLFTPNYNQSVIKNLVTMISEEDFDVSKEGQVEIIGWLYQYYNSEPHDQVVNINGGPVKTSDIPAATQLFTTDWVVRYMIDNSLGKLYLEHYPNSPIKDDLKYLLPGPIERTDKPLDLADLKVLDDAMGSGHILVYAFDLLIKMYDEQGYSNREAAAMILAHNLYGLEIDKRAYQLAYFALMMKARQYNRRILRKPIQHHLNVFENMQKIPEDVFAELKGNSETIADIRDLIQTFKEGKLLGSIMHFEKNYDLVAIRQAIDTLPENTGLDVFGIHQAKKALGQMVSIASVLQTKFDVVATNPPYLNRMNGDLKKFVKKYYKPYSGDLFSVFIWKNINMTKQNGYAAFMTPFVWMFIKTYESLRRNILENQQISSLIQMEYSAFEEATVPINTFVVRNSQSHNFTGTYLKLSDFKGGMEIQRQYVKKAIEDPSVSYVYRTNQTNFEKIPGSPVAYWVPENVFEKFQNSPSISDFLFAGVGIQTGNNLRFLRRWYEVSFQNIKFNACDAIDFARTSKKWAPISKGGPYRKWFGNLEYVINWENNGNEIKQHLGASKQKAIVPNEQFYFHSGFTWSDITSGKFSMRLLLPGMLFESNALSAFSKQKNISDRYLMGFANSTVGNYLLSILNPTIHMKSGYFLNLPVSRSAQEPNITEKVRQNIVLCHVDWNLDERSWGFKWDLLVSCIAEHNRNWTVEAAFNQWKREAEDRFNQLKSNEEELNRIFIDLYGLQDELSPEEDDKEVSVRKADLTRDIKAFISYFIGCVFGRYSIDTPGLAFAGGSWDSTKYETFKPSADDFILLTDEDYFGDSRDIINRFKEFLTTTFGEEHLAENMKFIANALGKRGSTPEEQIRSYIRDDFYQKDHLSTYQKRPIYWELNSGRNGGFVGLMYLHRYNTGTMAMIRTKYLHPLQEAYKQRLEQLQNFAEKEKETRQKNAYKKQISKLTKQMTELVKYDEQLQHVANLNIDLDLDDGVLVNHEKLQAGTKILTPIK

SEQ ID NO: 3246 - protein, 1296 aa, Bacteroides ovatus; identical to SEQ ID NO: 3224

SEQ ID NO: 3247 - protein, 378 aa, Escherichia coli; identical to SEQ ID NO: 3147

SEQ ID NO: 3248 - protein, 635 aa, Escherichia coli
MNTNNIKKYAPQARNDFRDAVIQKLTTLGIAADKKGNLQIAEAETIGETVRYGQFDYPLSTLPRRERLVKRAREQGFEVLVEHCAYTWFNRLCAIRYMELHGYLDHGFRMLSHPETPAAFEVLDHVPEVAEALLPESKAQLVEMKLSGNQDEALYRELLLGQCHALHHAMPFLFEAVDDEAELLLPDNLTRTDSILRGLVDDIPEEDWEQVEVIGWLYQFYISEKKDAVIGKVVKSEDIPAATQLFTSNWIVQYLVQNSVGRQWLQTYPDSPLKDKMEYYIEPAEQTPEVQAQLAAITPASIEPESIKVLDPACGSGHILIEAYNVLKNIYEERGYRGRDIPQLILENNIFGLDIDDRAAQLSGFVLLMMARQDDRRIFTRDVRLNIVSLQESLHLDIAKLWQQLNFHQQVQTGSMGDMFAENNALTQTDSAEYQLLMRTLKRFVNAKTLGSLIQVPQEEEAELKVFLDALYRLEQEGDFQQKAAAKAFIPFIQQAWILAQRYDAVVANPPYMGGKGMNGELKEFAKNNFPDSKSDLIAMFMQRAFSLLKENGFNAQVNMQAWMFLSSFESFREWLLDNKTLITMAHLGSRAFSQISGEVVQTTSWIIKNNHIKDYLPVFFRLTDGNEEQKKKNL

SEQ ID NO: 3249 - protein, 378 aa, Escherichia coli; identical to SEQ ID NO: 3147

SEQ ID NO: 3250 - protein, 635 aa, Escherichia coli; identical to SEQ ID NO: 3148

SEQ ID NO: 3251 - protein, 1171 aa, Coprobacillus sp.
MNKTAIKNYAVWARNELITRVTRKAFEYGIDKDNIVDINTDNINGRILTKDEKEQRNKLIKEINAKGFEQVIEEVAYTWFNRFIALRFMEVNNYLPNRIRIFTNFDNEFKPQILDEAMNLELEGLDKKLVYELLDANNKDELYKQLLIATCNDMGNYLPGMFTKILDYKVLLFPDNLLNQDSVLGHLVTDIDEDNFNVKKEGQIEIIGWMYQFYNIEPKAKVFGKSKGEKISKDEIPAATQLFTPDWIVRYMVENSLGRIWVEGHPNELLKENWKYYLDEAKQESEVELKLKELRNRYAELPPEKINLIDPCMGSGHVLVYAFEILMQIYESYGYTKRDATISILEKNLYGIDIDERAYQLAYFALMMKAREYHRTILSAGINLNLSFIVNSKSLKESELERLEDCKNIAAKLISDFNDAEEYGSILKVNYSVEDLTKLQNKIRLLEESNKNLVDIIEIDNISSNLIPLIKQALLLSNKYEVVITNPPYMPISNGSKVLQEYVKKQYPDSKTDLFAVFMESCKNMLVENGFQAMINMHSWMFLSSYENLRKRILENNIIINMAHLGARAFEEIGGEVVQTTTFVLQNTYYKNYVSTFKRLVDYNSQQSKEYAFFDDKNKYIAEMSNFNKIPGSPIAYWVSTKMIDAFDNRKIGDLGNPRQGMIPGNVNEFLRLWYEVGFNRIGFNHNNSDDIVEYKYKWFPYNKGGAFRRWYGNMEYIINMENNGYDIKYSGKNNNYRLREPELYFKEAITWSKISSGSFSARYMPVGNLFDIAGCCIFDLGTRLYYILGYTNSKVNSSLLSLISPTLNYEVDHIKKLPVRIDNLKVKEVNSIVESSILLSKQDWDFFETSWDYQIHPLVKLKMLNGYSDDRTGLNCTIKSAFANWQGDCNKRFNTLKSNEEQLNRIFIDIYGLQEELTPEVEDKDVTVRKADLVRDIKSLISYAVGCMFGRYSLDVEGLAYAGGQWDDSRYKSFIPDVDNIIPICDDEYFDDDIVGRFVKFVEVVYGKDSLEDNLTFIANALSNKGNTSREVIRNYFINDFFKDHCKIYQKRPIYWLFDSGKKNGFKALIYLHRYQPDLIARMRTKYVFEQQSRYKNQIDLLGNQLNNDISSSEKIRLNKQLKKFKEQNEELRQYEEKVHHYADQMINIDLDDGVKVNYEKFKDLLAKIK

SEQ ID NO: 3252 - protein, 1420 aa, Haloarcula argentinensis
MDGQSTHPRKAQLDKEEREHLEDVVTEMRDRVEANVRYQLEDEYGLDVKPDTVGASSDEPSLADAREDDDASLSEAQENLVEAIELEAADGHSWEDAHEQYITGVGYTIVNRLAALRCMEVRDFIEDEVTAFRDDGLTPAADRLVTEEFMLEEEAVLEAYRNACDDLADEIEILFDRSTAYSQIDPDDDTYEDLCSLLDKVPDEVWRADDVLGWVYEYYNRPVVEALDAKNTLEPEDVGPANQFYTPHWVVRMLTDNSLGKLYLEATGQESTVPEPEALSPEERKERLVTPEDSPTVPELCTYLIPDEEAGAAPEFDHPSELRVIDPACGSGHFLLYAFDVLERIWWAETDLDRAEIPAKVLEHNLYGVDIDLRSCQLSAFNLYLKARTRTEEEDGQFEMPNVDIVCADARVAEVEEGAAVLDDITGEGTDLREALGDIIDTFQHTEALGSLLDVSGTLEEVFDSSKTQSELTDYNEGAHQSLHSFLKALRRAVEERTSDSFGEQNLKSFLNLLVVLTQEYDVSLMNPPYGASGRMPPDVRDYVRDHYKYAAEYYINFFEACNRVTKQNGRVSMIVPRTFMFKSSFEEFREDFIGAQGSFDFLAEYGNDVLDNATVRTAGTVVRVGNYADQESTGTFFRLHDVNSHRKEGTFLNTAFGEGDDNIERLFSRPLSEFDKIPGSPISYWAPPQIRSLYDSDTVLDADNGRLNDRKSLGDAKQGLITGNNGRFVRKYWEVDSYTYWKPFAKGGEDAWILPQVNLTVAWGDSGEEIRRYEGSRPQNTQYFFTEALTYTYMKESGRRFGYLHPESIFGRAGCAYIPSRSPWNVLSYTNSNLVTYLMVCQTPDRQWEVGYVSKLPWRDELGSNTRLESLSREIVGHLISKRRYDFASPYYECPVLLGVLGEETSPQKFDHPHKGLREELELDQPDFSAKKGSPLSKLGTIAAKHLEQVEYNLQSCAGAIDEAVFDQFDISAQNRETVLQEISLRTNEDPRERKDHDPESITEPSDDFPEQVKDLLLHFTLRAIHDADDGIVPLSEIDRKDDLLTHIEAEFERVWGNYATDRLAEADEVLGNRSASDEAYPNLRAWLENDLFEYHISKFDRTPILWRFSTERLVSDPEGEGFGCLVDYHQLDASIFDRLQNQYLEPRRTHLRERRAAANSRRNDESLSASERADAAEEYERCESGLEQLSAFEEQLGELSEPSPREWPDEKQERAAEAAERVAEFRERTASRLDTLETLADLEDVDMGDLFSPSFYETVQGNKDEWIDALDDLQTAFEAYAEAGTEPVEAHLYDLFEYYDDLVGSSHYASNGILFMTYYFDQFEDAGQAQIGDAGVSERQRLLSELAADVDEYTQLADEISEDCDEVAADIPNDWEERALSEVTTTGYQPVHKHGVAINITPLAEKSIVPEVVEDKVL

SEQ ID NO: 3253 - protein, 1215 aa, Saccharomonospora glauca
MVGASKGERQTVAVRGADLGELVKDLRRQVTVLEDDLRARAQEVSEFHTPLRAEYDEARKRERTAATWESWLDQRVTQVAAAWVLGTVFVRFCEDNGLIQWPFLAGPGERLADAEERHEAYFREHPQDNDRDWIVAAFNHLAEAHPTAAGLFDARFNPLWEITPSFEAATALLQFWRRRGDDGEIRYDFTDPEWDTRFLGDLYQDLSEHARKTYALLQTPEFVEEFILDLTLEPAVEEFGLKGLRTIDPACGSGHFLLGLFRRVLAKWREAEPGTDQWELIQRTLGSVHGCDKNPFAASIARFRMLVAVLREANAIRLDQAPRFPINIAVGDSLMHGRGAPGIQGELFALDEPHTYTTEDVNEYVRSCDLLGKGSYHVVVGNPPYITVKDKQENQNYRDRYDACSGKYALSVPFAQRLFQLAIRRSGSDRDAGYVGQITANSFMKREFGKKLIEDFFRTVQLTHVIDTSGAYIPGHGTPTVILVGRNHEYRQDDPVRAVLGIRGEPSQPEDPAKGLVWSAIVEQITRPGSESEWITAEDVDRTAFAGHPWSLSGGGAGDLQDRIQSGGSMLLGKCFESSGFAAITGVDDAYVLASPLPRWRENQDVQRRVYVEGDQVRDWACGATAKVVYPIDLNVDERSYIETVYLWSMRSVLRRTIYFGETKEERGYHWSDYAFFMRERLKSRLLIAFAFVATHNHFTLDRGGKVHNKSAPVIKLPEGAGEDEHLELLGVLNSSTACFWLKQVCHNKGGPGGGYSKGEKWRDFYEFTGTKLQEFPLPAVLPLELGRALDSLAQDLAAQEPSAIAEAATPTRERLDAARAEHARIRGRMIALQEELDWTVYHSYGLLDDTERAQLTAPDLDTVPEIRLGERAFEIVLTRRMRAGLEETRWFTDFGGQPQTEVPEHWPEWYRQLVQARIDVIEKRRDIALIEQPNCKRPWESETWERKEADALRTWLLDRCERRDLWFGLRDGFEQPRTLTVHQLADAFRDDADMHAVAALYANDHLGKPDLPLAKVLETILTDQHVPYLAALRYKDSGLRKRAQWEQVWEKQREEDRTGQRLDIPVPPKYTSADFRKTSYWTHRGKLDVPKERFISYPDASPDADPSLLLGWAGWDHKDQAQALVNLINDRTADAGWETERLTPLLAGLAEVMPWVRQWHGEYDEEWEGVPADEYQAFLDEQRTKHQLTEDDLKNWRPAPTRRGRRGTAKETQQ

SEQ ID NO: 3254 - protein, 1189 aa, Rhodococcus triatomae
MALATISGAALKDALKPQLTLLVDDMRTKLTADADELARWRAIHREAVAEQRTAVSWTDWSEDQLTQAAVGWLLTSVFVRFCEDNLLLGDTTVWITHPDPMLRQRAVDAEQAFYRADTNNSYREWLEQSFDALRKYPATQSLVDEHAALNIIAPSSDAVHQVLSFWRQVDDSGSLAWTFRDPELTTRFLGDLYQDLSDFAKKKYALLQTPEFVEEFILDQTLEPALKDRPLEGFKVIDPTCGSGHFLLGAFARLVDRWNREAPGLELRTRVDNALSSVYGVDLNPFAVAIAKFRLIVAALKACGETTLVNAPKFTLNLANGDSLLHGAEQGGAKAFDFGDLSFDKDAVVSGFAYSTEDVALLRRILAPGQYDVVVGNPPYIVVRDKALNQRYREIYHYCKGPYALTIPFMEKFFNLAKHGDRAGWVGQITSNSFMKRDFGKPLVEEFFPGVDLRTLVDSEGAWIPGHNMDGTPTVILVGRNRRPSSDSVRAVLSLGIRETPDDYASGKGPYWRSLVDHLDDPNFENRWVSIVDLRRETLKRHPWSLSGGGAVETLASIETSRNLQLRDLVDAIGRTTHTGLDDAFFVSPASAKTRGFVGDTAPVVLGEDVRDFIVGPAQLTVFPYDDHGETRELGSAAAHFLWLNRTALSRRVDFDQTLDERGLHWFEHSMFFKKRYRTPLSIPFAFVASHNHFALDRGGKVFNRSASVIKLPPDSTEEDYLQLLGTLNSSTAGFWLREKTQPKGGAAEHAWSRTREYTGSALLDFPIPSSSPLERARRIDGLSQQLLAQEPSAVLSRDGVNQGAINDAGAEHARIRALMIAEQDELDWEVYRNYGLIEGSLFLPEGQAPGIALGERAFEIALARKVATGEAETAWFERHGSTSVTNVPTHWPAEYRDLVEKRLQAIESNPFIRLLERPEYKRRWAGDTWEVKLKRALKDWLLDRLEDQSLWFTAQGTPQMLSVAELAGHVEKDPEFITALDLWTGKKDAPVTDTLVKLLADEAVPYLAAMRYKESGLRKRAEWERVWDLQRDEDAGLRKATDIPVPPKYTSADFAKTSFWSHRGKLDVPKERFISYPGAGRATDPTPLLGWAGWNHAQQGLALATIYALREQEGTALTDLVPVVAGIAEILPWVKQWHSGVDPTFGIDLADYLQGQLNEKSAAVGVPVPDLTNLRPPKTTRVRQPKQT

SEQ ID NO: 3255 - protein, 1220 aa, Saccharomonospora cyanea
MVGASKGERQTVAVRGADLGELVKDLRRQVTVLEDDLRARAQEVSEFHTPLRAEYDEARKRERTAATWESWLDQRVTQVAAAWVLGTVFVRFCEDNGLIQWPFLAGPGERLADAEERHEAYFREHPQDNDRDWIVAAFNHLAEAHPTAAGLFDARFNPLWEITPSFEAATALLQFWRRRGDDGEIRYDFTDPEWDTRFLGDLYQDLSEHARKTYALLQTPEFVEEFILDLTLEPAVEEFGLKDLRTIDPACGSGHFLLGLFRRVLAKWREAEPGTDEWELIQRTLGSVHGCDKNPFAASIARFRMLVAVLREANAIRLDQAPRFPINIAVGDSLMHGRGAPGIQGELFALEEPHTYATEDIDEYIRSCDLLGKGSYHVVVGNPPYITVKDKQENQNYRDRYDACSRQYALSVPFAQRMFQLALRAHGSDRDAGFVGQITANSFMKREFGKNLIERFFPSVHLTHVVDTSGAYIPGHGTPTVILVGRNHISRNDDPVRAVLGVRGEPAQPSDPSKGLVWSAIVEQISRSGSESEWVTADDIPRSSFSNHPWSLAGGGASDLVRSLHEASSRNLGTVLLLTGRTTHTGSDEAYFAPVGTWARLGLPDERVATLVEGDSVRDWSLPLVTEAVFPYGADLRADLKDLPTYKHLWMHRAHLRERREPGGTHEEIGLTWYEWSRWHPERFSVPLGIPFAFVATHNHFVLDRGGKVFKQSAPVIKLPEGAGEDEHLELLGVLNSSTACFWLKQVSHNKGRPGAEQTGADEPWEHRFEFTGTKLQEFPLPAVLPLELGRALDSLAQDLAAHEPSAVAEVGTPTRERLDAARAEHARIRGRMIALQEELDWTVYHSYGLLDDTERAQLIAPDLDTVPEIGPSERAFAIVLARRLRQGETDTTWFSHHNHKFPPVTEIPAHWPDWCRQIVQARIDVIEKRRDIGLIERPECKRRWASETWERKEADALRTWLLDRCERRDLWYGLRDGFSQPRTLTVNQLADQFRDDADMHAVAALYASDHLGKPDLPLARVLETIIADQHVPYLAALRYKDSGLRKRAQWEEVWEKQREEDRTGQRLDIPVPPKYTSADFRKTSYWTHRGKLDVPKERFVSYPGASPDADPSLLLGWAGWDHKDQAQALVNLVNDRTADAGWETDRLTPLIAGLAELMPWVRQWHGDYDDEWEGVPADEYQAFLDEQRTTHQLTEADLTNWRPAPTRRGRRSATKETQQ

SEQ ID NO: 3256 - protein, 1198 aa, Gordonia polyisoprenivorans
MSLATIAGSQLTADLKPQLALLVEDMRAELDADADLTAAWKSEHQQARTQERTAASWTDFVEDHLVQAAVGWLLTSVFVRFCEDNLLLGPTAVWIAGPTPALRQRALDAEDQFYREERGAEQGTRSYREWLEQGFAALRANPGTASLVDDHAAIGLIAPSSYAIEQLLAYWRRTDDDGALRWSFADPELSTRFLGDLYQDLSDYAKKKYALLQTPEFVEEFILDRTMEPALKERPLEGFTLIDPTCGSGHFLLGAFTRLVQRWEEAAPGMEPRARADKALASVHGVDINPFAVAIAKFRLIVAAMKASGDRDLVNVPKYTLNLATGDSLLFGPERDGQHAFDPAGGFVDKDAVASGFAYSTEDRERLQSLLTLGQYDVVVGNPPYITVGDKALNARYREIYSHCKGAYALTVPFMERFFALAKRSDRPGWVGQITSNAFMKRRYGIPLIEDFFPQLDLTSVVDSEGAWIPGHNMDGTPTVILIGRNRAPVSTVVRTVQSMGVREVPEDVGEGGYGPYWESIVEHVDEPGFEDQWISVVDLPRVNLSQHPWSLAGGGAVELMAAVDAHAGRLLSEIVEEVGFGAVTREDSAYMVGLGTLRRAGIPADQRRPMVLGEDVRDWNLNDLIESIWPYHLQTLSALKDPNIQRFLWPVRTILSGRVAYGSTQIERGLEWFEYSMFFRNRFRSPLTITFAEIESHNHFVLDRGGKVFNRTAPVIKLPESSTEEDHFGLLGVLNSSTALFWLKQKTKAKGGAASHAWARTYQFNVTTLLDFPLPEGLPGFSASDLDDLALGAARVEPAATLAANGPSREALNAAREQSAAIRASMIRDQENLDWEVYQLYGLIDQNLNPPEGNPGPGLALGERAFEIALARRMAAGEVETAWFERHGSTPITEIPSHWPQDYRNLVQRRLDAIENNPYIRLLERPEYKRRWAGESWDTKLQRALRDWLLDKIEQPQLWVNAQGLPQPQSVGELAGALGRDAEFVQGLDLWAGYKDAPVTETLVKLLDDQAVPYLAAYRYKDSGLRKRAEWERVWDMQRDEDAGVISATDIPVPPKYTTADFRKTAYWSHRGKLDVPKERFILYPDAGRETDPTPLLGWAGWDHAQQGVALAAIYAMRESEGIEREKLVPIVAGIAELLPWVKQWHSGVDPNLGIDLHEYLTSQLQEKSQTVGVPVSELGQWRAPAPVRGRKTKAGQ

SEQ ID NO: 3257 - protein, 1218 aa, Amycolatopsis azurea
MANGIDQKALLADLRKQLTTLEDDLRERSAELEFDGPLRDEYQKAVDADRTAAIYETWRDDRVTQAAVAWLLGCVYVRFCEDNGLIPEPFLSGPGDALATAHERQEAFFRANPHLNDRDWLEAAFTHLTEAHPTAAGLFDRRYNPLWELTPSFEAATALLSFWRRRGPDGEVIHKFADESWNTRFLGDIYQDLSDHAKKTYALLQTPEFVEEFILDLTLTPALETFGLDPVVEIHRHGGGTERTREGLRTIDPACGSGHFLLGIFHRLLAEWRRTSPGIDDWILIRRSLESVHGCDKNPFAASIARFRLLVAALKASGTRTLASAGEFPINVAVGDSLLHGIGVAGEQIDMLDSKADEEFTYRSEDVNEYINSCDLLTSASYHVVVGNPPYITVKDRRENENYRARWKTVCSGKYALSVPFAARMFHLATPTQQGGYVGQITANSFMKREFGKKLIENFLRNIDLTHIIDTSGAYIPGHGTPTVIIIGRKKISNEHKPIRSALGIRGEPETPPDPTQGLVWQAIIEQISTPGSESDWISVADVDRHTLSSHPWSLSGGGADALLARIENSTTKKLERVSDSIGITSFTLEDDLYLQPKRSALRKSVSEEYLRDMITGDLLRDWSSGNPESALFPYTTDFKPIDVEGTPGLHRAMWPARTTISNNVLFGRKTKLDAELKWSEYGRLTHRKLLTPLSITYAEVSTHNHFVLDRGGRIFKQTAPVIKLASGRTEGEHLAILGLLNSSTACFWLKQVCHDKGIRGEGGGFTSNDWERFFQFNATKLQQFPLPAAAPARAATLLDALSRQLADTEPSVILDNNIPSRESLENKRIEQMKTRAQMISIQEESDWEVYKLYGITSEIESSELQYSLEDVPEIALGERAFEISIARRASIDDSVDLEWFDRHGSKPITELPEHWPEAYKQVVEKRIETINSRRDIALIERPECKRRWATEPWEKKERKALETWLLDKCEDKELWFALRDGLTGPRTLTVSQLADLLRTNDDVNSVAALYAADHLGKRDLPLADVLEQVIATEHVPYLAAMRYKETGLRKRAQWESVWEEQRKEDRTGKRLDIKVPPKYTSADFAKTSYWSHRGKLDVPKERFISYPGAGPEADPTLLLGWAGWDHKDQALALVNVINDRLEQEGWETDKIAPLLAGLAELMPWVKQWHAGYDAEWGGNPAEEFQTVLEQQQTKHGLTDEALSKWRPEQTRRGRRKS

SEQ ID NO: 3258 - protein, 764 aa, Marinobacter sp.
MINRADLLSSLQSLLPHIEQDILAYSAANERLHEHLQQQYQAAVAADRTAEHFVAWREAQITQAAVAWVLTCVFVRFLEDNGLLTEPVLAGPVSNAQGNNTLQQAKERMAAYFNDNPTHEERHYLLDLFQTLQQYPVIAQLLDQRHNPLWQTPVSADGAKRLIDFFQQIDPQTGDIKQDFTDPEWDTRFLGDLYQDLSESVRKRYALLQTPEFVESFILDYTLEPAIETFGLPGLRLIDPTCGSGHFLLTTFERVFERWLKREPGTNTRKLAQRALDVVHGVDINPYAIAVCRFRLLIAAMKAAGSDRVKDAPKFEFHLACGDSLLHGRRHEWEGQGDQQDFLGKHQHVYEVEDEQKLNQILGQRYHVVVGNPPYITVKDKVLNQAYRSKYLTCHRKYSLGVPFTERFFDLTLWPVDNQSAGFMGMITTNSFMKREFGKKLIEVYLPRKNLTHVIDTSGAYIPGHGTPTVILFARNQSSKSDVIRAVLGIRGEPGTPDDAAQGKVWSSIVELLPKAGAENDYISVVDQATEAFAAHPWSLGGGGISELKEFIEAEKARLGSIVSLIGFGAILGEDDAFGVPHEKVGSVSFPLQNRPLVEGDQVRDWALGSVTAVIFPYDHDINLSIDRGQKKYLWPLRTQLWSRKTFGEKTYKEAGRHFAEYHQIPVGRNKVPLSITFAFVATHNHFALDRGGKVFKQTAPVIKLPQCATEADHFAFMGLLNSSTACFWGRQTFFGRGGFSDGKWQERMEWDGTKLKSFPVVSE

SEQ ID NO: 3259 - protein, 1218 aa, Saccharopolyspora erythraea; identical to SEQ ID NO: 2945

SEQ ID NO: 3260 - protein, 1206 aa, Streptomyces turgidiscabies
MIDRKALLNDLKQQVKAVETDLGRQVKALGDVGARLRAEYDQARKLGRTAATWTSWLDERVTQVAVAWVLGSVFVRFCEDNLLIPEPYLTGPDGDRRELAESRYDAYVESDEDPTYRGWLEKAFEELGQGQAGRLLFDQRHNPLYQVPLSHDGARDLVEFWRGRDEAGVLVHDFTDPLNEDGTEGWDTRFLGDLYQDLSEAARKTYALLQTPEFVEEFILDRTMNPAVREFGYEELKMIDPTCGSGHFVLGAFRRLVRLWGEGQPGRDVHERVRAALDSVHGVDINPFAVAVARFRLLVAAMAAGEVRTLAEAAKYEWPVHLAVGDSLIKARQLELMLGGDENGLDDPLASFAYVTEDVHEHPGILQQGRYHVVVGNPPYITVKDKNLNALYRELYDACSGKYALSVPFAQRFFELAKRGDAAGSGYGMVGQITANSFTKREFGTQLIEGYFVHQVELVEVIDTSGAYIPGHGTPTVILIGKRRGGSARSEVIRTVRSVQGEPSVPDKAEEGMVWSAIVKQIDQPGSVSRWVSVDDLNRIRYFGKQPWILSDGGLEMLDQIAAQSTGNLREVAVESGISSVTGEDDLYLLPLNGSVGRNRIEYSRPMVTGDVIRDYRLVSTFEAVWVYDSDFKVLPLGQVPGTERYLKPYRAAISHRRRFGTPMLQRGLTWYEWQELYPAKLLTPLTITFAFVATHNHFVLDRGGKVFKQTARVIKLREGASEEEYLRLLGLLNSSTAGFWLKQVSHNKGSTVDSKGARQSTIPFEDFYEFTGTKLQDFPLPARYPTQLATALDALAQQLSITSLAALAGQEIPTAPVLREATSRWGSTRARMIALQEELDWQVYSLYNLHSEDLRVSEDPDDPNIPELDLGERAFEIVLARRVAAGEASDAWFKRHDSTPITEIPAHWPVPYREVVQMRIDAIESNRAVGMVERPEYKRRWATEGWDALQEKALRSWLLDRMEKRDHWFDENGQPTILTLARLTDALSRDEDFVSVAKLYAPRKDLAKAVAELITDEHVPYLPALRYKPSGLKKRADWEEVWDLQRKEDAASDEPAKRKIRDSIPVPPKYTSADFLRPSYWKARGKLDVPKERFVSYGQTNAATPELYGWAGWDQREQAQALATYFTNTALSTEEITPFLAGLLELQPWLSQWHNEFDMNYSGSPADFFAGYRQQKQGEHGLTDDDLRNWQPLAATRGRRAAVKK

SEQ ID NO: 3261 - protein, 1267 aa, Gemmata obscuriglobus
MIDRTAFLADAQKIVARLEKDLRARCDDMPEVGRAVGSEYRTAKDAGRTGQTLEEWRADAITQQAVAWVLSCVFVRFLEDNRLIDPPKISGPVPPEGEKGENRLARARDEHELFFTGARRGSEFTDREYLLSVFDELAKRPGTKDLYGPHNPIRAIPNWLSPDAAKDILLPFFQKIDAGSGLLVHDFTDPSFDTRFLGDLYQDLSEAARKKYALLQTPVFVEEFILDRTLLPAIETFGLATVKMIDPACGSGHFLLGGFNKLLELWVKKEPGTPPRELVQRALDAIHGVDLNPYAVAIARFRLLLAAWQAAGVTSLKNAPDFKLNLACGDSLLHGGRSVQKTLDEEVFGHTYQPEDPVELERLLRPGTYHAVVANPPYITPKDRGLCDQYRDRYSACHRQYSLSVPFMQRLFELACANGFIGQITANSFMKREFGKKIVEAFFPLIDLTHIIDSSGAHIPGHGIPTVILFGRNRPPVATTLRAVMGIRGEPCVPANPATGPVWSSIEQQVDQPGSQGKFVSVSDAERAVFLKHPWSIGGGGVADAKETIDQVSNTCLASIVESLGRTVSTQGDDVFVVPTAQARRSGIVTGHYRPLVRGEDVRDWQAKADLAVLFPYDTNLLPIPDDLSATVLRYLWPAKAVLASTLMFGDKTKVQTGLRWFEYGQFIADRLRNRIALVYSEVATHNHFAFDRGSRVFNRTAPIILLSSSVTEDGHFALLGLLNSSVAGFWLRQVCHDKGSSGITGGIKVEAWDRFFAFNGTNTNRFPLPDARPRGLAFRLDAFARNIADNQPASVIARWVDGLSLSSLLDSSEATCRRCRGTMIRLQEDLDWECYRLYGLSADGLTDSQWETRDLPVKLGERAFEIVLARKMRDEGLETTWFARHGSTPITELPAHWPPDYRKLVERRIEAIAANPQIALIEQPEYKRRWNDTPWAEKVTAALHDWLLARLESYFDIDGRMREDENLPQSRKGAKTEGSSLGDSAALREIRLYPLTRIADVASKDAEFREVGRLYREGRIDFDVTKLVTELVEAESVPLLPVLRYKPTGLDKRLAWERTWDLQRREDAIDARVAGKSVDVGAGGWTHQKDDGKSPLNPAQASLLKQYVVDPNTPQSIPVPPKYKSADFQKGDYWRLRGGLDVPKERWVLFPHCGGADGLPLVAWAGYDHLQLAKAIATHYVHVQEQEGGRDDPRLVPLLAAICQLLPWLKQWHNEMDEEFGSRMGDYYEGFVSEEARGMGKTVDEVCTWQPPAGGNGRSGRGRRAK

SEQ ID NO: 3262 - protein, 1196 aa, Rhodococcus ruber
MADFSATELVKALRKQVTVLEDDLRARVDGADVDTRQPGVEQRWRAEYTAALQAQRTAASWQAWRDERVTQAAVAWVLLTVFARYCEDHALVSRAWIGGPDADARQQALDARRAYFTEFPEHTDREWLETIVAHFAKMEATRGLVDSYSPMHQVAPSGDAARSLLEFWWDKNASGDPLWSFAGVDTRFLGDVYQDLSEFAKKTYALLQTPEFVEEFILDQTLEPALKERPLEGFTVIDPTCGSGHFLLGAFHRLLERWENEAPALGRRVLVQKALASVFGVDINPFAVAIARFRLMVAALEASGDKSIEKLIDIELNLAAGDSLLWGARQQALADDLWSTGAEQMAYATENADALRAILQREHDVVVGNPPYITVKDAALNATYRQLYSTCHRQYALTVPFMELFFDLAKSNSEGKPGWVGQITSNSFMKREFGSKLIEEFLGTRDLKRVIDTSGAYIPGHGTPTVILVGRNRTPVGETVRAVLGVRGEPGRPEESARGIVWSRIVAHIDEPGFDDGWISVAELDRSLLQTHPWSLSGGGAVELAQSVTSAAVSVLDSHVSSIGRTTVVGEDDAWIYDAHNSKRFMEMLPLREFVVGEDVRDFEIAPSTLVVNPYVDSANETPVSERSPVVAHLWPQRTLLQSRTVFQKTLTERGLPWWVHLESYSSKLRTPLSITFAFVATHNHFVLDRGGKVFNRSAPVIKLPEGASEDDHLRLLGVLNSSVGCFWLKQNSHNKGGGGIGRGDSDESWEQRYEFTGTTLDDFPLPSSYPLERGRTLDTLARVLAAQTPSAVAASGVPTAKALEHAHDESERIRALMIAHQEELDWECYRLYGLIDEDLTYSGELPGTTLGERAFEIALARAVESGEHTAWFERHRSTPTTEIPSHLPADYRDLLQRRLDVIKSNPHIRLLEKPEYKRRWASEPWDKRVTEALRDWLLDRVENRDLWFEGDHPTPRSVAQLADRLDRDNDFRQVLRLWAGNNEVSTSAALAKLLDEEGVPYLAALRYKPSGLIKREAWEHTWDLQRREDAGEKLGTPIPVPPKYKPADFLKTSYWSRRGKLDVPKERFIAYPNANRDTDPSMLLGWAGWDHAEQALALAGLVDERIAAEGWDQANPDRLTPMLAGLAELLPWVRQWHGEIDPEYGESVADTIAEVLRSHSTDLGITPDDLAVWRPPASARGRRTVKKSAKENDDA

SEQ ID NO: 3263 - protein, 1187 aa, Mycobacterium xenopi
MTWAAADLVAALRRQVSELEADLRARVDGHDHDLRQQGVYEAWKRDYDAAFAAQRTASSWQQWRNDRVTQAAVAWVLVTVFARYCEDNALVTPRWIGGATGDERGHALDARRAYFQQHPEHTDREWLQQIISHFGKFTATKGLVDEYSPLHLVAPSGDAARTLLEFWWQQSATGEPLYPFAGVDTRFLGDVYQDLSEHAKKTYALLQTPEFVEEFILDQTMEPALADRPLEGFTVIDPACGSGHFLLGAFRRLHERWQRHAPVLGARELVEKALDGVYGVDINPFAVAIARFRLVVAALHAAGDTSVEEQIRYTPHLAAGDSLLWGANQQALGDHLVTIGQAVQADSTENADALKAILQREHDVVVGNPPYVTVKDAALNATYRQLYTTPHRQYALTVPFMELFFRLAHPSGRERPAGWVGQITSNSFMKREFGSKLIEEFLPTIDLRVVIDTSGAYIPGHGTPTVIVAGRNQRPSTDAVRAVLGIRGEPGRPAEPARGVVWTSIVEHVNQLGFENSYITVCDMLRQTLSKHPWSLSGGGAVELLKVLESQANMRLSDVAGEIGFGAVTREDEAFMVGRGAIRRAAIPDELSRPLVEGDKIRDWDIRNVIDSIWPYSSTTLKAVTNQHVVRFLWPARTLLSSRVAYGSTQIERGLNWFEYSMFFVNRYRTPLSITFAFVATHNHFVLDRGGKVFNRSAPVIKLPAGATVEDHLRLLGVLNSSAACFWLKQNSYPKGGDPIGKDGARVSAEGWSDRYEFTGTTLQDFPLPSTTPLDRAKLLDELAQALQQQTPVEVAARQTPAHAVLETARSEFTRLRGLMIAHQEELDWEYYRIYGLIDNDLTYGGDVPEIALSERAFEIALARRMKDGEETAWFERHGSTPVTEIPEHLPADYRDLLQRRLDAIESNPHIRLLERPEYKRRWAMEPWDKQVQAALKDWLLDRVEDRALWYDREGRPTVLSVAQLADILDRNEEFRRVLRLWAGDQNVPTGAALAKLLADEAVPFLAAYRYKPSGLDKRAAWEHTWALQRREDAGEKIDAPIPVPPKYTSADFAKPSYWSHRGKLDVPKERFISYPHAGRESDTTELLGWAGWDHADQALALAALISQRIEDGWDTPRLIPLLAGLHELLPWVRQWHNEIDPEYGESVADTIDDELTARLAEHHLTVTDLTAWRPEPTRRTRRAATS

SEQ ID NO: 3264 - protein, 1188 aa, Micromonospora sp.
MAAGGVERRRPRTTAEERHPMIPLKALQAQVTALTDDLRAVVAGDSELESSLRKEHGQATDARRTAGTFETWLEDVLDQAAVAWVLGCVFVRFCEDNALVEPLWIGGPEPTAPVERAVQHRQQYLIDHPRRNDREWLREAFTYLRGLRATGKIFDEHNPVWRFDISGEAAEKLSEFFRRGPGLASLRVEDLDTRFLGDLYQDLSAHAKKTYALLQTPDFVEEFILDRTFEPAVKEFGLPDTSVIDPTCGSGHFLLGAFGRLVKLWRKREPAGDIRVLVERALGQVTGVDINPFAVAIARFRLLVAAMKECGLTSLERTPAWPVRVATGDSLLRWGRKSSHQGDLLEYGKGESGFAYATEDADVLGKYLREGQYTVVVGNPPYITVADAARNQLYREIYPDVCHRQYALTVPFAKRFFDLAKRSDEHGEGAGHIGQITGNAFMKREFGKRLVEEYLAHHVELTEVIDASGAYIPGHGTPTVILVGRANSRRRVAGVRAVLGVRGEPSQPDEPSMGLVWRAIVDQVGQPGSVSDWVSVADLPRADLSLHPWSLSAGISSPVMSKLQSSARVLSDVVDNIGYTGQTNTDSAMLASKKQFVRVGVEADAHLQFVTGEAVRNFVVHEGDHSLFLHRDSETIDIAGYPGALRRLWPLREALWARRTFAKLSYKEEGRPWWGWHQVASQRLGASLNICFAFVSTHNHFVLSRSERLFNRSAPTVKLRKDATEDEHLRLLGVLNSSTACFWLKQVSQSKAGSGIGRGIQPEAWMDRWEFTGTKLQGFPLPGAYPLGRARALDSLAQRLASLSPAAVADSGVPTRERLRTAHRDYDLTRAQMIALQEELDWEVYRLYGLLDGDLTCAEPPELKLGERAFEIVLARKMAAGEVETQWFARHGSTPITEMPAHWPDDYRALVQRRIEVIESDRNIALIERPECKRRWASDGWDEMQAKALRDWLLDRLEAPELWGDRPTPQSVAQLADKVRHDDDFRSVLELWAGRDDYDLTKTLAKLVADEHVPYLPADRYKPSGLRKRVQWERTWTQQRLEDAGESVQVDVPPKYSSADFAKASYWKARGKLDVPKERFISYPKAGRDNDGTVLLGWAGWDHLAQAQALATVYLDRKLQAAWPAERLLPLLAGVAELEPWLHQWHADERPDFPGSPAQFFTDLIDAELSQLGADRAELTKLRGVMSA

SEQ ID NO: 3265 - protein, 1211 aa, Saccharomonospora xinjiangensis
MAVRGADLGELVKDLRRQVTALEDDLRARALEVPEFHTPLRAEYDDARKRERTAAMWETWLDQRVTQVAAAWVLGTVFVRFCEDNGLIQWPFIAGPGERLADAEERHEAYFRERPQDNDRDWIVAAFTHLAQAHPTAEGLFEPKYNPLWEITPSFEAATALLQFWRRRGDDGEIRYDFTDPDWDTRFLGDLYQDLSEHARKTYALLQTPEFVEEFILDLTLEPAVKDFGLKDLRSIDPACGSGHFLLGMFRRVLDKWRAAEPGTDRWELIQRTLSSVHGCDKNPFAVSIARFRLLVAVLREANAIRLDQAPQFPINIAVGDSLMHGRGAPGIQGELFALDEPHTYATEDINEYVRSCDLLGKGSYHVVVGNPPYITVKDKQENKNYRDRYDACSGKYALSVPFAQRLFQLAIRRSGSERDAGFVGQITANSFMKREFGKKLIEDFFRTVQLTHVIDTSGAYIPGHGTPTVILVGRNHSYRKDDPVRAVLGIRGEPSQPEDPAKGLVWSAIVKQLHQPGSESEWVSVEDFDRQGFSQHPWSLSGGGAADLLAAIESTASTKLGDLSESLGITSFTLEDDLYLLPSRAAVRRSIGEWVRPMVTGDALREWWHSNYGVAIFPYSSEFYPVDVEGEAALLAFMWPGRTMLSNNVMFGRQTKLDAGLAWYEYGRLTASKLRTPLSIAFAFVATHNHFVLDRGGKVFKQSAPVIKLPEGAGEDEHLELLGVLNSSTACFWLKQVSHNKGNGADSKGARTTAVPWEDFYEFTGTKLQEFPLPAVLPLELGRALDSLAQDLAAREPSAVADRVTPTRERLDAARAAHARIRARMIALQEELDWTVYHSYGLLDDAERARLVAPDLDSVPEIQLGERAFEIVLARRVAAGEAETAWFERHGSTPITEIPAHWPDWYRQIVQARIDVISQRRDIALIERPECKRRWASETWERKEADALRTWLLDRCERRELWFELRDGLRHPRTMTVYQLADQFRGDTDMHAVAALYAADHLRKPDLPLAQVLDKILADQHVPYLAALRYKDSGLRKRAQWEQVWEKQREEDRTGERLDIAVPPKYSSADFRKTSYWTHRGKLDVPKERFISYPGASPDADPSLLLGWAGWDHKDQAQALVNLVNDRTTDAGWDTDRLTPLIAGLAELMPWVRQWHGEYDEEWDGAPADEFSAYLLEQRTKHQLTDDDLTNWRPTPARRGRRGTAKETQQ

SEQ ID NO: 3266 - protein, 1273 aa, Bradyrhizobium sp.
MSIANLPKLLQPALKALEKDLLARAKTESVEAGLRKAWEDEQKAGQTGLSFEPWRRERVTQLAVAWILSVVFVRTLEDRGYIEPRVAGVSADALRTAEDREALYLQVAPFLGPREYLLAVFRELSKLPGAHDVFDAKHNPVWVLSPSSEGAKALLDFFRKRGSNGAPALVFTGENTRFLGDLYQDLSETVRKRYALLQTPEFVEEFILDQTLDPAIAEFGLKDVSLIDPTCGSGHFLLGAFTRLFERWQKAAPTDNIADLARRALEQIHGVDINPYAVAIARFRLVLALLDAVGIRRLERAPDIKPNVVVADSLLHRFGNESNMQMRFSEQISMDDISWGDQLFRLENRSDVERLLSRRFHAVVGNPPYITEKDSAKKARYRNDYAAATFDVPLGPPFVERFFQLAVQSGYVGVIVSNAFTKRDSGKALIEEVLPKLDLQKIVDTSGCYLPGHGTPTVLLFGRNRSADSDAVTAVLGKRGEQQVPPEPSSAPVWTEILRHHDAVGWEGTYISVERGTRAELKKHPWVLSGGGGRDLFRKLAMGTSHTLGDLSEVIGSSAVMRADDVFILAPRWLRMPTKTVIPYVTGSYIRDWEINTPLRAAFPYDGSRTLSEAEIGELYNLAWCHRTALWQRRGKGFKTKFEQGGRFYEYSMYYPDRFTAPFRIPFAFIATHNHFLVDRGGKTFNRGAPIIILRNERTELDYQALAGYLNSSTVAFWCRLIMFPKGGDQVGEGARLSKTPWQDRLEYAGNLLQQLPVPKLDDLRSKLLDLVITAEETVSQMAEQAPEKVVAATLASTPKLAALQDARTKNLSQRTRLRGILTSLQEEMDWRVYGLFGLPTVEASSVDTVRVPIEPNHRPFEVRLARKVGADVSASEWFRVHRREAPKDVGGPLADLYRQRLRLLDDPEHGKHLRLLETPETKRRWSVPDDQKAFSEAVRTWLLARIEASFRDQSQPELRSARQLALELGRDPAIAAAHELLTEESGLDLAKLISELVDIDGVPFLAGFRYAETGMEKRATWEDTWRLQRIEDEDPEKLAAELKRLNLKSISVPDKYGPKDYLRHFWSLRGKLDVPKERFVSFPGGNTDEDTTPLVGWAGWNHLQVAQALSGLYQRRKTEDGWQKDRLVPLLAGLDERVPWLLQWHNEPAAEFGGMKLGEFFRDFVAGEAHALGVAVGDLRRWTPPSAPKRTTIDPAEVLAALSAWKPEVEEDDEDNGDQVEPPEGPSDVELASAVGVTKALVGKALKKLVADGLVEKLSGRPARYLAIGDQA

SEQ ID NO: 3267 - protein, 240 aa, Burkholderia thailandensis
MDLYAGSGSDAHVTVVALVQQASVPFLDALRYSESGLRKRAVWRNTWLMQRREDALDAEVARQLTDEPIEAIKEEQAKRKAAEVGVVPVPPKYKQVDYREGVYWKLRGALDVPKERFVCFPGLERSNDAGSPMLLWAGYDAKARALALTGYLYEMLQREGADVARLTPALAGLDELLPWVHQWHPEADDDLGMSTGDYLQGLLDAQLAQHGLTLSALRAWQPEAPVRRKRGKRGQHVAQA

SEQ ID NO: 3268 - protein, 1245 aa, Planctomyces maris
MINRSALLSDLQKLLKRLEADLLERSESADVPAVGETLRAEYEQARQAERTAQNYEDWRNDAITQAAAAWVLSAVFVRFLEDNRLIEPPRFSGPGDQLQRARDERELYFRTHPTETDREYLLAVFDELATLPGTREVFSEHNPLRELPQWLSGDAAGELLDFFQKIDANAGGLVHDFTDADWDTRFLGDLYQDLSEAARKKYALLQTPEFVEEFILDRTLEPALDEFGLDAPPVNDPQGHPVTQAGFRMIDPACGSGHFLLGTFPRLLDRWFRQQPGGKVRDLVQKTLDSIHGVDVNPYAIAIARFRLLLKAMQACDIHQLKNAPAFTLHLACGDSLLHSPLRGGQQVFDFELTSDDAECEHAYQSEDLPALKQTLRSGIYHAVVANPPYITVKDKQLNQRYRSRFKSCHRQYSLAVPFMERIFQLAAEGGFTGQITANSFMKREFGKKLIEQFLPQIDLTHVIDTSGAYIPGHGTPTVILFGRHRKPVTSTIRTVMGIRGEPSTPKNPAQGFVWSAIVNQIDHVDSESEFMSVADSDRELFHKHPWSITGGGASELKEIIENRTSSELQNLISEIGASVVTREDDVYQTGKSTLSRKRISTFQSRALIDGEHVRDWAIDGFELGIWPYNPETFNPFEDQEQHRYLWPYRSGLSSRIAFGKSQIEHGKTWYEYSMFFKDRLSGNFRIGQAEVATHNHFALDRGDKVFKQTAPVIKLSEEASEDDHLTLLGLLNSSTVGFWMKQVCHQKQMMGGDGIRIESKAKVPYAFNATAVGKLPIPESWTKGALRDRLLDLTQEMDQATMKFSNLKAETVLSADNLTKDSLLKTWEENQHQRQKLRSRQIFLQEQIDFTVYRMFDLIPDRLIGEETDQIDFDLTAGARPFCIRAGKNEDGFDVPASVPEDWPEEIQALWNARLKELESNKSLRLIESSMYKRRWIGRQGLFNHQRSDNELLDAAKNWLLDRLERYFDFDGRMNPEGTPTAEVDIQLISIAQLADIAGRDPQFLEVGAVYRDDDAFDVQRLIAELVHAEQVPLLPILRYKPAGLRKRAEWEQTWELQRREDAIDARTQLPEDDPQYLTEAAARDLKQAEVGDIPVPPKYKSSDFFSTGGVRYWALRGKLDVPKERWISFPHCEGPDGTPVIAWAGYDHLQLARAISAYFVEVQEQFGGRDDPRLIPLLACQIELLPWLKQWHHDLDPEFNQRMDEVFAGFITAEAKALEMTSAEIKNWQPPKKVSKAKRKAGK

SEQ ID NO: 3269 - protein, 1204 aa, Streptomyces gancidicus
MIDRKALLDDLKQQVKAVEADLGKQVKALDEVGARLRAEYDQARKLGRTAATWTSWLDERVTQVAVAWVLGTVFVRFCEDNRLIPEPYLTGPDGDRRELAEARYDAYVESDDDPTYRGWLEKAFDELGQGQAGRLLFDKRHNPLYQVPLSHDGARELVEFWRRRDEAGVLVHDFTDPLNEDGTEGWDTRFLGDLYQDLSEAAREMYALLQTPEFVEEFILDRTMNPAVREFGYEELKMIDPTCGSGHFVLGMFRRLVRLWAEGQPGRDTHERVRKALESVHGVDINPFAVAIARFRLLAAAMAASGVRTLAEAAKYEWPINLAVGDSLIKARRSQQGNLFGGVDEELTDELAEFKYATEDAHEYPDILRPGRYHVVVGNPPYITVKDKNLNVLYRELYPVCAGKYALSVPFAQRFFELSKRGDAQGPGYGMVGQITANSFMKREFGAKLIEGYFGHAVELTEVIDASGAYIPGHSTPTVILIGRQRGGDARMPVIRTVRSIQGEPSAPANAEKGLVWQAIVEQIDKPGSVSQWVSVSDLDRQKYFSQQPWILADGGLEMVDQLNAACTDKLSSLTSRLGVFGMTNADDIMLATEAAWRRRGGESEFGKDLVLGDELRDWCRDGSTYSFFPYTDDLKIRDLPEGSGAHKWLWPARTSMGNRATFSKGTYFSDGRRWYEWHQTTPSPGAHAWTICFAFVATHNHFVLDRGGKVFKQSAPVIKLRQDATEEKNLRLVGLLNSSTAGFWLKQVSHSKGNATASSGMPDQPWSWNYEFTGTKLQEFPLPSTYPAALAYDIDKLAQQLAASAPESVCSASTPNASVLREARVTWEATRARMISLQEELDWEVYAIYGLHSESLHALSSDVPEISAGQRAFEIVLARKIESGELATKWFTHHGHTPITEIPSHWPAPYREVVQKRIDAIESNRAIAMVERPEYKRRWATVGWDVLQEKALRSWLLDRMENRDHWFDENGQPTILTLPRLTDALSHDEDFVSVARLYAPRKDLLKVVAELLTDEHVPFLSALRYKPSGLKKRADWEEVWDLQRKEDAAPDEQTKRKIRDSIPVPPKYTSADFLRPSYWRARGKLDVPKERFISYGQTNAATPELYGWAGWDHKEQAQALATYFTNTALSTEEITPFLAGLLELQPWLYQWHNEFDMLYSGSPADFFAGYRQQKQGEHGLTDDDLRGWRPPAATRGRRAAVKQ

SEQ ID NO: 3270 - protein, 1206 aa, Gordonia amicalis
MALATIAGTQLTAALKPQLTLLVDDMRTRLDADPTRLDKWKSTHREAVQEQRTAGSWTDWAEDQLNQAAVGWLLTSVFVRFCEDNLLLGESAVWISGPTPMLRQRAIDAENDFYRNHQDLSYREWLAQSFEALRDNPATAALVDEHAALNIMEPSSDAVQQLLGFWRRTDDHGDLVWSFADTELTTRFLGDLYQDLSDFAKKKYALLQTPEFVEEFILDRTLEPALKDRPLEGFKIIDPTCGSGHFLLGAFERLVERWHHHAPGLELRTRVDNALASVYGVDLNPFAVAIAKFRLIVAAMKACNEKSLVNAPKFTLNLAAGDSLLHGPEKGGAHAIDFGDTAYDKDAVVSALTYSTEDARLLRTLLAPGQYDAVVGNPPYITVSDKALNARYREIYHYCKGKYALTVPFMEKFFTLAKGGDRAGWVGQITSNSFMKREFGVPLIEDFLAGKDLRLVADTSGAYIPGHGTPTVIVVGRNHTKIHDDVRAVLGIQGEPGAPENPAKGKVWTSIVANVENASYEDQWVSVTDLPRENLRQHPWSLSGGGAVNLLQAIESARVFELHDAAKRIGVFGMTNCDPGMIIDRRTSARRQLEPEALRRLVLGDEIRDYLIAEGNDVWFPYRGHSELQSISLYPNGAMYLWPNRTELGNRVTFNKVPYFVEGRPWYEWHQVPKGDDQNTPTITFAFVATHNHFVLDRGGKVFKQSAPVIKLPAGATEDDHLRLLGTLNSSTACFWLKQNSHDKGRPGADTAGADEPWERRFEFTGTTLQEFPLPATAPLDRARYLDTLAQELAQHEPAASVATDGPIESSLASARLAHKQVRMLMVAEQDELDWETYRSYGLIDDDLTLPVGNSPGIEPGERAFAIVLARRVANSDLETSWFDHHNHKFTPTIEIPTHWPDEYRALVQKRLDAIETNPFVRLLERPEYKRRWAGDTWDLKLLRALRDWLLDKLEEPSLWFTQQGTPQPRSIGELAGEMERDPEFLTALDLWAGQKDAPVTANLVKLLSVEAVPYLAALRYKDSGLRKRAEWERVWDLQRNEDAGLIKATDIPVPPKYTTADFRKTSYWAHRGKLDVPKERFIAFPDAGRATDPTPLLGWAGWSHAHQGLALATIYALRESEGTPLEELVPVVAGIAEVLPWVKQWHSGADPHLGVDLAEYLTAQLSEKSSSVGVPVAELKNWRPAAGTRGRKTASKTSQSRKAGN

SEQ ID NO: 3271 - protein, 1193 aa, Mycobacterium intracellulare
MSPRETLTSELRAEVLRLEDDLRARVTALPDVQKNWRSEYEAARAAERTAAAWEVWVDERVTLAAVAWVLTTVFIRFCEDNGLVKPVWISGPRSREAIEAQQQFLRETARTNPDVTDREWLLQATNYLQSLPATAGLVDETSPMWLVTPSGDAATRLVSFWRERDESGGLIRELTDTNLETRFLGDLYQEISEDAKKRYALRQTPVFVEEFILDRTLEPALNERPLEGFKMIDPTCGSGHFLLGGFQRLLDRWHKQFPALDERERVQGALDSVYGVDLNPFAVAIARFRLTVAALKASGLSNLEDAPAFKYHLAAGDSLLHGLDQREFELGSEFSIDQVAANFSYATENFQALKIMLREGQYDCVVGNPPYIQVKDPGLNELYRNAYRHCRGTYALTVPFLQRFFALAKSTAAGSGWVGQIVGNAFMKQQFGKPLVEKYIPTRDLKLIVNLAGVPIPGHGTPTVILVGRNRNPTSDLVRVVLSVKGEPGHPPDPAQGHVWTSIARHVDDIGWGDEWITVRDIERKRLGTHPWSLSGGGALELLETLDSGTRVLDNLIGRIGYSGQTNADPAFVAPRDAFVRRGVDDDWIRQFVPGEVIRDFEIRDSDYAIFPYADGKLRDIDEHQGIYRWLWPVRTVTWSRATFSKATYREDGRTWWEWHQIALDRVGWPFSLAYPNLATHNHFALDRKGRVFNPHAPFIQLRVDASIERYQELLGYLNTSVVCFWLKQNSHDRGVGGIGGGIGDEAWEPRYEFTGATLKRLPIPASLPSGRGEVIDRLSQELSNPVLRALEETSAPTRAALDERAAKWKRTLSLLVFEQEELDWETYSLWGLVDEDLTYREADIPTIVPGQRAFEIVLARRIRDGDEESAWFNRHGSTPMTEPPDHWPPGYRHLVERRITQIETHPYVGLLERPENKRRWVTEAWNEQEERALRTWLLRRLEESRFWFDAQGRPNPKSLAVLADEVARDQQFASTLSLWEGRLDVPVTASLAKLIASECVPYLAAFRYKESGMRKRAAWESTWEIQRREDTGRYNPAPTNQGGDGPVPVPPRYISADFARPEYWSNRGKLDVPKERFVLYPGAGRDGDQTPVLGWAGWDHAQQSLALAALIQSGEQQGFPDDRLIPLVAGLSELLPWVDLWHGEPDALYGGSSPAEFFSELLDGYMVRLGATRESLAHWRPQAPTRGRKARP

SEQ ID NO: 3272 - protein, 1199 aa, Phaeospirillum molischianum
MIIPAVLLKDLKRLVRVLEDDIRDGLPGTAADARLHGEWQAAKEAGRTAATYESWREEEITQSAVHWVLGGVFLRFIEDNGLVERPWLAGPNPERMALARDRYEGYFRAHPHESDRDYLLACFTEAGQLHGAAALFDTRHNPVWELPVSGDGGIALMNFWTKADPDSGRLVHDFTDPDLSTRFLGDLYQDLSEAARKRYALLQTPEFVEEFILDRTLTPAIQEFGFREVRLIDPTCGSGHFLLGAFHRLVTEWSRAEPGRNIRDVAQRALDAVAGVDINPFATAIARFRLLVAALKVCGIGRLADAPDFRFELAAGDSLLHGKRFMDIRGVQLSLDPHDGVTHYFHTEDRDDLDRILGRQYHAVVGNPPYIIVKDKALNDAYRQRYSTCHMKYSLGVPFTERFFDLTQAQNGHSAGFVGMITANSFMKREFGSKLIEDFLPRVDLTHVVDTSGAFIPGHGTPTVILFGRNRRPLLGDVRVAMSIIGESTEPSNPAEGPVWLSILSQIDSAGSEGAFVSVADIARISLSRHPWSLGGGGASDLKQAIESAAKCTLGEYPANSGVMALTLEDEPFIADDMVFIRNGIPKEFIKPYLTGADVRDYACGEGNSIVFPYGRDVNPFLDESILRWLWPHKASLANRIMFRRNQLQRGLHWYEYGMFVKTRFGEPDAIKFVCVATHNHFSAAKFEAVCNRHAPVISAPDHDSAVWMCAELNSSTAAFWMRSVFHNKGSQGISEGFKAEVWERFIEVGSTGLQSFPLAEPYPLDLARELDSLAQQLSATLPAALLAVAVPARAQLDAARERALSIRRRMIALQEELDWRCYKLYGVVDGHEAEGLEFGLEAPEVDLGQRAFEIVMARKMAAEELETTWFARHGSVPTAEIPDHWPVAYRAVVERRIALIESHSHIGLVEKPEYKRRWQWSDGGFEAGWAERERDALERWLLDRLEDGCYWQGGPALKSVNALADIARADDDFCRAAALYEGQDHPDLATLVARLVAKESVPFLPSLRYAESGRRKRAQWEQVWDLQRREDAGQDVGTIDVPPKYKREDFLNPDFWRLRGGLDVPKERFISYPGAEKSADGGLMVAWAGFDHLAQARALAGFYHEMKDVEGWDAPRLIPLLAGLADLIPWLKQWHNAYDADFGQGPGDWFTAFLAEEARTLGVTADDITAWEPAAKVKAKRGRKAKATDQITLEDLGL

SEQ ID NO: 3273 - protein, 1207 aa, Nitrococcus mobilis
MIDPVTLLSALRTQRDKLEGDLRRQVAELPELKARLQTDYRAAHEAGRTAATFGTWTDNEITQGAVAWLLACVFVRFAEDNGLIAAPLLSGPNDALRRARDAAREYFRRHPTEHDRHYLHHGFDQMAALPAVAGLFDRAHNPLFGLPLSPEGAQGLLNFWQQVDPDSGALRHDFTDPGLDTRFLGDLYQDLSEAARKRYALLQTPEFVEAFILERTLEPAIDAFGLEDIRLLDPACGSGHFLLGAFQCLLGHWQKAAPGLDARERVIHALAGVHGVDVNPFAVAIARFRLLVAALQATGIKMLKEAPGWCFNLTAGDSLLHGRRFGQLDLVGGKGLDQRYAHAYAAEDIDEINRILGQQYHAVVGNPPYITASDKALNTLYRARYGSCHRQFSLGVPFTERFFQLAVEDANGPAGFVGLITTNSFMKREFGKKLIEDYLPRQDLTHVIDTSGAYIPGHGTPTVILFGRNRAPVAETVRAVLGIRGEPSTPANPAQGLVWSSIVELLDRPGGENEYVSVSDMTRERLAQHPWSLQGGGAPAVLEAIDSAPTKLAEASASIGFHCITKQDDVFSQPEHVLAKANVEHEAIRGFGIGEQVRDWMVDDDGFVIYPYNTAVETVEPSKLPYAIRFMWPFRSTLFERKVFGGQSYRDAGKPWYEYGQIPPSKLKTPLSITFAFVATHNHFVLDRGGKVFKQSAPVIKLPAAAGEDQHLGLLGLLNSSTACFWMKQVLHSKGGGIGGGLASEEWEKFYEHTGTGMQSFPLPDKRPLQFARQLDRLAQQRAASLPAALAPRLPLGRAELDNARDTAVSLLAQMLAHQEELDWWCYRAYGLLDTDLCFAATPPEVQLGERAFEIVLARRIEAGEVQSKWFERHGSTPITEVPAHWPDDYRALVERRINLIESNAWIDLLERPEYKRRWNQPDWAELEQSALQGWLLDRLETADYWPQPALRSIETLAARAERDAAWMQVAALYTGQPGFDIAALVGELVHDESMPALKVLRYKPSGLRKRADWERTWELQRREDVIDAEIARANPRRDGEAAAAWRSRIKPEQDERKAAEIGPIPAPPKYTRGDFLAGTLWRLRGGLDVPKERFFRVPDPQAPGEWLYGWAGWNPAQRLQALAGAFIAAEQGSGAELARLIPLLAAIDEQLPWVRQWHNEVDPDMDVRPGDYFTSWLGEQLNRHGWTGRTLADWQPESISRRRRRT

SEQ ID NO: 3274 - protein, 1196 aa, Frankia sp.
MIDRVALLKDAQRQVKALEKDLRAQVDDVAEVGTRLKAEYERAFKVERTAATWSAWLGERVTQAAAAWMLGTVFVRFCEDNGLIGDPYLAGPTTARLTLAEERTEDFYRRHPERTARDWLQAGFGEIAKVPVGAGLFDRQHNALFQIPLSHDAAKELLTFWRRRTEAGTLVHDFTDPAWDTRFLGDLYQDLSEDVRKKYALLQTPEFVEEFILDLTLTPAIEEFGYDVVKLIDPTCGSGHFLLGAFHRLLAEWENNAPDRDVFERVRLALDAIHGVDINPYAVAITRFRLVVEVLRAAGIRTLAAAVGYQLALHVAVGDSLIKGRQLKIFDDARDNLAEFSYVTEDVREHSDLLKEDRYHVVVGNPPYITVKDASLNKMYRKLYGACGGSYALSVPFMQRFFELAKEADKEGRGAGRVGQITANSFMKREFGKKLIQDFLSSTAELTHVIDTSGAYIPGHGTPTVIVLARRNRWNRYRPVRAVLGIRGEPSAPVDPRRGRVWQAIVEGLSSPGNGGEWVSVVDWPRSRFDSFPWGLGGGGAADLSTFLVNGKKKLTSEIRVIGRTAHSGADEAYYGPVGVWARFSIPDNYSVALVEGEVIRDWVLAPGKEAIFPYGGDLKASLDPGSTGRMLWLNRTILVRRKELGGTHEEIGLTWYEWSRWHPERFAVPLGIAFPFVSTHTSFVLDRGGNVFKQTAPVIKLPPDASEDDHLRLLGVLNSSAACFWLKQVCYPKGGDPVGQDGARVSVEAWSDRYEFTGTKLQEFPLPAEYPLELARELDGLAQRLTAVSPTSVAAGGAPSRVRLAEARGEWGSTRARMIALQEELDWQVYRQYGLLADELILPMTEVPEIRLGERAFEIVLARKIAAGDETSEWFSRHGSTPITELPAHWSDEYRALVEKRIAVIESDRNIGLIERPEYKRRWATEGWDKMQDAALRDWLLDRLETRELWFAEVDGMVQPRAWTTGRLADELAADADFVAVAEIYRPGEDLTKVVAALVENEHVPFLAALRYKDSGLVKRADWESVWDQQRAEDAAPDEEAAKRIRDRIPVPPKYAQADFRKPSYWRARGKLDVPKERFISYPHAGPENDPTLLVGWAGWDHREQAQALATLVVERQDNDGWGAEKLAPLLAGLREVMPWVRQWHNDIDPLYDGSPAEVYDAFLADSMGQHALTADALTAWRPPAAGRGGRRAAK

SEQ ID NO: 3275 - protein, 185 aa, Dietzia cinnamea
LKDSGLRKFSEWQVTWDAQRAEDRGEITTAQVPVPPKYTSADFRKTSYWQARGKLDVPKERFIAYPGASGPDDPTAMLGWAGWDHAEQGIALVSLYDDRKDDTDPAQLVPLVAGLAELMPWIRQWHSGMDAHSGIDWADYLAGQLTTLAERSGVAIADLPDWRPAPATRGRRRVAAAATTPGKES

SEQ ID NO: 3276 - protein, 1195 aa, Eubacterium saburreum
MNKTAIKNFAIWARNKLIADVSYDARLIGITEDGIAKPLPQSFGDTQFFDIGTAKPYSISGEAVRQRDKLIEVIQQKEKDTDYKTAYQYVIEEVAYTWFNRLIAIRFMEVNDYLPSHIRVLSSESGKLEPDLVTTPFDAELPFTAEEEAQIFQWKQDNKLDEVFRILFLKQCNALNEILPALFEKTKNYTELLLSLSVIDRDGVVYHLIHDIPEDDFNIECGGQVEIIGWLYQYYNTEPKAAAFAKNGKITKEEIPAVTQLFTPDWIVRYMVENSLGRLWVGGHPDRGLKENWKYYLEEAQQEPEVQVKLSEIRKEYAALNPEDIKLIDPCMGSGHILVYAFDVLMQIYESVGYSERDAAKSILEHNIYGLDIDDRAYQLAYFAVMMKARQYNRRILNGENTCHFYAIQESNSINRAHLKYFGAGLDDIEKNAAKMQLEGLLDTLTDAKEYGSILNVESYNWDLLRRFVAAEDTDGQISMDSVGVEDTAEQLNRLIDIGETIARKYWVTCTNPPYAGTTNLSAKLNTYIKKYFPDSKSDMFAVLIERCYQFTLDSGFQSMITQHAWMFINSYENLRKKIYEKRFMSLVHLGIKAFEEIGNDVVQTCAFVIQGKYIDGYSSRFVRLVDCKNYNEKEQEFLAGNYRYMAEVANFRKIPGMPLAYWVSSQFIKNFNSAKYIENYGVLTGSQNITGDNEKYLKCFWEIENYQIGKRWHFYAKGGDYRQYYGNLTFVVDWSDTARLFYANNKTSNLLSEEFWFKPGVTYSAITSRGTGFRYLPEGCIFDKGGPSINLRKNIPEILALLNTNVAKYYFWVFNPSINLQVKDVKSFPIILPEDSSLTEMANTNLKLCEYDWNAFETSWEFKKHPLVSESEKEKSKTIQQCFNQWKADCEIRSTELRENEERLNQSFIDAYGMWDEVDAAVEERDVTVRKADLQRDIKSLLSYAVGCMFGRYSLDVEGLAYAGGEWDSSKYQSYIPDADDVIPITDEEYLDDDIVSRLCDWLKVVYGADTLEENLDYIAKALGNKGSTSREIIRNYFLNDFFKDHCRTYSVTGSGKRPIYWLFDSGKQNGFKVLVYLHRYTPDTIGNLRIDYLHRMQRVYESEINRMQDMMDHSENAREVAAAGKRKDKLAKQLKECREYDEKISHLALSRIELDLDDGVKVNYRKLQTAQDGKFYEVLADSKNIMAKQRGKA

SEQ ID NO: 3277 - protein, 1246 aa, Vibrio cholerae; identical to SEQ ID NO: 2910

SEQ ID NO: 3278 - protein, 1209 aa, Eubacterium saburreum
MNKTAIKNFAIWARNKLIADVSYDARLIGIMEDGIAKPLPQSFGDTQFFDIGTAKPYSISGEAVRKRDKLIEVIQQKEKDTDYKTAYQYVIKEVAYTWFNRLIAIRFMEVNDYLPSHIRVLSSESGKLEPDLVTTPFDAELPFTAEEEAQIFKWKQDNKLDEVFRILFLKQCNALNEILPALFEKTKNYTELLLSLSVIDQDGVVYHLIHDIPEDDFNIERGGQVEIIGWLYQYYNTEPKAAAFAKNGKITKEEIPAVTQLFTPDWIVRYMVENNLGRLWVEGHPDCGLKENWKYYLEEAQQEPEVQVKLSEICKEYSALNPEDIKLIDPCMGSGHILVYAFDVLMQIYESASYSQRDAAKSILEHNIYGLDIDDRAYQLAYFAVMMKARQYNRRILNGENTCHVYAIQESNSINRLHLKYFGAGMDDIEKNAAKMQMEGLLDTLTDAKEYGSILNVENYNWELLRQFVAAEDTAGQISMDSVGVEETAEQLNRLIDIGETMARKYWVTCTNPPYAGTSNLSAKVNNFVKKNYPDSKADLFAVFIERCHQMTLVNGFQAMITQHSWMFLSSFEKLREKMMLSETVNMAHLGARAFEEIGGEVVQTTAFVRCANHVEGYKGTYCRLIEPTSQHGKEEMFLAGQNRYTANQDDFAKIPGSPLAYWVAQAVFKLMAEEKLEGKFLSAGRFKSCNDELYLRLWWEPICKSTHWHPYCKGGDGRKYVGNEVRLINWTEESQRYYKDNGGVGNKEFWEKEGITWATITTSKPSFRRKPSNYFWSSSAPTIFHIQGAELTGYLAYLNSKPVEYILGVLNPTASLTVADVLKLPYKENWNTSTNQNLGNENERICRQDWDSFETSWDFKVHPLVNMSKGLWDATATAAAMDYFYGYKPEVSCPLEICYLLWQGQCKERFEKLKANEEELNRIFIDIYGLQDELNPEVEEKDVTVRKADLQRDIKSLLSFSVGCMFGRYSLDVEGLAYAGGEWDSSKYQSFIPDADNVIPITDEEYLDDDIVSRLCAWLKAVYGADTLEANLDYIAKALANKGSTSREIIRNYFLNDFFKDHCQTYSVTGSGKRPIYWLFDSGKQNGFKALVYLHRYTPDTIGNLRIDYLHKMQRVYESEINRMQDMMDHSENAREVAAAGKRKDKLAKQLKECREYDEKISHLALSRIELDLDDGVKVNYRKLQTAQDGKFYEVLADSKNIMVKEKK

SEQ ID NO: 3279 - protein, 1200 aa, Stomatobaculum longum
MNKTAIKNFAIWARNKLIADVSYAARLIGVTEGGIAKPLPQSFGDTQFFDIGTAEPYSISGEAVRQRDKLIEVIRQKEKDTDYKTAYRYVMEEVAYTWFNRLIAIRFMEVNDYLPSHIRVLSSESGKLEPDLVTTPFDAELPFTAEEEAQIFRLKQDNRLDEVFRILFLKQCNALNAILPALFETTKNYTELLLSLSVIDRDGVVYHLIHDIPEADFNIEQGGQVEIIGWLYQYYNTELKAAIFAKNGKITKEEIPAVTQLFTPDWIVRYMVENSLGRLWVEGHPDCGLEENWKYYLEEAEQETAVQAKLAEIRREYAALNPEDIKLIDPCMGSGHILVYAFDVLLQIYESAGYSERDAAKSILEHNLYGLDIDDRAYQLAYFAVMMKARQYNRRILNGENTCHVYAVQESNSINRAHLHYFGAGMDNSEKKAAKNQLEGLLDTLTDAKEYGSILNVENYNWDLLRRFVAAADTARQISMESVGVDDTAEQLNQLIDIGETLARKYSVVVTNPPYMASSGMNAKLSNYLKETYPCSKGDLFAVFIEKCRHFTKEGCYLSLITQQSWMFLSSYEKLREYLSDIDVATILHLGAHAFEELGGEVVQTVSFVIRKTHVLDYITTCDRLVNIDNASQKEIAFLSGDYRVLSKKTDFELIPAKPYAYWISEAALKNFKNPNLGCLAEIVSGMTTGNNEIFLRVWTELNFEKIAFNKSNIEKVNLQKTKWIPYHKGGGMRKWYGNQEYVVNWSRSSEFNRAKTTMTHVYLKPCITWSDISGNSFAGRYCEGGFMFDVKGSCAFAEKTKLQLLIGIFNSKVTPIYVEALNPTTTTQVGDLKRIPLVEPKQDEVGHIQSKVMGSVDLSKAEWDSFESSWDFKKHPLFRNVSTISEAFNQWNTECDDRFNQLKANEEELNRIFIDTYGLQDELTPEVEDKDVTVRKADLQRDIKSLLGYAVGCMFGRYSLDTEGLAYAGGAWDSSKYRRFIPDEDNVIPITDEEYLEDDIVSRLLAWLKAAYGADTLEENLDFIAKALGTKGSTSREIIRNYFLNDFFKDHCQTYSVTGSGRRPIYWLFDSGKQNGFKALIYLHRYTPDTIGNLRIDYLHKMQRVYESEINRMQDMMEHSENAREVAAAGKRKEKLTKQLKECREYDEKISHLALSRIELDLDDGVKVNYRKLQTAQDGKFYEVLSDSKNIMAKQRGKA

SEQ ID NO: 3280 - protein, 1157 aa, Stomatobaculum longum
MDKNAIKKYAVWARRELISRVSQKALQYGVSEEACGDASADTINGHLLTATEKQQRQALITKIKKDGYQQAMEEAAYTWFNRFCALRYMEVNGYLPTHVRVFSDEQNNFKPQIITEAIHLEFDGLDMEKVYALKEENKTDELYKYLLITQCNALSVILPGMFQKIADYTELLFPDNLLREGSTIEQMIALIPEEDWTDQVQIIGWLYQYYNTELKDKVFADLKKNIKISKENIPAATQLFTPDWIVHYMVENSLGRLWVEGHPNDKMKASWKYYLEEAEQEPEVQKQLAEIRAEYVQLKPEDIRVIDPCVGSGHILVVMFDVLVQIYEAYGYSAREAASMIVEHNLYGLDIDERAAQLSYFAVMMKARQYDRRFFSRKVQPHVYAIVESNDVDSFTLEYFVNGDANLKKSMSILMDELRDAKEYGSILNVTKVDFSALYARLAEVKEDISIHRESALNIIKPLIQVAEMLAQKYSITCTNPPYASAKGLAIKLREYLANIYPTAKYDLFGAFIVRCLKFTKKCGYIGLVTPVSLLYNPSFQGLRREVIGNTEFTSLIELGSDAFESGFGTATYSIVRYKIKGYVGRYFDVSSIVSKDKFRGTKCFYSSTDYFPSFDGEKVMYKLNDDYRSIITEAKPLSKIGNPRIGMQTNDNSRFLRLWHEIESTKLCTSHTKVDTFGDEKWFPIVKGGGYRKWYGNIENVVNWQHNGAEIRELNKNAAGGRIVAEEFYFCEGLTWTHTTYNQPFSMRYMPEGTLINVEGPAIFSLGKNQNYVLGCLNSVVARDVFQKIVSSIHFSASELGSFPLIVSEQGVISDIVKENILQGMQDWNAYEISWDFQRHPMLSRGKLADAYAAWKADCESRFLQLKANEEKLNRIFIDIYGLQEELTPDVAEKDVTVHRVFDTKDAVPESMKGSNYVRTMRDEVVSLISYAVGCMFGRYSLDVDGLAYAGGAWDGSKYQTFMPDKDNIIPICDDDYFDDDITGCFIKWVETVYGANPLEENLKFIANALGGKGSAREVIRNYFISDFYADHLKTYQKRPIYWLFDSGKKGGFKALSYMHRYQPDTIARIRTDYVHEQQSRYRTAIADLQQRINGASTGDRVKLTKQLIKLEAQAEEIRTYEEKIHHLADQMIPIDLDDGVKVNYAKFADVLAKIK

SEQ ID NO: 3281 - DNA, 666 bp, Desulfovibrio magneticus
atggcctcttggattgagggtgattgccttgagcatatccatgaaattcctgatggttctgttgccctcctgctgactgatcctccctatggttgtacgtttcgttccatttctgacaggactaatcggaccattgccaacgacaatcctgaggatgccacgcgtatccttaaagaaagccttgagcagctttatcccaagatgaaggatgattcgtatatcgttgtgttcagtggcgacaagatgctggcggacttcattaacattatcaagagtgctggttattgctaccagggggtcgctgtgtggaagaagtctcaccacacgcaggggtctcttatcagtggtcttcgccccattactgaaaaaattatttatgccaccaagggtaaacctgtgctgtacgatgccatttgcgaccacttcgagtaccccaacactaagaatgaattccatcagaccgagaagccggcgggtctccttcgtgagttgattggggccatgactgttcccggggattgcgtcgtcgactgtttcgccggatccggctcctctgtggtccaggccaaggcgatggggcgcaattggtggggctgtgtccttgaccccgatgactaccagaacgggtacatgcgcctgaatgagagcatggccgaagctgcttaa

SEQ ID NO: 3282 - DNA, 2658 bp, Pelotomaculum thermopropionicum
gtggcgaaggagaaccagatttccctggatatcttccttaaagaaggcaatgagcgaaaaaagatccaagaaaaccgtttcaaactcaccaaagaacacctggaccgggtgaggcatatcgagggattccccattgccaaagatgaggacatcatcagcctttccgacccgccctattacaccgcctgcccgaacccgttcataagggattttatcaaagagcacggcaagccatacgacccggataacgacgcttaccgccggcagccctttgcggcggatgtatcggagggcaagaacgatcccatttacaacgcccattcgtaccacaccaaggtgccgcacagggcgatcatgcgctatatcctccactacaccgagccgggagacatcgtctttgacggtttctgcggtacgggcatgaccggcgtggcggcgagcttatgcggggaccgcaggaccgtagaatccttaggctaccgagtactggatgacgcgaccatcctcgatgaaaaaggccggcctttttctaagcttggagcacgcaaggctatcttaattgacctctcccctgccgccaccttcatcgcctacaactacaacacgccggtggatgttagggcctttgagcgggaagcccggcggatcttagacgaagtggaaagagaatgcggctggatgtacctgacgcagcacgtggtggatgggaaggtgcagaaagacgcaaagggcaaccccatcatggggaaaatcaactacaccgtctggtccgatgtgtttatctgccccagctgttccagagagctcgtcttctgggaagtggcggtagataaagaagaaggtagagtccgggacgagtttccctgcccccactgcggagctaacctcaccaaacgaaccctggagagggccacggaaagggtgtacgaccgggagatcggggagtttatcatccgcgcccgccaggtgccggtgctgataaattattcggtggggaataagagatatgagaaaaagcccgacgggtacgacctggaattgatccggaagatcgaggagatcgagataccgtactggtatcctaccgaccgcatgccggagggctacaataccgaacagcctaaagtatcacatggttttactcattttcaccatttttatacgaagcgaagtcttgcctgtctagcagtattatggaactgtttccggtttcgaaacagaaaaataacctctcgtttattatactcttttacatctctctaccaacgtgtgactaagatggcagagtatcggaagggtgggggaagtggtaatattcctaacttttatatcccttcgtttaatagggagccaaacgtttacgaagtctgcaaaaggaaattaagaaatataataacggcgttaatagcaatgtcgctttgtcattcacagaataccatttccactcagtctgctgggcaattgcatcagattaagagtagtagcactgattacatttttaccgatccaccattcggtgggaacataatgtattcggaaatgaatttcctctgggaagcctggctcagggttttcaccaacaacaagcccgaggccgtggaaaacaaggcccaggggaaaggccccagggaatatcaggagctcatggaaaagtgctttgccgagtgctaccgcatcctgaagcccggccggtggatgacggtggtgtttcacaattcccagaaccggatctggaacgccatccaggaagctattctgcgggccgggttcgttattgccgatgtgcggaccctggacaaaaagcaggggaccttcaagcaggttacttcgaccaccgcggtgaagcaggacctggtcatctccgcctacaagcccaacggcggcctggaaaagcgctttcacctggaggccgggaccgaagaaggagtctgggattttgtccgcacccacctcaaacatcttccggtctttgtggagaaaaacggcagagcggaggtcattgccgagcggcagaatttccttctctatgaccggatggtggccttccacgtccagcggggagttgccgtacctatgggggcggcggagttttacgccggcttaaaacagcgcttcccggagagagacggcatgtacttcctccccgaccaggtggtggagtatgataaaaagcgcttaacggtccaggaaattgagcaattatccctttttgtaaccgatgaaaaatcttccatccagtggctgcgcagtgaactctcgaagaagccgcagacctaccaggagatccaccccaaattcctgcgggaactgcacaaagcgccgcacgaaaaactgccggagctctccgagcttctggagcagaacttccttaaagacgataacggccgctggtacgtccccgaccccggcaggcagtctgacctggagaagatgcgcgagaaggccctcctcaaagagttcgcagaatataaagaaggcaggggcaggctgaaagtgttccgcaccgaagcactgcgggcaggatttaaggcctgctgggctgccaaggattacaagaccatcatagaggtggccaggcgcataccggataccgtcctccaggaagataccaccctcctgatgtattacgacaacgccctgatgcggctggaggaatga

SEQ ID NO: 3283 - DNA, 2607 bp, Acetohalobium arabaticum
gtggatgaagataaattagaaccgctagaagatttactggatgaaatgagagagattgaaggctttcccaaaggtgaagatgaagatatcttagaattgtctgatccgccttattatactgcctgtcctaatccgtatctggatgactttattggagagtatggtacagagtatgatccagagagtgatgattatgaacggaagccttttgttggagatataaaagagtctaaaagggattcaataagtttagctcataaatatgtaacgaaggttccttataaagctatcatgtattttattatgcattatactaagccaggggatatagtgtttgatggttttgctggcagtggaatgacaggaattgcagcgcaaatgtgtgagaatccatctgaagaaatgcagaaaaagatagaagatcgtttagatagtgtagaatatggggctagaaaagcagtattaaatgaattatcaccagcagcttcatttattacttctaattataattttgcctgtaatgaagaagagttaaaacagaaagcagaagaaattattgcaaaagtagaagaagagtgtggatgggtatatgaaactaatcatgtgaaagaagcgacagatactcgtactggaaaacaagcgactttatttgatattgaaaagaataaggggaaaataaatcatattatttggagcgatatgtttatttgcccatattgtgaatctgaatttgttttatgggaagaagcaatagaccatgaaaaaggtgaaatgcaagatgaatttaagtgttctagttgtaatgctgaaattacaaagaaagagtgtgataaagctaaagaagagtattacgataatttaataggagagaaatctattagggtcaagaaatctcctgtgcttattgattattcagttggaagcaaaagatttgaaaaaaaacctgataaagatgatttagaattaattaaaaaaatagatgatattacaattccttatttcacgcctaattatagaatgccagaaggtaaagagtcaaggagaaatgataaatttggaatgactcatattcatcatttttatactaaaaggaatctttatgtacttgctaaattttataatgaaattaaaaaaatagataataagagaataaaggacaaattaatgtttatttttactagtttacttttaagatctagtaaaaaatgtatagttcatgttagtaatttctttcatggcggagggggttatgtgactacaataagtggtaatctttatattccttcttttagagtagaaacttctgttatagaaaactttaaacgaagagtaaataagactaataagcttaacaagtataaacaacttaaaaaagataatgctagagttaatttggggtcagcgacggatttatcaatgataccagaaaatagttttgactatatgtatatagatcccccatttggctctaatttaatgtattcagagctgaattttttgactgattcatggttacaagtgattgaaaataataactcagaagcaattataaatagtgttcaaaataaagatttagtagactacaataatttaatggagcaatcttttaaagagttttatcgtattttaaagccaaatagatggattactatagaatttaataattcaaaagcaaccatttggaataagatacaagaatcgttaactagagctggatttattattgcacaggttgcggttttagataaagattctggcagttttgtaagtaatgtatctccaggagcagtaaagaatgatttaataattaatgcttataagcctaagaaagaatttgaagataaattcttaaagacagctggtgaaggtcttgaagcagattttatacgtcaacagttggaacatctaccagtagaagctaatatagagcgaacggagcagatgctttactctaaaatgttagcccattatgtggaaaatggttttaagattcagtataacgctaataatttctatcaattgttacacgatagctttattgaacgagatggttactggtttttagaggagcaggctgatgaatatgatcgttggaaagcatcgctaaagttagatgaaatagaggatattaaagaaggtaatcaggttatgtttgtaactgatgagaaatctgctttaacttggttacataatttcttagatgaacctaaagagtatagcgaaatttatactggttatgaacaggtagtaactaaaactaaagatttaattcctgaacttagagatatgctcgataataactttgtcatggaagatggtaagtaccgtcgaccgcagacaaaagaagaacgacagaagatagaagagaatcgagaacgagagttagagcgggcatggaaggatctactggataaagccaagaatggacggcgtaagattaagaatgtgcggaaagaagcgttaattcacggctttactaaatgttatcagaaggaaaactacgaagatatcattactgtagccgatagactatataagtctacattaaggtctagtggtgatattctagattttgtagatattgcacggatgaagttagaccaatag

SEQ ID NO: 3284 - DNA, 2979 bp, Acidothermus cellulolyticus
atgaaccggcaaaacaacctttttgaaaaccaggaggccaaaaccagggaccaggaacctgtcgaatgccttggcaagaccttcgactccgacgaggcgcggcggcagcacttcctccgcctcttgcgcgaagggctggaggaactccacgccaagctcggcggtgtgcccttcaccacggtggaagacgccgtggaacggatgaagtcggtcgagaaatggccgatgggaggtgagacgcgcctgcgtgagcttgccgagcgcatgcgccatgccgattcaagcaaggacctgctccagcgctggaaggacgaggtcggcttcccgcacggtgagatcgaagacatcctgaacctatccgatccgccctattacacggcgtgcccgaaccccttcatcgcggacttcatcaagcactacggcaagccatacgacccgaacgtgccttacagcaaggagccgttcgcggtcgacgtgagcgtggggaaaacggacccgctttacaaagcccattcgtatcacaccaaggtaccgcatctggccatcgtgccttccattctccactacacagagccgggagacgtggtcttggatgggttctgcggctctggtatgacgagcgtcgcggcacaatggtgtagctccgcaccggagagctacaagcgtgatgtcgaggcatcatgggagaaggaaggccggaagaagcccaactggggcctacgccgtgtggtgctgggcgatctcgcgcctgccgccaccttcatcgctgccaactacaacttgcccttcgatgtggatggatttgcacgcgcggcgcgccagatcctcgacgaggtcgagcaggagatcggctggatgtacgagaccctgcataccgatggcaagaccaaggggcgcatcgaatatacagtctggagcgaagtgttcacctgctgggactgcgcgggcgaggtggtgtttctggagcaggccctggacccggagaccaagaaggtaagggagaccttcccttgcccccattgcggtgcggagctgacaaagaagcggctggagcgcctctatgaaaccaagctagacagggcgctgaacaccatcattcgcatccccaagcgccagcccgctctcatcgtctacagaattggcaagacacgttacgagaagaagccgaatcagaccgatcttgaaaccctctccagggtggaatctcttgcctggccgcatgaggttccgatagatgccttgccctatatgcacatgacccatgaacgggcgcggatggacaatgcaggcatcacccacatccaccacttctttctcccccgcgccgcccacgtcctggcggcgctgtggcgcaaggcccaggcatggccggacaagcgcaaccggcacatgttgttgtttttcgtggagcaggcgatttgggggatgtccgttctgaatcgttatttgccgacggcgttttcgcaaacaaatcgccagttgacgggggtatattacattgcatcccaaattgccgaagtctccccgtcctacaaccttgaaggaaagctcaagggtttggcgaaggcctttcgagggcatcgaacatcatccggaagcgccatcgtcaccaccgtcaccaccgcacgtctcgacctccctgacaactctattgattacatcttcaccgacccgcccttcggcgagaacatctattacgccgacctaaatttcctggtggagtcctggcaccgggtgctgaccaacgccacccccgaagccatcgtggacaaggccaagaagaaaggcctgcccgagtaccagcacctgatgcggcaatgcttcgcagagtattgccgagtactcaagcccggccgttggatgacggtcgttttccacaactcccgcaacgccgtctggaacgctattcaggaagcgatactggccgcgggcttcgtggtggccgatgtccgcaccctcgacaagcaacagggttcctaccgtcaggtcaccagcacggcggtcaaacaggacctggtcatctccgcctacaaacccaacgggggccttgaggaaaggttcaagctgaccgccggcaccgaggaaggtgtctgggacttcgtccgcacgcacctgaggcagctgccggtgttcgtctccaaggacggcgaggcggaagtcatcgcagagcggcagaactacctgctattcgaccgcatggtggctttccatgtccagcggggcgtgacggtgcctctctccgcggcggagttctacgccggtctcgcgcagcgcttctcggagcgcgacgggatgtacttcctgcccgagcaggtggcggagtacgacaagaagcgcatgaaggttggtgaggtcctgccgctgcagctcttcgtcaccgacgaggcctccgccatccagtggctcaagcagcagctcaccaggaagccgcagaccttccaggagcttcatccgcagtttctcaaggagattggaggctggcagaagcacgagaagccgctcgagctgtccgagctgctggaacagaacttcctccgctacgacggcaagggtccgattccgaagcagatcgtttcctggatgcgtcagagcgcggagcttcggaagatcatcgatgagcagcttgcgtctggacaggctcaagaggatgacagcggactcgtgacccgtgagccacgactcatcgaccgcgcgaaagcgcgctggtacgtcccggaccccaacaaggccggcgacctggagaaactccgcgagcgggccctgctgcgcgagttcgaggagtaccgcgagtccaagcagaagcgcctgaaggtcttccgcctcgaggccgtccgcgccggcttcaagaaggcatggcaggaacgggactacgccaccatcatcgccgtggcgcgcaagatcccagaggacatcctccaggaagaccccaagctcctcatgtggtacgaccaggcgcttacccgttctggggaggagtga

SEQ ID NO: 3285 - DNA, 3111 bp, Anaerobaculum mobile
gtgagcgaaaaaacaagacaacatcgtcaacagatcttgtttgatttagaatctatgccctctggcaaggtggacttaggtgcctctataagttgcctgggtattacatttgaaaatgacgaaaagcggcgggaatacttccttgatctgcttcacaaaggactggaagaattagatgccaagcttaaaggcgttccttttactacgctagatgacaccatatctcgtttgaagtcgctcgaacattggtccgttggcgacgatgattgcataaataaacttgccctttgcatggccgaagcggcacgaatttcccgccgcggaagccgggatgtggatcttttaacgctttataaagacgaggttggcttccctcacggcaagatcgaggatatcttgcgcctttccgacccgccttattatacggcctgccctaatccattcatcgaggatttcatcagatgtcatggcaaatcatatgatccgcaaagcagtaactaccatcgcgagccctttgcagccgatgtaagcgagggcaaaaatgacccgatctataacgctcattcctatcacacaaaggtgccacacaaagcaatcatgcgatatatactgcactacacagaaccgggcgatattgtctttgatggtttttgcggcacgggaatgaccggcgtggcggctcaactttgcggtgaccgcaacacagtggaatctcttggttatatggtggacgatcaggggatagtgtaccaacaggaaacagaggataacggaaaaagcgcgtggaaacctttttctaaacttggcgctagatacgcagtgttaaatgatctgtcgccagctgctacattcatagcttataactataacactccagtagacgtcaaagcctttgagcgtgaagctaaacgtattctacgtgaagttgaagaagaatgcggctggatgtacgctacattgcctcagggggagactgacaaagcagaaatttgggctgatgagcttaaaatgtgtaaaaccgccgatgaagccagaaaactaattcgtgcaatcccaaacctgggacagatcaactatacggtttggtctgacgtgtttatatgtccagaatgtacaaaggaagtcgttttctgggaatctgccgtggacaaaaatgccggcaaagtctacaatgagtttccttgtccgcattgcggtgctttgcttaccaagcgcaacatggatcgtgcctgggtggccaaatatgataatgcgattggcgagaccgtacgtcaggcaaagcaagttccggtgctcataaattatagtgtgggcaaaaagcgctacgagaaagcgcccgatgactttgatatagcgcttattgacaagatcgaacagctcgatattccctattggttccctacagacccaatccctaaaggcgacaaaactggcgagccacttcgtgttggtattacccacgtacatcatttctatactaagcgaaatttgtgggtgctgggggcatattggagaaggttagggagaaaagaaaagtggttagcaacaatgttgttgtcacgtaatttggtaaagtctaaccgattcattataaataaatataaccctaaagggagaataaatggccctttaactggaacttggtatattcctagcgagcaagtagagcaatcgccgatagatctttacaaggaaaaaatgctatcgtgtggatggaatatactaggcaacatcgtttcgtcagcatcggcacattttcagatactacagaaagattcaatagattatatttttacagatcccccgtttggtgcaaattatatgtactccgaattaaattttatttgggaagcatggttgcaagtccaaacaaacaataaacccgaggcaattattaatagtgcacagaaaaagactttgtcggaatatcagcagataatagcagagtgttttagggagttttaccgaattcttaaacctgatcattggatgactattgagtttcacaattctaaaaatagtgtttggaacagtatacaagaggctttgcaagctgctggttttatgattgcagatgtaagtacattagataaagttcatggcggaataaaggctgcgttttcagctaatactgttaaacaagatcttatcatttcatgttataaacctaacgaaggcttggaagaacgtttcaagattgaggctggcagcgaagaaggcgtatgggacttcgtccgcatgcatttaaaaaaccttccggtattcatctccaaggatggcaaggcagaggtcattgccgagcgtcaagactatttactcttcgacagaatggtggcttttcatgtcctgcgcggagtcaccgtccctctttctgcagccgagttttacgaaggccttgcccaacgatttccggaacgtgatggcatgtatttcttgcctgaccaggtagtggaatatgacaaaaaacgcatgaaaatcaaagaggtcatgcagcttgagcttgcagttacagatgaatcctctgcaattcaatggcttaagataaatctcaacagaaagccgcaaactttccaggaactacatccgcagttcataaaggagattggcggctggcaaaaacatgaaaaaccgcttgaacttttggaaattttggaacagaactttcttcgctatgacgggaaagggcctatccctgcgcaaatagtttcttggatgaaacaaagcgctgatttgcgcaaaatcatacaagaagagctagcaagaggtagctcgagggaagaaaatggccaattatacactgaaaaccaagagcttataaaacgtgcaaaggaccgttggtatgtccccgatcccaataaagcgagtgatttagagaggcttcgtgagcgtgccttattgcgcgaatttgaggaatacagagattccaaacagaagcgacttagggtatttagactcgaagctgttcgtgccggcttcaagaaggcttggcaagaacgcgattacgcaaccatcatctccgtagcgcgcaaaatcccagaaagcgcccttcaagaagacccaaaattgttgatgtggtacgatcaagcgcgcatgcgctttggagttgaatga

SEQ ID NO: 3286 - DNA, 2646 bp, Bacteroides vulgatus
atgagttcaaaagatataagccctagattgtttcttgatgatgaatttgaagaaacaaagattgtaccagataaagttgtttgtttaggaatggaattcccaagcgaagatgcccgtcgtgagtattttcgtgcagagcttcgtaaaaaactgccagagttgaaacaaatcgaaggtttcccaattggagaggatgatgatataatcaatctctccgatcctccttattatacggcttgccccaatccttggctaaatgattttatcgaagaatgggaaaaggaaaaagttgaattggaaaaagaagggaaacgtaaagcaaattttgaggtaaaaacgccatacgcagctgacgtcagtgaagggaaaaacaacccgatttatatggctcatgcctaccatacaaaggtaccacatcctgcaataatgcgttatatattacattacacgcaacctggcgatattgtattcgatggtttttgtggcactggaatgaccggtgttgcagcacagttatgtggctcagagaatgatgtaaaggctttattaaaaaaaggagagaaagctgaaattggagtcagacatagtatctgttctgacctatctcctattgcctctttaatagcagctacatataatctaaaattcgaccccaaagcttttgaaagaaaagcattaagaattctagaacaagtagaaaaagaacttggatggatgtatgaaactgaggtagatggtaaaaaagccaaaattaattatacaatatggagtgatgtttttgtttgcccatcttgcggaaatgagattgttttatgggacgaagctgttgatttagataaagaaataatgaaagattcttttccatgtccacattgtggtaatacttgttccaagaagaatatggaaaaagcatgggaaacttcatttgattcgttattgaataaaacagttacattgaataaaaaagttccagtaagggttaattatactttatctggcaaaagaggagaaaaaaatatagatgctaaagataagaatcttattgaaaatacgaatttatataaattaaatcttaatttatacactaacaaacttccatttggagaaaaaacaaaagcaataaaaagttctaatcacatagaatatttacaccatttctttcatttgcgtaattttatattaaacaatagagtttcggacttatcaggaaaagatatatatcttcagagttggttaacatcaataattcaaaatagttcctcaatgtataaatttcggttagatcgaaaaggaggtatattaaatggaactttttttatcccatcattaaatattgaacaaaatcctattaaactgctaaaatcaaaaataacagatttcaacagatgtttctatgaaactagaggaaattctgccattagtgttaattctgcgacatcattatataatctaccaaattcatctgtagactatatttttatagatccacctttcggagctaatattatgtattctgaattaaattcaatatgggaaggatggctaaaagtaacaaccaataacaaagaagaagcaatcataaacaaagaacaaaagaaatctttatttgattatcaatcacttatgtacaaatcattcaaagagttctatcgtgttctaaaacctggtaaatggattaccatagaatttagcaatactagcgcatctgtatggaatagcattcaaaatgcattgcaaagtgtaggatttgtagtcgtaaatgtcgctgcaatagacaaaaaacaaggttcatttaatgctgtaactaccactactgcagtaaagcaagacttagtaattacttgctataaaccttctgatgccataatagagaaatttgaaaaatctgaagataaggccaaaacagcaatggactttatcgaagaactgcttgtacatctacctgtacatttaagcaaaggagaatctacaacagctgtaattgaacgtagccctaagatattattcgacagactgatatcctactatgtacaaaaaggctatgccatccctatggatgcccaagagtttcaaaagcagcttaaagaacgatttatagaaagagacggtatgttcttcacggcatcacaagcaattgaatatgaacaaaagaaagaaaaatgttctggttttgtacctatggcactattcatcagcagtgaagctgaaggtatagaatggttgaaaagagagcttcaaaactcgcagacatattcagacttacagccagaatggatgaagaatatgcttcctcctaaaaaaggagacgttcttccggaactaatgtcaatccttgaagaaaatttcatcaaagatgaagaaggtaattggcgtaatccggaccctgaaaaggctgccgaccttgaaataatccgaaatcgcagaatgatgaaggaattcaacatgtatctggaacaagcccaaaaaccgaaagcaaagagaatgaaagatacccgtctggaagtattgcgctatggtttcaaagaatgctacaagcagaagaactatcaggctatagtaaccgtaggtgaccatattctggaatcacttctacaggaagacgaagttctgttgcagtactatgacattgcttcatcaagggtataa

SEQ ID NO: 3287 - DNA, 2583 bp, Caldicellulosiruptor kristjanssonii
atggagcttacaaaagagattctggatagtgtacgaaacattgaaggatttccaattgcagatgatgaagatataataagactttctgacccgccgtattatacagcttgtccaaatccctttataaaagactttattgaaagatacgggaaaaaatatgacgaagaaaaagatgattataatgtggaaccatatactgcagatatttctgaggggaaaaacgatcctatatacaatgctcattcgtaccatacaaaagttccttataaggcaatcatgagatatattttgcattacacaaaacctggtgatattgtttttgatggattttgtgggtcgggcatgacaggtgtagcagcggcaatgtgcgaaaatcccgacccagagtttaaaattgttttagaaaaagagtttgaacaaagaggtaaaaagatagagtggggagcaagaagggcaattttatgtgatttatcaccagcagctacttttatagcttataactacaacaatcctgttgatcccgaagaatttgagaaagaagcaaaaaggattctggaagaagttgaaaaagaatgcggatggatgtatgaaacaatacatgttgatgaaaacgggaatcctgtaaagggcatagatggtgatgttgtaaagggtaaagtaaattatacagtttggtctgatgtcttcatttgcccaagttgtgggcaagagattgtgttttgggatgtggcagttgataaggaaaatggggaggttttagatagtttcaattgtccattttgcaatgctttgctgaaaaagactattttggaaagggcaacagtgaccgtttatgataaagcactaaaagaatatattgttcaggcaaaacaggttcctgttttgataaactattcagtaaacggtaagcgatttgaaaaaaagcctgataagtttgactttgagcttttacaaaagatagatgagatggatattccatattggtatcctactgatagaatgcctgagggtgatgagtcaaggagaaacgataagtatggcataactcatgttcatcatttttatacaaagaggaatttatgggttttaagttgtttgtatgaaaaaataagtagtttacccaaaatcaaaagtttagtaaacaaattgaaatatatttttacatcaatatctatattaaccactaaaatgtcaagatatggtgatagaactggtaatgtttctggaactttatatattccatctttaataaaagatttgaatgcgatagaacttacaaaaagaaaactttggggaccaaaggggattatttcaccaataaatagtatatctaaatgttttaacaataattcattttctataaccaccactaatagtagtggaaatttgaatattatcccttcaaactctattgattatatctttattgatccaccatatggagacaacctcatgtattcagaacttaactttatttgggaggcatggctgagagtatttaccaacaataaaacagaggcaataataaataaagtgcagagaaaaggtcttcatgagtatcaagaattaatggaacagtgttttaaagagatgtatagaatactaaaacctggaagatggataacagttgagtttcataatactaaaaatgctgtatggaatgcaattcaagaggcaatgttgagagcaggttttgttattgctaatgtcagagcacttgataaaaaacaaggcagttttaaacaagtcacaacaactacagccacaaaacaggatttgataatctctgcgtataaaccaaaagaaagctttgaaaagaagttctatttagaagtaggaacagaagaaggtgtttgggaatttgtaagacagcatcttgagaagcttcctgttgtagttgaaaataatggagttttagaatatattcctgaaaggcaagcttatttgttatacgatgcaatggttgcttatcatgttcaaagaggtttgagcatccctatgggagcagccgagttttataagggcttgaaagaaagatttatagaaagggatggaatgtactttcttccaagccaagtaccaaaatatgaagaaaaaagatacaggcttgaactaaaagaacaggtttcatttgttattgttgatgagaagagtgcaattcaatggataagaaatgagcttgaaaagcagtcacagacttatcaagagctacaacccaagtttttgaaagctaagcatgagttcaagcatgaaaagttaccagagcttttgcaattacttgaagaaaactttttacaagataaagatggtaaatggtatgtgcctgatgttaataagcaatcagaccttgaaaagctgagaactaaaaatcttttgagggaatttgaaggatacttaaatgtcaaaggcaagttgaaagtttttagaacagaagctataagagctggatttaaggatttatggcaaaagaaagattataaaacaattgtaaaggtggctgaaaaactcccagagtcagttttacaagaagattcagtgcttttgatgtattatgacaatgctctgacaagattaggtgaatag

SEQ ID NO: 3288 - DNA, 3093 bp, Chloroflexus aggregans
gtgaacgacgatacaccgatgttcgatatggaagagcagaccacaccgcacgctccggtggaatgcctggggatgacctttgataacgatgatgcgcggcgcgtattctttctcgaccgcttgcgcgccgcccttgaggaactgcacgccaggctcggtggtgtccccttcacgaccgtggccgatgccgtggaacggatgaagtcgctcacgcactggccgatgggtgatgatgaacggctccgcgaactggccgaacagatgcgcaaagcccaccgctcggcgcccgccaccgacctgctccggctctggaaggatgcggtcggctttccgcacgggaagatcgaggatattctaaacctctccgatccgccgtattacacggcatgccccaacccgttcattggcgatttcatccgctcctacggcaaaccctacgacccgcagaccgacgactaccggcgggagccgtttgcggcggacgtgagcgaaggcaagaacgaccccatttacaacgcgcactcctaccataccaaggtgccgcacaaggccatcatgcggtacatcctccattacaccgaaccgggggatgttgtctttgacggcttctgtggcacggggatgaccggcgtggcggcacaactgtgcggcgaccgcaccacggtggagtcgcttggctacaaggtggatgatgcaggcaccatctaccggccggaacaggatgaaagcggcaaaacggtctggacgccgttctcgaaactgggcgcgcggcgcgccgtgctcaacgacctttcgccggcggcgacgttcattgcctacaactacaacaccccggtggacgtgcgcgccttcgagcgcgaggccaaccggatactgaaggacgtggaagccgaatgcggttggatgtacgccaccctcgccactaccaatgcgcacgaggcggcgatgtgggccgagcgcctgcgcgcatgccgcacggccgacgacgcgcgggcgctcattgcgtcgattccgaatcgcgggacgatcaactacaccgtctggtcggatgtgttcgtctgcccggaatgcaccgaggaggtggtcttttggcaggcggccgtcgaccacgaggcgggcaaggtgcgcgatgcattcccctgcccccactgcggcgccatcctcaccaagcgcacgatggagcgtgcatgggtgacgacgtatgaccgggccctcggccagaccattcgccaagccaaacaggtgccggtgcggatcacctaccgcgtgggcaacacgcgctacgagaaagcgcccgatgccttcgacctggcgctgatcgcgaagatcgaggagctggacattccctactggttcccgaccgaccgcatgccggagggtgaggagtcgcgtcgcaacgatgatattggcctcacccacgtgcatcatttttataccaagcggaatttgtgggtgttgggggcggctatatatcgagctcttgcgacaaatccacggttaggcgtatgggttacttcaaccatgataagaacgaccaaaatgtataagtacatgcctgtccttaataatggccaacttaccgaccgccgtactggaacggtatcaggcactctttatgttccatctatggctgatgagaattgtccattagacctactggtttcaaaaatccgtgattttacgttctcaatatcccggaacataaatgctgctactagcacgaattctgcaactgatgtgaatacgggtaacatcacggtcgactacatcttcaccgacccaccgttcggcggcaacctgatgtactccgagctgaactttctatgggaagcgtggctgaaggtgttcaccaacaacaaaccggaggcaattgaaaaccagacccaagggaaggggctggccgaataccaacgcctgatgaccgcctgcttcaaggagtactaccgggtgctcaagccggggcgctggatgacggtggagtttcacaactcgaagaacgccgtctggaatgcgatccaggaggcgttgcaggccgccggcttcgtgatcgccgacgtgcgcacgctcgacaagcagcaggggtcgttcaagcaggtcaccagcgcgaacgccgtcaaacaggatttgatcatctcgtgctacaaacccaacggtggtttggaagcgcggtttgcccacgaagcaggcaccgcagcaggcgtctgggacttcgtccgcacgcatctgaagcacctgccggtgttcgtcgccaaagacggcaaggcggaaatcatcgccgagcggcagaactacctgctctacgaccggatggtggccttccacgtccagcgcggcgtcctggtaccgctctcggcggcggagttctacgccggtctcgcccggcgcttcccggagcgggacggcatgtacttcctgcccgatcaagtcgtcgagtacgacaaaaagcggctgacgatccgcgaactgcaccaactgaccctcttcgtcaccgacgaagcctcggcgatccggtggctcaagcagcaccttgagcgcaagccgcagaccttccaggagcttcacccgcaattcctgaaagagatcggcggctggcagaagcacgaaaagaagatcgagctgcgggaactgttggagcagaacttcctgcgctacgacggccaggggccgatcccggcgcagatcgtctcgtggatgaagcagagcgccgaactgcgcaagctcatcgaggaggagcgtgcgaccggccgggcgactgaggagaacggccaactcagcacgcaatccgccgtgctgatcgcgcgggccaaagaccgctggtacgtgcccgacccgcacaaagccggcgacttggaaaaactgcgtgagcgggccttgctgcgcgagtttgatgcgtattgtgaatctggcgagcggcgcctgaaggaattccgcctcgaagccatccgcgccggcttcagaaaggcatggcaagagcgcgactacgacaccatcatcgcggtggcgcgcaaaatcccggagaacgttctgcaggaggatcctaagctggtcatgtggtacgaccaggccatcacccgttcgggagagcaaggatga

SEQ ID NO: 3289 - DNA, 1251 bp, Chloroflexus aggregans
gtgcgtgacaataccattcaacaacggccagagttcacatttcgagaaaaccacaaaaacggtcgccatggatgggtgcgtttaacacctgcctactctgtgacactcgtgaccgatattcttaaccgagaacgaggagcattccgcattctcgatccattcgcagggaccggaaccaccgtactttgtgcagcagaacagggaatgtacggtgttggtatcgacatcaaccccttcctcgtctggctgggaaatgccaagcttcgtcgatacactcttgcagagattgccgaattcgagcacacggtttgccgtatcatatcggcactcagatcggagggaccaagcgtacccccaccaccaatccacaacgttgcgcgctggtggtctcctccagcacttgactttctctgtcgactgaagtatgaaattgacactaggatcaataaagcgcaagcaataagcgacctatggtacatcacattctgtcgagttcttatcatgatcgctcgtgtcgcatttaatcatcaatcaatgtcgttccaagatgagtcgttccggcaagggtatctttttgtaggagaagatcagtacatcactattttgtcagaagtagcgcatcttgtgagccgatccgcgatgagcaatccaagcggaacgggaacgatcatgttaggtgattcacgcatgttggtatgtctcgccgacgaagaacgtttcgatctcgtcattacttctccaccatacgttaatcggatgtcgtatatccgtgaactacgcccatatatgtattggcttggctatatcacagcggcgagagaagcaggagaactcgattggcagacgattggcggaacgtggggggtcgcgacgagtcggcttgccgaatggcgattagcgagcgacacctttctgccaagagacctgcacgacaccatcaaacggatacgttccgcagaacacaagcacagcttcttaatggctcagtacgttgcaaaatacttcgaggatatgtggatgcacgtaaaggcggtgaagcgttgggttcaacccggcgggcatctgtactacatcatcggtaatgctaagttctacgacgtagttgttccggtcgaacgagtattggccgatatgatgcttgagtcagggtacgaacaggtctccatcgaaaccgtgcgaaagcgtaactcgaagaaggagctttttgaatacattgtatcagcccgtaaaccaaaagaagatgatcggtaa

SEQ ID NO: 3290 - DNA, 2805 bp, Desulfovibrio aespoeensis
atgagcgacaacatgctgtttgacctcgatagcgaggaaaagaaaagcggacccgtaaagtgtcttggacgtgagttcgaaaatgatgaggctcgccgcgcccactttatagaggagttgcgcaaaaaactccaagacccggaattccgcaagatcgaaggatttcccaacggcagcgacgaggatatcctgaatctgagcgacccgccttattacaccgcctgcccgaacccttggattgggcattttattgctgagtgggaggctttaaagcctaaaaaaccagataactacagttatcatcgtgaaccatttgcagcggatgttagcgaaggaaaatacgatccaatatacaaataccatccatatccaacaaaggttccacacaaagcaataatgcgttacatcctccattatacaaaacctggagatatcgtatttgatggcttttgcggaaccggtatgacaggagtcgccgctcaaatgtgtggtgaccgtgatgccgttatttcccttgggtaccaagttaagcaagatggttcaattctacgcgaggagattgatgaaactggaataaaaacgtgggttccattttctcagattggcattaggagagttgttttaaatgatttatccccggccggaacttttgttacatataattataatacgcccataaatataagttcgtttgaaaagacggcgaatcgcatcctcaaagaaattgaaaatgaatgctcatggatgtacacaaccaaacattcagatgggcgtcttggaactattaactatacagtttggtcagacgtttttgtgtgccaagagtgctcaggagaggttgttttttggaatgctgctgtagataaagaagctggaaaggtaagggacgagttttcctgtcctcattgcagttcaagtcttaccaaaagaagccttgatagggcttggataacatttttcgatcccattataaatcagacacagaagcaggcaaagcaggtacctgtgttgatcaattattcggttggatcttcacgtcatgaaaaagtcccggatcagtatgatatagatacacttaaaaaactagaggacctcaaggtcccatattggtttccatcagaaagaatgatttttggaaaagaaacaagacgaaacgatcctgctggtttaacacacattcatcatttttactctaagaggaatctttacgcgctggcaaagttgaagtctttgtctccgtctgcaaagtttaacctcttgattacgaaggtttcctttcaaataaccaagctttatagatttacataccagagcggtgtctggggggcaggaggtgggccactgtccggaacgctttacgttccatcactcgtaaaagagctgaatattataaaacaaattaaagacgctctaaaacaaagacgaggaatttctcatcccgcgacttatgggagttttgtcgggtctacacaatcaagctcgtggctaccatcaatccctgataacagcctaagttacatatttattgaccccccgtttggtgcaaatctttattattcagagttggcatttctctgggaaacttggttgcgcatattaacaaataataaagaagaagcgatcgaaaatgatgctcaaggaaagggcctagatgattatcgacttctgatgcagaaatgtttttctgaggcatatcgtgccttaaagccaggaagatggatgaccatagaattctctaacacgaaagctagtgtttggaatagcatacaaacagccctgctcgaggcgggttttcttgtcgccaatgtgtctgccttggacaagaaaaagggaagtttcaaagcggtaactacaccaactgcagtaaaacaagatttggtcatctcggcatacaaacctaatggtggcttcgaggagagattttcttctgaggctaacacagaagacggagtttgggattttgttagaacgcatctaaaatatcttccagtcattaagaagcaagcaggagagctgatcattattcctgagcgcgacccccgtatcctgtttgatcagatggtggcctattacgttcgcaaaggctacccagttcctatctccagccaggaattccagcttggactgagacagagattcgcagaacgagatggcatgtttttcctgcctgagcaagctgccgagtatgacaagaaacgtcttactgttgaacgtttggtccagcgctccctttttgtctttgatgaatcctcggcaatcgagtggctgagaagcctgttgcgtgaaaagccgcagaccttccaagatcttcatcctcaatttctcaaagaaatcggaggttggagcaaaaacgagaaagccctcgagctttcaactttgttggaacaaaactttttgcgattcgatggtcgcggcgaggttccaagtcagattcacagttacttatcaaccaactggcccgagttaaggaatcgcccaaaagatgatccggctttagtaatgaaggcgcgggatcgctggtatgtgcctgaccctaataaggcaggcgacttggagaagcttcgtgagaaggccctgctaaaagaatttgaagagtacaaacaagtcaagaaaaagcttaaggtcttccggttggaggctgtccgggcaggttttaagagcttatggcagctacgaacgcctgaagcatacaaagccatcattgaggtggcggaaaagattccgtcgaatgttcttgaagaagatccgaagctgctcatgtggtatgaccaggcaatcactcgaagtggcggcgagatttcatga

SEQ ID NO: 3291 - DNA, 2790 bp, Dichelobacter nodosus
atgaaagaaaccagtttgttcgactcgctgcttgaagagccgcagaagccctccggcccggtgacttgtctcggcatgaccttcgagaacgacgaggcccgccgcgcccactttatcgaggaactgcgcaagaagctgcaagacccggagttccgcaagatcgaaggctttcccatcggcagcgacgaggacatcctgaacctgagtgatccgccgtattacaccgcctgcccgaacccgtggatagccgacttcatcgccgaatgggatgagcagaagccgaaacagcctgaaggccatcactatcaccgtgagccttttgcggccgacgtgagcgaggggaaaaacgacccaatctacaatgcgcactcctatcacaccaaggtgccgcataaggccatcatgcgatacatcctccattacacgcagccgggggacatcgtgttcgacggtttctgcggaaccggcatgacgggtgtggccgcgcagatgtgtggcgaccgagaagtggtcatgtctctcggctaccaggtgaagtcggatgggaccattttgcaggaagaaattgatgagaatggcaaaaaggtttggaagcaattttcaaaactgggctctcgtagggccgtattgaacgacctttcgccagcggcaacttttattgcctacaactacaacacgccagtcgatgtagcagcatttgagaaagaggctaaacacattcttaaagaggtcgagaaagagtgcggttggatgtatgagacgctccatactgatggaaaaacgaaaggaaagatcaactatacggtttggtcggatgtcttcttgtgcccagaatgcacaaaggaagttgtattctgggatgttgctgtagaaaaaggaaagggaattgttcacgataaatttccgtgccctcattgcgggtctttactgctaaaacgcagcttgaagagagcatgggagacggtttttgatgaagcattcggcgatacgattcggcaagctaagcaaactcccgtactgataaattatacggcaggtgggaaaagggctgaaaaaattcccgatccatcagatattgccttgatcgaaaaaataaataacagccacatcccgtattggtttcctgttgcagaactccaggatggctttaatacacgacaaccaaaaggttctcacggaatcacacatacccatcatttttatactcgaaggaacctctggatacttgcatcgctatggtcaaaggcatctccgaaaatgagattcggattaactaatttcctttctcgcaatctgacaaagatgaatcgatttgttgtgaataggcacaatccaaatggaagaattaatggtccgatgaccggaaccttgtacattccgagcgaacaagtcgagcaaacagctacactgttgtttaaagacaaatggatcaaacatggctggaatacatgcgggaatttgataacaacccaaagcttttcaagcatagaagcatctgtgactaactcgcttgattatattttcatagacccaccgtttggtgcaaacattaactattcagagttgaactctttgtgggagtcttggctttcagttaaaacggatcaaaaacctgaagcagttgaaaatgatgtgcaaaataagtctctgaatgattatagagacttgatgctgggttgctttagaaaagcatacgaactattaaaacctggccgttggatgactgttgagttttcaaatactcgtgcagccgtttggaataatattcagacatcaattgcagatgccggattcattgtggctaatgtttctgttttagataagaagcatggtggtattaaggcaatggcctactcaacagccgtcaaacaagatctcgttatctcagcctacaagccaaacggcggttttgaggagcgctttcagaaagaggcgcaaaccgaagaaggtatatgggattttgtacgcacacacttgaagtatctgccggtcacgaaacagcagggagccttgctgcagttcgtcccggaacgtgatccacgcatcctgttcgaccagatggtggcctacttcgtccgcaagggctaccccgtgccgatctccagccaggaattccagatcggtctggcgcagcgtttcatcgagcgcgacggcatgttttttctgccggatcaggtggccgaatacgaccgcaagaagatgacctcgggcgaactcaagcagatgagtatgtttgtttccgacgaggcttccgccatccagtggctccgccagctcatcaaggaaaagcctcagaccttctccgacatcaatccgcagttcatgcagcagctcggcggttggagcaagaacgaagcccagctcgaccttcgtgaactgctgaaccagaacttcctcagctacgacggcaaaggccctgttcccgagcagatccacgcctacctctccaccaactggaaagagctgcgcaacctgcccaaggacgacccgaccttggtcgccaaggcccgcgaccgctggtatgtgcccgatcccaacaaggcaggcgacctcgagaagctgcgcgagaaggcactgctcaaggaattcgaggagtacaaggcagccaagaagaagctcaaggtcttccgccaggaagctgtccgcgccggattcaagaaagcctggcaggaacgcgactacaccgtcatcgtcgccgtggccgacaagatccccaacaacgtcctggaagaagatcccaaactgctcatgtggtacgaccaggcagtaacgagaatgggaggcgaataa

SEQ ID NO: 3292 - DNA, 2472 bp, Methanocaldococcus sp.
atggaagacaatattattaaagacattgaaaaagttaaaaacattgaggggtttccattaggagatattgaagatatcgttgagatatcaaaccccccagaatttactctttaccctaacccttacattgaagactttataaaagagtttggaaagtcttatgatgcagaaaatgatgattaccaaaaaactccttatgtttcagatgtaagtgaggggaagaacgacccaatttataatgcacatacttatcatacaaaagttccatataaagcaataatgaagtttataaagcattatactgagcctggagacatagtttttgatggattttgtggtagtgggatgactggtgttgcggcattgatgactggaagacatgcaatcttaaatgacctctctccagttgcaacatttatagcatataatttcacgcatcctgtaaatcctaaggaatttaaaaaaatggcagagcaaattttaaaagaagttgaagaagaatgtggatggatgtataagacaaaacatgatgatggtagggagggagtaataaattatgttgtttggagtgatgtttttagatgtccaaattgtggtgcagagttggtattttgggatattgcagtagattttgaaaaaaataaagtgaaaaaagaatttatctgtccaagttgtgaaattaaattggataagaggaaacttgaaagagtttttgtgaaaaagtatgattctgctcttggaaaagaaatagaacaagcaaaacaagtgccagttttaataaattataaggttagagaaggtaaaaaatggaaaacttatgaaaaaaccccagatgatgaagatttgaagttaattgaagaaattgaaaaaagaaatattccatactggtatccaacatatagaatgccagaaggatataatactgaacaacctaaaaaatcgcacggagtaactcacgttcatcatttttacacaaaaagaaatttatggtgtttagcatcattttatgataaaatcagaaagattgaggataaaaatttaaaatatgcgttgatattttggtttacttcagcattacttaggactaccaaaatgtataggtggaatcctaaaagaccaacaggttttttatctggaacattatacattccttccataggttatgaatttaatataatatatatgatgaattatagaatagaccgactgtgtaagtatttgaatagttatccaaaaataaataataaaatatacataacaacacaatcctcaacagatttaaggaatattccagacaattccatagattacatttttgttgatccaccattcggagataacctaatgtactctgaattaaactttatctgggaatcatggctgagagtttttacaaataataaaccagaggcaataataaatgaaacacaaaataaagatgtttatgagtataaggaacttatgtatcaatgttttaaagaaatgtatagaatattaaagccaaatagatggataactattgaattccataattcaaaagcaaaagtatggaacgcaatccaagaagctttatctaaagcaggatttattattgcaatggtatctacattggataaaaaacaaaaaacattcaaacaaataactggaactacatcagttgctacagatttgattataaatgcttacaaaccaaaaaaagaatttgaagaaagattcttaaaatctaaaggtaaaggatttgaaaaagaatttgtagaagagcatttacaacatttaccattagaaccaaatatagaaagaactgataaagtcctttattcaagaatgttagcatattatgtgcaacatggttatgaaattaccatggattcagaagaattttatgaaatgttaaaagaaaacttcataaatatagatggttattggtatactattgagcaggcagataaattaagaaaagagcaggaaaataaattgggagaattattagccaaaaagaaacaattaacattattcattacaaatgaagaagatgctcttctttggttatggaatttcttaaaagagccaaaaacttacagtgaaatttatacaaactatacaaagttcttaggaaacactgaggaagacattccagaattggaagaacttctaagacaaaactttatagaggaaaatggaaagtggaggagacctaccgaagaagagaaaaaatctctcgaaaagaaaaagagagacaaactacttagagaatttaacaaattacttgaagatattaaagcaggaaagattaaagctaaaattaaaaatgtcaaaaagagtgttattgtcgaaggatttaaagaattatacaagaaaaagtgttatgaagacattattttggtagctgagaaattaccaacaaaacttgttgaagaagatgaagatatttcaatgtttgtagatatagcatactcaaaattagaggactga

SEQ ID NO: 3293 - DNA, 2805 bp, Methanosalsum zhilinae
atgactgataccaccttatttgacaatttctccgaaggcagcaacaactctccaaagcaggtcacctgtctcggcatgacctttaaaaacgaagaggaacgccgcaactacttcaccgaaaagctgcgtgaaaaactgcaggacccggagttccgcaagatagaaggtttccccataggttcggacgaagacatccttcacctgagtgacccaccatactacactgcttgcccaaatccctggatcacggatttcattaacgagtgggaagcagaaaaaccagaaaaatctgcagattacaagtaccacagggaaccctttgcagccgacgtgagcgaaggcaagaacgatcccatctacaatgctcactcataccacaccaaagtacctcacaaagccatcatgcggtatattctccactatacagaacccggagacatagtttttgacggtttctgtggcacaggtatgaccggtgtggctgcacagatgtgtggtgaccgcaagactgtggaatcccttggctaccaagtcaaacctgacggaaccattttgcagcagaagactggcgatgatggaaagactcgatgggtgcctttttcgcagcttggtgtgcgaagggcggtccttaatgatctttctccggcagctactttcatcgcctacaactacaacactcctatggatgtgaaggcatttgaaaaagaagcaacacgcatcctcaaagaagttgaagaagaatgtggctggatgtatgagactaagcacactgatggaaagatgggaagaataaattataccgtttggtcggatgtttatgtttgtcctgagtgtgctaatgaggttatattctgggaagcagcattagatcgggaaggaggaaaagtaaatgatgtttttccctgtccttactgctcagccaaccttaccaagcgtaatatggaaagggcttgggtaacaaagtacgattccgcgattaaggaaaatgtaaaacaggcaaaacaggtgccagttctaattaattattctgttgataaaaagcgttttgaaaagattcctgatcaatttgatttaaagctgattgaaaatatagtaaatgctgaaattccttaccattttccctcaactaaattgccaaatggttataatactcgacagccaaagacttctcatggtatcactcatgtacatcagttttacactaaacgaaatttatgggtgttgtcttctgttcttaagaaattaagagataaaaatccaagatatactgcatggtatacatctacgatgagttgggttggaagagaattgagacttcatttgggtaattattttggtggtggtggtggtgttatcacgagtcttcgtggaacactctatgtagcatcactttcagttgaaacaaatgtacttgaacgtcttgctttacgtgttcgatggcaagcatttagaagtaatttgaaagaaggtgaatgtatttctgaaacgtgtagtgcagctgctgcttctgtaagtaaagaatgttatgattatatttttcttgatcctccatttggttctaatttaaattattctgagttaaatagcctccttgagtcttggttaggaatcttaacggataatactccagaagcgattcaaaataatgtgcaaaataaaggattgaatgagtatagattattgatgacaaactgctttaaaactgcctacaatttgttaaaacctggacgctggatgacagttgaattctctaatacaaaggcttctgtctggaacagtatccaaacagctttaacagatgcaggtttcattgttgcaaatatatcagcgttggataagaaaaaagggagctttaaagcgtgtactacaccaacagccgtcaaacaggatcttgtcatctccgcctacaaacctaacggtggctttgaagagcgctttaagaatgaagcagcaactgaagaaggtgtttgggacttcgtacgaacccatttagaataccttgctgtaactaaatatcagggcgctttgctacaactgataccagaacgtgacccgcgtattctttttgaccagatggtagcctactatgttcgtaaaggctatcctgtgccaatctcaagccaggagttccagataggacttggacagcgattcattgaacgcgacggcatgtatttcctgccagagcaggctgcagagtacgatcggaagaaactgacatcaggacagcttgtacaaacaaagctttttgtttcagatgaagcttctgcaattcagtggttacgccagcttctgaaggtaaaaccgcagacattccaggatattaatccgcagttcatgcaggagcttggtggctggagtaagaatgaacaggaactggacctgagggaattgctaaaccagaatttcctcagctacaatggtattggtgacgtgccaagccagatccatagttatctttctaccaactggccagagatgcgtaatcgccagaagaatgattcgggattgatgactaaggctaaggataggtggtatgtgccagatcccaacaaggcaggggacctggagaaactgcgtgagaagtcgctgttgaaagagttcgaggagtacaggcagtctaccaagaagctcaaagtgttcaggatggaggctgtacgggctggttttaagaaggcatggcaggagagggattattctacgataattaaggtggctgatctgataccgaacaaggttctggaagaggatccgaaattgttgatgtggtatgatcaggctgtgactagggttggaggtatttaa

SEQ ID NO: 3294 - DNA, 1161 bp, Methanosalsum zhilinae
atggcacaaaacaattttcctggaaacgacttatcttttcctcttaataagcttcctaataaaagtaattcttatctgaggctcaacaccatttgcccgtattttactatgtttccgcttgattatccttttgaagttttaaaatacgcaaaatcaaatgataaagttttagatcctttttgtgggagagggacaacaaattttgctgcaagattaagagggctgtcttctgttggaattgatgcaagtcctatagcatccgcaattgccatttcaaaatttacgaatacgacacctgaacaaataatatctttatgtcaggagatattgacagattcagataaacccgaaaatgttccagaaggtcctttttggactctgtgttatcattcttctaccctaaaccagatatgcaaattgagagaatctttttcggaagaatgtaatacggatacatctattgctttaagggcattaactttgggaattctgcatggaccactcggaaaaacagttgattcatatctatcgaaccaaatgccaagaacatatgcttcaaaaccaaattattcagtgaaatactgggaagaacgtggtcttttacctaaaaatattgatttgctggaggtagtaaaaagaagggcaaaatactcattgtcttcattaccaccatatgtagatggcggaatattgaaagaggacagtcgcaaccctataaaaaacagttcacttccactagaagagtttgattgggtaattacatctccaccctattacaatatgaacacatatatccctgatcaatggataaggaactggtttttgggtgggaatgataaagttgaatattcatattctaagcaagtttcacattcatcaaaaaagaaatttagctcagaattagcaaaggtttggaaaagcgttgctgacatatgtaatccaaatgctaatttaatgattcgttttggatcacttcctagtagtccttgtaatccttcagaactgctagaagaatctctcgaagaagcaaactgtggatgggaaataaataatataaaatcggcaggaacagcagaaaatggtagacgtcaatctgaacaatgtgtaaagaacttgggaaaagctatcgaagaaatagatttgcatgccatactgaggtga

SEQ ID NO: 3295 - DNA, 2196 bp, Methylacidiphilum infernorum
atgcggatcatgacgcttgtgcaatgtgcatcccagaagcaccgggtggttcaagaggatgtcgcatgctctcgctttcacggtttcccagacacgaccctgcttgagtcgggcgcacttccgattgccgaaattgctgaacttgccatgcgggaaggtcaatgcacgaatccgctctatcgggttcaccgctggttcgcccgacgcctcggttctcagtttcggtctatcttgactggcctttcgcttgatgctgatgaagaaaaccgcttttgggacaccttcctgggcgaggtgccgctggacggcgcggttgtcctggatcccttcgtcggagggggaaccagcctagtggaagccatgcgctgtggcgcccatgtgatcggatacgacattgacccgatagccacgttcatcacgagatttgaactggaagcagctacctacgatcccgagagcgaagagattgccgagctctgcgtctccattgctgcccagctagcacctttccataggactaaattcaatggccgggagcacgaggtcttgcatcacttctgggtggagtgtcgcacctgtcgttcctgcgggagcactttcgagatccatccgcatttccagttggcttccagcaaggagaaggggctccagtgggccttctgtaaggaatgccacgagatccacgagcttcccatagagcgaaaagaaatccgctgtaggtgcgggacccggacccgcatcgcacagggcacccttaatcgtggaaaggttcgctgtcccgcatgtggcgacacagcgggtctcgcttatcgtggaaatagtccgaagcccccgatgtggcacttgtttgcccaagaatacatcgagcgaaacccaggtggcgtaacgcggcatttcaagaaggcgacgaagggagaccgtattcgctacggaaaagcctcgcgccttctcaaggagattgagagctccgaaggcccgtttgcgccgatacgcgagatcccgacagatggccgctcagaccagcgaccgatcatccacggcttcagaaggtatcgtgacctttttaatgaccggcagctgctacatctgaccctgctcggcaaggccatcgcagcggtggatgagcctcgcgtccggcgcgtccttgctatggccttcagcgagcatctcaccacgaactgtatgtacacggcgtatgctttcggctaccgccgcttaagccctatgttctcaatccattcctacaggcacatcacgaggccggtggaaatcaatccatggctcgactgtattgggagaggcacatttccgaacactctcagcaagatcacgaaggcggttgcgtttgccaaggccccgaccgagttggacccgaaaggcggccgcgttccgtccaaggcgggaaagcacgtttacgcctcgaaggtttctgacaacccctggcagatcctgaccggctcctcaagagcttccatacgcacaaagacttccgaggatctgtctgagatccctgatggaaccatcgacctcatcctcacggatcctccgtacttcgataatctaagctactcggagctctccgacttctacctggcctggcaccagtcccttggagaggccgaacctccattcgatgatcctcatcttgcggctcccatcggagagaacctcgcgttgacctccagggacgatgagtcgattgcggtttatcgtgaaaggctccggcggatcttctccgaatgccagcgtgtgctcaaacggaatggcgtctttgtcttcacctatcaccacaagcacattgctgcgtggaacgctgtaggcgaggtgctggccagatcgggtttcagatgtaccgccgtcttgccccttcgcggtgagggacagggggggctccattcctacgacggaaccatcaagtgggatgccgtattcgtatgccgcaaggatgcacaggcacccgatagagaatcctgcccagtggtcgttccgcggagcgccatagccgatgctagacgccgtgcggatgcctacgccaaggagctcggtgataagaaacgaatcggcttccgagagccagaccgcctgaacctggaacgggccatggttgtagcgtcggcggtcctgggaaaggcagacgacgagtccatgccacttcacacggcactccatcgcacaagagaacgaggaggcaactga

SEQ ID NO: 3296 - DNA, 2895 bp, Methylacidiphilum infernorum
atgtgcatggctcataggctatgtagtacgtgcccagattatggaatcggagattcggatcatagttggaaaaccagcccatacgattccccacgccgcgtacacagattgcgattcattactccaaatactcagggaacagggagaaaatgtatgaaatgttctaaacagcaactctttccctctatagacgagggtgagaagccggttgagtgcctaggtctgacttttcccaacgaaaaggtgcggcgcgagttttttctcgacaagttacgccagaagcttcaggatcccaagtttcgtcaatttccaggtttccctgacgctagcgacgaggacatattagctctttccgatccgccgtattatacggcatgcccaaacccctttatcgaagattttataaggcactatggtaagccctacgaaccgggcagttcttatagcaaggaacctttagcagtagatgtcacggagggtaagaatgaccccctgtatcgtctgccagcttatcatacaaaggtccctccaaaggctattcaacactacctgctccactatacggagcctggtgacattgtcctggacgctttttgcggcaccggaatgacgggagtagcctgcctcttgcttgaacaccctgatcatgaacttgccgccacgatggacaccgactccaaatggggtaagcgtcatgcaatactcatagatctgtctcctgccgcgacgttcatagccagtgtaatgaatgcgcctttgccgccaaagttggcagaaggacctgatggagatctaggccagattattcaacgcgatatcattcccctgtatctgaccgattgggatggaaaagaagtttcatttaactacgcagtttggagcgattggggagaatgcccggaatgcgggcatatctttcgtctatatgatattgtgattgattataagcatcacagaatgttgcctgagtataactgccccaactgtggatttacgatccggtcggatagacaaaaaaaggcatttacaacagagtttgatccctggctcaacagacccacaaagatagccaaaaccacaatggttctcgtctctatgaaaataggaaatcgcactattcgacgagaagccacacacgccgatacgcaattagctgcttccgttggtgaaaatcatgtcttaattacgcctacagaacttccttactcgcacatgacacatgagcggaacaaccttcctgaatactgggggatcacccacatacatcatttctacacaagacgcaactacctcgctctcgcgcgtgtagcaactattgggaatcaagacctgaaacgagctgctctgtttgctgtattgacgatactggagaataatgccactcgacgcaatcgtttttatgtagatgcaaggcgtccccaaggatcccctgttggtccattgtcaaatacactctatgttccgacactgcaggtcgaaacaaatatcggaataaagctgttatccatgctgaagcaaatagctaaattgagaaacaagtgggtcatcgggcgatcctttgtttccacgcaaagtgctacacagcttttccaaattcccgacaactccgtagattttatattcaccgacccgcctttcggggggaacatcaattattcagagcaaaactatttggcagagtggtggttgagagtatttacaaacaagatcaacgaagccatcactaatcccgcccagaagaaggggctattcgaataccaacagataatgacgcgttgtttctgtgagtattaccgcgttctaaaaccaggtcgatggatggtgatggtatttcacaactcatccaacgcgatatgggctgccatacagcaagctcttgaggcggcagggtttgttgtcgcaaccgtagcagtattagacaaggttcactcaacactccatcaagaccacaaggcagctgcggtagacaaagacttagccataacagtttacaaacccaacggcggccttgaggaaaggttcaagctgatcgcaggtaccaaggaaggcgtatggtacttcatccgcatgcacctaaagcaactgcctgtgttcgtctcaaaggacggcaaggcggaggtcatcgccgagcggcagaactacctgctcttcgaccgcatggtggccttccatgtccagcgtggcgtgacggtgccgctctccgtggcggagttctacgccggtctcgccaagtgcttcccggaacgcgacgggatgtacttcctgcccgagcaggcggcggagtacgacaagaagcggatgaaggtaaaggaggtcctgcatctccagctcttcgtcaccgacgaggcctccgccatacagtggctcaagcagcagctcaccaggaagccgcagaccttccaggagcttcatccgcagttcctcaaggagatcggcggctggcagaagcacgagaagccgctcgagctctccgagctgctggagcagaacttccttcgctacgacggtaagggcgaggtgccgagccagatccacagctacctctccagcaacttcaaggagctgcgcaacctccccaaggatcacgagcgcctccgggccaaggccaaggaccgctggtacatcccggatccgaacaaggccgtcgacctggaaaagctccgcgagcgggccctactgcacgagttcgaggagtaccgccagtccaagcagaagtgcctgaaggtgttccgcctcgaggccgtccgtgccggcttcaagaaggcatggcaggagcacgactacgccaccatcattgccgtggcacgcaagatccccgataatgtcctccaggaggataccaagctcctcatgtggtacgaccaggcggtgacaaggatgggaggagaggtatga

SEQ ID NO: 3297 - DNA, 2559 bp, Moorella thermoacetica
atggattacgaaaccgggtcactgtttgaagcgaaaaatgatccaaagctggagccggaggacgatttcgcccgctcctgcccgcccctttccgagctgctggatacggtgcgccacgtggagggcttccccctgggccgggacgaagacatcctggccctctccgacccgccctactacaccgcttgccccaacccctacctgggcgagttcatcaggcgctacggcaaaccctacgatgaggccaccgatacctaccagcgcccgcccttggtggccgacgtgaccgaggggaagaacgaccctgtttacaacgcccactcctaccacaccaaagtgccccacaaggccattatgaaatacatcgagcactacaccgaaccgggcgatatcgttttcgacggcttctgcggcagcggtatgaccggcgtggcggcgcagcttctgggccggcgggccatcctctgcgacctctcgccggccgccacctttatcgcctataattacaacacccccgtggacgtggccgcgttcgagcgggaggcgaaaaggatcctcgccgaggtagagaaggaatgcggctggatgtatgagaccctccacaccgacggccgcaccaatgggcggatcaactatactgtctggtccgatgtcttcatctgtccctactgcggcagcgaatacgtcttctgggaggcggcggtagacaaggaacggggcaaagtgcttaatgaatacccctgtccctcctgcggcgccaaagtagccaagcgtgagtgcaagcgggcatgggtggccttctacgaccaggtcataggccaggaagtgacccaggccaaacaggtgccggttctgatcaactatacggtgggcaagaagcggtacgaaaagaagccggaccagtacgacctggacctgatccgcaggatcgaggagagcgccatcccctactggttcccgacggatcggatgctagagggggataagactgtagaacccatacgcctaggtattacccatgtgcaccatttttatactaaaaggaatttatgggtgctggcagcactaaacagtaaaatttctgcagcaaagggaaccggtgtcgccgctgttctcagatttctaatctcttcttacaaccatactcatagcactaaaatgacgaggataatatttaaggataccggcaaaccggtgctaacaagttgccagtcgggtacgttgtatataagttctcttcctgttgaaaaaaacatcttacagggcttaacaaaaatgaagctggcgcttataagtagagcgttaaaggccttgagttatgagcaagcaatcactacttcctcttccaccgggttttcattaataagtatttataataactgcatagattacatttttactgatccgcccttcggtagcaacctgatgtactctgagctcaacttcctctgggaggcttggttgagggtattcaccaacaacaggcctgaagccattatcaatgaaacccagggtaagggcctgcccgagtataaggagctcatgaccgcctgcttcaaggagatgtaccgcctcctcaagcccaaccgctggatgactgtagtcttccacaattccagggctgcggtgtggaacgccatccaggaggccatcaccagggccggcttcgtcattgctcaagtgacggttatggataggaagcagggtagctttaaccaagtaactgctgctggtgcagtagaaaaagatttgatcataaatgcctacaagccaaagaaacagatggaggaaaacttcctgcgccgggccggggcggggctggagcgggacttcgtggccgaccttttggagcaccttcccgtggtgcccaacgtgggccgcaccgagaagatgctctattccaagctgctggcctattacgtacagcgcggttttgaaattcgcctggatgccaggcagttctatgtcctgcttaaagagaatttcaagctcattgacggttactggttcaccgacgagcaggttttacaatacgaggaatggaagaggaaacagagactggatggcatcaaggaggtgcagtccggccagcagatcttctttgtgagcgacgagcgctcggctctggcctggctttataacttcctggaaacacccaggacctataccgacatttacaccgcctatagccgggctcttgtgcaaagcgacgatgccataccggagctgaaggagcttttggataacaactttatcctggagaacggccgctaccgccgcccgcagacggagcaggaaagagaggccatcgaggcccagcgggaaagggaattgggccgggcctttgagcggctcctcgccgaggccaggagtggggttaagaggctgaagggagtacgcaaggaggcgctcatcttcggctttaccaaggcctaccgggagaagcgttaccaggacatcctggccgtggccaggaaactggaccaggacttcttggagacaaacggcgagatcaacgactttgtagaaatcgccaggctgaaaacgggagaggaataa

SEQ ID NO: 3298 - DNA, 2844 bp, Nitrosococcus oceani
atgaaaccaaaacaagaaagcctgttccagaccagactggttcccgccgaagcgggctccggcaggctattcgacgaagaactggtggctggttcggatgggcctgtaaagtgtcttggtcttgagtttgaaaacgacgaagcccgtcgcacccactttaccgaggagctgcgcaagaagctgcaggacccggagttccgcaagatcgaaggttttcccatcggcagcgacgaggacatcctgaacctgagtgatccgccatattacaccgcctgcccgaacccatggatcgccgacttcatcaccgagtgggaggcgcaaaagccggaacagcccgaaggctatcactatcaccgtgagccttttgccgccgatgtcagcgaaggaaaaaacgacccgatttacaatgcccactcttatcataccaaagtgccgcacaaggcaatcatgcggtacatcctccactacacggagccaggagacatcgtttttgacggcttctgtggtactggcatgacaggagtggccgcgcagatgtgtggcgaccgtgaagtggtcatgtcgctcggctaccagttgaagccggacgggaccattttgcaggaagagatggacgaagatggcaaaaaggtttggcgaccattttcaaaactgggcgtccgcagagccgtactgaacgacctttcaccggcggcgacgttccttgcgcataactacaacctttatgttgatacggcatcatttgaaaatgaagctaagaaattcatcaaaataatcgagcgagaatgtggatggatgtatgaaacaactcatacagacggggtgaccaaggcgaaagtgaactacacaatctggtcagatgtatttgtctgtcctgattgcactaatgagattgtattctgggatgttgcagtcgacaaagaatctgagacagtaaacgatgagtttcaatgtcctaattgccagaccagcttaacaaagcgcaatatggaccgtgcttgggttaccacttatgaccgattcttgggagagacgattcggcaggccaagcagatacctgctttgatcaattatagcgttggtgggaaacgatatgagaagaaacctgacgagggtgacttcgcaattttggagaagatagaaaacgaaggattagacggatggtttcccatcaatcgcatgattgaggggcatgagtctaggagaaatgatccggttggtatcacgcacactcatcacttttattcacctcgaaatctatcagtgatgtcgaagattttggatttggctgacaaatctgaatttactcccttcaaattcggttttctgaatacctcttggcacgccacgcagatgaggcaatacaacccaggtggcgggcacagacctagaacgggtactttgtatatgccttccatccatagtgaaggtaacatgattcccgtttacaagaaaaagctgaaccagcttgttcagttttataaagtcaagtctcatcgaaatagggttgccattattcagaccatgtcgtctacggtggaatcatctatcgaagcgggtttggactatgtattcattgatccgcctttcggcgcaaatctgaactactcagaactaaattcaatatgggaggcatggcttaaagtaagtacgaataatgccgaggaggcaattgagaataggtcacagaacaaggggattgatgaataccgatctcttatgactcagtgctttcgacaggcatacaaccaattgaaacctgggcgctggatgactgtagagttttctaatacaagcgctggtatttggaacaatattcagacggcaatatcagacgctggatttattgtcgcgaatgtctctgttctaaataaaaagcaggggtcgataatggcttacactacccccactgctgtcaaacaagacctcgttatctcagcctacaaacccaacggcggttttgaagagcgctttcagaaagaggcgcaaaccgaagaaggtgtgtgggattttgtccgaacccacctaaagtatctgccggtcaccaagcaacagggagccttgctgcagttcgtcccggaacgcgatccgcgcatcctgttcgaccaaatggtggcctactacgtccgcaagggctaccccgtgccgatctcgagccaggagttccagattgggctgtcgcagcgtttcatcgagcgcgacggcatgtttttcctgccggatcaggtggccgaatacgaccgcaagaagatgacctcgggcgaacttaagcagatgtccatgttcgtctctgacgaggcatccgccatccagtggctccaccagctcatcaaggaaaagccgcagaccttctccgacatcaatccgcagtttatgcagcagctcggcggctggagcaaaaacgaggcccagctcgacctgcgtgaactgctgaaccaaaacttcctcagctacgacggcaaaggcccggtacccgagcagatccacgcctacctctccaccaattggaaagaactgcgcaacctgcccaaggacgacccgactctggtcgccaaggcccgcgaccgctggtacgtgcccgatccaaataaggcgggcgacctggagaaactgcgcgagaaggcactgctcaaggagttcgaggaatacaaagaggtcaaaaagaaactcaaggtcttccgcctggaagctgtccgcgccggattcaagaaagcctggcaggaacgcgactacgccgtcatcgtcgccgtggccgacaagatccccaacaacgtcctggaagaagatcccaagctgctcatgtggtacgaccaggcggtaacaagaatgggaggcggtgactag

SEQ ID NO: 3299 - DNA, 2721 bp, Nitrosococcus watsonii
atgaaacaggacgagcttttcaactcagaacacagaacccagaacacagaaccgcaaccggtcacctgtctcggcatcgaattcccaagtgatgaagcgcgacgccaacacttcaccgagctactacgcgaccggttgcgcaacccagagttccgcaagatcgaaggttttcccatcggcagcgacgaggacatcctgaacctgagcgatccgccgtattacaccgcctgtccgaatccatggatggccgacttcatcgcagaatgggaggctcagaagccggagcagcctgaaggccaccactaccaccgtgagccttttgcggcagacgtgagcgaggggaaaaacgacccgatttatcgaatcccaagttaccacacaaaggttccaccaaaggccatcgaaaactacatccttcattacaccgaacccggtgacatcgtgctggatgcattttgcggaacaggcatgaccggggtagccagccttctctgcaaacctgctaagcgtaatgcaattctgatcgatttgtcgccaacagcaactttcacggcctccataatgaattccccaatccttaatgacctatcgaaagggcaaaaagggaggttgggggaatttgtaacaaagaaattattaccactctatcaaacagaatgggatggaaagaagcagccgtttgattatgcaatttggagtgattggggcgagtgctccgagtgcgctgaaactttcagactttttgatgtggttattgattttcagaattcaaaaatgcgccctgaatacgagtgtccaaaatgtggagctgctctgaggtctgactcacagaaaaaagcttttagcactgatttcgatccatggctaaataagccagtgcggattgcaaaaaatacgatggttatgctttctaaaaaggttggtaaccgagcaattagaaggacggtaacagataaagataagttactcgctaatgaaatcgggaaccgtcctgttgatcaaacaccgatggagctaccgtactctcatatgacccatgagagaaacaatttacccgagtattgggggatcacgcacatacaccatttttatacacggcgcaattactatgcaatctcaagggttgcagctatcgatgaccaggtacttagaaaagctggcttattcgcagtaataacgtcacttgaaaacaatgccacaagacgtaatcgtttctatgtggattcccgtcgcccaaatggctctccggtaggccccctttccaacacgctctatgttccaacagtccaagtggaaaccaacatagggatgaaaatcctatctgttttgcgtgacacgagtaagaacaaaagtggttggcctcgcggccgttcattagtttctactcaaagcgcgactcagcttaacaacatacctgacaattcagttgactttgttttcaccgatccacctttcggagggaacattaactactccgaacaaaacatccttgctgaatggtggctgcgactttttacaaacaatgaatcagaggcaattacaaatagtgttcaaaaaaaaggactgcccgaataccaagctctcatgacacaatgtttcaaggagtattaccgcgtcctaaaaccaggacggtggatggtcgttgaattccataattcctcaaatgggatatggtctgctattcaacaagcacttgaggcatctggatttgtagtcgctaccgtagcggttttagacaagatacattctactcttcaccaggatcacaaggctgctgctgtcgacaaagatctggccatcaccgtctataagccaaacggaggtcttgagcaccgcttcgagatgtctgctggatctgcggatggagcgtgggattttattcgaacacacttggatcagttaccggtctttatgtcaaaagacggccaggccgaggtcatagcagaacgacaaaactatcttcttttcgatcgcatggttgcgtttcatgtccagcgaggggctacggtgccactttctgctgcagagttctatgctggactatctcaacgctactcagagcgtgatggcatgttttttacgccggaacaagttgccgagtatgacagaaaaagaatgactgtgcgggaagttcttcagctccaactgtttgttacggacgagtcgtcggccattcaatggttaaagcaacagctctcaaaaagaactcaaactttccaagaactacatccgcaatttcttaaagaaattggcggctggcaaaagcatgagaaatcactagaactatctgttctccttgagcaaaacttcctgcgttacgatggcaaaagccctgtgcccgaacagatccacgcctacctttccaccaactggaaagagctgcgcaatcttcccaaggatgatccgaccctggtcgctaaggcccgcgaccgctggtatgtgcccgaccccaacaaggcaggcgacttggagaagctgcgcgagaaggcgctgctcaaggagttcgaggaatacaaagaggtcaagaagaagctcaaggtcttccgcctggaagctgtccgcgccggattcaagaaagcctggcaggaacgtgactacgccgtcatcgtcgccgtggccgacaagatccccaacaacgtcctggaagaagatcccaagctgctcatgtggtacgaccaggcggtcacaagaataggcgatcgtgaggggtactcagtatga

SEQ ID NO: 3300 - DNA, 2763 bp, Parvibaculum lavamentivorans
atgaacgacctactgcaaaatcatcacagcggaacaagtggcccggtcgaatgcctcggccagacatttgccagcgacgatgcgcggcgcgcgcacttcctaacgctgctggccgagaagctgcaagacccgaccttccgcaagcaggaggggtttccgaagggatcggacgcggccatcctcgccatgtccgacccgccatactacaccgcttgcccgaacccgtggctggcggagttcgtagcgcattacggcaagccctacgacccggcggtgaaatacagccgcgagccgctggcgatcgacgtgagcgttggcaagaccgatgccatctataaagcgcacagctaccacaccaaggtgccgcacctggccatcgtgccgtcgatcctgcactacacccagccgggcgatgtggtgctggacggttttgccggttcgggcatgaccggcgtggccgcgcaatggtgcggcacggccccggccagttaccggcacgacttggagctgacgtggaagaaggaaggccgcactgcccccaaatggggcgctcgccgcgccgtgctgaacgatctttcgcctgccgctactttcatcgccaccaacaacaatcaaccatttgatgtcattggctttgcaaaagcagcggagacgttgctgcatgacgcagaacgcgaaatcggctggatgtataagacaaagcacacagacggcacagaagctcatattgcatatgtcgtctggagcgaagtcttcatctgccgatcctgctcgggagagaccgtattcttcaatgcagcttacgatccagtagcaaacaaggtccgggataaagtgacatgttctcattgtggggctgaatcctccaaagagaacatggatttgaaattcgagtcttttatggatgcgccgcataatcgggtagataaacggccggaacgtgttccggtcttaatcaagtattctatcggacgatcttcgttcaccaaaactccagatcagaatgatctggcaattcttgacaagatctacaagctcagcatccctcaaaatctgccgaccgttgagctgcccgattgtcagatgacgcgcgttgggcgaatgcggacgacaaatacgggcagcattcaccatatgtatttgcctagggccggttacgctttgtcctatctctgggaaaaagcgaataacttgaccgacggacgtttgcgtaacgaaatcaaatattggctagacagtcagttcaccaatttgtctatacttaatagatacaggccagaagtttccttcccatacaatcctctctctggtgttttttacgtcccctccttaatttcggaggccgatccattcacggcatataaaaacaaaataaagagattgacctcagcgttttccgtgagccgtgcacaggaaaatatgagcatgacctcgtgcgggagcacaacgaaattgcctctcaataacgagagcattgactatatttttacggacccaccgtttggagagaatatctactacgccgacttaaatatccttgtcgaatcttggcatcgcgttcttactgatgcgagccccgaggcgattgttgatcgagtgagagaaaagggaatccctgagtatcaacatctcatgcgcgcgtgcttttccgaataccaccgtgtactgaagcctggccgttggatgacggttgttttctcaaacagtcgcgcgtcggtatggaacgctattcaagtagcattacagcaggttggatttgtggttgcagaggtgaccgccctcgacaaagtgcagggtagttttcagcaggtcacttcgccaaatgtcgtgaagcaggacttggtgatttccgcctacaagcccaatggcgggctggaagatcgtttcgtgaagagcggtgcgacggtagattcagcgtgggattttgtgcagacccatctgcggcatctctccgtcacgaaggttaaagacgccgagctggagttcatcgtcgagcgcgacccgcgccgcatctacgaccggctggtggcctggttcgtgcgccatgacgcgcccgtgccgctgtccagcgacgagtttctttccggccttcgcaaccgcttccccgaacgcgacggcatggtcttcctgccggagcaagtgacggagtacgacaagaagcgtgcacagaccgcgcaggcgccgcagatggaactgttcgtctccgacgagcgcagcgctatcgactgggtggcggacttcctgagagcccggccgtccacctatcaggacatccacccggagttcatcaggcaactgggcgccggttggaaaaagcacgaaactcgaccggaactctcggcgcttctggaagccaacttcctgcgcttcgacggcgcgggcgaggtaccgagccagattcaccgctatctctcgaccaactaccacgacctgcgcggcctggagaaaatcgatccgcgcctcaacgcccgcgcgcaggaccgctggtatgtgcccgatccgaacaaggcgcaggacctggagaagaagcgcgaaaaggcgctgctcaaggagttcgagacctacaaggcgttcaccggccgcaagatcaaggaatcgcggctggaagtgctgcgggcaggttttaacgcggcgtgggcggtaaaggattacgccaccatcctcggcatcgcccacaagctgccggaagcaaccctgcaagaggatgagcggctgctcaccctctatgacatggcgctgacgcgcaccgaagacggggcgtaa

SEQ ID NO: 3301 - DNA, 2763 bp, Parvibaculum lavamentivorans; identical to SEQ ID NO: 3300

SEQ ID NO: 3302 - DNA, 2853 bp, Planctomyces brasiliensis
atggcaaagaaggccaagaaacagcaaaaggaacgcctcttcgaggagaaactcgtcccgagcaagaagggatcgggtgagttattcgatgtcagctacggcgatgacgacgggaagccggttgagtgtctcggcatgacgttcgagaacgacacggctcgacgagaatacttcactgaaaaactgcgggagaagctgcaagacgctgagtttcgcaagatcgaaggattcccggttggtgaggtcgatgacattctggcgatgtctgatccgccgtactacacggcatgtccaaatccatttctggacgacttcattgctcactgtgggacgacctacgattcctcgacggaatatcaccgtgagccgttcaccgcagatgtgagcgaaggcaagaccgacgctctatacacggcccatgcgtaccacacgaaggttccgcataaggcgatcatgcgctatctccttcactacacaatgcccggtgacatcgttttggacggcttctgcggaaccgggatgactggtgtggcagcccagatgtgcggtgataagcaagagattgagtcactcggatacagcgttagtgcgaatggtgaagtgtgcgacaactcagacagcgaagacgtggtgtctcgtctggggccaagacgtgccattctcggtgacctgtctcctgcggccactttcattgccgcaaaccttggcaggtgggtagatgccaaagcgtttcgagcggaagccgaccgaatcctaaacgagattgaggatgaacttggctggatgtacgagacgctccactcagacggtaagtcgaaaggacgtattgaatacactgtatggagcgatgtctttgcgtgcggcgagtgcggtgaagaaattgtctttgtcaaagaagcattggatcgggacaagggatcaatacgaaagacgtttccgtgtccgggatgcggggcggaatccaacaagaacgggctggagctaatctacgaatcgaaactcgataaggctctcggaacaccactgtcccaccccaaacgtgtgccggttttcatcgtttactcacacaaaggcactcgttacgagaaagagccagacgacgcagatcacaaagtgttgagaaagatcgatgaacttcccttcccatccggtcttccaactctggagcttcccgacatgcagatgcgtcgggtaggcagaatgcagccgtcgaagattactcacatccaccatttctttttgccacgttcggcaacgtggttagctgctgcgtggaacaaagcggaacacgttaccgatgcccgaatgcgagcgacattgctgttcttcgttgaacaggcaatctggactgcatctttgctgaatcgatttcgtccaacaggatattcccaagtcaaccagtatttgacaggcgtgttctatgcgccttctcagcacgccgagtgcagtccttggtatatcttgtctggtaaggcgaagcggctaacgaagctgtttgaggagtttcgtcctcagtcgaattcacgaatggtgacaactcaggacttggctcacattcgaattccagacaattccgttgactatgtttttactgatccaccgtttggtgagaacatctactactctgacctcaacattttgatcgaatcatggcatggagtgcagacggcaccagagcaagaagccatcgtggatcgagtcaaagagaagtcattacttgattaccagaggatgatgagcgactgcttcgtgaattactatcgaatgttgaagccgggccgttggatgacggtcgagttccacaattcccaaaatagggtttggaatgctattcaggaaggcttgcagcacgctggattcgttgttgctgatgttcgcacgttggacaaaaagcaggggtcgttccagcaggtcgtgagtggaaacacggtgaaacgtgacctcatcatttcagcatacaagccgaacggtggcttggaagaacgcttcgagggaactgctgggactgagcagggagtatgggacttcgtgtcgtcgcacttgcggcaactgcctgtgttcgtgatgaaaggcaaaaaggccgagccagtcgcagagcggcaaaaccatttactctttgatcgaatggtggcctttcatgttcagcggggtgtctcagtcccattgtcatctgccgaatttcatagtggtctgattcagcgctatcccgagcgtgatggaatgtgctttcttcctgaacaggtcgctgagtacgacaaacggaggatgcaggcagaggaagttgtgcagttggagttgtttgtgagcgacgaagcctcagcggtgaattgggtgcgccagcaactcggcagaaagcctcagagctttggggaactccaaccgcaattcatgcaagaggaggccggatgggagaagtacgaaaagcgattggaactctccgaacttctggagcagaactttctgtgctacgacggcaagggggaagttccaagccagattcacagctacttgtctacaaacttccacgacctacgtggtttagaaaaggacgccccgaaactgattagcaaagcgaaacatcgatggtacgttcccgaccatcgcaaggaagccgaccttgagaagattcgtcatcgtgccttgatgaaggaatttgaggagtaccaagacgcaaaaggaaagctgaaaatcgttcggacagaggcactgcgtgcgggtttcaagcaatgctggcaggatggtgactatcaaggcatcgtggacatggcaaagaaggtgaaggacgacatcatccaagaagacccagcactcctcatgtactacgacaacgcctcgatgcgaacgggagattag

SEQ ID NO: 3303 - DNA, 2640 bp, Syntrophothermus lipocalidus
atggcccaggaagagcagctttttatggacattccggaaggaaacgaagaaggacagcagaagcaaaagcgccggcgtttcgggctcaccaaagaacgcctggaccgggtcaggcagatcgaggggtttcccattgctaaagatgaggacatcatcaacctttccgacccgccctattacactgcctgcccgaacccgttcatcgaggatttcattaaagagcatggcaagccgtacgacccggataacgacgattaccgcaggcaaccgtttgcggcggatgtatcggagggtaagaacgatcccatttacaacgcccattcctatcacaccaaggtgccccacagggccatcatgcgctatatcctccactacaccgagccgggagacatcgtctttgacggtttctgcggcacgggcatgaccggcgtggcggcaagcttatgtggggaccgcaaggccgttgaatccctgggctaccgcgttctggatgacgggaccatcctggacgaaaaaggccggcccttttctaagcttggagcacgcaaggctatattaatcgacctttcgccggcagccactttcattgcctacaactacaacacgccggttgatgttcaggccttcgaacgcgaagcccggcggattctggaggaagtggaaagagaatgcggctggatgtacgaaacgcagcacgtggtgggcggaaaggtgcagaaaggcgccaagggcagccccatcatgggtaaaatcaactacaccgtctggtccgacgtgtttatctgcccccattgttcagcggagcttgtcttctgggaagtggcggtagacaaagaagaaggtaaagtcagggacgagtttccctgcccccactgcggggcggacctcaccaagcggaccctggagagggccacggaaagggtgtatgaccgggacatcgggcagaccgtcacccgtgcccgccaggtgccggtgctcattaactattcggtggggaataagaggtatgagaaaaagcccgacgagtacgacctggacctgatccggaagattgaggagagcgagataccgtactggtatcctaccgaccgcatgccggagggctacaataccgaacagcctaaagtgtcacatgggattactcatgttcaccatttttacacgaggcggaatttgtgggttttggcgctcgttttaaatatggccaaagccttgccgttaaaactactcctaatttggctaacttcttccctgataagaacgacaaaaatgtacaagtttaccctggaccggaaaatggggacagtaagtggtaccctttacattccttcattatggacggaaaatagcccgttgaagcttttgaaatataagctgttagacttttgcaaagttcgatacccagaaaaaggatatgttctggtggaaacaacttcggccaccaataccagtatccccaaaaattatatagactacattttcaccgaccctccctttggcggcaacctgatgtactctgagctcaatttcctctgggaagcctggctcagggtctttaccaacaataagcccgaagccgtagaaaacaaagcccagggcaaaggcccgcgggaataccaggagctcatggagaagtgctttgccgagtactaccgggtcttaaagcccggccggtggatgacggtggtgtttcacaactcgcagaaccggatctggaacgccatccaggaggccattatgcgggccgggttcgttattgccgacgtgcggaccctggacaaaaagcaggggaccttcaagcaggttacttcgaccaccgcggtgaagcaggacctggtcatctccgcctacaagcccaacggcggcctggaaaagcgatttcacctggaggctggaaccgaagaaggagtctgggattttgtccgcacccacctcaaacagctgccggtcttcgtggagaaaaacggcaaagcggaggtcattgccgagcggcagaatttccttctctacgaccggatggtggccttccacgtccagcggggagttgccgtgcctatgggagcggcggagttttacgccggcttgaagcagcgcttccccgagcgggacggaatgtattttctgccggaccaggtaaacgagtatgataaaaaacggctatcagttagggagtttgaacaactgtcgctgttcgtgattgatgaaaagtcggctatccagtggctgcgcagcgaactcgaaaagaagccgcagacataccaggaaatccaccccaaattcctgcgggaattgcacaaggcaaggcacgaaaagctgccggagctctccgaactgctggagcagaacttccttaaagacgattacggccgctggtacgtccccgaccccggcaggcagtccgacctggagaagatgcgcgagaaggccctcctcaaagagttcgaggagtacaaggaaggcaggggcaggctgaaagtattccgcaccgaagccttacgggccggattcaaggcctgctgggctgctaaagactacaagaccatcgtagaggtggccaggcgcataccggataccgtcctccaggaagataccactctcctgatgtactacgacaacgccctgatgcggctggatgaatga

SEQ ID NO: 3304 - DNA, 2550 bp, Tepidanaerobacter acetatoxydans
gtgaaactaacaaaagaaatacttgacaaagtaaggaatattgaaggctttccactaggaaaggatgaagatattatagcactttcggatccgccgtattacaccgcatgcccaaacccgttcataggtgaatttatagaaaaatacggaacttcttatgacgagtccacagatgaatacaatgtggagccatatactgctgatgtatccgaaggcaagaacgaccccatatacaacgcccattcctatcatactaaggtgccacataaagccatcatgcgatatattttacactacacaaaaccgggtgatatagtttttgacggcttttgcggtaccggcatgaccggagtagctgctgcaatgtgcgagaatcctgacgaggattttaaaataaaattagaacaagaagccagacaggacggcaaaaccatagaatggggagctagaagagcagttctatgcgacctatcgccggcggctacctttatagcatataattacaataccccagtggacgtggaggaatttgaaaaggaagctaaaaggatattacaagaagtggaagatgaatgcggttggatgtatgaaactaatcatactattaatggtacatcccaactaagcattgacggcaaacccataaagggacggataaactatacggtatggtccgatgtttttctatgtcctaattgtatggaagaaatgattttttggaatatagcggtaaacaaaaaaacgggcaaggtcatggataaattccactgtcctcactgcggattgctaactgacaagaggaatgttgagaaggcaaaaacaaccatatatgataaggcattaggcaagatgatagaacaggtaaaacaagtacctgtaatgataaactattcagttggccgcaaaagatttgaaaagactccagatgaggaggatttgaaattactccagaagattgaggagatggatatcccttattggtatcctacggaccgtatgccggagggagatgagtcacgaagaaatgacattgctgggataacacatatccatcacttttatactaaaaggaatttgtggatgttaagtgcgatatgcgataaggcaaaagaaaatcttcggtctttagttgcctttcaatctatatgtgcgactctttcttcaaagctttctagatataatttaggtaggcgaggtaatggacctatcagtggaaccctttatgtagcttcactacttgctgaagctaatattcttaatacctttgatggaaagatacgggacttttccaaagcattttcaattatttgtaaaaaacctttatctataattaattgttcatcttcgacagacctcaaaaatattcctagtaacagcatcgactacatcttcaccgatccgccatttggagcaaatctcatgtattcggagctcaactttctgtgggaggcatggctgaaagtttttacaaataacgaatcagaagccataataaacaaaacacagggaaagggtttagtggaataccaaagaattatggaaagatgttttaaagagatgcatcggatattaaaacccgggcgctggatgacggttgaatttcataattctaaaaacagtgtatggaatgccattcaagaagcaattatgagagcaggttttgttgtggcaaatgtccgcagtttaaataaacagcaagggagtttcaaacaggttacaactacaatggcggtaaagcaagaccttataatctctgcctataaacccaaagaccgttttgtgcaagattttgtgcggcaggcaggtactgaagaaggtgtatggaattttgtacgccaacacctggagcggctgccggtgacgttggaaagcggcggaagacttgatgttattccggagaggcaaaattatctgctttatgatagcatggtagcatatcatattcagcgtggggcgacagttccaatgggagcagcagatttttatcaagggctaaagcagcggtttccagaacgggacggtatgtactttttaccggatcaggttagtaagtatgagcaaaagcgaatggaattggagttaaatgaacagttatcttttctgattcttgatgagaagactgcaattcagtggctaagacaagaactttcaaaggggcctaagacctatcaggatatacagcctaaatttttacaagagctcaagcaattgcgtcatgagaatatgccggaacttggcgatttactacaggaaagctttctgcaggatgaaaagggtcgctggtacgtgccggatacaagcaaacagtcagacttggaaaaactccgggaacggcggcttttaaaagattttgaggaatataagactggccgcggcaagctgcgctacttcaggactgaagccgttcgggcagggtttaaggactgttggagcaaaaaggattataataccattgttaaaataggcgagcgcctgccggaatctgtgttgcaagaagacactaccctcttgatgtactacgataacgcattgactagactgggggattag

SEQ ID NO: 3305 - DNA, 2550 bp, Tepidanaerobacter sp.; identical to SEQ ID NO: 3304

SEQ ID NO: 3306 - DNA, 3207 bp, Thermanaerovibrio acidaminovorans
atgttcgattcagaaagacccgtgacccgcgactcgggacccgtgacctgttttgggatgacctttgaaaacgacgaggcgcggcgggagcacttcctccgcctcttgcgcgcgggtttgcaggaattgcgggagaaacttggtgtcccgtttgtgagttttgaggatacctatgcccggttgaaatcgctgcaatattggcccatcggcacggaggaacagatacgcgatctcgcccgacgcatcgcccgtgccgcatcctcgacccgtgactcgcgacccgcgacccgcgacatcctcggcctatacaaggacgaggtcggcttcccgcatgggtcgatcgaggacatcctgagcctgtccgatccaccctattacacggcatgcccgaaccccttcatcgcggacttcctcaagcactacggcaagccctacgacccgaacgtgccttacagcaaggaaccgttcgcggcggacgtgagcgaggggaagaacgatcccatctacaacgcgcactcctaccacaccaaggtgccgcacaaggcgatcatgcgctacatcctgcactacaccgagccgggcgatgtggtctttgacggcttctgcggaacggggatgaccggcgttgccgcccagctctgcggcgaccgcaagacagtggagtctttgggctataaggtggatgagcaaggcttcatctaccagcaggaaacagacgagaacggcaagacggtctggaagccgttttccaaactgggcgcccggcgagccatcctcaacgacctgtccccggccgccaccttcatcgcctataactacaacacaccggtggatgttaaggccttcgaacgcgaagcgaaacggatcctgaaggaggtggaggaagagtgtgcctggatgtacgccacgctctcgcgcggagttccaggttcagggttgtcggttcctagtgatgataggttcgtggaactagccaaccggattcgcaaggcaaaaacaattgatgaaatcaggcagatttttgctgaactaggaaccaggaaccagaaactaggaaccgttgattttgccctcggcaaaatcaactacgccgtctggtccgatgtcttcgtctgcccggagtgcacgcaggaggtgatattctgggaagtggcggtggataaagaagcaggcaaggtgcacgaccagtttccctgcccgcactgcggggcgcagcttaccaagcgcaccatggaccgcacctgggtgaccaaatacgacaaggccatcggccagaccatccgccaggcgaagcaggtgcccgtgctcattaactacagcgtgggcaacaggcgctacgagaaggcgcccgatgcctttgacctcgcgcttatcgagaagatcgagcagctggagattccctactggttcccgacggataggatgccggagggctacaatacggagcagccgaaagtctcgcacggcctcacccacgtgcaccacttttataccaagcggaatttgtgggcgctgggcgcgctatacgagactgctggtcgatcgccgatagaacttcgagatattgccaagttttttgttcagtatgcctgtcttggcttctcaaagatatctcggtacgtaccaactcattattcccaggtaaaccgatatctcagcggaacgttgtatgttggctcgcaacaggtcgaggtgtcgccagtttacattctaaaagccaaagcggacagaatggcaaagcgcgagcttaaacggccttacgcaggagctttcgtgctatcaacatcagatgctacttcaagtatcgaacacagagagtcggtcgactacatcttcaccgacccgcccttcggcggcaacctgatgtattcagagctcaacttcctctgggaagcctggctcaaggtgttcaccaacaacaagcccgaggccattaccaatgaaacccagggcaaaggcctgcccgaataccagcgcctgatgaccgagtgcttcaaggaatactaccgcgtgctcaagccaggccgttggatgacggtggagtttcacaactccaagaacagcgtttggaacgcgattcaggaggccctgcagacggcaggctttgtcgttgccgatgtgcgcaccctggacaagaagcaaggatccttcaaacaggtcacctctgcatctgctgtcaaacaggacctcatcatttcatgctacaagccaaacggcggtcttgaggaacgcttcaagctggaagccggcaccgaggaaggcgtctgggacttcgtccgcacgcacttacggcaactgccagtggccgtggtcacgggtcgcgggtcgaaggtcgcgggtcaagacgactcgggactcgggactcaggactcgcgactggagatagttgccgaaaggcaaaactatctcctttttgaccgcatggtggccttccacgttcagcgtggcgtgacggtgccgctctccgcggcggagttctacgccggtctcgcccagcgcttcccggagcgcgacggcatgtacttcctgcccgagcaggtggcggagtacgacaagaagcgcatgaaggtgaaggaggtcctgcagcttcagctcttcgtcaccgacgaggcctccgccatccaatggcttaaagcaagtctcaccaagaagccacagaccttccaagagctccatccgcagttcctcaaggaaatcggcggctggcagaagcacgaaaagcccttggagctctccgagctcttggaacagaacttcctccgctacgacggcaaaggccccatcccggcgcagatcgtcgcgtggatgaagcaaagcgaaaacctccgcaagatcatccaagaagaactcgcagctggcggcgcgacggaagagaacggccaactagaaaccaggaaccaggaactcataacccgcgcgaaagcgcgctggtacgtcccggacccgaacaaggccggcgacctggagaagctccgcgagcgggccctgctgcgcgagttcgaggagtaccgcgaatccaagcagaagcgcctgaaggtcttccgcctcgaggccgtccgcgccggcttcaagaaggcatgggccgagcgggactacgccaccatcatcgccgtggcgcgcaagatccccgagaacgtcctccaggaggaccccaagctcctcatgtggtacgaccaggcgcttacccgatctggggaggatcgataa

SEQ ID NO: 3307 - DNA, 2538 bp, Thermoanaerobacter brockii
gtgaaattaacaaaagaaatgcttgataaagtaagagatatagagggatttcctattgggaaagatgaagatataatagaactttctgatccgccttattatactgcatgcccaaatccttttataagtgaattcattgaaaaatacgggaaaccttatgttgaagaaaaggatgattacaattgtgaaccctatacggcagatgtatctgaagggaaaaatgatcctatatacaatgcccattcgtatcacacaaaggtgcctcacaaagcgatcatgagatatatacttcattatacaaaaccgggagatatcgtgtttgatgggttttgtggaactggtatgacaggggttgctgcacagatgtgtggcaaccctgaccctgagtttaaggctaaagtggaaaatgagtttaaaaaagagggtaaaaaggtagaatggggagcaagaagagccattcttggggatttatctcctgctgctacttttatagcttacaattacaatactcctgttgatgtagaagaatttaaaaaagaggcagagagaatactgaaggaagtagaaaaagaatgtgggtggatgtataaaaccatacatactgtagaaggtgtaccacaacgggatgtggaaggtaatgttataaaaggaaaaataaattatactgtgtggtcagatgtgtttatatgtcctaactgcagcaatgaaatagttttttgggatgctgcggtagacaaagaggatggaaaagttctggatgaatttaaatgtcctcactgtggtgcaaaattaaccaaaacaagtcttgagagggcgtggaggactgtttatgataaggctattggtgaaacaataaaacaggcaaaacaagtacctgttcttattaattatacagtaggtaagcagaggtatgaaaaagagcctgacaaatttgatttggaacttatacagaaaattgaagagatggatataccctattggtatccaacagatagaatgcctgaaggggaggaatcgagaaggaacgataaaattggcataacacatgtacatcatttttatactaagaggaatttatgggttttgagtgcgttatataattacaaaattatgcctaaattttattggattataaatagtgtacaaaattatattaacaaaaagcaatcttttaaaggaggtggcggtggtgtaactggtactctatacataccatctttagtagaagaaaaaaatgtattaaatgttttgaagagaaaattagataaaattggcttaatacgtggtatacttgctaattttaaaaatgtaaattatattacaacacaatcaacagtttcattaaaacagtttagtgataattcgattgactacattttcacagacccgccttttggtgataatctcatgtacagtgaacttaattttttatgggaggcatggcttaaagtatttacaaacaataaaacagaagctattataaataaagttcagagaaaagggcttcatgaatatcaagagcttatggagaaagctttttcagagatgtacaggatattaaagccgggaagatggatgactgtggaatttcacaattccaaaaatgctgtatggaatgcaatacaggaggcaattttaaaagctggatttgtcatagcaaatgttagaactttagataaaaagcaaggaagttttaagcaagttactacgacaactgctgtaaaacaagaccttataatatcagcttacaagcctaaagaagggtttataaaaaggtttttgaaagaagctggaacggaagagggagtatgggattttataagacagcatttagaaaaactgcctgttgttatagagacaaatggaaaacttgatataataccagaaagacaggaatatttactttatgatagtatgattgcatttcatatacaaaaaggagcttctattccaatgagcgctgctgagttttatgaggggttgaaaaagaggtttatagagagggatggaatgtactttttaccggatcaggcggctatttatgatacgaaaaggctcaaattagaacttaatgagcagcttgcctttataatacaggatgaaaaaacagcaatacagtggttgaaatataagcttttaaataaacctatgacatatcaggaaatacagcctatgtttttagaggagttaaagcagctaagatatgaaaaattgccagagcttttggatttactacaggaaaactttttgcaagatgaggcaggcagatggtatgtgccagatgcaaataagcaggcagaccttgaaaaactgagggaaaaaagattacttaaagaatttgaggaatataaaaatgttacggggcgtcttaaagtttttaggacagaagctataagagctggtttcaaaaattgctggaaaaacaaagattatgaaacgattgtaaaaataggcgaaaagctacctgaaaatgtgctgcaagaggaccaaactttactcatgtattatgataatgcagtgacaaggttaggtggttga

SEQ ID NO: 3308 - DNA, 2562 bp, Thermoanaerobacter italicus
gtgaaattaacaaaagaaatgcttgataaagtaagaaatatagagggatttcctattgggaaagatgaagatataatagaactttctgatccgcctcattatactgcatgcccaaatccttttataagtgaattcattgaaaaatacgggaaaccttatgaagaagaaaaggatgattacaattgtgaaccctatacggcagatgtatctgaagggaaaaatgatcctatatacaatgcccattcttatcatacaaaagtgcctcacaaagcgattatgagatatatacttcattatacaaaaccgggagatattgtgtttgatgggttttgtggaactggtatgacaggggttgcggcacagatgtgtggcaaccctgaccctgagtttaaacttaaagtagaaaaggagtttggaaaagaaggtaaaaaagtagattggggagcaagaagagccattcttggggatttatctcctgctgctacttttatagcttacaattacaatactcctgttgatgtagaagaatttaaaaaagaggcagagagaatactgaaggaagtagaaaaagaatgtgagtggatgtataaaaccatacatactgtagaaggtgtaccacaacgggatgtggaaggtaatgttataaaaggaaaaataaattatactgtgtggtcagatgtgtttatatgtcctaactgcagcaatgaaatagttttttgggatgctgcggtagacaaagaggatggaaaagttctggatgaatttaaatgtcctcactgtggtgcaaaattaaccaaaacaagtcttgagagggcgtggaggactgtttatgataaggctattggtgaaacaataaaacaggcaaaacaagtacctgttcttattaattatacagtaggtaagcagaggtatgaaaaagagcctgacaaatttgatttggaacttatacagaaaattgaagagatggatataccctattggtatccaacagatagaatgcctgaaggggaggaatcgagaaggaacgataaaattggcataacacatgtacatcatttttatactaagagaaatttgtatgtattgagtgcgttatatgggaggataaagcatgaaaatttattttattatatttttaaatttatgtttacagcgatcgtacccatgtcaacaaaaatgtcaagatatggtaaaagaacaggaaatgtatctggaacactatatataccctctttaattaaagaacttaatatattagaatatttaaaaagaaaattatggggagccaaaggacttttaaaaccattgcagaagtttagaaattatagtagaaataattgttatatttatacaaattcaacgactttagtattaatcaagtcgaattccatagattacattttcaccgatcctccatttggagataatttgatgtacagtgaacttaattttttatgggaggcatggcttaaagtatttacaaacaataaaacagaagctattataaataaagttcagagaaaagggcttcatgaatatcaagagcttatggagaaagctttttcagagatgtacaggatattaaagccgggaagatggatgactgtggaatttcacaattccaaaaatgctgtatggaatgcaatacaggaggcaattttaaaagctggatttgtcatagcaaatgttagaactttagataaaaagcaaggaagttttaagcaagttactacgacaactgctgtaaaacaagaccttataatatcagcttacaagcctaaagaagggtttataaaaaggtttttgaaagaagctggaacggaagagggagtatgggattttataagacagcatttagaaaaactgcctgttgttatagagacaaatggaaaacttgatataataccagaaagacaggaatatttgctttatgatagtatgattgcatttcacatacaaaagggtgctactattccaatgagtgctgctgagttttatgaggggttgaagaagaggtttatagagagggatggaatgtactttttaccagaccaggcggctatttatgatacaaaaagactcaaattagaacttaatgagcaacttgcctttataatacaggatgaaaagacagcaatacagtggttgaaatataagcttttaaataaacctatgacatatcaggaaatacagcctatgtttttagaggagttaaagcagctaagatatgaaaaattgccagagcttttggatttactacaggaaaactttttgcaagatgaggcaggcagatggtatgtgccagatgcaaataagcaggcagaccttgaaaaactgagggaaaaaagattacttaaagaatttgaggaatataaaaatgttccaggacgacttaaagtttttaggacagaagctataagagctggtttcaaaaattgctggaaaaacaaagattatgaaacgattgtaaaaataggcgaaaagctacctgaaaatgtgctgcaagaagaccaaactttgctcatgtattatgataatgcagtgacaaggttaggtggttga

SEQ ID NO: 3309 - DNA, 2538 bp, Thermoanaerobacter pseudethanolicus; identical to SEQ ID NO: 3307

SEQ ID NO: 3310 - DNA, 2547 bp, Thermoanaerobacterium saccharolyticum
gtgaagctaacaaaagaaatgctggacagtgtacgaaatatagatggatttccgataggaagtgatgaggacataattgagctttccgatccgccacactatacggcatgtcctaatccattcataaatgattttatagagaagtacggtaagccgtatgatgaggaaactgatgattacaaatgcgagccatatgctgctgacgtatcagaagggaaaaacgaccctatatacaatgctcattcgtatcacacgaaagtacctcacaaagctataatgaggtatatacttcattatacaaagccaggcgatatcgtctttgatggattttgcggaaccggcatgacaggtgttgctgcacaaatgtgcggcaatccagatccagaatttaagtttaaagtggaaaaagagtctgaaaaagaaggcaagaaagtagaatggggagcgagaagggcgatacttggcgatctatcgcctgctgcaacatttatcgcatacaattacaatacgccggttgatactgcagaattcgagaaggaagctaaaagaatcctcgatgaagtagagaatgagtgcggctggatgtatgagacgattcacacgattgatggagtacctcagaagtacatagatggaagtgtcataaaaggaaggataaactacacagtgtggtcggatgtttttgtctgtccaaactgcagcaatgagatagttttttgggatgcagcagttaataaagaagatggcaaggtgatggatgagtttaagtgtccacactgcggtgctgccgtaaacaagaaagatctcgatagagcatggaaaactgtatacgataaggcgctggataaagtgataaatcaagtaaaacaagttcctgtcttaataaattacacagtagacaataagaggtatgaaaagaaaccagatgaatttgatatggagcttatagaaaagatcgaagagatggatataccatactggtatccgacagatgaattgccgaatggttataatacagaacaaccgaaaaaatcccatggaataacacatgtgcaccatttttatacaaagagaaatctgtgggttttaagtgcaatatatgataggattaaaatgaaaaaaaatatcttttattggcttttaacttcggtttctgaaggttcttcaaaattaaatagagagagacctaatggtttgccaagtaaattatctggtacattatatgtaagctcaatgatacatgaaattaacaatattgattttatttatagaaaaattatgaaaagaatacttaacaaagagttatctagcccttacaataaatgtatttcaacgcaatcattagatgatataaaaaatattaaatctaactctgttgactatatttttacggaccctccatttggagataatcttatgtacagcgagctgaattttttgtgggaatcatggcttaaaatttttacaaacaataagacagaggctataattaataaaacgcagaagaaagggcttcatgagtatcaagagttgatggagaagtgcttttcagagatgtacaggatattaaagccaggcaggtggatgactgtagagtttcacaactcaaaaaacgctgtgtggaatgccatacaggaagctatattgagagcaggctttgtcatagccaatgttaggacgcttgacaaaaaacaaggatcatttaagcaagttacgacaacgactgctgtaaagcaggatcttgttatatcggcatataagccaaaggaaggctttgtcaagaggtttttaaaagaggctggcacagaagaaggcgtgtgggattttgtgagccagcaccttgagaagcttcctatcgtcgtagaggttggtgacaggcttgatatcgtagatgagaggcgtgattatctgctttacgacagcatgattgcttttcatatacagaatggcgcatctataccgatgggatcttctgacttctatgctggactaaagaaaaggtacatagaaagagatggaatgtactttctaccggaccaagcagcggtttatgactcaaagcgagcaaagcttgagcttaatgatcagctttcattcatcataaaagatgaaaagatggcgatacagtggctaaaatataagcttttaaataagcctatgacatatcaagaactacagccattgtttttagaagagcttcatcagggaaagcatgaaagcataccagagcttatagatatacttcaagaaaatttcttgaaagatgatgatggcagatggtatgtgccagatgtcaatagacagtcagacatggagaaattaagagagaaaaaactcttaaaggattttgaagagtataaaaattctaagggaaagcttaagatatttagatcagaagctataagagtaggctttaaggaatgctggaaaaataaagattatgagactattgtaagtgttagcgaaaggctgcctgaatcatttttgcaggaagaccaaacattgctgatgtactatgataatgcacaaacaaggttaggtgtttaa

SEQ ID NO: 3311 - DNA, 2571 bp, Thermoanaerobacterium thermosaccharolyticum
gtgaagctaacaaaagaaatgctggacagtgtacgaaatatagatggatttccgataggaagtgatgaggacataattgagctttccgatccgccgcactatacggcatgtcctaatcctttcataaatgattttatagagaagtacggcaagccatatgatgaggaaactgatgattacaaatgcgagccatatgccgcagacgtatcagaagggaaaaacgatcctatatacaatgctcattcgtaccacacgaaagtaccttacaaagctataatgaggtatatacttcattatacaaagccaggagacattgtctttgatggattttgcggaaccggtatgacaggcgttgctgcacagatgtgcggcaatccagatcatgaatttaagtttaaagtggaaaaagagtttgaaaaagaaggcaagaaagtagagtggggtgcgagaagggcgatacttggtgatctatcgcctgctgcaacatttatcgcatacaattacaatacgcctgttgatactgcagaattcgagaaagaagctaaaagaatccttaatgaagtagagaatgagtgcggctggatgtatgagacaattcacacgattgatggagtacctcagaagtacatggatggaagtgtcataaaaggaaagataaactacacagtgtggtcggatgtttttgtctgtccaaactgcagtgatgagatagttttttgggatgcagcagttaataaagaagatggcaaggtgatggatgaattcaaatgtccacactgcggtgctgctgtaagcaagaaagatctcgatagagcatggaaaactgtatacgataaggcgctggataaagtgataaatcaagtaaaacaagttcctgtcttaataaattatacagtagacaataagaggtatgaaaaaaagcctgatgaatttgatatggagcttatagaaaagatcaatgagatggatataccatactggtatccgacagataggatgccggatggttataatacagaacaaccgaaaaaatctcatggtataacacatgtgcaccatttttatacaaagaggaatttgtgggttttgagtgcgatatatgataaagtagtcgattgcaaatttaataaattatttttttcattaatattatcaagtttagctagagcttctaaaagaaatagatatatgcctcaatatggtaatagacatgttggtattttgtcggggacattatatattccttctttaacagaagaaaataatattacaatgctaataaatactcgaatatcgaatgctattagggcttatagttcatttatttcagataattattttgattatttaattagcactaattcattacttaattacaagaacttagaaaataattctgttgattatatttttacagatcctccatttggagataatcttatgtacagcgagctgaattttttatgggagtcgtggcttaaagtttttacaaacaataggacagaggctataattaataaaacgcagaagaaagggcttcatgagtatcaagagttggtggaaaagtgcttttcagagatgtacaggatattaaagccaggccggtggatgactgtagagtttcacaactcaaaaaatgctgtttggaatgccatacaggaagctatattgaaagcaggctttgtcatagctaatgttaagaaactagataaacaaaaaggaactacaaaacaattaacatatagtatgactgtaaagaaggatcttgttatatctgcatataagccaaaggaaggttttgtaaaaaggtttttaaaagaggctggcacagaagaaggtgtgtgggattttgtgagccagcaccttgagaagcttcctatcgtcgtagaggttggtgacaggcttgatatcgtagatgagaggcgtgattatctgctttatgacagcatgattgcttttcatatacagaatggcgcatctataccgatgggatcatctgacttctatgctggactaaagaaaaggtacatagaaagagatggaatgtactttctaccggaccaagcagcaatgtatgactcaaagcgagcaaagcttgagcttaatgatcagctttctttcatcataacagatgaaaagatggcaatacagtggcttaagtataaacttttaaataagcctatgacatatcaggaactacagccattgtttttagaagagcttcatcagggaaagcatgaaagcataccagagcttatagacatacttcaagaaaatttcttgaaagatgatgatggcagatggtatgtgccagatgtcaatagacagtcagacatggagaaattaagggagaaaaaactcttaaaggattttgaagagtataaaaattctaaaggaaagcttaagatattaagatcagaagctataagagtaggctttaaggaatgttggagaaataaggattatgagactattgtaagtgttggcgaaaggctgcctgaatcatttttgcaggaagaccagacattgctgatgtactatgataatgcacaaacaaggttaggtgtttaa

SEQ ID NO: 3312 - DNA, 2565 bp, Thermoanaerobacterium xylanolyticum
gtgaagctaacaaaggaaatgctggacagtgtacgaaatatagatggatttccgataggaagtgatgaggatataattgagctttccgatccgccgcactatacggcatgtcccaatcttttcataaatgattttatagagaagtatggtaagccgtatgatgaggaaactgatgattacaaatgcgaaccatatgctgcagacgtatcagaagggaaaaacgaccctatatacaatgctcattcgtatcacacaaaagtacctcacaaagccataatgaggtatatacttcattatacaaagccaggcgatatcgtctttgatggattttgcggaaccggcatgacaggtgttgctgcacaaatgtgcggcaatccagatccagaatttaagtttaaagtggaaaaagagtttgaaaaagaaggcaaaaaagtagagtggggtgcgagaagggcgatacttggcgatctatcgcctgctgcaacatttatcgcatacaattacaatacgcctgttgatactgaagaattcgaaaaagaagcaaaaagaatccttgatgaagtggaaaaagagtgcagctggatgtatgagacgattcacactattgatggcgtacctcagaagtacatagatggaagtgtcataaaaggaaggataaactacacagtgtggtcggatgtttttgtctgtccgaactgcagtgatgagatagttttttgggatattgcagttaataaagaagatggcaaagtgatggatgagtttaagtgtccacactgcggtgctgctgtaaacaagaaaaatctcgataaagcatggaaaactgtatacgataaggcgttggataaagtgataaatcaagtaaaacaagttcctgtcttgataaattatacagtagacaataagagatatgaaaagaaacctgatgaatttgatatggagcttatagaaaagatcgaagagatggatatatcatactggtatccgacagataggatgctggatggagaagaatcaaggagaaatgatagaattggtataacacatgtgcatcatttttacacaaagagaaatctatgtgttttaagtgcaatatatgataggattaaaagttcaagaagtttgtttttacatatatctaaattcatctttactgcaatagttattatggcaactaaaatgtctagatatggtgaaagaacgggaaatgtatcaggaacattatatgtaccatcattaataaaagagctaaatttaattgagtatctaaaaagaaaattatggggcgctaaggggatattaaaaccattagataatataaaaaaatttaatccaaataatatttgcttgtatttaggttctacaataaatacattaattaaacctaactctgttgactatatatttacagatcctccatttggagataatcttatgtacagcgagctgaattttttatgggaatcatggcttaaagtttttacaaacaataagacagaggctataattaataaaacgcagaagaaggggcttcatgagtatcaagagttgatggagaagtgcttttcagagatgtacaggatattaaagccaggcagatggatgactgtagagtttcataactcaaaaaatgctgtttggaatgccatacaggaagccatattgaaagcaggctttgtcatagctaatgttaggacgcttgacaaaaaacaaggctctttcaagcaagttacgacaacgactgctgtaaagcaggatcttgttatatcggcatataagccaaaagaaggctttgtaaagaggtttttaaaagaggctggcacagaagaaggtgtgtgggattttgtaagccagcaccttgagaagcttcctattacaatagaagttggtgacaggcttgatatcgtagatgagaggcgtgattatctgctttatgacagcatgattgcttttcacatacagaatggcgcatctataccgatgggatcatctgacttttatgctggactgaagaaaaggtacatagaaagagacggaatgtactttctaccggaccaagcagcggtttatgactcaaagcgagcaaagcttgagctaaatgatcagctttcattcatcataaaagatgaaaagatggcaatacagtggctaaaatataagcttttaaataagcctatgacatatcaagaactacagccattgtttttagaagagcttcatcagggaaagcatgaaaacataccagagcttatagacatacttcaagaaaattttttgaaagatgatgatggcagatggtatgtgccagatgtcaatagacagtcagacatggagaaattaagggagaaaaaactcttgaaggattttgaagagtataaaaattctaaaggaaagcttaagacatttaggtccgaagctataagagtaggctttaaggaatgctggagaaataaggattatgatactattgtaaatgttggcgaaaggctgcctgaatcatttttgcaggaagaccagacattgctgatgtactatgataatgcacaaacaaggttaggtgtttaa

SEQ ID NO: 3313 - DNA, 2787 bp, Planctomycete KSU-1
atggaaaagctacttattgacgataaaaccaccaaacaaacaggcccggtagaatgccttggcctaaccttcccaaacgatgaggaacggagaaagtattttacggaaaaacttcgtgagcatttgcaaaaccccgagttcagaaaaatcgaaggtttccccataggcactgatgaagatatcctaaagctctctgatccaccatattatactgcctgcccaaatcctttcataaatgactttatcaggcattacggcaagccttacaaccctaaaactgataattatcgccgggaaccgtttgccgcagacgttagcgaaggaaagaatgatcctatttacaacgcccactcttaccatacaaaagtgccacacaaagccattatgcggtatatcctgcattatacagagccaggtgatattgtttttgatggtttttgtggtacggggatgacaggggttgcagcacaactatgcggggataagagggtcgttgaatctttaggatataaagtgttggatgatggtactatccttgatgaagaaggcaaaccactctctaaacttggctcaagacgtgcagtgctgaatgacctttcaccagccgccacatttattgcttacaattataatacacctgttgatgctcaggagtttgagcgggaggcaaagcaggttttaaaaaaaatggaacaagattgtgggtggatgtacgaaaccatgcatacagatggtaaaaccaaaggcaaaatcaattatgttgtttggagtgagctgcttcgatgccatcaatgtaacgaagaaaatacttattgggaattagctgtagatcctgtaacaagatataagaaaaatattaccgaaaacatattgtgcaagcgatgtggttcgttagattcctatacaaagtgggagagagtttttgaaacatatatggatattctacttggccattctttgaagcgaagtaaacttgtgcctgtattaataaattattcgtttggcggtaaaaaacttgagaaaataccagatgctttcgattttcttcttttggagaagattaatcaatttccaatgccacctaatatgccaattttaccccttcccgaaggacaaaataccaagcaaccactggtttcaagtggcgtttcacatgtccatcatttttacattcaacgttctttgtttgcttattcacttgcggaaagatgcattgcagaaggtcatgtatctttacaaaacactctcaaatattggcttcagtctgtaggggtaggatttacaaagcttaaccgatatctggcagcttcattttcacaagtaaatagatatcttaagggaacactttatattgcaccttttattgctgaggtaagtccagtttactcattgactggaaaaataaaaaggttaaaaaatgttttctttttaccttcagtcaaacctagctttattatagagactaaatcctccacgggtaacggcgttcatgaatcctctattgattatatttttactgatccacctttcggtgggaatttaatgtactctgaacttaactttatttgggaagcttggctcaaagtatttacaaataacaaacatgaggcaattgagagcaaactacaaaagaagaggttacaagaatatcaagaattaatgactcgatgctttaatgaatattatcgtatcttgaaggcgggtagatggatgacagttgaatttcacaataagaaaaatagtgtatggaatgctattcaagaggcgttacaacaggctggttttgtagtagctgatgtccgaacgcttgacaagaaacagatgacgatgaagcagatgactacagcttctgctgtaaagcaggatcttattatttcagcttacaaaccgaatggaggtcttgaagaacgatttaaattaaaggctggtaccgaggatggcgtctgggattttgtaaggacgcatctcaggcaacttcctatctttgtcaaaccaaaggatggaatggcagaaataatagccgaacgcctaaactacctgctctttgatcgcatggttgccttccatgtccagcgagggattatcgtacctatctctgctgcggagttttacgctgggctagaacagcgattcccatcccgtgatgatatgtacttcctgtctgaacagatatcggagtatgataaaaagcgtatgaccgtaaaagaaatgctccagcttcagttattcgttactgatgaggcctctgctatccaatggctcaagcaactactcactaaaaaaccacagaccttccaggagattcatccacaattccttaaagaaattggtggctggcagaaatatgaaaaaccgttagaacttatggaattgctggaacagaattttatctgctatgatggcaagggtgacgtaccgagccagatacacagctatttatccacaaattataaggagttgcggaatcttcccaaggatggtccatcattgcgtgataaggcaaatgatcgatggtatgtccccgatccaaacaaggcacaagacctcgaaaaactacgcgaaaaagccttgttgaaagaatttgaggaatataaaacctttacaggccgaaagtttaaaagttttcgtcttgaagccgttagggcaggatttaaaagggcatggcaagagcgcgattatcaaaccatcatttctgtatcaaaaaaaatcccggaaaatgtacttcaggaagaccagaaattgctcatgtggtatgaccaggcggtaacaaggatgggagtagattga

SEQ ID NO: 3314 - DNA, 2796 bp, Bacillus cereus
ttgggaaatgatgaaaaacaactatcattattaggtgaacatatgcaagcagacaacggaccagttgtctgcttaggtatgaaatttgaaaatgatgaggcacgtcgagaatattttcgaaatgaattgagaaaaatacttccagaacttaaggaaatagaaggattccctctcggagaagatgaggatattattactttgtctgatccaccatattatacagcttgtccgaatccatggataaataaatgtattgaagaatgggagcaagataaagttaaaaattataatagaaatagcaatgaagaataccatcgtgaaccttttgcctctgatgttagtgaagggaaaaatgatgcagtatataatgcgcatagttatcatacaaaagttccatataaagctataatgcactatttattacactatactaatccaggggatataattttagatggtttttctggaactggaatgacgggggttgcatcaaggagatgtggaaatccggatatcattaaaagtttagggtatacagttcagaatgggaaaatagttaaaggttcaggtgagtacgtaggagaattgggtgagcgtttaacaattctaaatgatctttctccatcagcaactttgattacatataactataattcaattcctaacattgaagaatttcttaaagaagctaaacaagttttagaacaagtaaaagaagaatgtaattggatgtaccatacatctcatgaaaataatggatcacaacaaggggaagcgaatattaattatgttgtatggagtgatgtatttcaatgtcctaactgtacaaaagaagtggtatattgggatgctgctgtagatgtagatgaaaagaagattatcagtgattttaattgtgaatattgtggtgtggaactacaaaaaagtaaattgcaaagagcttgggatacgtattatgatcaatacttacaggaagcaattactgtcgcaaaacaaattccagtacatgtgaattactctgtagggaaaaaaaggtttgaaaaaaaaattgatgaaactgatattgaattgatagagaaaattaaaaacactaagagtttatattcatttccaattgagcggatgccggcaggggatgagtcgagaagaaatgatagaataggcttaacgcatgcacaccattattatacaaataggaatctgtataccctagcaagttttgtcggtcacgctaaaaaatctaagtattttaatcgattggtatttttcttccaggcttcaattaatcgagctacaaaaactaatcgattccgatttggaggaactgggggattaagcggtactttatatattccttctttaatctttgaaagaaatgttattgcgttattggagaaaaagttgaaagactatgaaaaaatgctttttgaagagaagcaacctggttatacggcgatgatttctactcaatctacatctaatgttacaaatattaatgagaattctgttgattatatttttactgacccaccgtttggaaaaaatttaatgtactcggaattaaattttctatgggaatgttggctgcagcttattaccgataataaaggcgaagcgataataaataatacccaattaaaagggttgggtgagtatcaaagattgatggaagaaagttttgagaattattttaaagtgttgaagccaggtagatggatgactgttgaatttagtaattcacaagccagtgtgtggaattctattcaggaagcaattcaaaaagcgggctttgtgatagcgaatgttgcagccttagataaaaaacaaggaagtttcaaagcagttacaacaacaacggcagtaaaacaagaccttgttatttcagcgtataaacctaagcaagaaaatatagataaaataaatagagagaaaaacactgaagaatcagcttgggtttttattaaccaacatttggaacaattacctgtttttatcggagtgaaaggtgaagcgcagattatttctgaaaggacaccacgtattttatttgatcgtatggtagcatatcatgttcaaaatggattgccagtaccaatttcatctgctgattttcaaggtagtgtggcacaacgttttccaatgcgtgatggcatggcatttttagaaaaacaagtagcagaatatgataagaaacgtacgctagttaaagaatttgcacaaatgagcttatttgtatctgatgaaaacagtgcaattgaatggattcgtcaacagttattaaagaagccacaaactcgacaagatttacatccaaattatatgaaggaaattcaacatattgctaaacatgaattacttccagaattagataatttattgcaacaaaacttcttatcctatgaaggcgagggagaaataccagatcaggttgcttcttacttgagacgaaattataaagatttccgtggtttagatacaaatgattctgcacttattgaaaaagcaatgaatcgttggtatgttccagatccaaataagcaagcagatttagaaaagcttcgagaaaaggcgttgcttcgagagtttaatggttacttagaggaattggagagtagtaagaaaaaattaaaacaattccgtacggaagccattcgtgctggatttaagaaagcatatagcgagaaggaatttgagcagattgtgaaagttggagatcgccttcctgaaaaaataattcaagaagatgataagctgttaatgtactatgacaatgcttgcattcgtttaggactatag

SEQ ID NO: 3315 - DNA, 2556 bp, Clostridium thermocellum
atgaagaaattaacaaaagaagatattgacaaagtacgtcatatagagggttttcctatagccaatgacgaagacattatagctttgtccaatccaccatattatacagcatgccctaatccttttattgaggattttataaaagagcatggcaaaccttatgatgaagcgactgatgattatcatagagagccttttgctgccgacgtgagcgaaggaaagaatgacccgatttataatgcccatagttatcatacaaaagtgcctcataaagctattatgagatatattcttcattataccgagccgggggatattgtatttgacggcttttgtggtacggggatgacaggagttgcagcacaaatgtgcggaaatcctgatccggaattaaaggcaagaattgaagctgaaatgccttatgtcaagtggggggcacgtaaagctattctaaatgacctttctcctgctgcgacttttattgcttataactataatacacctgttgatgttgcagaatttgaaaaagaagcaaaacgtattcttgaggaatgtgagaaagaatacggctggatgtatgaaacgcagcatacgattaacggtgaaatacagtatggaatagacggaaagccgataatggggcgtatcaattacacagtttggtctgatgtttttatatgtcctacctgttccaatgaaatagtgttttgggacgcagctgttgacaaggagaaaggcaaagtcaatgatactttttattgtcctcactgtaacagtcaattgactaaacgtagttgtgaaagagctcaggaaacacatttcgatgcacggttgaatgaatttgttaccatggccaaacaggtgccggttttaattaattattccgttggaaaaaaacggtttgaaaaaacgccagacgaatatgatttggcgttgattgaaaaaatcgacaatatggatataccatactggtatccgacggataggatgtgtgaaggcagcgaaagtcgtcgaaacgatcgatatggtataactcatgtgcatcagttttatacgaaaaggaacttgtatttaaatgcatggttaagaaacaaaataataaaggtgaaggacaaatgcattagtgatattttattgtttggttttaacaatgttcagcaaaggcattgtaaactgaatgcaatgagatttaatgtatcttttccttcaaatatcactagtggcactttgtatttgccatcaatgatacgggaaaacaatattatagaccaattgagcaataagtattttaaacgtatagttaaggcctttaaagataatacttcaaagtattcaatagtgtctacaaatagtacaacatctaatataataaatagtaataattctatcgattacatttttactgatcttccatttggtagtaatttgaactattctgaactgaattttttatgggaagcatggctgaaagtttttactaaccaagaaccagaagcgattataaatgctgttcaggggaaagggctacttgaatatcaatcattaatgacacgatgctttgaggaatgttatcgagtgctaaaaccaggtcgctggatgacggtggtatttcataattcacaaaattctgtttggaatgctatccaagaatccttaatgcgagcaggttttgttatagcagatgttcgcacattagacaagcagcaaggtagcttcaagcaggtaacgacaacatctgcagtaaaacaagaccttgtaatttcagcatataaaccaaaagaaagttttaagcgggagtttatttcccacgctgggagtgaagaaaccgcatggagttttatacagcaacatcttgagaaattgccagtagttgtcgtaaagaacggaaaaattgaattgatagaagagcggaaggcttacttgctttatgaccgcatggtggcataccatattatgaatggaatacctgttccattagatgcaacggacttttataaaggtttggacgaaaggttcttaaaacgtgatgggatgtactttctccctgatcaggttaacgaatatgatactgcccgtattgtaaacgacgtagagccaattcaaatggaattgcttgttaccaatgaaaaatcagctattgcctggctttataagcagcttgaaacaccgcaaacatatgcagaactacagccaaaatttatgcaggaaataagagcttgggataagtttgagaaaagaccggagctttcagaattgcttgaggaaaattttctgcaaaacgaagagggtaagtggtatattccggatgttacaaaggcttctgatgtggctaagcttcgtgaaaaaaaattactcaaggaatttgaaggttacctggctacaaaaggaaagcttaagttattccgtactgaagcaatcagggtagggtttgcaaaactctgggcagataagaattataagttaattgtcgaaacagcggagcgcctacctgaaagtgttatcctagaagacgataagttgcttatgtattatgatttaagcttgggaaggatttga

SEQ ID NO: 3316 - DNA, 1530 bp, Lachnospiraceae bacterium
gtgcaccatttttataccagaagaagtttgctttcgattgcgttcttcatggaacaggtaaaaaaatcacacaacagccaaaaaatgcggtttgtctttgaacagataattctagggatggctaaaatatcaaggtatgttccaagccatttttcacaggttaatcaatatttgagtggaacattgtacattggttcacaagtggtcgaggtcagtccagaatacatcctcagtggaaaaattgaaaagctttcaaaaatgtatagtcaggttccatttgatggagagtcggcatgcgtttttacagggtctaccactaatacacccgtaccgaatgattctatagattatatttttacagacccaccattcggcagtaatttaaactactctgaattgaatttcttctgggaagcatggatgggatgtgttacaaataacacaatggaggctatagttaatcaagttgccggaaaaaatcttcttgattaccaacgtttgatggaattgtgttttaaggaatactacagggtgctaaaacctaatcgttggatgactgtggaatttcataattcgaaaaattctgtttggaatgcgattcaagaggcgctacaatgtgcaggttttattattgctgatgtgagaacattggataaacagcaaggaacttttaagcaaattttgaataattcagcagtcaaacaagacctaattatttctgcttataaaccgcagactggttttataagggaattcgttgcaaatacaggcactgaagaaaccgcttgggcatttgtgcgtcaacatctttcaaacattcctattgttgtggacgccaataatgatggaaaaattgatattcttgctgaacgtcaggcgtatcttttatttgaccgtatggtagcataccacattatgcaggggcttccggttcctattgatgcaagcgatttttaccgaggacttgatgataaatttctaaaacgagatggtatgtacttccttgcagaccaagtgaatgaatatgatactgcacgcataaaaaccgatgtggagccgattcaatttgggctgtttgtgacaaacgaaaagagcgccattgcttggttatatcagcagctagatgataattcaggtgaaagacaaacatatgcccaacttcagccgaaattcatgcaggaagtaaagtctgtcgacaaatacgagtctatgccggaactgtctgttcttcttgaagaaaacttccttcaggatgagaaggggcaatggtatatccctgatgtaactaaggaaggcgacgttgtcaaacttcgcgagaagaatctttggaaagaattcgaaggttatttaagcagcaaaggcaaacttaaattgttccgttccgaggctgttcgtgtaggtttctcacgcctatggaaggaaaagaattataaggccattgttgatattggcaatcgtctgcctgagcagacaattcaagaggatgcaaacttgcttatgtactacgatattagcttgggccgcatctaa

SEQ ID NO: 3317 - DNA, 939 bp, Lachnospiraceae bacterium
atggagccaagaaacttaacgaaggcagatatcgacaaggtacgtggtattgaaggttttccgattgccaaggatgaagatatcattgctctttcggatgcgccatattatacggcatgcccaaatccgtttattgaggattttatcaaggaaaatggaactctatatgatgaagccacggatgattatcatagggagccatatgcggcggatgtaagtgaagggaaaggggatattgtatatggcgcccataattatcacacaaaagttccctataaagcgataatgcactatatcttgcattatactaatcctggcgacgttgtatatgatgggttttcgggaacgggtatgactggtgttgcggcgcaaatgtgtggagccgatgacaagcaattggaatttcaaatgatttcacaggataaaaaggcaatatgggggaaaaggaaagttgtgttaaacgacctttctcctgtagcagcatttatcgcctataaccaaaatactggtataaatgcattagtgtttgaaagtgaaacctcccaaatactgaagctgtttgaagaaaactacggatggatgtataagacaaatcatatctctaatgaaggacagataagcttagaagctcagcctcaaggttatattaactatacagtatggtcagatgtttttgtatgtccacattgttcatcagagtttgtgttttcggaagtggcatttgattacgagacaaaaaaggtaattgacaaatttgtatgtccacattgcaagagcactcttgcaaaaaaagattgctctaacgctatggtcaccatgttcgacgaggatttgaatagcacaattcaaatgtcaaagcaaaagccggtattgattaactatacctatcaaggaaaaaatttgaaaaaaaccagatgtagaggatttggcgctaattga

SEQ ID NO: 3318 - DNA, 2721 bp, Enterococcus faecium
atgtcattagaaaatgaacaattgtcttttgattctgaacaaagggaaaataaaagagtgacagttctcgggatggaatttgaaaatgatgatgctcgtcgagagtatttccgggaggaactgagaaaaaaacttcctgagttgaggaaaattgaaggttttccaataggcaatgatgaggatattattgagctgtctgatccgcctttttatactgtatgtcctaacccatttattaataggtttatcaatgaatggaaaacagaggacgttgaagagtattcaaaagaacctcttgccgtggatattagctttggtaaaaatactccaatctataacgcacatacttatcataccaaggttccgtacaaagcaataatgagttatttgcttcattatacgaaacctggcgatatagtgtatgatgcttttagtgggacaggaatgacaggtgttgcttcttcattgatgaataacaaagaagaacttcttgaaattaagccggatattacagacaatgatattggtgttagacatgcctttctttctgatttagctccagtgggaagtgttatttctgaggtatataatagttcggttgattccgaattgctggttagtgagctaacaaaattattggctgattcaaagaaagatttaggatgggtttataaaactgaagtaaataatgttgaatatgatattaattacactgtatggagcgatgtatttagttgcccaaattgcttgacggaatttatttattatgaagaggctttcgatattgaagaaaataaattgcattctgatttttcatgtccaaactgtggcatgttattaaacaaacaaaaatctgataaagtaatgtctgagtattttgatgctgtggttggaaaaaaacttaaagttcttaaacaaaaacctgtattaattagttatggatttggtagaaataaaggaattaaaaaaataggcaataaagataaagaacttttagagaagattgataaatataatattaataaatggtttccagcattcaagttacctaagggtgatgagattgaacgagtgaagagaaatggtattgaatatacacatcagttttacacaaaaagaaacttgattgtagcaagtgatttactggaccgaatttctaaactgcctgaaagtcttaaaagaccagcatatttgtgttttcaatccatcgtatatagtcttatctcaaaactggtacgttataatatgggaaatagaggcaacgggatgcttagcgggacatactacctcccttccttaatggcagagactaatgtatataatgtttttaaaggaaaagtaaaggatatagctaaagcattgattgtgaaacaacggtcatcaattgtatttgtcagctctgcaattacaaatgagttacaagagaactcagtggattacatttttacagatcccccatttggagagaatattgattactcagagttaaattttttatgggaatcatggttaaaagtgttcacaaatagttcttcagaagcgattataaatgattcacaaaataaaggtctctttgaatataagcaacttatggaagagtcttttagaaattattttaaggttttaaaacctaatcattggattacagttgaatttagcaattctaaatctagtgtgtggaatgcaatacaagactcgattcaaaaggcaggctttataattgcagatgtctctgcacttgataaaaaacaaggaagttttaaagcggtcacgacgacaacggctgttaagcaggacttagtaatttctgcttataagcctactgaagagaatattgacaaaatgaaggcacaacgtaataatgtggaatcagcttggacgtttgttacacaacacttatcaaatcttccagtatttatgggagacaaaggtgatgcggtaatcatatcagagcgaacaccacgtattctatttgatagaatggttgcctatcatgttcaacaaggtctaccagtcccaatttcttctgctgactttcaatcaggtattgctagtcgttatccgatgcgcgatggcatggctttcttagactctcaagtggcagaatatgataaaaaacgaattcttgcaaaagagtttgctcaattgtcgctatttgtatctgatgaaaatagtgctattgaatggattcgtcaacaattaatgaaaaaaccacaatctcgacaagatattcatccgcagtttatgaaagagattcagcatattgcaaagtatgaagaattacctgagcttgatgagttgttagcacaaaattttttatactatgatggaaatggggcagtaccaaatcaaattagtacctatttgacaaaaaattatcatgaattgcgtggcttagaaaaaagtgatgctttattaagagaaaaagcaaaaaatcggtggtatgtgccaaatcctaatcaacaagcagacttggaaaaacttagagagaagaacttattgcgtgagtttagccattatcttgatgaaatcaataatagtaagaagaaattaaaagtattccgtacagaagcaatccgtgttggctttaagaaagcatggacagaaaaagaatatcaaactatcgtaacagtaggagagcgccttcctgaaaaagtaattcaagaagatgataagcttctgatgtactatgataatgctttaatgcgaatagaaatgtag

SEQ ID NO: 3319 - DNA, 807 bp, Caloramator australicus
atgaagcttacaaaagatgatttagacaaagtaaggcatatagaaggtttccctatagctaaagatgaggatataataaatctttcagatccaccttattatacagcttgccccaattcatttataaatgattttatagaaaattttggtaaaaaatatgacgagaatagtgatgattattatgtagagccttttacagcagatgtatcggaagggaaaaacgatcctatatataatgcacattcctatcatacaaaggttccttataaggctataatgagatatatacttcattatacaaagccaggagatattgtttttgatggattttgtgggacgggtatgacaggggttgcagcagctatgtgcgaaaatcctgatccagagtttaaacttcagcttgaaaaggagttcaaagaaagagggaaaaaaatagagtggggtgcaagaagagccatactttgcgatatatctcctgctgcaacatttattgcatataattataataccccagttgatcctgcagaatttgaaaaggaagctaaaagtattttggaggaagttgaaaaggaatgcggatggatgtatgaaactattcacattaatgataatggagagcctatattagatatagaagggaagcctataaaagggagaattaactacacagtttggtcagatgtttttatatgcccaagctgtggagaggaaattgtgttttgggatgtagcagtaaataaagaagatggacaagttcttaatgaatttaaatgtcattcttgtggggcaattcttaaaaaaaaataa

SEQ ID NO: 3320 - DNA, 402 bp, Caloramator australicus
atgaatttaaatgtcattcttgtggggcaattcttaaaaaaaaataatcttgaaagggctaaaactacagtttatgatagggcattgaaggaatttatcactcaagcaaagcaggttccagttttaataaactatacggtaaacggcaaaagatatgaaaaaaaaccagatgaatttgatttaagactaattcaaaagattgatgatatggatattccttactggtatcctacaaacaggatgccagagggggatgaatcaagaagaaatgataagtatggtataacacatgtgcatcatttttatataaagaggaatttgtgggtgttaagttgtttaaataaaaaaaatataattctaagttttgttatttattttttgcttctatattatcatccttag

SEQ ID NO: 3321 - DNA, 1383 bp, Caloramator australicus
atgcctgaatatgggaataggcatgttggtgtattatctggaacattatatattccaagtttaaatgaagagaataatattatatcgatgttaaaaacaagaataaacagtattcataaagcattaataatatttaagaatataaaaaattataattatataatatcaacaaattctactgttaatttattttatataaagaataattctatagattatattttcactgacccaccatttggtgataacctaatgtattcagagcttaactttatatgggaagcatggcttaaagtatttacaaataataaatcagaggcgataataaacaaaattcaaagaaaaggacttaaagaatatcaagaactaatggaacagtgttttaaagagatgtatagaattttaaagccgggaaggtggataactgtagagtttcataactcaaagaactccgtatggaatgcgattcaggaggcaatgttaaggtcaggatttataattgcaaatgtaagaattttagataaaaagaaatcaacaaccaatcaattgacatatgcaaatacaacaaataaggatttattaatttcagcctacaaacccaaggaaagctttgaaaagaagtttatgttagaagctggaacagaggatggagtttgggattttgtaaggcaacatcttgaaatgttaccagttataatagagaataacaataaattagagattattccagagaggcaaaattatttactttatgatgctatgattgcttatcatattcaaaaaggattaagtatacctatgggtgctgctgaattttataaaggattaaaggaaagatttgttgaaagagatggaatgttcttcctaccaagccaggttataaagtatgaagaaaaaagatataaattagaacttatggagcaacttacatttgtaattgttgatgaaaaaagtgcaatacagtggataagaagtgaacttgaaaagcaacctcaaacatatcaagagattcagccgaaatttttacaaaagaagcatgaatttaaacatgaaaaaatgccggagcttttagatatgttaaaggagaactttttacaggatgaagaaggaagatggtatgttccagatccaaataaacaatctgatattgaaaaattaagaaataaaaatttattaaaggaatttgaaggctatttaaatacaaagggtaaacttaaagtttttagaacagaggcgataagagctggatttaaagatttatggcagaaaaaagattataaaacaatcgtaaaggttgccgagaggcttccagaaactgttttgcaggaagataatttccttcttatgtattacgataatgctgtaacaagattaggtgattga

SEQ ID NO: 3322 - DNA, 969 bp, Caloramator australicus
atgggaagaaaaataaaatgccagttttgtgatgaattattttataaaaaagattatccgaaacatcttgaaaaacttcataataatgaattcataagaataattgaagaaatattaaataattatgaagaaaagcaaattgataaatgcgttgaaaaatataactttacaaaggatttcataaagaagattttttcaggaaacgatatgcttttaaaagaaagcaaacaactttatttaacaaacctttcaccggaaaaatttgaattagaaacaactacaatatggagtttcccggatagaggtaattgggcaacacattcaggtaaatatcgaggaaattggtcgccatatataccaagaaatattttattaagatattctaatgaaggagaattaatattagatcaatttgtaggaagtggaaccactttagtagaggcaaaattgttaaatagaaatgctgttggtgtagatattaatcctattgcattagaaataactagagaaaatttaaaatttaactatgaatataatcccaagatagatattaaattaggtgatgcaagaaatttatattttattgaagataatagtatagatttaatatgcactcatccaccttatgcaaatataataaaatatagcgaaaatattaatggagatttatcacatttagatgtaaaagaatttttgttagaaattgaaaaggttgcaaaggaatgttatagagtattaaagaaggataagtattgtgcaattttaataggagatacaaggaaaaaagggcatataattcctataggttttagtgtaatgcaaaagttcattgatgcaggatttaagttaaaagaaataataattaaagagcagcataactgtaattctacaccatattggaagaataaaagtttaaagtataattttttattgataatgcatgaatacttatttgtatttagaaagtaa

SEQ ID NO: 3323 - DNA, 2802 bp, Pseudoalteromonas marina
atgcaacaagattcattattagatgatgtaaaagttgaatcatcaaaagaccctgtagagtgtttaggccaaaccttcgaaaatgaagaagcacgtagagcgcactttagtaaacttttgcgtgaaaaattaaaagatccagagtttagaaaaatagaaggctttccaataagcacagatgaagcgattcttgaattatcagatccgccatattataccgcttgcccaaacccttggttaaatgattttattgaatattgggagtctgaaaaacaatattcaacagaagaatatgaaagagaaccttttgtagctgatgttagtgaagggaaacatgatcctctctacaaggctcactcataccatacgaaagtgcctttcaaagcgattatgcgctatatcttacattataccaatccgggggatattttacttgatggtttctgtggtactggcatgactggcgtagccgcacaaaattgtggcgataggactactgtcgaatcattagggtattttgtagattcaaaaggaaaaatttacgaggacgctagtcagaaaaaattaattagtcaactcggagcaaggaaagttgtattaaatgacttatctccaatcgctacctttatttcttcaaattataatttagaacctgaagtcgaaagttataactcagaatcacaaagaatactgaatgagataaataatgaattaggctggatgtacagaacaaagcatgaagatggtagtgagtacccaattgattttgtagtttggagtgaagttttttcgtgtccggaatgttcagaagaaatagtattctcaaaagaagctttagatattgattcaggaaaagttgcaaaatcattttcatgtcccggttgttcaacagaacttaaaaaggacttaatggagttacaatatgagtccaagcatgatccttataaaaacggtgtacatcaagaacctaaaagggttccttttttaatttactataaagtaggaaaagaacgaatttataaatctcctgacgaatatgacattaatgtcctagctgagattgaaaagttggaattccctagtaactttccaataaaagaaatgcccgatatgcaaatgatgagagttggaagaatgaagccttctaacattgatcatttacaccatttttttatgaaaaggccgttggtaacgttagctaaaatgtgggagaaagctaatggtatcctagattatacgacaagaagacaatgtttattttttgttgagcaggctatttggggcatgtcaaaacttgcacgatttactccgacacatttttctcaagtaaatcaatatttatcaggggtgttttatattgcatcgcatatagtagatgtatctccaaattatattttaggaggaaaaagagataggctattaaaagtatttgggcaaatgaataataagaacattcactccttgacatcaacccaggacattgcaaaagctagtatattaccgaatagccttgattatatatttgtagatccccctttcggtgagaatatttattactctgatttaaattacttaatcgaatcatttcatggtgttatgacgaattcaactaacgaagcgataattgataaagtaaaagaaaaagattttggtcaatatcaacagctcatgctcagttgttttaaaaatgctttcatagctttaaagcctggtcgatggattacggtagaattctctaactccagtgcagcaatttggaatcttttgcaaactagtttgactagcgcaggctttgttatttctagtgtttcagctttagacaagaaacaaaggtcttttcaatcaatagtttcaactacagcggttaaacaagacttggttatttcagcttataaaccgagtcagaaattttctaataaattcaaaggggatgacaattttaatgcaatatgggattttgtcgaaaaccaccttaattatcttccaagcattaaacatgaagatggtgagcttacatttattcctgagagggaccctcgtatactgttcgacagggtagtaagttactttattgtaaataataggagtgtacctttaagtagtggtgaatttcagaaagaactttgtcaaaagtttagcttccaggatggaatgatatttactcaaccccaattactagaatatgaaaaggttaaaagtaaaggtgtttgtattaagcaactttctatttttgtagatgatgaatcgtcagcaataagttggttgaaacaaaatctaaaggataagcccaaagttcagtcagatatccacccagagtttatgagtgctatttcaggatggaaaaagaatgaactgcaacttgaactttctacgttattagagcagaactttctaagatatgacggtaaggaagatgtaccaagccaaatccatacctatttatcaacaaattataaagatatgcgaagtttggctaaagattctgtaagtcttaggttaaaagcaaaaggtcgttggtatgtacctgacccaagtaaaactggtgatattgagaagttgaggttaagaattttacttcgggaattcgataagtacaaaagcgagaagaaaaagattaaacaacctcgtactgaagcgttaagagctggatttaatcaattgactgaaaatcaagagtatcaaactattttagatatatctgccaaaattccacctgctgtattgcaagaggatgaaaaactgctgatgttctatgataacgcattaacgctaacatctaacgatgatgacgattgggattaa

SEQ ID NO: 3324 - DNA, 2820 bp, Desulfotomaculum nigrificans
atgacgatattagatgaacaagcagacaagaaaaaccaaccggtcacctgcctgggcatgacctttgccaatgacgcagagcgccgggcgtattttaccgaagagttacgtaagaaactgccggaattaaagcaaatggaagggttccccattggcgaggatgaagacatcctcgccctatcggacccgccatattatacagcatgcccgaacccgtttattccggagtttattaagcagtgggaaaaggaaaagagagagctttacggggatgaggaagaggagtatcaccgggagccttttgcagcagatgtttctgaagggaaaggcgatccaatatacaatgcgcatagttatcatacgaaggtcccccataaggcaattatgaggtatattcttcattacaccaaacccggagatattatttatgatggtttttccgggacaggaatgactggtgtcgcagcaggaaattgcggtgatatagaaagtgttttagatattggataccacgtaaaagataacgggataatcatagatgaaaacggtaatttggtctccaaactaggagaacgtaaatgtattttaaatgatctttccccagttgcttcatttattgcttataattacaactctcccgttgatagtcatacttttgagaatgaagcaatgcgaataattgaagaggtagaagaagagtgtagctggatgtttgaaactgaacatgtaattaatggggaataccagcaagatagttcaggtacgataattaaggggtcaatcaactacaccatatggagtgatgtatttttatgcccagattgtttgaaagagattgtcttttgggatgtagccatagatcatgaaaaatgggaggtaaaagatgtatttttgtgccccagttgcaacgcagaattaactaaaagaagattagagcgagcctgggagacgaaatacgatgacgctattaatcagacaataactcaagtaaaacaaatacccgtacttattaattattctgtatataacaagagatatgagaaaaggcctgactcgagggacttagaaaagatttcaaaaattgatgaattgaagattccctattggtttcctaaaaacgttattcccaaaggggaaaaaactgttgagccattaaggataggcattacacatattcaccatttttataccaagagaaacttatgggtcttgagttcactgtataacaaaataaatgctgtagaagatgaaagattacgttcgatgctgttcatgttggtttcttcctataatcttacccatagcacaaagatgagcaggattatatttaaaaaatctgggactaagcctgtattaacgggttaccaatcaggcaccttgtatgttagctcaatgccagtagagaaaaatatatataactccattaggaatatgaaagtagatttattttgtaaagcaataagtgacaaacaagtacaacaagttgttggaacacaatcaaccactaaagttgaattaccaccaaattcaattgactatatattcacagatccaccatttggtgcgaatctaatgtactccgaattaaatttaatatgggaagcttggttaggtattttgactaacagtaagccagaagcaattatcaatgaagctcaagaaaaaatgttgcctgattatcaaaaattaatcgaagaatgctttagggaatattttagagtattaaagcctggtcgctggatgactgttgagtttagtaattctcaggcaagtgtatggaatgttatccaggaatcgatacaaagagctggctttgtaattgcgaatgtatctgcattagacaaaaaacaaggtagttttaatgcagttacctctacaacggcagtaaaacaagatttagttatttcagcatataagccatcagatgtgttaatacaagagctgagaaccaatcaaaatacggaagagtctgcttggtctttcataagagaacatttaaataaactacctatctttattggaaataaaggtcaagcacaaataatagtcgagcgtaccccacgtgtactattcgaccgtatggtggcttaccatgtccaaaacggcttaactgtgcctatttcctcggcagaattccaaaggggcatcacccagcgtttccccatgcgggacggcatggtgtttttggatacccaggtggcggaatacgataaaaaacgcatcctggccaaagaattcgtccaaatgaacctgtttgtttcagacgaaaacagtgccattgaatggcttagacaacaactgatgattaaaccccaaacccgccaggatttgcaccccaactttatgaaagaaattcagcacatagctaaatacgaaaaactgccggaattggacgaactgctggaacaaaacttcctgaagtatgacggcactggcccggtgcccagccaaatccatagttatcttagttccaattataaagacatgcgggatttagacaaagaagatcccaagctacaagccaaagccaagaatcgttggtatgtgcccgacccgaataaagcagttgatctagagaagcttcgcgaaaaattcttgttacgggaatttgcctcctatatggaagaaataaagaagagcaagaaaaagctaaaacaattccgtattgaggccatccgggccggctttaagaaggcctggggcgataaggattaccaaaccattgtagacatcggccagcgcctaccggaaagcatcctgcaagaggatgacaaactgttaatgtattacgataacgcccaaatccggttaggaatgtaa

SEQ ID NO: 3325 - DNA, 2847 bp, Dethiosulfovibrio peptidovorans
atgaataaacaaaaaaaattatttaagacaaagtttattcccggcaaactgggtagcggcaacctttttgaggaagagcttgttcccgcgaatgatgggccggtgaaatgccttggtctggaatttgaaaacgacgacgccaggcgtgcccactttacggaggaactgcgcaaaaaactgcaggatccggaattccgcaagattgagggcttcccgatcggtgaagatgaggacatcctaaaactgagcgatccgccatattacacagcctgcccgaacccatggatcggtcagtttattgaggaatgggagagccaaaagccggaaaagccagcggactaccattatcacagggagccttttgccgccgatgtcagcgaggggaaaaatgaccccatttataacgcccactcttatcataccaaggtgccgcacaaagcaattatgcgctacatcctgcattacacagaaccgggggacattgtttttgatggtttctgtggaaccggtatgacaggtgtggctgcccagatgtgtggtgatcgggatgtggtcacgtcgcttggttatcaagtgaaaccagatggcactattcttcaggaagagactgatgaggatggcaaaaaagtatggaaacgcttctcaaaactcggcgctcgcaaggccgtgttaaatgacctgtctcctgcggctacctttatcgcttacaactacaacacaccggttgatgttcatgcatttgagagggaggcaaaacgtattctcgctgaagtggaagaggaatgcggctggatgtatgaaacacttcatactgacggtaagacgaaaggcaagattaattatactgtgtggagtgatgtgttcgtttgccctgaatgtactggtgaggttgtgttttgggatgccgcggtcgataaagaagcaggaaaagttagagactctttcccatgtccacattgtcacgctgaattaactaaacgaaaaatggaacgtgcctggacaacgaattttgattccgccctgaataattctgttaaacaggcaaagcaagtgcccgttcttattaattattcgatagaaggcaagcgtggtcgttttgaaaaaagtccggataagaacgatttaacactgattgagaaaattgaaaacagcgaaatccattactggtttccaaattatcgaatgatgaaaggaaaagaaacccgccgcaatgatcctgctggtatcacccatgtgcatcatttctatacaaaaagaaatttatgtgtgttagctgctgttagaataagaagctcttcaagttttttgattagtcaacttgctatgtggtggacgttaacaaaactctatagatatagatgggcgggtggaatagcgggtgctgggggtggcccaatggcaggaacattatacattccatctttgattaaagaaatttcagtattggtctctgcagtggacgtattcaataagaatattcgcaaaaaaaaattatttgcgaacttcttgaggcacccgctttcaacgagttccgctaattggattgattataacaacaacagtgtggattacatctttacggatccacctttcggagccaatctcaattattcagagcttagcttcatttgggaatcatggttaaaagtatggacgaataacaagccagaggctattgaaaactctgttcaaggcaagggcgctacagagtatcgaaatctaatggctggttgcttcaaagaagcttaccgagtgctaaagcctggtcgctggatgacggttgagttttcaaacaccaaagcatcggtttggagtagtatccaaacagcccttactgaagctggatttattgtagcaaacgtttcggccctcgataagaaacaagggagctttaaggctgtaacaactctaacagcggttaaacaagaccttgttatctcagcttataaacctaatggtggctttgaagataggttcgaggaagaggctaaatctgaagagggtgtctgggattttattcgaactcacttgaaatatctaccagtaatcaaaaaacaaggctatgatctcgtcgcaatacctgaacgtgacccacgcatcctttacgatcaggttatagcctattacgtgcgtaaaggctacaacgttcccatcgacagccaagattttcagcttggcttatcgcaacgtttcgccgagcgtgatggcatgtacttcctgccggaacaggtggcggaatacgaccgtaagaagatgatcggtggcggaagaccactacagcagtcgctgtttatttccgatgaagcatcggccatcgaatggcttcgcagtctgttacgtgacaagccacagagttttcaggatatcaatccactctttatgaaggagattggtggctggagtaaaaacgaggtgggcctggagctctccacactgttggagcagaacttcctggcatacgatggcaaaggtcccgttcctgatcaaatccacagctacctctccagtaactggaaggacatgcgtaatctgccgaaagaggatccggcgttggtcgccaaagccaaaaatcgctggtatgtgcccgatcctaacaaagcgggggatcttgaaaaactgcgcgaaaaagccctcttgaaagagtttgaagaatacaagcaggccaaaaagaagctcaaaatatttcggcttgaggcggttcgcgccggattcaagaaagcgtggcaggaacgggactataaagtgattatcaccgttgccgaaaaaatcccgaacaacgtacttgaggaagatcccaagctgctaatgtggtacgaccaagcggttacacgggtgggagacgagtaa

SEQ ID NO: 3326 - DNA, 2643 bp, Kingella denitrificans
atgagtgatcttttccagaaccacgcggccaagtccgatccggttgaatgcctcgggcagactttcccgagtgacgaggctcgccgcgagcactacctgaagctgcttgccgagaaactcaaggaccctgagttccggaagatcgagggttttcctatcgggtcggacgaagatatcctgaccctatctgacccgccgtactacaccgcttgtcccaatccattcctgggtgaattcgttaagcatttcgccaactcctcgtctcacgggaagacaacacttccttttggcggtgatttggaggcggagagcaggcaccctgtctactcattccacccgtaccacacaaaagttcctccagaggtaatcaaaaagctgattgagcattacacgcgaccaggagaaattgttttagatgctttcagtggaactgggatgaccggagtcgctgcacgggagtgcggtcgtcatggggtcaccgttgatttgtccccaatagcaaccttcatatctgcagtcaatgtaaacaagaacccaggccacgaggtggctatggcgctcaagaaaataatccaggaatcaaggaaagagttgggttgggtttatcagatcaaggaatctgcaatcttatacgaagcaaactattttgtttgggcagatgtttttacttgtccagaatgtgttcacgagttttccttctttccttatggagtgattcaccacgggaataaagttgagactcgaaaggcattcccatgcccggagtgcggcgcggaattgaatgttcgtcgcattgaaaggatcattaattcaagcgggaaaaagaaatctctcgtatgggtcaatgccggaacaggcaggaatcgcatcaatagagaggcaaacgattatgatcaagaaattgtcgaccgtgtgaactcatacaaatctccatcgtggtacccaaaagaccagattgatccaaacggatactcggcaaagctcgcgcaacttggcgataaagctattcgcgatataagcaagtttctctctgagagaaatcgtctagttttttcagacctttgggcaagggcggctgaaatacgcgacgtctcagtaaggaacgcagctaaagcctgcctcacatcgatattcacggtagtgtcagagcgtcagggatattttggcggtggcggtggcatgtctggcaacctttacatgcccatcgttcgcatggagaagaatatctatgcatctcttgagcgaaaggtgaaaaagttaattgatgcagaaaatgcgaaaccgataagtggtgcgcgctgcattgtttctgcgcaatcggcaacgaacttaaatcagatccccgatgcgtcgattgactatatttacactgatccgccatttggagcgaacatcatctacagcgagatgaacctcatcttggaagggtggttaagggttctctcttccgagaagccagaggctgttatcaatgaggcaaagaataaggcatttgatgactacggcttgttaatgcgatcggtatttagagagtattacagagttcttaagcctggacgctggattactgtcgagttccacaataccaaggccagtgtttggaatctgattcaaacgaatttggcagaggccggcttcatcgttgcgcaggtaggtaagctggacaagggatcgacaacgatactcgcagatattcgaccgggtgcagtcgtgcaggacctgattatctctgcatataagcccaatggagggctggagaaccggtttttactgcaaggtgcgagcattgagtctgcatgggactttgttgcgacacaccttcaacatttgcacgtaaccgacgtcaaggagggtcgattggcttacatcgctgagcgtagtgggagaattatctacgatcgcatggtgggctggttcatcaaaaatggggcaatggttccactgtcgtctcaggagtttttcgcaggtcttaagcaaaggtttgcggaaaggaatggaatgttcttttcggaagaacaagcatcacaatacgacaaggagcgtgcaaagtatcaatacgaactgcagttggaactatttgtttctgacgagcgttctgcgatcgactgggtaactgagcagcttaggcgtaagccatcaacttatcaggagcttcatccagaatttgttcgacagctgggagccggatggaaaaagcatgaggaaaagccggaactcggaaagttgcttgagcagaatttcctttgtttcgatggatctggtgaagtgccaagccaaattcacagttacctgtcctccaatcacaaggatcttcgaaaccttgagaagaatgccccggtcctggtggccaaggcaaaggatcgctggtacgtgcctgacccaaacaaggcgcaagacttggagaagaagcgcgaaaaggcgctgctcaaggagttcgagaattacaaggccttcaccggtcgaaagataaaagagtcgcgacttgaagtgcttcgcgccggcttccgggccgcgtgggccgccaaggactacaagaccatcatcggcatcgccaacaagctgccagaggaaacgctgcaagaggacgagaagctgctgacgctctacgacctcgccctgacccgtaccgaagacgggatctga

SEQ ID NO: 3327 - DNA, 2742 bp, Alcanivorax hongdengensis
atgaacgatcaacttaattttggccagacagaggcatcagcccaaccggtggaatgcctagggcaaacttttccgagcgatgaggctcgccgtgagcattttctgaagctattgtctgagaagctgaaagatccggaatttcgtaagcaggaaggctttccgcagggaacggatgaagccattttggctatgtctgacccgccgtactacaccgcttgcccgaatcctttcataacagacttcgtcttgaagtacggaaagccatacgaacctgctcagaaatacagcagggagccttttgcggctgatgtatcagaagggaagaacgatccaatctacaacgcgcatagctatcacacaaaggtgccgcacaaagcaatcatgcgctatatcgaacatttcacgtcgcccggtgacttagtgctcgatggtttctgtggcacgggaatgactggggttgcttgttcccatgtgggagagggaagaaaatccattctcgttgacctttcaccaatagccacttttatcgcaaaaaaccttaatgggactctcgatgcagtcgtctttgtggagtctgccagagcgctagttgatagtgtcaagctgaaggagccgaatctctataaaaccaagcactcaggctggaaggtaagagatagaaaaatcgtcgagcacaaatcctacaaacacgtagattcttcgcagggagaagttgaatttgtcctctattccgatgttgtttcttgtccaaactgtggcgctcagtatcccttctactccatagctgttgatgagatcgaagattcacttcgatcggagctcagctgcccgtcttgcagcgttatctcccgagagacggattgggagacttgttacgagaatcggattgatcccttgatgggcgctgcacataaggaagcaaagactgtccctgtgttgatcaattactcagtaggcagcagtagatatgaaaagattcctgataatgaggatcttgctgccattcgagagatggagggaaagcttagtcatttagattttcctgtggttgagctaattccagggaaggaaacgcaaagaaacgtctcaaggggcatcacacatttgcatcacttcttcacgtcgcgtgagttgtataccgttgctctgctattgcatcacattaagaaacatcaatcagcatcgatacgacacgcgttgttatttgcgcttacggcttgtttgccctacgcatcaaagatgcggcgattccgtgccgacaggaagggcggcggcccattgtctggaacactgtatgttgggtccctaactacgccaccaaatgttcttaactcctttctacgtaatgctgaaaccattgcttcaagtttgtcttaccagcgggctatgaagaaaagcaacatcatttctacccagagctctacgacgttatccaggatctcggataatagtatcgattatatttttgtggaccctcccttcgggagtaacttcgattattctgagctaaatttcttctgggaagccttgcttggtgttgtaacgcatcagttttctgaagcaatagttagtaactcgcaagagaagaatattgctgattatcgatacttgctgactaggtctttcaaagaatttttccgcactctgaagccaggaagatggatgacggtagaattttcaaatactaaggcgtctatttggaacaccattcaaacgtccttgcaagaagcaggatttgttgtcgccaatgtttcagctctggataagaaacaaggtagctttaaggcagtaatgactgcaactgcggtcaaacaagatcttgtcatttcggcctataaaccaaacggtggacttgaagaaaggtttgagacaaccggaggtagcgaagagtcagtatgggacttcgtccgaacacacctgaagtacctgccaactgtaaaggttagaggcggagtgcttgagtttgtcaccgagcgagaccctcgaataatttttgatcgtatgattgcttggttcgttcgtcataatactgctattccactttcgagccaggaattccaagaaggattgcgacaacggtttccagagagagatggaatgattttcctgcctgagcaggtggccgaatacgacagaaagcgagctcaggctacacaggcgccacagctagaaatgttcgtttcggacgagcgcagtgcgatcgattggctttgcgatttcttgaagaagcgcccatctacctatgcagaagttcactccgagttcattaggcagatcggcgcgggctggcgaaaacatgaatccaaacccgagctttccgacttgcttgaagacaatttcttcaagtacgacggcaacggcgacgtcccgagccagatccacagctatctatccacgaatcacaaggatttgcgtgggctggagaagaacgatccaaatctgatcgccaaagccaaggatcgctggtatgtgcccgaccccaacaaggcgcaggatctggagaagaagcgcgagaaagcgctgctaaaggaattccagacctacctggcattcaccggccgtcggctcaaggagttccggcttgaggtactgcgcgcgggcttcaaggaagcctgggcaagcaaggactatgcaaccatcatcaaggtggcgcaaaagattcccgatgccgccctacaggaagatgaaaagctgctgctctggtatgaccaggccctgacccgcacggaggccgacagttga

SEQ ID NO: 3328 - DNA, 2757 bp, Bacillus cereus
atgacaaataatgaacagctttcttttttaaacaatactactgaagtagacaacacccctgttgtctgcttcggcatgacgtttgaaaatgaagaagcacgcagagaatactttcgtaatgaactacgaaaaaaactatcggaactaaaacaaattgaggggttccctattggtgaagatgaagatattattgcactttcagatccaccttattatacggcatgtccgaatccgtggattaataacttcattgcagaatgggaaaaagagaaagttgaaaaatatggtcgtgatgtaaacgaagaatatcatcgtgaaccgtttgatgcagatgtaagcgaaggaaaaagtgaccctatttataaagcacatagttaccatactaaagttcctcataaagcaattatgaagtatattctgcattatactaaaccgggggatattatttttgatggttttggcggaactggaatgactggtgttgcagcacgcgagtgtgatctattaaatgaaaatgataaaaagaagataatttctgaaattggtgttgttgaatttggcccaaggaatgtaattctaaatgaacttagtccagcagcaacttttatacagcaagggtataatttaaaagctgatgcaatgactttcgaattagaagctactaaattaatttgggaagttgaaaaaaaatatagttggatgtacaagacattgcatacagacgggcaatattatgatgtaaactattttgtttggagcgatgtttacttatgtccacattgtacacatgaaattatatattggaatgaagcgatttctcatgagaaaggcgaagctttaaaacatttcaattgtagtaattgtgggaaagaattagaaaaaaaggttttagaaagagcctggacaaaaagtaatgatataataccagatagatttgataatactgtaaaaaaacaattagttgaaattaactataatgtaggaagtaaaagttttaagaagaagccagacattaatgatttaaaaatattagaaaaattacgtgacatacaaattaataattggattccaaacaataaccttttaaaaggcgataaaactatggaaccgataaatgtaggaattacaagtatcgatttatttttcactaaacgtaatcttattactactgcggaaatttgggataaatgtaaagataataaaactaaatttttatttacatctttaataacgagattaagtaaattaagtaatctacacatttcaaattattttaatggtggtggtggtgctgcatcaggaaatatgaaaggaatattacatccacctactatatctttagaacaaaatccattcaaatattggccaataagaattgaagctataaaaaaagtaattaagaatacccaaagtagccttatatcgactagttcatccactgatttaagaaatattcccgatgcgtctgtagattatatatttattgatcctccttttggtgcaaatctttcttattcagatttaaatacaatttgggagggttggttaaaggttcaaacaaatgtacaagacgaagctatagtgaataaaactcagatgaagacacttagtgagtatcaagagctaataacacaatgcttaatagaacattatagaatcttaaaaccaggtcgatggattactgttgaattttcaaatactaaggcatcagtttggacaagtttacaacaagcaatagaacgagctggatttgtagttgctaatgtagcggtgctagataaaaaacaaggtggatataatgcaaatgtacatgcagttgctgtcaaaaaagatttagcaataacagcatataaacctgtaaaggacattttcacagacatatctcatataaatcaatctgaaaaaaatacttgggaatttgtatgtatgcatttaagcaaattacctatttactctatttctaattctgagataaatatagtagttgaacgaactccgcgtgcattatttgatagaatggttgctttctatgtacaaaacgggctaccagtccctatgtcatctgcagaattccaatcaaaaatagaaagaaaattccctatgagagacggaatggtctttttagaagaacaagtcacagaatatgataaatatcgattgaaaaatagtgaattaaaacaaatgaatctcttgatttctgacgaaagtactgcaatcgattggttaagacaaaaattagtattcaaacctcaaacgcgtcaagatttgcatccacagtttatgaaggaaattcagcatattgagaagcatgagcagttacctgagttagatgaattacttgcccaaaacttcttacgctttgaaggagaagagacggtaccagaccagattgtaagttatttacgtcgtaattatcgtgatttccgtggcttggaaaatattgatgctaagcttaaaacaaaagcaatgaatcgttggtatgtaccagatccgaataaacaagccgaccttgaaaaactacgtgaaaaaacattactgcgtgagtttgataattatgtagaagaacttggtacaagcaagaaaaaattaaaacaattccgaacagaggccattcgtgcaggatttaaaaaggcttggagtgagaaaaactacgagaagattgtaacagtaggcgatcgtttaccagagaaagtaatacaagaagatgataaattactgatgtactatgacaatgcacaggtacgtttagatatgtaa

SEQ ID NO: 3329 - DNA, 2844 bp, Nitrosococcus oceani; identical to SEQ ID NO: 3298

SEQ ID NO: 3330 - DNA, 2778 bp, Methyloversatilis universalis
atgaatgatcttttccagaaccacgcggccaagtcaggcccggttgaatgcctcgggcaaacgttcccgagtgatgaggcgcgccgcgagcactacctaaagcttctcgccgagaagctcaaagatcccacgttccgcaagatcgagggttttcctatcgcatcggacgaagacatcctcaacctgtctgatccgccttactacacggcctgcccgaatcctttcatcgaggattttgttcggcactacggcaaaccatacgactcgtctgttcactacagcaaagaaccttttgcggcagatgtgagtgagggcaagaacgacccgatttacaacgctcacagttaccacaccaaggtgccgcataaggcaatcatgcggtacatcctgcattacacgcagccgggtgatgtcgtgtttgacggattttgcgggacagggatgactggcgtagccgcacagctctgcggagactcgtctgccgtcgcagaacttggatatcgcgtagacgaacgcggaaacgtattaacaagggatgaagaaggggctcttcagggcttctcgaaaataggaaagcgaaaagtcatcttaaatgacctgtcatctgctgccactttcatttcgcacaattacaacacgcctattgatgtacatgaatttgatgccgagtcgaaaaaaatcattgcagaggtagaaagtgagtttggctggatgtaccagacgcggcatacggatgggtcgcaggttggcaaaattaatttcacggtttggtcagatgtttttctctgcccagagtgcactggtgaaatagtttattgggatgtggcggtcgacaaagacgcaggaaaggcgcgcgaagacttttgctgcccgcactgctcggcggctttgtcgaagcgcaacatggacagagcttggtcgtccgtgttcgataaagaggtttcaggcacattccgccaggcaaaacaagttccagtgttgataaattacagcgttgggaagaaaagatatgaaaaagtacccgatcagttcgatctcgaattgattgagaaggttagtgatttggagccagccagatgggtgcctacagccccgttacctgatggctacaacacccggcagccaatggagtcacatggtgttcgtcatgcacaccatttttacactaagagaaatttgcatgttttggccgcgttccgagaaaaaatagcgaaggcaaaccctaaatatctcttttggtttacttctgctttgacatgggtgggccgggagaacaggcttcacttaggtaactattttggtgggggtggcggtgttatcacaagcttgaggggtacgtggtatatcgcgtcattgtccgtagagacatccgtacttgagcgattcgcacttcggacccgtgctcaattggttcgccattctatggacgggacgaatgcatttgtttcctgcggaagtgccaccgccttgcccatcggggattcttcaatcgactacatcttcatcgatccaccgtttggcgggaatctcatgtactccgaactcaactttgtttgggaagcttggttgagggtggtcacaaacaatcaacaagaagccatcgaaaataaggttcagggaaaaggcctaaacgattatcgccttcttatgagcaggtgttttaaggaagcatttcgaatcttgaagccaggtcggtggatgacagttgagttctcgaatacacaggcatcagtttggaatgcaattcaaactgcaatccaagaggccggatttgttgttgccaatgtatctgctctcgacaaaggaaaagggagcttcaaggcggttactacaacgacagcggtaaagcaggatctcgttatatcagcctataaacccaacggcgggctagaagatagattttcgaaacaaggtggcagtgaagattctgtatgggattttgtacgcacccatctcaaatatttacccactgtaaaaattagggctcgggagcttgaatttatctctgagcgagatccacgcatcattttcgaccgcatggttgcttggtttgttaggcataacactcccgtgccgatgtccacacaagagtttcaggcgggtcttatacaacgtttcgtcgagcgcgatggaatggtgtttctgccagagcaagtggctgagtacgacaagaagcgcatgcaggtcgcggttgcaccgcagatggagatgtttgtctccgacgaacgcagcgcgattgactggctgtcggattttctgaagcgccgcccatcgacttaccaagaaatcagtcctgaattcatgggacagcttggtgcagggtggaagaagcatgaggtcaagcccgaattggctgctttgctagaggacaacttcctgaagtacgacggcactggtgaagtgcccagccagatccacagctatctctcctcgaaccataaagaccagcgtggtctcgacaagagtgacccaacgctagtcgccaaggccaaggaccgttggtacgtgcccgatccaaacaaggcgcaggacctggagaagaagcgcgagaaggcgctgctcaaggaattcgagacctacaaggctttcaccggtcgcaagatcaaggaatcccgcctggaagtgctgcgtgccggcttccgcgcagcatgggcagccaaggactaccaaaccatcatcggcatcgccaacaagctgccagaggaaacgctgcaagaggacgagaagctgctgacgctctatgacctggcgctgacccgtaccgaggacgggatctga

SEQ ID NO: 3331 - DNA, 2535 bp, Thermoplasmatales archaeon
atggataaaaatacaattaaaccattaaaagatcttattgagtcagttcgtgatattgatggttttcctattggaaaagatcaagatattttagcattatcagatcccccttattttaccgcttgtccaaatccatatattaaagattttattgaggaatatggcacaccatatgatcggaacaatgataaatatgagagaacaccgtatattggagatgtaactgaaggaaaaaatgacgagatatatcgggctcataaatatcatactaaagttccatttaaagcgataatggaatttattatacattatactgaaaaggacggtttgatttttgatggattttgtggaagtggaatgactggagttgctgcaggtttactggggcgtagagcaatattgaccgaattatctccctcagctgcttttatttctaatatttacacacaacctattaatatttcagaatatgagaatagcgcaaataaaattttaaaagaaattataaatgaatgcggatggatgttcaaaacaaaacatacaaaagatgcaatggaaattccctcaggaaaaaatcctgattttatctcagaatcaaatatttttgttgatattaactatgttttatggagtgatgtattaatatgcccttattgtaaaaaagaatatattttttgggatgctgcagcaaataaaaataatggtaaactaaaaagtagttatctatgtacatattgtaattctgaaatcacaaaatctgaatcaggaaaagctattgaaagtttttatgatacttctcttaagaaaaatattgaattacgaaaacaaaatcctgtattaataaattacagtcttaatggtaaaagatatctaaaaaaaccagataaatttgatttcgacataatttcaaaaataaatgctgcagaaataccttataattatcccacaaataggatgcctgaaggtgatgagtctaggagaaatgataaaaatggattaactcatgttcatcatttttatactaagagaaatctatgggttttatcagcattcgcttctaagataggtccatcaaataaatactataatataacatctgtctcagccatcataaataaattatacagatttacctcacaaaaaggaagtttaggtgctggcggtggtcctttatcaggcacactatatgttccttctctaataaaagaaattccaatgataaaggcattaagaggacatatatcaaaaacaataaaattaaaaaattttataaaagatattaaaccaccgattattcaaactgcttcacatactgatttggctcagataaaaaacaactctattgattatatatttacagatccaccttttggagacaatttaatgtattctgagcttaattatatctgggaagcgtggctaagagtttttactaatataaaaaaagaggcaattattaataaaacccaacataaaggaatatctgaatatacaaatctaatgacaagttgttttaaagaaatgtatagaattttaaaaccaaatcgttgggtaaccattgtttttcataattcaaaagcatctgtttggaatgcaattcaagaatcaatgaatcgtgcaggttttataatcgctcaagttgctgttttagataaaaagcaggagagttttaaacaagtaacttctgcaggtgccgtaaaaaatgatcttgttataaatgcttataagccaaaatgcgatttttcagagatttttttaaaaaaggctgggaaagatatggaggtagattttatttctcagcaattatctcaccttccaattagaccaaatttagaacgtactgaaaaaatgctttattcgaaaatgcttgctcattatgttgaaaatgggtttaaaataagatatgatgcaattaatttttacaagcttttattagataatttcattgaactcgatggatattggttccttgacgatcagacaaaagaatataataaatggaaaagtaatttaagcttggatcaattaaaagaagctttaacaggtcaacaaacattatttatttcagatgaaaaatctgcattaacatggctttatcagtttttaaatataccaaaagattatagtgaaatttatacatcgtatcaacaagttgctactacttctgatgataatatacctgaattgagagaaatgctagataataattttatattagaaaatggcaaatatcgaagacctttgtcaaaggaagaaaaagatgaaaaaagtaaatcacgagagaaggaactatatcgttcttttaatgttttattatcaaaagcaagagatgccaaagaaaaaatacaaaatgtccgtagagaagctttgatttatggttttacaaaatgttatcaagaaggaaaatatgatgatattttgactatcgttgataaacttcatgatagtgttttggaatcaagtggagagattatggattttgtagacattgcaaaaattaaaacatctggtaaaaaaacaattgaggattattaa

SEQ ID NO: 3332 - DNA, 2802 bp, Pseudomonas sp.
atgaacgacttattgcacgatcaagatattggttttagtggtccagtggaatgcctcggccaaacatttgcgagtgagcagaagcgtcgcgaacattatctcaatcttttggctgagaagctgaaagatcctgtatttcgcaaaattgaagggtttccagttggcacggatgaagccatcctggcgatgtccgacccgccatattacaccgcttgccccaacccatggttggacgattttatgcgttgttatggtaagccgtatgacccgagtgagaagtactcgcgcgaaccgctggccattgatgtgtcggtaggtaagactgatccgctctatagggcgcactcgtaccacaccaaagtacctcatctggcaatcgtgccatccatcctgcactacaccgagccgggcgacattgtgcttgacggctttggtgggtctggcatgacaggtgttgccgcgcaatggtgcggctctgcccctgcgacttaccggcatgaactggaatcggggtggaagaaggagggtaaggctgcgcctaagtggggggcacgtcgagtcattctcaacgacctgtcaccggctgccaccttcatggctgccaactacaacctgccgttcgatgtagaagcttttgccatggcaggtaaaaagctactcgaggagtttgagcaaaaatttggttggatgtacgagactttgcactcagatgggaagactaaaggccgaattgagtatacggtctggagccaaatttacacatgtcctcactgcacgggtgaagtgaattttttagttgaagcgcttgatgcagaaaccaagcgggtgaaagatgagttttcatgtcctcattgtagttctgaaatttctaagagacggatggagcggctttttctctctaaaaatgatgagcttacagggggcgctattcaaacacctaagcgtctccctagcttaattagctatatagtggcaggtgtaagatattcaaaagttcccgatgaaaatgatctgtctgttctggctaaaattgaggcgatgcctcttcctgagtcacttccagtagtcaaaatacccaccatgcatatgactcacgagcgtgcgcggatggactattcaggaattacatatatccatcattttttcttgagaagagcattgctttcgcttggagtgatgtgggcgcacgcccaagaggtaacggatgtccgcttgaagggaatgatgctcttttggatagagcaatctatatggtcaatgtccgttatgaataagtatgagccaatccagtttgggcgtgctgatggaaatgcgagtcaagttggcaggtttatgaagggagtgtattatgtcgcttctttgcatactgagtgttcaccttggtatgttaatgagggcaagcataagcgccttgcaaaagccttctcggagtttaatagaaatgctaatacagcggctataacaaccggcactgcagccactatagctatgcaatcaaattcaattgactatgtttttactgatccaccgtttggtgaaaatatctactatgctgacctgaactttatggttgagtcttggcatcgtgtaacaactgatgcgaatcccgaagcaatcatcgatcgctttaagaaaaaggcgttgcctgactatcagcatctgatgcagagatgtttttctgagtactaccgtgtgctcaagccgggtcgctggatgaccgtggtgttctccaacagcaaagcggcggtatggaacgcgattcaagtcgcgttgcagcaagctgggtttgtggtcgcagaagtcacctctctcgacaaagtgcagggcagctatcgccaagtcacctctaccacggcggtgaaacaggacttggtgatctcggcctacaagccgaacggcggtctggaggatcgtttcgaccgcaacggtgcgacggttgagtccgcttgggacttcgttcagacccacctgaaacagctgccaattacaaaagtgaccaagggtgatacgccggagctactgaatatcgtcgaacgcgatcctcggcggatatatgaccgcatggcatcttggtttatccgtcacggcgctttggtgccaatttcgacccctgagttcttggcagagctgcctacgaggttccgtgaagtcggcggaatggtgtttcttccggagcagctcgttgagtacgagatggcgcgagctcggattccacaggttaaacaagccgagttatttgtctccgacgagcgtagtgctatcgactggttgactaatttccttgggaaacggccttcgactcgttccgagattcacacggagtacattccgcagatcggtgcagctaagaaaaagggtgaaattatccccgagttggatgagctactcgaagataatttccttcagtgcgacggaactggcgaaattccgagccggattcacagctacttatctagtaacttcaaagatctgcgtggcttgccaaaggatgcgcctgcacttgtcagtaaagccaaggagcgctggtacgtaccagatccgaataaggcccaggatctggataagaagcgcgagaagggtcttttgaaggagttcgagagctacaagatatttgctggtcgtaagatcaaagagtcacgcctggaggtgcttcgtactggcttctctgccgcttgggcgaacaaggactaccagacaattatcgccgtggccaacaagctgccagatgagacactccagacagacgaaaaattactaacgctctatgacatggcgctgacccgtacggagagcgatagctga

SEQ ID NO: 3333 - DNA, 2796 bp, Bacillus cereus
ttgggaaatgatgaaaaacaactatcactattaggtgaacatattcaagcagacaacggaccagttgtctgcttaggtatgaaatttgaaaatgatgaggcacgtcgagaatattttcgaaatgaattaagaaaaaaacttccagagcttaaggaaatagaagggttccctattggagaagatgaggatattattgctttgtctgatccaccatattatactgcttgtcctaatccatggataaatgaatttattagagaatgggaacgagaaaaagttgagaagtatggaagggatgcaaatgaagagtatcataaggagccatttgcgtctgatgtaagtgaagggaagaatgacccgatttataatgcgcacagctaccatactaaggtgccatataaagctataataaagtttttacttcattatactgaaccgggagatgttattctagatgcattttgtggaactggaatgacaggagtagctgcagcaagatgtgcaaacgaagaagatttacaatcactgggttttaaggttgagggtggaaagatattagacagtgaagggaattttatttctaaaatagggaagcgaaatacaatactaaatgatttatcaactgcagcttcattcattgcacataattataataacgtagtaaatatcgaagtttttgagaaaaatatgtctgccttgatagagagaattgaaaaggaataccattggttttatgaaacacttcatcaaaccgataatcaatcgagtataggtaatattaactacgtaatttggagtgacgtattttcttgtccaaactgtactaatgaatttattttttatgatgttgcattaaatgaagaaggaaataaaatagttgatgaaatttcttgtccaaactgtaaggtagttctttcgaaagaaaagttagaaagaaagaaaactaatttctatgatgagacactaaatggagtaattgaacaaaccgagcaagtaccggttggggtattctacacgtataataagaaaaggtattttaaaaaaattcatcaatctgataaagatgtaataagggagattgaaagagtacctaatttaagttggtatcctaagtcattactgccagatggaaaaaacacaaagcagcctcttgtaagtcatggttttagaaatgttcatcatttctataccaatagaaatctttttatactttcaaagctaaatgaagagatacaaaaattagatttagataggaatttaggaagagtattgtttcaatctatcgtaggtacacttacttcgaaattagtgaggtacaacatggggaatagagggaacggaatcctaaatggaactctatatgtatcttctttaaatgcagaaagtaatgtatttaatgtaattagaggcaagctgcgagatttttgtaaggctctaaaagacaataaaagtaagaatgttgtgactgtacaatcagcgagtacagtaggtattgctgataacagtatagactatatctttacagatccaccatttggggcaaatataaattattctgaattaaattttatatgggaatcctggctcaaagtagttacaaataataacagtgaagcaattataaatgcaactcaagaaaaaggaattactcaatatcaggatttaatggaagatagttttaaaaactattatcgagtattaaaaccggggcgttggatgacggtagaatttagtaatcctaaggctagtgtgtggaatgctattcaagaagcaatgcaaaaagcagggtttgtcattgccaatgttgcagcattagataagaaacaaggcagttttaaagcggttactactacaacagcagtaaaacaagatctagttatatcagcttataaaccaagaaaagaaaacatcgataaaatgaaagaagaaaaaaatacagaagaatctgcttggacatttgttactcaacatttggatcaattacctgtatttattggaataaaaggagaggcacagattatatcagaaagaacaccgcgaatattattcgatcgcatggtagcatatcacgttcaaaatgggttaccagttccgatttcatcagctgagttccaatctggtgtagcacaacgtttcccaatgcgtgatggcatggcatttttagaaagtcaagtggcagaatacgataaaaaacgtacactagttaaagagtttgcacaaatgagcttatttgtatctgatgaaaatagtgcaattgagtggattcgacaacagttattaaagaaaccacaaactcgacaagatttacatccaaattatatgaaggaaattcaacatattgctaagcatgaattacttccagagttagatgatttattacatcaaaacttcttattctttgaaggtgatggaggagtacctgatcagattgcttcttatttaagacgaaattataaagatttacgtagcgtagatacaactgatcttgtatttgttgaaaaagcgatgaatcgctggtatgttccagatccgaataagcaagcagatttagagaagcttcgagaaaaggcgttgcttcgagagtttagtggttacttagaggaattggagagtagtaagaaaaaattaaaacaattccgtacggaagcaattcgtgcaggatttaagaaagcatatagcgagaaggaatttgagcagattgtgaaagttggagatcgccttcctgaaaaaataattcaagaagatgataagctgttaatgtattatgacaatgcttgtattcgtttaggattatag

SEQ ID NO: 3334 - DNA, 2541 bp, Treponema primitia
gtggaaaggcgaaaattgaccaagaccgatatagataaagtccgaaacatcgaaggcttccctattgccaaggatgaggatattatcgccctgtcagacccgccgtattataccgcctgccccaatccctttatcgaggattttattaaagaacacggaacgccttacaatgaggcgaccgacacttaccatcgggaaccatttgcggctgatgtgagtgaggggaagaacgatccgatttacaatgcccatagctaccataccaaagttccccataaagcgataatgcggtatattttgcattataccaagcccggtgacattgtgtttgatggtttttgtggaaccggtatgaccggtgttgctgcccagatgtgtggttgtcctgatgaagaattcaaacagaagatagaaaatgaaatgcctggaatagaatggggcgccagaaaagccatcttgaatgatttatcccctgcggcaacttttattgcgtacaattataatacaccagttgatgttgaagagttccgtaaagaagcggaacatattcttgcagagtgtgaaacagaatgcggctggatgtatgaaacgattcatgttgataagagtggaaacccagtaatggatttacatgggaatccggttaaagggcggataaattatactgtgtggtctgatgtatttatttgcccgacatgctcaaatgaaattgtttattggcatgtagcaatagatgctgataccgagaaagtcatggctacttttgattgtcctcactgtggaagtaacctcaaaaagcaagattgtaattattcacaagaaacccattatgatatcggactaagaacaaatgtgactatttctaaacaaattccggtacgtatacattatacaattggtggaaaacgatatacaaaaacgcctgatgagtttgattatgctctgattgaaaaaatcagtaatgaagaaatacctttttggtatcctacgaatagaatgtgcgaaggtagtgagagtcgccgaaacgaccgttacggtattactcacatacatcaatattatacaaaacggaatttatggtcattggccgtagctgtcaataaagctaataataatcgtacgttatttattcttacagctataatgaaaacacttactaaaatgtttcgttgggctccacatggtaagcatacggcaggaatgtcgggaacgctatatctgccatcagttacacacgaatatccaatttttggcgcaatagagcgtagaatcgcattgtataaagatctgcttaatgttgcagaaaaatactcaaatgatacactaatttcatgtagtgacttggcaaatacttttttaccaaatgattccattgactatattttcactgatccaccatttggcggtaatctcaactattcagagctaagctttatttgggaaacatggctcaaggttatcacgaacaataagacagaagcgattattaatactgtacatcataaaggcttgccagagtatcaagcattaatgacgcattgcttttttgaatattatcgtgtgttaaaacctggtcgatggatgacagtagagtttcataactctcagaactctgtttggaacaccattcaggaagctttgcagcgaacaggcttcatccttgccgatgtacgaacattagataaacaacaaagtagttttaagcaggtaacaactagctctgcggttaaacaagaccttgtaatctccgcctataagccaaaaaataattttaaaaaagaatttattgctaaagcaggaagccttgaaacagcgtggaccttcattagtcagcacctagaacagcttccggtagcagttattaaagacaaaaaaatagaacttattaccgagcgacaggcttatcttctttttgaccgcatggtagcttatcatattatgaacggcatttccgttccccttgatgcatccgatttctataaaggtctggatgaaaagtttctatgccgtgataccatgtattttcttcccaatcaggtcaatgagtatgataccgcccgtatcaagaacgaagtagaaaaacctgaactggaactctttgtaaccaacgaaagaactgcgattgcttggttatatagtcaattagagacccctcaaacttatggggaaatccaaccgaaatttatgcgtgaaggaaagaccaccgataaatacgaagcgatccccgaacttatggtcatgttggaagaaaattttatacaagatgacaacggcaagtggtatgttcctgaccgtacaaaagagggagatgttgtcaaattacgcgaaaagaatttactcaaagattttaactcctatcttataacccctggtaaacttaaacaattccgtaccgaagccatccgcgttggttttgcccgcctttgggcagataaaaactataaactcatcgtagaaacagcagaacgcttgccggaatcagtcattcaggaagatgataaacttcttatgtattatgatattagcttgggaagggtgtaa

SEQ ID NO: 3335 - DNA, 2835 bp, Bacillus methanolicus
ttggacgaaaaacaattgtctttattagatgatcatgaagaagcagacaacggtcccgttgtctgcttgggcatgacattcaaaaatgatgaggaacgaagagaatatttccgaaacgaattacgcaaaaaactgccagagctaaagaaaatcgaaggtttcccaatcggggatgatgaggacatcattgcgttgtctgacccgccttactacacagcatgtccgaatccgtggattaacgattttattgaggaatgggaacgggaaaagaaagaaaagtatggtagagatgagaatgaggagtatcatcgcgaaccatttgcttcggatgtgagtgagggaaaaaccgatgcaatgtatatggcacacggttatcatactaaagtaccatttaaggccattataaggtatatacttcactatacaaagcccggtgatataattcttgatgctttttcaggaactggcatgacaggtgtttctgcagcattaagtggttatgaaaaaacgttaaaagatatgaattttaagcttaattctgacggtgaaatattactcgatggaaatgttttttcaaaaattggaggacgaaaagcaattttaaatgatatatcaccagtagcaagttttatttcctataattatacaaatattccggatgctgaagaatatgaaaaaacggctattcgtattctttcggaagttgaagaagaatgtgattggatgtttaaaacaatccatagtatcaatggacaaaaacaaatagacaaggatggtaactacattataggcacaataaactatactgtttatagcgatgttttcatgtgccctaactgttctaatgaaataatattcactgaagtagctttagactttgaaactggaaaagtacgtagtgaattcgactgtccttattgttctgctaaattaaataaacgaattttggaaagggtaagtgaacatcgttatgatccaattttaaataaggtagtaacttttgctaagcaggttccttatttaattaactataacgttgggaaacaaaactttacaaaaaaagttgataaggaggacattgacttaataaacagagttgaaaatactttaattccttatcgagtaccattagtgaaactacctgaaggaataaatactgaacaacctagaaaaagtcatggaatcgagtacgtgcaccaattttatactaggagagcgttgtacacattatctaaattatttgatttaattgatagggttgaggataggttaaaatattatataatttatacttttgaacaagcaatattagggatggctaaaattgcaaggtatgtgcctacacatttttcacaggtgaatcagtacttaagtggtaccctttatataggatcacaagtcgtagacccttccttaacttatctaataaagaataaaattaataggctaaaaaaaatactaactgaatatcacgatgcttttaatagaacaaatttaataactactcaagctgcacaaagtttaattcaaattgaggacgaaactattgattatatatttactgatcctccttttggagcaaatttaatgtattctgagttaaatattttatgggaatcttggctgaaagttcgcacaaataaccaaaaggaagctattgttaacaaatctcaaaataagtcattattagactataaagagttgattcatgagtgtttcaaacagtattatagggttttaaagccataccgatggataactgtggaattcagcaactctcaagcatcggtttggaatgctattcaagaagccatccaaaaagccggatttgttatagcgaacgtttcagtattagataaaaaacagggaagttttaaagctgtaacttcaactacagcagtaaagcaagatttagtaatttcagcttataagccgaaacatgagactgtggaaaaaatgaggcaacaacaaaacaccgaagaatcagcttggacgtttgttcgtcagcatcttgaacagttaccagtgtttattggtcataaaggcgaagcgcaaattattgcggagcgtacaccacgcatcttatttgaccgaatggttgcgtaccatgtgcaaaacggtttgcctgtaccgatttcttctgcggagtttcaggcaggagtagcccaacgcttcccaatacgagatgggatggcgtttttagaaagtcaagtagcagagtacgataagaagcggacgttagtgaaagagtttgcacaaatgagcttgtttgttacagatgaaacaagtgccatcgaatggcttcgtcagcaattattaaagaaaccgcaaacgcggcaagatattcatccaaactttatgaaagaaattcagcatattgccaaacatgagaagcttcctgagttagacgacttattgcatcaaaacttcttgaaatatgaaggtgacggtcctgtaccagaccaaattgcaagttatcttcgccgaaactataaagatttacgtggtttagaaaacgacgatccacaactaaaagaaaaagcgatgaatcgttggtacgtaccggatccaaataaacaagctgatttagagaagcttcgtgaaaaagcattgttgcgtgaatttgaaggttacttagaagaattagaaaagagcaagaaaaagctcaaacaattccgcacagaagccattcgtgctggatttaagaaagcatggagcgaaaaagattatgaaaaaattgtcaaagtcggtgaacgtctacctgagaatgtcattcaagaggacgacaagctgttaatgtattatgacaacgcgcaaattcgtttaggtttgtaa

SEQ ID NO: 3336 - DNA, 2814 bp, Vibrio scophthalmi
atgaaacaagataacctgtttgatattgaaggcgaaaataaagcacctgggccagtagattgcctggggatgacttttgagagtgacgaagctcgtagaaatcactttacagaattactacgtgaaaaattaaaagatccagagtttagagccattgaaggctttcctatcggcacggatgaagccattttggggctttctgatcctcctttctacactgcatgtccaaatccatggttaagtgactttgcaaatttatgggaatcccaaaaacaattaagtgaggaagagtactttagggaaccttttgctgcagatgttagtgaaggtaaaaacgaccctatctataatgcgcactcatatcatacaaaagtacctcataaagcggtcatgcgttatattcttcactacactaaacccggagatgtagttcttgatagtttctgtggctcaggaatgactggtgtagcaggtcagttgtgtggagaccgaagtgtcgtagaatctttgggttatagggttctagataacgatgacattcaacaagaattttttgatattgaaagtaatgagacaaagagggaaacattttctaagctaggcaaaagaaatattttgttaaacgatatcgctccgattgcgaccctgatatctagtaattacaatcaagcaattgataatgaatcatttgttttagaggcagaaaatataattaatgagatattcaaagagtattcttggctatacaaaactaaacattcggatggttctgaatgcgacattaattgcgttgtttggtcagatgtgtttttgtgtccggagtgctctggtgagatagtgctctggaatgagggaattgataaggaagtagggaaggtaaagaacacaattgaatgttcatgttgcacagcatctttagtaaaaaagcagttgataagaaaggatgccactgtatttgatccagctttgaaaaaaacaatagttcaagctgaatccgtgcctgtgttaatcgtatataaacataacggtaaaagatataaaaaatccccagattctgatgatataaaattattaaaagttattgatgagtgtgaaattacattcccatttcctaatcatcgaatgatagaagggaaggaaacaagaagaaatgatccatctggaataacccatttacatcacttctacacgaagagaaatatgatcgttctttctgctttaaaagaacgaattaaatcatcaagatactataaagaactacagtttcagttggatagcttagtaattaggcaatctaagttaactagatttttagtatcatactttttccatggcggcggcggatgggtcgggacccctctttctggaacattatatattccttctttttctgtagaagtgcaaccttttgaaacctggttgaacagaattcctaaaactctcagtcgtgttgatacacatcctaatactagtgctatttcaacaggaaatgctggaaagttaaatattccagataattctgttgattacatttttttagatcctccattcggctcaaatattagttattctgaattgagttttctttgggagtcttggcttgaagttagaactgcaattgaaaaagaagcaattgaaagttcagcacaatctaaaagccttgattgttatcgcgctcttatgagtgaatgcttcaaagaagcagcaagagtgttaaaaccagggcattggataacaatagagttctcaaatacaaaggcatctgtatggaatagtattcagacagcaattcgagagtctggattaattgtagctaacgtttccgcattagataaaaaacaaggcagctttaaagctgtcacaacaacaacggctgtgaaacaagatttagttatatctgcatataagccaaaagatgatatagaaattgtatttaattcaaaaactgatgattttaaaggagtatgggagtttataagttctcatttaagctttttaccgataactaaatatcaagggagtgacttggttaagattccagaacgagaccctaggatattatttgatcagcttattacaacttgtattagaaaaggtattcaagtcccactatcgagccaagatttccttaaaggcttattaaaaagattcgtagaacgagaagggatggtatttttgccagagcaagttgctgagtatgatagaaaaagagcactatctaacgaagtaatgcagctttcaatttttgtggatgatgaggcgtctgcaatcgaatggatgcgtcaagaactgaaagaaaaacctaaaacctactcagagattcatccattattcttgaatgaactttcaggttggaagaaaaacgagttagagctggagttgtcaacattgctcgagcaaaatttcattaagtatgatggtaaagatgaagttcctgctcaaattcacacctatttatctaccaacttcaaagatatgcgtggtttagataagagcgatcctaaacttgttgcgaaagctaaggaccgttggtatgtgccagatccaaacaaagcagcggatttagagaaggtgcgtttacgtgcattgctcaaagagttcgaaacgtacaaagtggaaaagaaaaaaatcaagcaaccgcgagctgaagccctgcgagctggttttaatacagcttgggaagctcaagacttccaaaccattttggatatctcagcgaaaattccaccagcggttcttcaggaagatgagaagttgttgatgttctacgataatgcattaacgctaacctctaccgaggatgatgagtggtaa

SEQ ID NO: 3337 - DNA, 2796 bp, Thiorhodovibrio sp.
atgagtaagcaaaacacgctggagctgaacgataccgcagagcagaaaccctccggcccggtgacttgtctgggcatgacgttcgagaatgacgaaggccgccgcgcccactttaccgaggagctgcgcaagaagctgcaggacccggagttccgcaagatcgaaggctttcccatcggcagcgacgaggacatccttgccttaagcgatccgccgtactacaccgcctgcccgaatccgtggatcgccgacttcatcgccgagtgggaggcgcaaaagccggaacagcccgagggctatcactatcaccgggaaccctttgcggccgatgtaagcgagggtaaaaacgaccccatctacaacgcgcactcttatcacaccaaggtgccgcacaaggccatcatgcgttacatcctccactatacgcagccgggggatatcgtgttcgacggcttctgtggaaccggcatgacaggggtagcggcgcagatgtgcagcgaccgtgaagtggtcatgtctctcggctaccaggtgaagcctgacggcaccattttgcaggaagaggcggatgaagatggcaaaaaagtttggcgaccgttttcaaaactgggctctcgtagggctgtgctgaacgacctttcgccagcggccacatttattgcttacaactacaatacgccagtcgatgtaacagcatttgagaaagaggcaaagcgcattctcaaagaggtggagaaggaatgcggatggatgtatgagaccaagcattcggatggtcgaaccggaaagatcaatttcacaatttggtccgatgtgtttatttgtcctgattgttcaaaagaaattgtattctgggatattgctgtcgataaagaaaacgattgtgtacgcgagaatatgtcatgcccacactgctcagcagagttaacaaagcgcgggatggagcgcgcatggcagtcctcatatgatagttcaatcggagaaacagtccagcaagcgaagcaggttcctgttcacatcaactattctgtaaacggtaagcgctttgaaaaagcaccagatggagatgatctaaatctaattgacagaataaacgggttaaatatcccgtattggcatcccgctgtcaggatgatggagggaaaggaaactcgccgaaacgaccctattggcatcacccatgctcaccatttctatacgaaacgcaatttgtatgcgttggcatcaacaatagacaaaacacattttgatcggaccttgttcgtcgttaccgcgataatcagaacattgactaaaatgttccgctgggctccaagagggaaacatacggcaggtacctcgggaactctttatgttccgtcaataacacacgaataccctatctttggcgctattgagagacggttggcgatctataaggactggctgcgatttgccggaaaatacgagagtcctaatatatgcatgtgcactgactcttctgacacaacaatagagcgagactctgtagattatatctttcttgacccaccttttggttcaaatctcaattattctgaactcaactttttatgggaatcctggataaaagttgcgacagataacaaacctgaagcaatagagaatagcgtccaaaacaaaggggcaaatgaatatcgtcaactgatgatggcctgtttcaaggaagcctatcgtgtgctcaagccaggaagatggatgacagtcgagttctcaaatactaaggcttctgtctggaacagtatccaaactgcactcactgaggccggtttcatcgtggccaacgtatcggctctggacaagaaacagggaagcttcaaggccgttaccaccccaaccgctgtcaaacaagacctcgtcatctcggcatacaagccaaatggtggttttgaggagcgcttcaaaaaggaggcgcaaaccgaagaaggcgtgtgggattttgtccgcacgcacttgaagtatctacctgtcactaaacgacagggcgttttgcttttaatggtgcccgagcgcgatccacgcattctgttcgaccagatgatcgcattatatgtccgtaagggattcccggtgccgatctccagcctggaatttcagataggtctggcacagcgctttatcgagcgtgacggcatgtatttcctgccggaccaggtggccgaatacgaccgcaagaagatgacccccggtgccccacagcagctttcgatgttcgtctccgacgaagcatccgccatccagtggctccgccaactcatcaaggaaaaaccgcagaccttctccgacatcaatccgcagttcatgcagcagctcggtggctggagcaagaacgaggcccaactcgacctgcgcgaactgctaaaccagaacttcctctgctacgacggcaaaggccccgtgcccgagcaaatccacgcctacctgtccaccaactggaaagaactgcgcaacctccccaaggacgacccaaccctgatcgccaaggcccgcgaccgctggtatgtgcccgacccgaagaagcagggtgatttagatctgcttcgggaaaaagccttgttgaaggaatttgaggaaatcaagcaacgcagcaagcgatttacgagcaaagaccgtttcagaaacgaggcgctcagagtcggcttcaaagtcgcatggcaaaatcgcgattacgcaaccatcatccagatcgccgacaagatcccccacaacgtcctggaagaagatccgaagctgctcatgtggtacgaccaggcagtcacacgtatgggaggggaataa

SEQ ID NO: 3338 - DNA, 2778 bp, Ectothiorhodospira sp.
atgaattcgactgattccctggacttgagatccgagaccacttccggcccggtcgaatgcctgggccaaaccttccccagtgatcaggctcgccgcgagcattatctgaagttgctggccgaaaagctgaaagatccggaattccgcaagcaggaaggtttcccgcatggcaccgatgaggcgattctggctatgtccgatccgccttattacaccgcctgccctaacccctggctggcggagttcgtcgagcactacgggaagccctacgacgcgcagcagacgtacagccgagaacccttggcgattgacgtttcggtcggtaaaaccgacgccatttatcgtgcgcattcctaccacaccaaagtgccgcacctggccattgtgccgtcaattctgcactacacccagcccggcgatatcgtgctagatggcttcgcaggctcgggcatgaccggcgttgccgcccagtggtgcgcttccgcacccgcggactaccggcatgagctggaaatggagtggaagaagcaaggcaagccagcaccgaagtggggagcacgccgcgtcatcctcaacgatctgtcgccggcggccaccttcatcgcagccaactacaacctgccgttcgatgtggataccttcgccaaggcggggaaacaactgcttaaggaggtcgagcaggaaatcggctggatgtacgagaccctgcactcggacagcaagaccaaggggcgaattgaatacaccgtttggagcgaagtcttcacctgtccggagtgcgcaggtgaagtgaattttctggacgaagcgctggacaaggacagcaaacgagtacgcgctgcgtttccttgcccgcattgcggcgcagagttgaacaagggcaggatggatcgcgtgttggaaaaccgccttgatccgtgcaccagcaagccgtggcaacgggtcaagtttaagccgtccctgatcgtctataaggtgggcaatgcgcggtatgagaaggagccagacgaccaagatatggcgacgcttgcgcggatccaagcgatgccctatccagcgtcaattccaaacacacccttcccggtcgagcagatgtaccatggatcgcgaattgcgccgaaaggattcacccatgttcaccatttttttctgccccgggctgcccacgctatgggtcttctttgggaccaggcaagcagtcatccagatcagcggattcgagcgttccttaagttcgtagtcgaacaggctatctggaatatcactgtcttgaactcgtatcgcccaacaggtttttcgcaagtctctcagtatatgaagggcgtctattacgtcccgtcacagcatgccgaactaagtccgcgctacatcttggggggcaaaattgatcggctcatcaagctcttttccgcttcggtaattgggcagcgacagtgtgcagccgtaactacgggtaccgctggccgactcccactttcagatgacagcgtcgactatatattcaccgacccaccgttcggcgagaacattttctacgcggaccttaattttcttgttgaggcttggcatggagtcacgactgaatcacgatccgaggccatcatcgataagccgaagaacaaggcgttaccggaataccagcacttgatgcagcgctgcttcgcggaatacctccgcgtgctcaaacccgggcgctggatgaccgtggtgttctccaacagcaaggcatccgtctggaacgcgatccaggtggcattgcagcaggctggctttgttgtggctgaggttagcgccctggacaaggtacaaggtagctataggcaagtgacgtccaccacagccgtgaagcaggacctggtgatctctgcgtacaagcccaacggcggactggaacagcgctttgcggaacgtggcgcaacgccggaatccgcttgggacttcgtgcaaacgcatctcaagcagctttcggtgaccaaagccaagaacagcgagttggagttcatcgtcgaacgcgagccacgacgtatttttgatcgactggtggcctggttcgtgcgtcatgatgtacccgtgccgatttccaacgatgaattcctaaccggtctgcgcagtcgcttccccgaacgcgacggcatggtctttttgccagaacaagtagccgagtacgacaagaaacgcgcccaggtggcccaggcgccgcagatggagttgttcgtctcagacgagcgtagcgccatcgactggctggctgatttcctcaaacgccgtccctcgacttaccaggaagttcaccccgagttcaccactcagctgggcgctggctggaaaaagcatgaagccaagccggagttgatggcactgctggaaaacaactttttgaaatatgacggtactggcgatgtgccgagccagatccacagctacctatccacaaaccacaaggatctgcgtggtctggagaagagcgacccgcgcctgatcgccaaagccaaagaccgctggtttgtgcccgacccaaacaaggcacaggatctggagaagaagcgcgaaaaggcattactcaaggagtttcaggtgtaccaggccttcaccggccgacgccttaaggaattccgcctggaagtgctgcgcgccggcttcaaagaagcctggggcaagaaggactaccagaccatcattgccgtggccaagaagatccccgatgaggcgctgcaggaagatgaaaaactgctgctctggtacgaccaggcgatgactcgtactgaggatggcctatga

SEQ ID NO: 3339 - DNA, 2553 bp, Clostridium papyrosolvens
atggagttaaataaagagaccttggataaggtaagaaatattgagggatttcctattggcaaggatgaagatattattaagctatcggatccaccgtattatacggcgtgtccgaatccatttataaatgagtttattgaaaagagcggaacacaatatgacgaagaaaatgataattataatgtagagccttatacggctgatgtttccgaaggtaagaatgatccaatttataacgctcattcctatcatacaaaagttcctcataaagctattatgaggtatattttgcattatacaaagcctggtgatattgtttttgatgggttttgtggaacgggaatgactggtgttgcctcacagatgtgcggaaatcctgatagcctgtttaaattaagcatagaacaagatatgaaaaatattagatggggagcaagaagagcaatcctaaatgatttatcagtagctgcaacatttattgcatacaactataataaaccacagactgctgctaaatttagtgctgattgtagtgatttaattagtgaaattgagaaagaatgtcattggatgtacaaaactaatcatattattgatggtaggccgcaaataggaatcgatggtcaagtaattaaaggaaatattaactatactgtatggtcagatgtttacttatgccctaattgtaacacggaattagtattttggaatgttgcagtagataaagaaaatggagttgttaaagaacattttaattgttgccattgcaataaagatttaacaaaaaaagatcttgaaaagctatggattacaaaatatgacaaagctattaatgggaaagttgtccaggctaaacaagctccagtgcaaattaattatactgttggcaaaaagagatatgataaagaacctgatgaatatgatatacaattgttaaataagatagacgagatagaaattccatattggtatcctaataatgttcttccagagggttataacacggagcaacctaaaaaatcgcacggtattactaatgtacatcatttttttgtaaaacataatttgtatgttttggcgaaaatatacaatgcatcaaagaataacccacacatactctgtttaataggtgatatgttgccaagagcaagtaaaatgcacaagattgctgttagtaggcttaacagtaatctatctaaaactgctggtatattaactggaacatactatattccatcgaattcgattgcgtattcgcttattgaaatgttaaagtcaagagttgctgatgtagagaactatattaataaaacaaactataatgatgattgtattattagttgtcaatcaacaacatctatgagtaacattaatgacaacagtattgattatatttttactgacccgccatttggagaaaacttgatgtattcagagcttaactttttatgggaagcgtggcttaaagttttcacaaataatagacacgaagcaataatgaacaaagtacaaaataaaacactcaatgaataccaagaccttatggagaagtgttttatggagaattacagaatactcaaaccaggtagatggatgactgttgaatttcataactctcaaaacagtgtttggaatgctatacaggaagcaattttaaagtctggttttgttatcgctaatgttaaaactttagacaagaaacaagggagtttcaagcaagtcacaactacttctgctgtaaaacaggacttgataatttcggcatataaacccaagtcttcttttgttcatcgttttttaatagaagcaggtacagaggaaggtgtgtgggattttattcgggagcatctttctaaacttccagtggtagttgaatgtagcggaatgttagatactattccagaaagacaaaattatctgctttacgatagcatggttgctttccatatccaaaaaggtgcaacagtaccgttaggagccgctgacttttacttgggattaatacaaagattcccagagagggatggtatgtacttcttgcctggacaggtaagcatttacgatgccaaaagaattactcaagagcttaatgagcagatgtcattgtttgttctggatgaaaagacagcgatacagtggcttcatatagagcttgcaacaccgcaaacataccaggacgtacaacctaaattcctgcaggaattgaagcagctaaaatatgaaaaaatgccagaactacgggatctgcttgatgagaatttcctgcaggatgaacaaggaaaatggtatgtacctgacgtaaataaacagtccgatcttgaaaaattaagagataaaaagctcttgaaagagttcgacgaatacagaaacagcaaaggaaagctcaagttattcaggatggaagcaattagagcgggttttaaacactgctggaaggaaaaggactataaaactattgttaatattggtgaaagaatgccagaagccgtggtacaagaggacccgagcatacttatgtactacgataatgctcgaacaagaataggggattaa

SEQ ID NO: 3340 - DNA, 2562 bp, Thermoanaerobacter ethanolicus
gtgaaattaacaaaagaaatgcttgataaagtaagagatatagagggatttcctattggtaaagatgaagatataatagaactttctgatccgccttattatactgcatgtccaaatccttttataaatgaattcattgaaaaatacgggaaaccttatgttgaagaaaaggatgattacaattgtgaaccctatacggcagatgtatctgaagggaaaaatgatcctatatacaatgcccattcgtatcacacaaaggtgcctcacaaagcgattatgagatatatactacattatacaaagccaggagatatagtatttgatgggttttgtggaactggcatgacgggggttgcggcacagatgtgcggcaaccctgacccggagtttaaacttaaagtggaaaaggagtttgaaaaagagggtaaaaaagtagagtggggagcaagaagagccattcttggagatttatctcctgctgctacttttatagcttacaattacaatacccctgttgatgtggaggagtttaaaaaagaggcagagaggatacttaaggaagtagaaaaagaatgtgggtggatgtatgaaaccatacatactcttgatggcgttccgcaatatgacataacaggaaatgttataaaaggtaaaataaattatactgtatgctctgatgtgtttatatgtcccagctgcagcaatgaaatagttttttgggatgctgctgtagacaaagatgatggaaaagttctggatgaatttaaatgtcctcactgtggtgcaaaattaaccaaaacaagtcttgagagggcgtggaggactgtttatgataaggctattggtgaaacaataaaacaggcaaaacaagtacctgttcttattaactatacagtaggtaagcaaaggtataaaaaaaagcctgacaaatttgatttggaacttatacagaaaattgaagagatggatataccctatttgtatccaacagatgccattcctaaaggcgacaaaactggagaacctataagaattggcataacacatgtacatcatttttatactaagaggaatttgtatgtattgagtgctttatatgagaggataaataatatagtaaatttaaatagaagaaatttttattggttaataagtgctgttactgagggggggtcaagattaaatagggagagacctaagggattaccaagcaaattatccggtacattatatgtaagttcaatgatacatgaagttaatattattgattttatagataggaaaattgcaaaaagaattttaattaataaggatgcagggataaatttaggaaaagtgaaaattactacccagtcatgtaataactttgataatataaattctaattctatagattacattttcacagaccctccttttggagataaccttatgtacagtgagcttaattttctatgggaggcatggcttagagtatttacaaataataaaacagaagctgttataaacaagatacagaaaaagggacttcatgagtatcaggagcttatggagaaggctttttcagagatgtacaggatattaaagccaggaagatggatgactgtagtgtttcacaattctaaaaatgctgtgtggaatgcaatacaggaggcgatcttaaaagctggttttgtaatagcaaatgtacgaaccttagataaaaaacaaggaagttttaaccaggtaactacaactaatgctgtaaaacaagaccttataatatcagcttacaagcctaaagaagggtttataaaaaggtttttgaaagaagctggaacggaagagggagtatgggattttataagacagcatctagaaaaactgcctgttgttatagagacaaatggaaaacttgatataataccagaaagacaggaatatttactttatgatagtatgattgcatttcacatacaaaagggtgctactattccaatgagtgctgctgagttttatgagggattgaagaagaggtttatagagagggatggaatgtactttttaccggatcaggcggctatttatgatacaaaaaggctcaaattagaacttaatgagcagcttgcttttgtaatacaagatgaaaagacagcaatacagtggctgaaatttaagcttttaaataaacctatgacatatcaggaaatacagcctatgtttttagaggagttaaagcagctaagatatgaaaaactgccagagcttttggatttactacaggaaaactttttgcaagatgaggcaggcagatggtatgtgccagatgcaaataagcaggcagaccttgaaaaactgagggaaaaaagattacttaaagaatttgaggaatataaaaatgttccaggacgacttaaagtttttaggacagaagccataagagctggtttcaaaaattgctggaaaaacaaagattatgaaacgattgtaaaaataggcgaaaaactgcctgaaaatgtgctacaagaagaccaaactttgctcatgtattatgataatgcagtgacaaggttaggtggttga

SEQ ID NO: 3341 - DNA, 2550 bp, Thermoanaerobacter ethanolicus
gtgaaattaacaaaagaaatgcttgataaagtaagaaatatagagggatttcctattgggaaagatgaagatataatagaactttctgatccgcctcattatactgcatgcccaaatccttttataagtgaattcattgaaaaatacgggaaaccttatgaagaagaaaaggatgattacaattgtgaaccctatacggcagatgtatctgaagggaaaaatgatcctatatacaatgcccattcatatcacacaaaggtgcctcacaaagcgattatgagatatatactacattatacaaagccgggagatatagtatttgatgggttttgtggaactggcatgacgggggttgcggcacagatgtgcggcaaccctgacccggagtttaaacttaaagtggaaaaggagtttgaaaaagagggtaaaaaagtagagtggggagcaagaagagcaattcttggagatttatctcctgctgctacttttatagcttacaattacaatacccctgttgatgtggaggagtttaaaaaagaggcagagaggatacttaaggaagtagaaaaagaatgtgggtggatgtatgaaaccatacatactatagaaggtgtaccgcaacatgatgtggaagggaatgttataaaaggtaaaataaattatactgtatggtctgatgtatttatatgtcccaactgcagcaatgaaatagttttttgggatgctgcagtagacaaagaggatggaaaagttctggatgaatttaaatgtcctcactgtggtgcaaaaataaccaaaacaaatcttgagagagcgtggaggactgtttatgataaggctattggtgaaacaataaaacaggcaaaacaagtacctgttcttattaattatacagtaggtaagcagaggtatgaaaaaaaacctgacaaatttgatttggaacttatacagaaaattgaagaaatggatataccctattggtacccaacagataaaatgcctgaaggatataatacagaacaacctaagaaatctcatggcataacacatgtacatcatttttatactaagaggaatttgtgggtattaagtgcgatatatgataaaataaaagaaccaaaaattaaattcttgtttacatcggcaattgcaaatttagctattactgcgagatataaatttcatagaagtggcaatgtacctttaactggaacattatatattgcatcattacctacagaaacgaatgttattcatggatttaaaggaaaacttggtgtattaaagaaattatttaaagtattagatattaatattagtaattgtttaataatgacacaatctacaaatgaattatctaacattccttcaaacttcattgactacatcttcaccgaccctccatttggagataatcttatgtacagcgagctgaattttttatgggaatcatggcttaaagtttttacaaacaataggacagaggctataattaataaaacgcagaggaagggacttaatgagtatcaagagcttatggagaaggctttttcagagatgtacaggatattaaagccaggaagatggatgactgtagtgtttcacaattctaaaaatgctgtgtggaatgcaatacaggaggcgatcttaaaaactggttttgttatagcaaatgtgcgaaccttagataaaaaacaaggaacttttaaccaggtaactacaactaatgctgtaaaacaagaccttataatatcggcttacaagcctaaagaagggtttataaaaaggtttttgaaagaagctggaacggaagagggagtatgggattttataagacagcatctagaaaaactgcctgttgttatagagacaaatggaaaacttgatataataccagaaagacaggaatatttactttatgatagtatgattgcatttcatatacaaaaaggagcttctattccaatgagcgctgctgagttttatgaggggttgaaaaagaggtttatagagagggatggaatgtactttttaccggatcaggcggctatttatgatacgaaaaggctcaaattagaacttaatgagcagcttgcttttgtaatacaagatgaaaagacagcaatacagtggctgaaatttaagcttttaaataaacctatgacatatcaggaaatacagcctatgtttttagaggagttaaagcagctaagatatgaaaaactgccagagcttttggatttactacaggaaaactttttgcaagatgaggcaggcagatggtatgtgccggatgtaaataagcaggcagaccttgaaaaattgagggaaaaaagattacttaaagaatttgaggaatataaaaatgttccaggacgacttaaagtttttaggacagaagctataagagctggtttcaaaaattgctggaaaaacaaagattataaaacaattgtaaaaataggcgaaaagctacctgaaaatgtgctacaagaagaccaaactttgctcatgtattatgataatgcagtgacaaggttaggtggttga

SEQ ID NO: 3342 - DNA, 2766 bp, Nitrococcus mobilis
atgacatccctttttgaagcaggcaagcagatctccggctcggtggaatgtcttgggcagacattcccaagcgaccaagcgcgtcgcaagcactacttgaaactgctggccgaaaaactcaaagacccggcattccgcaagcaggaaggatttccgcaggggacggacgaggccattctggccatgtccgatccgccgtactacaccgcgtgcccgaatccctggttggccgatttcgttcagcagtatgggaagccttatgacccggccgaatcttatcggcgcgagccattggcgatcgacgtgtcggtgggcaagaccgatccgatctacaaggcgcactcttaccacaccaaggtgccgcatctggccatcgtgccgtccatcctgcactacacgaagccgggcgacatcgtgctcgacgggtttgcgggctctggcatgacgggtgtagccgctcagtggtgcggcacggcgccagccaagtatcgacacgaggtcgagctggcgcggaagaaggaaggtcggccggcgccgcaatggggtgcgcggcgagtggtgctcaacgacctgtcgccggtggccaccttcattgcagccaactacaacctgccgttcgacgtcgatgccttcgcgcaggcaggcaagcaactgctcaagtcggtcgagcaggatgtcggctggatgtatgaaaccctgcacaccgacggcaagaccaaggggcgtatcgggtacaccgtttggagccagctctacagttgcccggagtgtgcaggtgaggtgaacttcaccgaggaggcacttgatgagaagtccaagcgagtcaaggagtcgtttccttgtccacactgcggcgccgagctgatcaaatctcggctcgaccgcctatacacagcaaagctcgatccgagtacaggcaatacgatacaggtgcccaaacgggcggcgacgctgatctcatacaccgacggcaagacgcgctacgaaaagaagccgacccacgatgacttggctgtgatccagcgcattgagtcattgccgctcccgtttcaagtgcccaccatcgaaatcccgccgatgcacatgactcatgagcgggctcgcatggactacgcgggagtcacacacattcaccacttttttctgccacgtgccgcgcaggccatgggcaagctgtgggagaaggccaacgcataccctggtgctcggactcgggctttcctgttgttctttgttgaacaagctatctggggtatgtcggtacttgcacggtacacgcctacacacttctcgcaggtcaatcagtacctgagtggcgtatattacatcgcgtcgcagcattcggaatgtagcccctggtacatcctcgatggaaagctgagccgactagaaaaagccttccacgggtatcgatcccaattcggattcgctggtatcaacaccggagcagccgcccaactgccactgcctgatgcttctatcgattacgtcttcaccgacccgccgtttggcgagaacatctactacgctgacctgaacttcctggtcgagtcgtggcacggagtgacgaccgatgcccaacccgaagccatcatcgaccgctttaagaagaaggcactgcccgagtaccagcacctgatgcaacgctgcttcgccgagtaccaccgcgtactcaagcccgggcgttggatgacggtggtgttctccaatagcaaggcggcggtgtggaacgccatccaggtagccttgcagcaggccggtttcgtggtcgccgaagtgacggcgctggacaagctgcagggcagctaccggcaagtgacctccaccaccgcagtgaagcaggatctggtgatctcagcctacaaacccaatggcggcctggagcagcgccttgcccagcgaggcgctacgcctgaatccgcgtgggacttcgtacaaacccatctcaggaacctgtcggtgaccaaaaccaggaacggggagatggaactcatcgtcgagcgtgaccctcggcgcatctacgaccggctggtagcctggttcgtgcgccatgacgcgcccgtgcccttgtccagcgacgaattcctgagtggggtgcggagccggtttcccgagcgtgacggcatggtgttcctgccggaacaggtcgccgagtacgacaagaagcgggctcagatggcacaggcaccgcagatggagctgttcgtgtccgacgagcgcagcgccatcgattggctgacggatttcctgagaaaacgcccttcgacgtatcaggggctgcatcctgagttcatcactcaacttggcgccggttggaagaaacatgagagcaagcctgagctctcacagctgctcgaggataacttcattcgatacgacggcgcgggtgatgtgccaagccagattcacagctacctctccaccaaccacaaggacctgcgcggtctcgaaaagagtgatccgcgcttggtcgccaaggccaaggatcgctggtatgtccccgacccgaataaggcgcaggatctcgaaaagaaacgcgagaaggtgctgttgaaggaattcgaaagctaccgggccgcgacgggtcgccgactcaaggagttcaggctggaagcgctgcgtgcggggttcaaggcggcctggggtaataaggactaccagaccatcatcaaggtagcccagaagatccctgaagcggcactacaggaagacgagaagctgctcctctggtacgaccaggcgctgacgcgcacggaggagccgtaa

SEQ ID NO: 3343 - protein, 868 aa, Acetohalobium arabaticum
MDEDKLEPLEDLLDEMREIEGFPKGEDEDILELSDPPYYTACPNPYLDDFIGEYGTEYDPESDDYERKPFVGDIKESKRDSISLAHKYVTKVPYKAIMYFIMHYTKPGDIVFDGFAGSGMTGIAAQMCENPSEEMQKKIEDRLDSVEYGARKAVLNELSPAASFITSNYNFACNEEELKQKAEEIIAKVEEECGWVYETNHVKEATDTRTGKQATLFDIEKNKGKINHIIWSDMFICPYCESEFVLWEEAIDHEKGEMQDEFKCSSCNAEITKKECDKAKEEYYDNLIGEKSIRVKKSPVLIDYSVGSKRFEKKPDKDDLELIKKIDDITIPYFTPNYRMPEGKESRRNDKFGMTHIHHFYTKRNLYVLAKFYNEIKKIDNKRIKDKLMFIFTSLLLRSSKKCIVHVSNFFHGGGGYVTTISGNLYIPSFRVETSVIENFKRRVNKTNKLNKYKQLKKDNARVNLGSATDLSMIPENSFDYMYIDPPFGSNLMYSELNFLTDSWLQVIENNNSEAIINSVQNKDLVDYNNLMEQSFKEFYRILKPNRWITIEFNNSKATIWNKIQESLTRAGFIIAQVAVLDKDSGSFVSNVSPGAVKNDLIINAYKPKKEFEDKFLKTAGEGLEADFIRQQLEHLPVEANIERTEQMLYSKMLAHYVENGFKIQYNANNFYQLLHDSFIERDGYWFLEEQADEYDRWKASLKLDEIEDIKEGNQVMFVTDEKSALTWLHNFLDEPKEYSEIYTGYEQVVTKTKDLIPELRDMLDNNFVMEDGKYRRPQTKEERQKIEENRERELERAWKDLLDKAKNGRRKIKNVRKEALIHGFTKCYQKENYEDIITVADRLYKSTLRSSGDILDFVDIARMKLDQ

SEQ ID NO: 3344 - protein, 992 aa, Acidothermus cellulolyticus
MNRQNNLFENQEAKTRDQEPVECLGKTFDSDEARRQHFLRLLREGLEELHAKLGGVPFTTVEDAVERMKSVEKWPMGGETRLRELAERMRHADSSKDLLQRWKDEVGFPHGEIEDILNLSDPPYYTACPNPFIADFIKHYGKPYDPNVPYSKEPFAVDVSVGKTDPLYKAHSYHTKVPHLAIVPSILHYTEPGDVVLDGFCGSGMTSVAAQWCSSAPESYKRDVEASWEKEGRKKPNWGLRRVVLGDLAPAATFIAANYNLPFDVDGFARAARQILDEVEQEIGWMYETLHTDGKTKGRIEYTVWSEVFTCWDCAGEVVFLEQALDPETKKVRETFPCPHCGAELTKKRLERLYETKLDRALNTIIRIPKRQPALIVYRIGKTRYEKKPNQTDLETLSRVESLAWPHEVPIDALPYMHMTHERARMDNAGITHIHHFFLPRAAHVLAALWRKAQAWPDKRNRHMLLFFVEQAIWGMSVLNRYLPTAFSQTNRQLTGVYYIASQIAEVSPSYNLEGKLKGLAKAFRGHRTSSGSAIVTTVTTARLDLPDNSIDYIFTDPPFGENIYYADLNFLVESWHRVLTNATPEAIVDKAKKKGLPEYQHLMRQCFAEYCRVLKPGRWMTVVFHNSRNAVWNAIQEAILAAGFVVADVRTLDKQQGSYRQVTSTAVKQDLVISAYKPNGGLEERFKLTAGTEEGVWDFVRTHLRQLPVFVSKDGEAEVIAERQNYLLFDRMVAFHVQRGVTVPLSAAEFYAGLAQRFSERDGMYFLPEQVAEYDKKRMKVGEVLPLQLFVTDEASAIQWLKQQLTRKPQTFQELHPQFLKEIGGWQKHEKPLELSELLEQNFLRYDGKGPIPKQIVSWMRQSAELRKIIDEQLASGQAQEDDSGLVTREPRLIDRAKARWYVPDPNKAGDLEKLRERALLREFEEYRESKQKRLKVFRLEAVRAGFKKAWQERDYATIIAVARKIPEDILQEDPKLLMWYDQALTRSGEE

SEQ ID NO: 3345 - protein, 1036 aa, Anaerobaculum mobile
MSEKTRQHRQQILFDLESMPSGKVDLGASISCLGITFENDEKRREYFLDLLHKGLEELDAKLKGVPFTTLDDTISRLKSLEHWSVGDDDCINKLALCMAEAARISRRGSRDVDLLTLYKDEVGFPHGKIEDILRLSDPPYYTACPNPFIEDFIRCHGKSYDPQSSNYHREPFAADVSEGKNDPIYNAHSYHTKVPHKAIMRYILHYTEPGDIVFDGFCGTGMTGVAAQLCGDRNTVESLGYMVDDQGIVYQQETEDNGKSAWKPFSKLGARYAVLNDLSPAATFIAYNYNTPVDVKAFEREAKRILREVEEECGWMYATLPQGETDKAEIWADELKMCKTADEARKLIRAIPNLGQINYTVWSDVFICPECTKEVVFWESAVDKNAGKVYNEFPCPHCGALLTKRNMDRAWVAKYDNAIGETVRQAKQVPVLINYSVGKKRYEKAPDDFDIALIDKIEQLDIPYWFPTDPIPKGDKTGEPLRVGITHVHHFYTKRNLWVLGAYWRRLGRKEKWLATMLLSRNLVKSNRFIINKYNPKGRINGPLTGTWYIPSEQVEQSPIDLYKEKMLSCGWNILGNIVSSASAHFQILQKDSIDYIFTDPPFGANYMYSELNFIWEAWLQVQTNNKPEAIINSAQKKTLSEYQQIIAECFREFYRILKPDHWMTIEFHNSKNSVWNSIQEALQAAGFMIADVSTLDKVHGGIKAAFSANTVKQDLIISCYKPNEGLEERFKIEAGSEEGVWDFVRMHLKNLPVFISKDGKAEVIAERQDYLLFDRMVAFHVLRGVTVPLSAAEFYEGLAQRFPERDGMYFLPDQVVEYDKKRMKIKEVMQLELAVTDESSAIQWLKINLNRKPQTFQELHPQFIKEIGGWQKHEKPLELLEILEQNFLRYDGKGPIPAQIVSWMKQSADLRKIIQEELARGSSREENGQLYTENQELIKRAKDRWYVPDPNKASDLERLRERALLREFEEYRDSKQKRLRVFRLEAVRAGFKKAWQERDYATIISVARKIPESALQEDPKLLMWYDQARMRFGVE

SEQ ID NO: 3346 - protein, 881 aa, Bacteroides vulgatus
MSSKDISPRLFLDDEFEETKIVPDKVVCLGMEFPSEDARREYFRAELRKKLPELKQIEGFPIGEDDDIINLSDPPYYTACPNPWLNDFIEEWEKEKVELEKEGKRKANFEVKTPYAADVSEGKNNPIYMAHAYHTKVPHPAIMRYILHYTQPGDIVFDGFCGTGMTGVAAQLCGSENDVKALLKKGEKAEIGVRHSICSDLSPIASLIAATYNLKFDPKAFERKALRILEQVEKELGWMYETEVDGKKAKINYTIWSDVFVCPSCGNEIVLWDEAVDLDKEIMKDSFPCPHCGNTCSKKNMEKAWETSFDSLLNKTVTLNKKVPVRVNYTLSGKRGEKNIDAKDKNLIENTNLYKLNLNLYTNKLPFGEKTKAIKSSNHIEYLHHFFHLRNFILNNRVSDLSGKDIYLQSWLTSIIQNSSSMYKFRLDRKGGILNGTFFIPSLNIEQNPIKLLKSKITDFNRCFYETRGNSAISVNSATSLYNLPNSSVDYIFIDPPFGANIMYSELNSIWEGWLKVTTNNKEEAIINKEQKKSLFDYQSLMYKSFKEFYRVLKPGKWITIEFSNTSASVWNSIQNALQSVGFVVVNVAAIDKKQGSFNAVTTTTAVKQDLVITCYKPSDAIIEKFEKSEDKAKTAMDFIEELLVHLPVHLSKGESTTAVIERSPKILFDRLISYYVQKGYAIPMDAQEFQKQLKERFIERDGMFFTASQAIEYEQKKEKCSGFVPMALFISSEAEGIEWLKRELQNSQTYSDLQPEWMKNMLPPKKGDVLPELMSILEENFIKDEEGNWRNPDPEKAADLEIIRNRRMMKEFNMYLEQAQKPKAKRMKDTRLEVLRYGFKECYKQKNYQAIVTVGDHILESLLQEDEVLLQYYDIASSRV

SEQ ID NO: 3347 - protein, 860 aa, Caldicellulosiruptor kristjanssonii
MELTKEILDSVRNIEGFPIADDEDIIRLSDPPYYTACPNPFIKDFIERYGKKYDEEKDDYNVEPYTADISEGKNDPIYNAHSYHTKVPYKAIMRYILHYTKPGDIVFDGFCGSGMTGVAAAMCENPDPEFKIVLEKEFEQRGKKIEWGARRAILCDLSPAATFIAYNYNNPVDPEEFEKEAKRILEEVEKECGWMYETIHVDENGNPVKGIDGDVVKGKVNYTVWSDVFICPSCGQEIVFWDVAVDKENGEVLDSFNCPFCNALLKKTILERATVTVYDKALKEYIVQAKQVPVLINYSVNGKRFEKKPDKFDFELLQKIDEMDIPYWYPTDRMPEGDESRRNDKYGITHVHHFYTKRNLWVLSCLYEKISSLPKIKSLVNKLKYIFTSISILTTKMSRYGDRTGNVSGTLYIPSLIKDLNAIELTKRKLWGPKGIISPINSISKCFNNNSFSITTTNSSGNLNIIPSNSIDYIFIDPPYGDNLMYSELNFIWEAWLRVFTNNKTEAIINKVQRKGLHEYQELMEQCFKEMYRILKPGRWITVEFHNTKNAVWNAIQEAMLRAGFVIANVRALDKKQGSFKQVTTTTATKQDLIISAYKPKESFEKKFYLEVGTEEGVWEFVRQHLEKLPVVVENNGVLEYIPERQAYLLYDAMVAYHVQRGLSIPMGAAEFYKGLKERFIERDGMYFLPSQVPKYEEKRYRLELKEQVSFVIVDEKSAIQWIRNELEKQSQTYQELQPKFLKAKHEFKHEKLPELLQLLEENFLQDKDGKWYVPDVNKQSDLEKLRTKNLLREFEGYLNVKGKLKVFRTEAIRAGFKDLWQKKDYKTIVKVAEKLPESVLQEDSVLLMYYDNALTRLGE

SEQ ID NO: 3348 - protein, 1030 aa, Chloroflexus aggregans
MNDDTPMFDMEEQTTPHAPVECLGMTFDNDDARRVFFLDRLRAALEELHARLGGVPFTTVADAVERMKSLTHWPMGDDERLRELAEQMRKAHRSAPATDLLRLWKDAVGFPHGKIEDILNLSDPPYYTACPNPFIGDFIRSYGKPYDPQTDDYRREPFAADVSEGKNDPIYNAHSYHTKVPHKAIMRYILHYTEPGDVVFDGFCGTGMTGVAAQLCGDRTTVESLGYKVDDAGTIYRPEQDESGKTVWTPFSKLGARRAVLNDLSPAATFIAYNYNTPVDVRAFEREANRILKDVEAECGWMYATLATTNAHEAAMWAERLRACRTADDARALIASIPNRGTINYTVWSDVFVCPECTEEVVFWQAAVDHEAGKVRDAFPCPHCGAILTKRTMERAWVTTYDRALGQTIRQAKQVPVRITYRVGNTRYEKAPDAFDLALIAKIEELDIPYWFPTDRMPEGEESRRNDDIGLTHVHHFYTKRNLWVLGAAIYRALATNPRLGVWVTSTMIRTTKMYKYMPVLNNGQLTDRRTGTVSGTLYVPSMADENCPLDLLVSKIRDFTFSISRNINAATSTNSATDVNTGNITVDYIFTDPPFGGNLMYSELNFLWEAWLKVFTNNKPEAIENQTQGKGLAEYQRLMTACFKEYYRVLKPGRWMTVEFHNSKNAVWNAIQEALQAAGFVIADVRTLDKQQGSFKQVTSANAVKQDLIISCYKPNGGLEARFAHEAGTAAGVWDFVRTHLKHLPVFVAKDGKAEIIAERQNYLLYDRMVAFHVQRGVLVPLSAAEFYAGLARRFPERDGMYFLPDQVVEYDKKRLTIRELHQLTLFVTDEASAIRWLKQHLERKPQTFQELHPQFLKEIGGWQKHEKKIELRELLEQNFLRYDGQGPIPAQIVSWMKQSAELRKLIEEERATGRATEENGQLSTQSAVLIARAKDRWYVPDPHKAGDLEKLRERALLREFDAYCESGERRLKEFRLEAIRAGFRKAWQERDYDTIIAVARKIPENVLQEDPKLVMWYDQAITRSGEQG

SEQ ID NO: 3349 - protein, 416 aa, Chloroflexus aggregans
MRDNTIQQRPEFTFRENHKNGRHGWVRLTPAYSVTLVTDILNRERGAFRILDPFAGTGTTVLCAAEQGMYGVGIDINPFLVWLGNAKLRRYTLAEIAEFEHTVCRIISALRSEGPSVPPPPIHNVARWWSPPALDFLCRLKYEIDTRINKAQAISDLWYITFCRVLIMIARVAFNHQSMSFQDESFRQGYLFVGEDQYITILSEVAHLVSRSAMSNPSGTGTIMLGDSRMLVCLADEERFDLVITSPPYVNRMSYIRELRPYMYWLGYITAAREAGELDWQTIGGTWGVATSRLAEWRLASDTFLPRDLHDTIKRIRSAEHKHSFLMAQYVAKYFEDMWMHVKAVKRWVQPGGHLYYIIGNAKFYDVVVPVERVLADMMLESGYEQVSIETVRKRNSKKELFEYIVSARKPKEDDR

SEQ ID NO: 3350 - protein, 934 aa, Desulfovibrio aespoeensis
MSDNMLFDLDSEEKKSGPVKCLGREFENDEARRAHFIEELRKKLQDPEFRKIEGFPNGSDEDILNLSDPPYYTACPNPWIGHFIAEWEALKPKKPDNYSYHREPFAADVSEGKYDPIYKYHPYPTKVPHKAIMRYILHYTKPGDIVFDGFCGTGMTGVAAQMCGDRDAVISLGYQVKQDGSILREEIDETGIKTWVPFSQIGIRRVVLNDLSPAGTFVTYNYNTPINISSFEKTANRILKEIENECSWMYTTKHSDGRLGTINYTVWSDVFVCQECSGEVVFWNAAVDKEAGKVRDEFSCPHCSSSLTKRSLDRAWITFFDPIINQTQKQAKQVPVLINYSVGSSRHEKVPDQYDIDTLKKLEDLKVPYWFPSERMIFGKETRRNDPAGLTHIHHFYSKRNLYALAKLKSLSPSAKFNLLITKVSFQITKLYRFTYQSGVWGAGGGPLSGTLYVPSLVKELNIIKQIKDALKQRRGISHPATYGSFVGSTQSSSWLPSIPDNSLSYIFIDPPFGANLYYSELAFLWETWLRILTNNKEEAIENDAQGKGLDDYRLLMQKCFSEAYRALKPGRWMTIEFSNTKASVWNSIQTALLEAGFLVANVSALDKKKGSFKAVTTPTAVKQDLVISAYKPNGGFEERFSSEANTEDGVWDFVRTHLKYLPVIKKQAGELIIIPERDPRILFDQMVAYYVRKGYPVPISSQEFQLGLRQRFAERDGMFFLPEQAAEYDKKRLTVERLVQRSLFVFDESSAIEWLRSLLREKPQTFQDLHPQFLKEIGGWSKNEKALELSTLLEQNFLRFDGRGEVPSQIHSYLSTNWPELRNRPKDDPALVMKARDRWYVPDPNKAGDLEKLREKALLKEFEEYKQVKKKLKVFRLEAVRAGFKSLWQLRTPEAYKAIIEVAEKIPSNVLEEDPKLLMWYDQAITRSGGEIS

SEQ ID NO: 3351 - protein, 929 aa, Dichelobacter nodosus
MKETSLFDSLLEEPQKPSGPVTCLGMTFENDEARRAHFIEELRKKLQDPEFRKIEGFPIGSDEDILNLSDPPYYTACPNPWIADFIAEWDEQKPKQPEGHHYHREPFAADVSEGKNDPIYNAHSYHTKVPHKAIMRYILHYTQPGDIVFDGFCGTGMTGVAAQMCGDREVVMSLGYQVKSDGTILQEEIDENGKKVWKQFSKLGSRRAVLNDLSPAATFIAYNYNTPVDVAAFEKEAKHILKEVEKECGWMYETLHTDGKTKGKINYTVWSDVFLCPECTKEVVFWDVAVEKGKGIVHDKFPCPHCGSLLLKRSLKRAWETVFDEAFGDTIRQAKQTPVLINYTAGGKRAEKIPDPSDIALIEKINNSHIPYWFPVAELQDGFNTRQPKGSHGITHTHHFYTRRNLWILASLWSKASPKMRFGLTNFLSRNLTKMNRFVVNRHNPNGRINGPMTGTLYIPSEQVEQTATLLFKDKWIKHGWNTCGNLITTQSFSSIEASVTNSLDYIFIDPPFGANINYSELNSLWESWLSVKTDQKPEAVENDVQNKSLNDYRDLMLGCFRKAYELLKPGRWMTVEFSNTRAAVWNNIQTSIADAGFIVANVSVLDKKHGGIKAMAYSTAVKQDLVISAYKPNGGFEERFQKEAQTEEGIWDFVRTHLKYLPVTKQQGALLQFVPERDPRILFDQMVAYFVRKGYPVPISSQEFQIGLAQRFIERDGMFFLPDQVAEYDRKKMTSGELKQMSMFVSDEASAIQWLRQLIKEKPQTFSDINPQFMQQLGGWSKNEAQLDLRELLNQNFLSYDGKGPVPEQIHAYLSTNWKELRNLPKDDPTLVAKARDRWYVPDPNKAGDLEKLREKALLKEFEEYKAAKKKLKVFRQEAVRAGFKKAWQERDYTVIVAVADKIPNNVLEEDPKLLMWYDQAVTRMGGE

SEQ ID NO: 3352 - protein, 823 aa, Methanocaldococcus sp.
MEDNIIKDIEKVKNIEGFPLGDIEDIVEISNPPEFTLYPNPYIEDFIKEFGKSYDAENDDYQKTPYVSDVSEGKNDPIYNAHTYHTKVPYKAIMKFIKHYTEPGDIVFDGFCGSGMTGVAALMTGRHAILNDLSPVATFIAYNFTHPVNPKEFKKMAEQILKEVEEECGWMYKTKHDDGREGVINYVVWSDVFRCPNCGAELVFWDIAVDFEKNKVKKEFICPSCEIKLDKRKLERVFVKKYDSALGKEIEQAKQVPVLINYKVREGKKWKTYEKTPDDEDLKLIEEIEKRNIPYWYPTYRMPEGYNTEQPKKSHGVTHVHHFYTKRNLWCLASFYDKIRKIEDKNLKYALIFWFTSALLRTTKMYRWNPKRPTGFLSGTLYIPSIGYEFNIIYMMNYRIDRLCKYLNSYPKINNKIYITTQSSTDLRNIPDNSIDYIFVDPPFGDNLMYSELNFIWESWLRVFTNNKPEAIINETQNKDVYEYKELMYQCFKEMYRILKPNRWITIEFHNSKAKVWNAIQEALSKAGFIIAMVSTLDKKQKTFKQITGTTSVATDLIINAYKPKKEFEERFLKSKGKGFEKEFVEEHLQHLPLEPNIERTDKVLYSRMLAYYVQHGYEITMDSEEFYEMLKENFINIDGYWYTIEQADKLRKEQENKLGELLAKKKQLTLFITNEEDALLWLWNFLKEPKTYSEIYTNYTKFLGNTEEDIPELEELLRQNFIEENGKWRRPTEEEKKSLEKKKRDKLLREFNKLLEDIKAGKIKAKIKNVKKSVIVEGFKELYKKKCYEDIILVAEKLPTKLVEEDEDISMFVDIAYSKLED

SEQ ID NO: 3353 - protein, 934 aa, Methanosalsum zhilinae
MTDTTLFDNFSEGSNNSPKQVTCLGMTFKNEEERRNYFTEKLREKLQDPEFRKIEGFPIGSDEDILHLSDPPYYTACPNPWITDFINEWEAEKPEKSADYKYHREPFAADVSEGKNDPIYNAHSYHTKVPHKAIMRYILHYTEPGDIVFDGFCGTGMTGVAAQMCGDRKTVESLGYQVKPDGTILQQKTGDDGKTRWVPFSQLGVRRAVLNDLSPAATFIAYNYNTPMDVKAFEKEATRILKEVEEECGWMYETKHTDGKMGRINYTVWSDVYVCPECANEVIFWEAALDREGGKVNDVFPCPYCSANLTKRNMERAWVTKYDSAIKENVKQAKQVPVLINYSVDKKRFEKIPDQFDLKLIENIVNAEIPYHFPSTKLPNGYNTRQPKTSHGITHVHQFYTKRNLWVLSSVLKKLRDKNPRYTAWYTSTMSWVGRELRLHLGNYFGGGGGVITSLRGTLYVASLSVETNVLERLALRVRWQAFRSNLKEGECISETCSAAAASVSKECYDYIFLDPPFGSNLNYSELNSLLESWLGILTDNTPEAIQNNVQNKGLNEYRLLMTNCFKTAYNLLKPGRWMTVEFSNTKASVWNSIQTALTDAGFIVANISALDKKKGSFKACTTPTAVKQDLVISAYKPNGGFEERFKNEAATEEGVWDFVRTHLEYLAVTKYQGALLQLIPERDPRILFDQMVAYYVRKGYPVPISSQEFQIGLGQRFIERDGMYFLPEQAAEYDRKKLTSGQLVQTKLFVSDEASAIQWLRQLLKVKPQTFQDINPQFMQELGGWSKNEQELDLRELLNQNFLSYNGIGDVPSQIHSYLSTNWPEMRNRQKNDSGLMTKAKDRWYVPDPNKAGDLEKLREKSLLKEFEEYRQSTKKLKVFRMEAVRAGFKKAWQERDYSTIIKVADLIPNKVLEEDPKLLMWYDQAVTRVGGI

SEQ ID NO: 3354 - protein, 386 aa, Methanosalsum zhilinae
MAQNNFPGNDLSFPLNKLPNKSNSYLRLNTICPYFTMFPLDYPFEVLKYAKSNDKVLDPFCGRGTTNFAARLRGLSSVGIDASPIASAIAISKFTNTTPEQIISLCQEILTDSDKPENVPEGPFWTLCYHSSTLNQICKLRESFSEECNTDTSIALRALTLGILHGPLGKTVDSYLSNQMPRTYASKPNYSVKYWEERGLLPKNIDLLEVVKRRAKYSLSSLPPYVDGGILKEDSRNPIKNSSLPLEEFDWVITSPPYYNMNTYIPDQWIRNWFLGGNDKVEYSYSKQVSHSSKKKFSSELAKVWKSVADICNPNANLMIRFGSLPSSPCNPSELLEESLEEANCGWEINNIKSAGTAENGRRQSEQCVKNLGKAIEEIDLHAILR

SEQ ID NO: 3355 - protein, 731 aa, Methylacidiphilum infernorum
MRIMTLVQCASQKHRVVQEDVACSRFHGFPDTTLLESGALPIAEIAELAMREGQCTNPLYRVHRWFARRLGSQFRSILTGLSLDADEENRFWDTFLGEVPLDGAVVLDPFVGGGTSLVEAMRCGAHVIGYDIDPIATFITRFELEAATYDPESEEIAELCVSIAAQLAPFHRTKFNGREHEVLHHFWVECRTCRSCGSTFEIHPHFQLASSKEKGLQWAFCKECHEIHELPIERKEIRCRCGTRTRIAQGTLNRGKVRCPACGDTAGLAYRGNSPKPPMWHLFAQEYIERNPGGVTRHFKKATKGDRIRYGKASRLLKEIESSEGPFAPIREIPTDGRSDQRPIIHGFRRYRDLFNDRQLLHLTLLGKAIAAVDEPRVRRVLAMAFSEHLTTNCMYTAYAFGYRRLSPMFSIHSYRHITRPVEINPWLDCIGRGTFPNTLSKITKAVAFAKAPTELDPKGGRVPSKAGKHVYASKVSDNPWQILTGSSRASIRTKTSEDLSEIPDGTIDLILTDPPYFDNLSYSELSDFYLAWHQSLGEAEPPFDDPHLAAPIGENLALTSRDDESIAVYRERLRRIFSECQRVLKRNGVFVFTYHHKHIAAWNAVGEVLARSGFRCTAVLPLRGEGQGGLHSYDGTIKWDAVFVCRKDAQAPDRESCPVVVPRSAIADARRRADAYAKELGDKKRIGFREPDRLNLERAMVVASAVLGKADDESMPLHTALHRTRERGGN

SEQ ID NO: 3356 - protein, 964 aa, Methylacidiphilum infernorum
MCMAHRLCSTCPDYGIGDSDHSWKTSPYDSPRRVHRLRFITPNTQGTGRKCMKCSKQQLFPSIDEGEKPVECLGLTFPNEKVRREFFLDKLRQKLQDPKFRQFPGFPDASDEDILALSDPPYYTACPNPFIEDFIRHYGKPYEPGSSYSKEPLAVDVTEGKNDPLYRLPAYHTKVPPKAIQHYLLHYTEPGDIVLDAFCGTGMTGVACLLLEHPDHELAATMDTDSKWGKRHAILIDLSPAATFIASVMNAPLPPKLAEGPDGDLGQIIQRDIIPLYLTDWDGKEVSFNYAVWSDWGECPECGHIFRLYDIVIDYKHHRMLPEYNCPNCGFTIRSDRQKKAFTTEFDPWLNRPTKIAKTTMVLVSMKIGNRTIRREATHADTQLAASVGENHVLITPTELPYSHMTHERNNLPEYWGITHIHHFYTRRNYLALARVATIGNQDLKRAALFAVLTILENNATRRNRFYVDARRPQGSPVGPLSNTLYVPTLQVETNIGIKLLSMLKQIAKLRNKWVIGRSFVSTQSATQLFQIPDNSVDFIFTDPPFGGNINYSEQNYLAEWWLRVFTNKINEAITNPAQKKGLFEYQQIMTRCFCEYYRVLKPGRWMVMVFHNSSNAIWAAIQQALEAAGFVVATVAVLDKVHSTLHQDHKAAAVDKDLAITVYKPNGGLEERFKLIAGTKEGVWYFIRMHLKQLPVFVSKDGKAEVIAERQNYLLFDRMVAFHVQRGVTVPLSVAEFYAGLAKCFPERDGMYFLPEQAAEYDKKRMKVKEVLHLQLFVTDEASAIQWLKQQLTRKPQTFQELHPQFLKEIGGWQKHEKPLELSELLEQNFLRYDGKGEVPSQIHSYLSSNFKELRNLPKDHERLRAKAKDRWYIPDPNKAVDLEKLRERALLHEFEEYRQSKQKCLKVFRLEAVRAGFKKAWQEHDYATIIAVARKIPDNVLQEDTKLLMWYDQAVTRMGGEV

SEQ ID NO: 3357 - protein, 852 aa, Moorella thermoacetica
MDYETGSLFEAKNDPKLEPEDDFARSCPPLSELLDTVRHVEGFPLGRDEDILALSDPPYYTACPNPYLGEFIRRYGKPYDEATDTYQRPPLVADVTEGKNDPVYNAHSYHTKVPHKAIMKYIEHYTEPGDIVFDGFCGSGMTGVAAQLLGRRAILCDLSPAATFIAYNYNTPVDVAAFEREAKRILAEVEKECGWMYETLHTDGRTNGRINYTVWSDVFICPYCGSEYVFWEAAVDKERGKVLNEYPCPSCGAKVAKRECKRAWVAFYDQVIGQEVTQAKQVPVLINYTVGKKRYEKKPDQYDLDLIRRIEESAIPYWFPTDRMLEGDKTVEPIRLGITHVHHFYTKRNLWVLAALNSKISAAKGTGVAAVLRFLISSYNHTHSTKMTRIIFKDTGKPVLTSCQSGTLYISSLPVEKNILQGLTKMKLALISRALKALSYEQAITTSSSTGFSLISIYNNCIDYIFTDPPFGSNLMYSELNFLWEAWLRVFTNNRPEAIINETQGKGLPEYKELMTACFKEMYRLLKPNRWMTVVFHNSRAAVWNAIQEAITRAGFVIAQVTVMDRKQGSFNQVTAAGAVEKDLIINAYKPKKQMEENFLRRAGAGLERDFVADLLEHLPVVPNVGRTEKMLYSKLLAYYVQRGFEIRLDARQFYVLLKENFKLIDGYWFTDEQVLQYEEWKRKQRLDGIKEVQSGQQIFFVSDERSALAWLYNFLETPRTYTDIYTAYSRALVQSDDAIPELKELLDNNFILENGRYRRPQTEQEREAIEAQRERELGRAFERLLAEARSGVKRLKGVRKEALIFGFTKAYREKRYQDILAVARKLDQDFLETNGEINDFVEIARLKTGEE

SEQ ID NO: 3358 - protein, 947 aa, Nitrosococcus oceani
MKPKQESLFQTRLVPAEAGSGRLFDEELVAGSDGPVKCLGLEFENDEARRTHFTEELRKKLQDPEFRKIEGFPIGSDEDILNLSDPPYYTACPNPWIADFITEWEAQKPEQPEGYHYHREPFAADVSEGKNDPIYNAHSYHTKVPHKAIMRYILHYTEPGDIVFDGFCGTGMTGVAAQMCGDREVVMSLGYQLKPDGTILQEEMDEDGKKVWRPFSKLGVRRAVLNDLSPAATFLAHNYNLYVDTASFENEAKKFIKIIERECGWMYETTHTDGVTKAKVNYTIWSDVFVCPDCTNEIVFWDVAVDKESETVNDEFQCPNCQTSLTKRNMDRAWVTTYDRFLGETIRQAKQIPALINYSVGGKRYEKKPDEGDFAILEKIENEGLDGWFPINRMIEGHESRRNDPVGITHTHHFYSPRNLSVMSKILDLADKSEFTPFKFGFLNTSWHATQMRQYNPGGGHRPRTGTLYMPSIHSEGNMIPVYKKKLNQLVQFYKVKSHRNRVAIIQTMSSTVESSIEAGLDYVFIDPPFGANLNYSELNSIWEAWLKVSTNNAEEAIENRSQNKGIDEYRSLMTQCFRQAYNQLKPGRWMTVEFSNTSAGIWNNIQTAISDAGFIVANVSVLNKKQGSIMAYTTPTAVKQDLVISAYKPNGGFEERFQKEAQTEEGVWDFVRTHLKYLPVTKQQGALLQFVPERDPRILFDQMVAYYVRKGYPVPISSQEFQIGLSQRFIERDGMFFLPDQVAEYDRKKMTSGELKQMSMFVSDEASAIQWLHQLIKEKPQTFSDINPQFMQQLGGWSKNEAQLDLRELLNQNFLSYDGKGPVPEQIHAYLSTNWKELRNLPKDDPTLVAKARDRWYVPDPNKAGDLEKLREKALLKEFEEYKEVKKKLKVFRLEAVRAGFKKAWQERDYAVIVAVADKIPNNVLEEDPKLLMWYDQAVTRMGGGD

SEQ ID NO: 3359 - protein, 906 aa, Nitrosococcus watsonii
MKQDELFNSEHRTQNTEPQPVTCLGIEFPSDEARRQHFTELLRDRLRNPEFRKIEGFPIGSDEDILNLSDPPYYTACPNPWMADFIAEWEAQKPEQPEGHHYHREPFAADVSEGKNDPIYRIPSYHTKVPPKAIENYILHYTEPGDIVLDAFCGTGMTGVASLLCKPAKRNAILIDLSPTATFTASIMNSPILNDLSKGQKGRLGEFVTKKLLPLYQTEWDGKKQPFDYAIWSDWGECSECAETFRLFDVVIDFQNSKMRPEYECPKCGAALRSDSQKKAFSTDFDPWLNKPVRIAKNTMVMLSKKVGNRAIRRTVTDKDKLLANEIGNRPVDQTPMELPYSHMTHERNNLPEYWGITHIHHFYTRRNYYAISRVAAIDDQVLRKAGLFAVITSLENNATRRNRFYVDSRRPNGSPVGPLSNTLYVPTVQVETNIGMKILSVLRDTSKNKSGWPRGRSLVSTQSATQLNNIPDNSVDFVFTDPPFGGNINYSEQNILAEWWLRLFTNNESEAITNSVQKKGLPEYQALMTQCFKEYYRVLKPGRWMVVEFHNSSNGIWSAIQQALEASGFVVATVAVLDKIHSTLHQDHKAAAVDKDLAITVYKPNGGLEHRFEMSAGSADGAWDFIRTHLDQLPVFMSKDGQAEVIAERQNYLLFDRMVAFHVQRGATVPLSAAEFYAGLSQRYSERDGMFFTPEQVAEYDRKRMTVREVLQLQLFVTDESSAIQWLKQQLSKRTQTFQELHPQFLKEIGGWQKHEKSLELSVLLEQNFLRYDGKSPVPEQIHAYLSTNWKELRNLPKDDPTLVAKARDRWYVPDPNKAGDLEKLREKALLKEFEEYKEVKKKLKVFRLEAVRAGFKKAWQERDYAVIVAVADKIPNNVLEEDPKLLMWYDQAVTRIGDREGYSV

SEQ ID NO: 3360 - protein, 920 aa, Parvibaculum lavamentivorans
MNDLLQNHHSGTSGPVECLGQTFASDDARRAHFLTLLAEKLQDPTFRKQEGFPKGSDAAILAMSDPPYYTACPNPWLAEFVAHYGKPYDPAVKYSREPLAIDVSVGKTDAIYKAHSYHTKVPHLAIVPSILHYTQPGDVVLDGFAGSGMTGVAAQWCGTAPASYRHDLELTWKKEGRTAPKWGARRAVLNDLSPAATFIATNNNQPFDVIGFAKAAETLLHDAEREIGWMYKTKHTDGTEAHIAYVVWSEVFICRSCSGETVFFNAAYDPVANKVRDKVTCSHCGAESSKENMDLKFESFMDAPHNRVDKRPERVPVLIKYSIGRSSFTKTPDQNDLAILDKIYKLSIPQNLPTVELPDCQMTRVGRMRTTNTGSIHHMYLPRAGYALSYLWEKANNLTDGRLRNEIKYWLDSQFTNLSILNRYRPEVSFPYNPLSGVFYVPSLISEADPFTAYKNKIKRLTSAFSVSRAQENMSMTSCGSTTKLPLNNESIDYIFTDPPFGENIYYADLNILVESWHRVLTDASPEAIVDRVREKGIPEYQHLMRACFSEYHRVLKPGRWMTVVFSNSRASVWNAIQVALQQVGFVVAEVTALDKVQGSFQQVTSPNVVKQDLVISAYKPNGGLEDRFVKSGATVDSAWDFVQTHLRHLSVTKVKDAELEFIVERDPRRIYDRLVAWFVRHDAPVPLSSDEFLSGLRNRFPERDGMVFLPEQVTEYDKKRAQTAQAPQMELFVSDERSAIDWVADFLRARPSTYQDIHPEFIRQLGAGWKKHETRPELSALLEANFLRFDGAGEVPSQIHRYLSTNYHDLRGLEKIDPRLNARAQDRWYVPDPNKAQDLEKKREKALLKEFETYKAFTGRKIKESRLEVLRAGFNAAWAVKDYATILGIAHKLPEATLQEDERLLTLYDMALTRTEDGA

SEQ ID NO: 3361 - protein, 920 aa, Parvibaculum lavamentivorans; identical to SEQ ID NO: 3360

SEQ ID NO: 3362 - protein, 950 aa, Planctomyces brasiliensis
MAKKAKKQQKERLFEEKLVPSKKGSGELFDVSYGDDDGKPVECLGMTFENDTARREYFTEKLREKLQDAEFRKIEGFPVGEVDDILAMSDPPYYTACPNPFLDDFIAHCGTTYDSSTEYHREPFTADVSEGKTDALYTAHAYHTKVPHKAIMRYLLHYTMPGDIVLDGFCGTGMTGVAAQMCGDKQEIESLGYSVSANGEVCDNSDSEDVVSRLGPRRAILGDLSPAATFIAANLGRWVDAKAFRAEADRILNEIEDELGWMYETLHSDGKSKGRIEYTVWSDVFACGECGEEIVFVKEALDRDKGSIRKTFPCPGCGAESNKNGLELIYESKLDKALGTPLSHPKRVPVFIVYSHKGTRYEKEPDDADHKVLRKIDELPFPSGLPTLELPDMQMRRVGRMQPSKITHIHHFFLPRSATWLAAAWNKAEHVTDARMRATLLFFVEQAIWTASLLNRFRPTGYSQVNQYLTGVFYAPSQHAECSPWYILSGKAKRLTKLFEEFRPQSNSRMVTTQDLAHIRIPDNSVDYVFTDPPFGENIYYSDLNILIESWHGVQTAPEQEAIVDRVKEKSLLDYQRMMSDCFVNYYRMLKPGRWMTVEFHNSQNRVWNAIQEGLQHAGFVVADVRTLDKKQGSFQQVVSGNTVKRDLIISAYKPNGGLEERFEGTAGTEQGVWDFVSSHLRQLPVFVMKGKKAEPVAERQNHLLFDRMVAFHVQRGVSVPLSSAEFHSGLIQRYPERDGMCFLPEQVAEYDKRRMQAEEVVQLELFVSDEASAVNWVRQQLGRKPQSFGELQPQFMQEEAGWEKYEKRLELSELLEQNFLCYDGKGEVPSQIHSYLSTNFHDLRGLEKDAPKLISKAKHRWYVPDHRKEADLEKIRHRALMKEFEEYQDAKGKLKIVRTEALRAGFKQCWQDGDYQGIVDMAKKVKDDIIQEDPALLMYYDNASMRTGD

SEQ ID NO: 3363 - protein, 879 aa, Syntrophothermus lipocalidus
MAQEEQLFMDIPEGNEEGQQKQKRRRFGLTKERLDRVRQIEGFPIAKDEDIINLSDPPYYTACPNPFIEDFIKEHGKPYDPDNDDYRRQPFAADVSEGKNDPIYNAHSYHTKVPHRAIMRYILHYTEPGDIVFDGFCGTGMTGVAASLCGDRKAVESLGYRVLDDGTILDEKGRPFSKLGARKAILIDLSPAATFIAYNYNTPVDVQAFEREARRILEEVERECGWMYETQHVVGGKVQKGAKGSPIMGKINYTVWSDVFICPHCSAELVFWEVAVDKEEGKVRDEFPCPHCGADLTKRTLERATERVYDRDIGQTVTRARQVPVLINYSVGNKRYEKKPDEYDLDLIRKIEESEIPYWYPTDRMPEGYNTEQPKVSHGITHVHHFYTRRNLWVLALVLNMAKALPLKLLLIWLTSSLIRTTKMYKFTLDRKMGTVSGTLYIPSLWTENSPLKLLKYKLLDFCKVRYPEKGYVLVETTSATNTSIPKNYIDYIFTDPPFGGNLMYSELNFLWEAWLRVFTNNKPEAVENKAQGKGPREYQELMEKCFAEYYRVLKPGRWMTVVFHNSQNRIWNAIQEAIMRAGFVIADVRTLDKKQGTFKQVTSTTAVKQDLVISAYKPNGGLEKRFHLEAGTEEGVWDFVRTHLKQLPVFVEKNGKAEVIAERQNFLLYDRMVAFHVQRGVAVPMGAAEFYAGLKQRFPERDGMYFLPDQVNEYDKKRLSVREFEQLSLFVIDEKSAIQWLRSELEKKPQTYQEIHPKFLRELHKARHEKLPELSELLEQNFLKDDYGRWYVPDPGRQSDLEKMREKALLKEFEEYKEGRGRLKVFRTEALRAGFKACWAAKDYKTIVEVARRIPDTVLQEDTTLLMYYDNALMRLDE

SEQ ID NO: 3364 - protein, 849 aa, Tepidanaerobacter acetatoxydans
MKLTKEILDKVRNIEGFPLGKDEDIIALSDPPYYTACPNPFIGEFIEKYGTSYDESTDEYNVEPYTADVSEGKNDPIYNAHSYHTKVPHKAIMRYILHYTKPGDIVFDGFCGTGMTGVAAAMCENPDEDFKIKLEQEARQDGKTIEWGARRAVLCDLSPAATFIAYNYNTPVDVEEFEKEAKRILQEVEDECGWMYETNHTINGTSQLSIDGKPIKGRINYTVWSDVFLCPNCMEEMIFWNIAVNKKTGKVMDKFHCPHCGLLTDKRNVEKAKTTIYDKALGKMIEQVKQVPVMINYSVGRKRFEKTPDEEDLKLLQKIEEMDIPYWYPTDRMPEGDESRRNDIAGITHIHHFYTKRNLWMLSAICDKAKENLRSLVAFQSICATLSSKLSRYNLGRRGNGPISGTLYVASLLAEANILNTFDGKIRDFSKAFSIICKKPLSIINCSSSTDLKNIPSNSIDYIFTDPPFGANLMYSELNFLWEAWLKVFTNNESEAIINKTQGKGLVEYQRIMERCFKEMHRILKPGRWMTVEFHNSKNSVWNAIQEAIMRAGFVVANVRSLNKQQGSFKQVTTTMAVKQDLIISAYKPKDRFVQDFVRQAGTEEGVWNFVRQHLERLPVTLESGGRLDVIPERQNYLLYDSMVAYHIQRGATVPMGAADFYQGLKQRFPERDGMYFLPDQVSKYEQKRMELELNEQLSFLILDEKTAIQWLRQELSKGPKTYQDIQPKFLQELKQLRHENMPELGDLLQESFLQDEKGRWYVPDTSKQSDLEKLRERRLLKDFEEYKTGRGKLRYFRTEAVRAGFKDCWSKKDYNTIVKIGERLPESVLQEDTTLLMYYDNALTRLGD

SEQ ID NO: 3365 - protein, 849 aa, Tepidanaerobacter acetatoxydans; identical to SEQ ID NO: 3364

SEQ ID NO: 3366 - protein, 1068 aa, Thermanaerovibrio acidaminovorans
MFDSERPVTRDSGPVTCFGMTFENDEARREHFLRLLRAGLQELREKLGVPFVSFEDTYARLKSLQYWPIGTEEQIRDLARRIARAASSTRDSRPATRDILGLYKDEVGFPHGSIEDILSLSDPPYYTACPNPFIADFLKHYGKPYDPNVPYSKEPFAADVSEGKNDPIYNAHSYHTKVPHKAIMRYILHYTEPGDVVFDGFCGTGMTGVAAQLCGDRKTVESLGYKVDEQGFIYQQETDENGKTVWKPFSKLGARRAILNDLSPAATFIAYNYNTPVDVKAFEREAKRILKEVEEECAWMYATLSRGVPGSGLSVPSDDRFVELANRIRKAKTIDEIRQIFAELGTRNQKLGTVDFALGKINYAVWSDVFVCPECTQEVIFWEVAVDKEAGKVHDQFPCPHCGAQLTKRTMDRTWVTKYDKAIGQTIRQAKQVPVLINYSVGNRRYEKAPDAFDLALIEKIEQLEIPYWFPTDRMPEGYNTEQPKVSHGLTHVHHFYTKRNLWALGALYETAGRSPIELRDIAKFFVQYACLGFSKISRYVPTHYSQVNRYLSGTLYVGSQQVEVSPVYILKAKADRMAKRELKRPYAGAFVLSTSDATSSIEHRESVDYIFTDPPFGGNLMYSELNFLWEAWLKVFTNNKPEAITNETQGKGLPEYQRLMTECFKEYYRVLKPGRWMTVEFHNSKNSVWNAIQEALQTAGFVVADVRTLDKKQGSFKQVTSASAVKQDLIISCYKPNGGLEERFKLEAGTEEGVWDFVRTHLRQLPVAVVTGRGSKVAGQDDSGLGTQDSRLEIVAERQNYLLFDRMVAFHVQRGVTVPLSAAEFYAGLAQRFPERDGMYFLPEQVAEYDKKRMKVKEVLQLQLFVTDEASAIQWLKASLTKKPQTFQELHPQFLKEIGGWQKHEKPLELSELLEQNFLRYDGKGPIPAQIVAWMKQSENLRKIIQEELAAGGATEENGQLETRNQELITRAKARWYVPDPNKAGDLEKLRERALLREFEEYRESKQKRLKVFRLEAVRAGFKKAWAERDYATIIAVARKIPENVLQEDPKLLMWYDQALTRSGEDR

SEQ ID NO: 3367 - protein, 845 aa, Thermoanaerobacter brockii
MKLTKEMLDKVRDIEGFPIGKDEDIIELSDPPYYTACPNPFISEFIEKYGKPYVEEKDDYNCEPYTADVSEGKNDPIYNAHSYHTKVPHKAIMRYILHYTKPGDIVFDGFCGTGMTGVAAQMCGNPDPEFKAKVENEFKKEGKKVEWGARRAILGDLSPAATFIAYNYNTPVDVEEFKKEAERILKEVEKECGWMYKTIHTVEGVPQRDVEGNVIKGKINYTVWSDVFICPNCSNEIVFWDAAVDKEDGKVLDEFKCPHCGAKLTKTSLERAWRTVYDKAIGETIKQAKQVPVLINYTVGKQRYEKEPDKFDLELIQKIEEMDIPYWYPTDRMPEGEESRRNDKIGITHVHHFYTKRNLWVLSALYNYKIMPKFYWIINSVQNYINKKQSFKGGGGGVTGTLYIPSLVEEKNVLNVLKRKLDKIGLIRGILANFKNVNYITTQSTVSLKQFSDNSIDYIFTDPPFGDNLMYSELNFLWEAWLKVFTNNKTEAIINKVQRKGLHEYQELMEKAFSEMYRILKPGRWMTVEFHNSKNAVWNAIQEAILKAGFVIANVRTLDKKQGSFKQVTTTTAVKQDLIISAYKPKEGFIKRFLKEAGTEEGVWDFIRQHLEKLPVVIETNGKLDIIPERQEYLLYDSMIAFHIQKGASIPMSAAEFYEGLKKRFIERDGMYFLPDQAAIYDTKRLKLELNEQLAFIIQDEKTAIQWLKYKLLNKPMTYQEIQPMFLEELKQLRYEKLPELLDLLQENFLQDEAGRWYVPDANKQADLEKLREKRLLKEFEEYKNVTGRLKVFRTEAIRAGFKNCWKNKDYETIVKIGEKLPENVLQEDQTLLMYYDNAVTRLGG

SEQ ID NO: 3368 - protein, 853 aa, Thermoanaerobacter italicus
MKLTKEMLDKVRNIEGFPIGKDEDIIELSDPPHYTACPNPFISEFIEKYGKPYEEEKDDYNCEPYTADVSEGKNDPIYNAHSYHTKVPHKAIMRYILHYTKPGDIVFDGFCGTGMTGVAAQMCGNPDPEFKLKVEKEFGKEGKKVDWGARRAILGDLSPAATFIAYNYNTPVDVEEFKKEAERILKEVEKECEWMYKTIHTVEGVPQRDVEGNVIKGKINYTVWSDVFICPNCSNEIVFWDAAVDKEDGKVLDEFKCPHCGAKLTKTSLERAWRTVYDKAIGETIKQAKQVPVLINYTVGKQRYEKEPDKFDLELIQKIEEMDIPYWYPTDRMPEGEESRRNDKIGITHVHHFYTKRNLYVLSALYGRIKHENLFYYIFKFMFTAIVPMSTKMSRYGKRTGNVSGTLYIPSLIKELNILEYLKRKLWGAKGLLKPLQKFRNYSRNNCYIYTNSTTLVLIKSNSIDYIFTDPPFGDNLMYSELNFLWEAWLKVFTNNKTEAIINKVQRKGLHEYQELMEKAFSEMYRILKPGRWMTVEFHNSKNAVWNAIQEAILKAGFVIANVRTLDKKQGSFKQVTTTTAVKQDLIISAYKPKEGFIKRFLKEAGTEEGVWDFIRQHLEKLPVVIETNGKLDIIPERQEYLLYDSMIAFHIQKGATIPMSAAEFYEGLKKRFIERDGMYFLPDQAAIYDTKRLKLELNEQLAFIIQDEKTAIQWLKYKLLNKPMTYQEIQPMFLEELKQLRYEKLPELLDLLQENFLQDEAGRWYVPDANKQADLEKLREKRLLKEFEEYKNVPGRLKVFRTEAIRAGFKNCWKNKDYETIVKIGEKLPENVLQEDQTLLMYYDNAVTRLGG

SEQ ID NO: 3369 - protein, 845 aa, Thermoanaerobacter pseudethanolicus; identical to SEQ ID NO: 3367

SEQ ID NO: 3370 - protein, 848 aa, Thermoanaerobacterium saccharolyticum
MKLTKEMLDSVRNIDGFPIGSDEDIIELSDPPHYTACPNPFINDFIEKYGKPYDEETDDYKCEPYAADVSEGKNDPIYNAHSYHTKVPHKAIMRYILHYTKPGDIVFDGFCGTGMTGVAAQMCGNPDPEFKFKVEKESEKEGKKVEWGARRAILGDLSPAATFIAYNYNTPVDTAEFEKEAKRILDEVENECGWMYETIHTIDGVPQKYIDGSVIKGRINYTVWSDVFVCPNCSNEIVFWDAAVNKEDGKVMDEFKCPHCGAAVNKKDLDRAWKTVYDKALDKVINQVKQVPVLINYTVDNKRYEKKPDEFDMELIEKIEEMDIPYWYPTDELPNGYNTEQPKKSHGITHVHHFYTKRNLWVLSAIYDRIKMKKNIFYWLLTSVSEGSSKLNRERPNGLPSKLSGTLYVSSMIHEINNIDFIYRKIMKRILNKELSSPYNKCISTQSLDDIKNIKSNSVDYIFTDPPFGDNLMYSELNFLWESWLKIFTNNKTEAIINKTQKKGLHEYQELMEKCFSEMYRILKPGRWMTVEFHNSKNAVWNAIQEAILRAGFVIANVRTLDKKQGSFKQVTTTTAVKQDLVISAYKPKEGFVKRFLKEAGTEEGVWDFVSQHLEKLPIVVEVGDRLDIVDERRDYLLYDSMIAFHIQNGASIPMGSSDFYAGLKKRYIERDGMYFLPDQAAVYDSKRAKLELNDQLSFIIKDEKMAIQWLKYKLLNKPMTYQELQPLFLEELHQGKHESIPELIDILQENFLKDDDGRWYVPDVNRQSDMEKLREKKLLKDFEEYKNSKGKLKIFRSEAIRVGFKECWKNKDYETIVSVSERLPESFLQEDQTLLMYYDNAQTRLGV

SEQ ID NO: 3371 - protein, 856 aa, Thermoanaerobacterium thermosaccharolyticum
MKLTKEMLDSVRNIDGFPIGSDEDIIELSDPPHYTACPNPFINDFIEKYGKPYDEETDDYKCEPYAADVSEGKNDPIYNAHSYHTKVPYKAIMRYILHYTKPGDIVFDGFCGTGMTGVAAQMCGNPDHEFKFKVEKEFEKEGKKVEWGARRAILGDLSPAATFIAYNYNTPVDTAEFEKEAKRILNEVENECGWMYETIHTIDGVPQKYMDGSVIKGKINYTVWSDVFVCPNCSDEIVFWDAAVNKEDGKVMDEFKCPHCGAAVSKKDLDRAWKTVYDKALDKVINQVKQVPVLINYTVDNKRYEKKPDEFDMELIEKINEMDIPYWYPTDRMPDGYNTEQPKKSHGITHVHHFYTKRNLWVLSAIYDKVVDCKFNKLFFSLILSSLARASKRNRYMPQYGNRHVGILSGTLYIPSLTEENNITMLINTRISNAIRAYSSFISDNYFDYLISTNSLLNYKNLENNSVDYIFTDPPFGDNLMYSELNFLWESWLKVFTNNRTEAIINKTQKKGLHEYQELVEKCFSEMYRILKPGRWMTVEFHNSKNAVWNAIQEAILKAGFVIANVKKLDKQKGTTKQLTYSMTVKKDLVISAYKPKEGFVKRFLKEAGTEEGVWDFVSQHLEKLPIVVEVGDRLDIVDERRDYLLYDSMIAFHIQNGASIPMGSSDFYAGLKKRYIERDGMYFLPDQAAMYDSKRAKLELNDQLSFIITDEKMAIQWLKYKLLNKPMTYQELQPLFLEELHQGKHESIPELIDILQENFLKDDDGRWYVPDVNRQSDMEKLREKKLLKDFEEYKNSKGKLKILRSEAIRVGFKECWRNKDYETIVSVGERLPESFLQEDQTLLMYYDNAQTRLGV

SEQ ID NO: 3372 - protein, 854 aa, Thermoanaerobacterium xylanolyticum
MKLTKEMLDSVRNIDGFPIGSDEDIIELSDPPHYTACPNLFINDFIEKYGKPYDEETDDYKCEPYAADVSEGKNDPIYNAHSYHTKVPHKAIMRYILHYTKPGDIVFDGFCGTGMTGVAAQMCGNPDPEFKFKVEKEFEKEGKKVEWGARRAILGDLSPAATFIAYNYNTPVDTEEFEKEAKRILDEVEKECSWMYETIHTIDGVPQKYIDGSVIKGRINYTVWSDVFVCPNCSDEIVFWDIAVNKEDGKVMDEFKCPHCGAAVNKKNLDKAWKTVYDKALDKVINQVKQVPVLINYTVDNKRYEKKPDEFDMELIEKIEEMDISYWYPTDRMLDGEESRRNDRIGITHVHHFYTKRNLCVLSAIYDRIKSSRSLFLHISKFIFTAIVIMATKMSRYGERTGNVSGTLYVPSLIKELNLIEYLKRKLWGAKGILKPLDNIKKFNPNNICLYLGSTINTLIKPNSVDYIFTDPPFGDNLMYSELNFLWESWLKVFTNNKTEAIINKTQKKGLHEYQELMEKCFSEMYRILKPGRWMTVEFHNSKNAVWNAIQEAILKAGFVIANVRTLDKKQGSFKQVTTTTAVKQDLVISAYKPKEGFVKRFLKEAGTEEGVWDFVSQHLEKLPITIEVGDRLDIVDERRDYLLYDSMIAFHIQNGASIPMGSSDFYAGLKKRYIERDGMYFLPDQAAVYDSKRAKLELNDQLSFIIKDEKMAIQWLKYKLLNKPMTYQELQPLFLEELHQGKHENIPELIDILQENFLKDDDGRWYVPDVNRQSDMEKLREKKLLKDFEEYKNSKGKLKTFRSEAIRVGFKECWRNKDYDTIVNVGERLPESFLQEDQTLLMYYDNAQTRLGV

SEQ ID NO: 3373 - protein, 928 aa, planctomycete KSU-1
MEKLLIDDKTTKQTGPVECLGLTFPNDEERRKYFTEKLREHLQNPEFRKIEGFPIGTDEDILKLSDPPYYTACPNPFINDFIRHYGKPYNPKTDNYRREPFAADVSEGKNDPIYNAHSYHTKVPHKAIMRYILHYTEPGDIVFDGFCGTGMTGVAAQLCGDKRVVESLGYKVLDDGTILDEEGKPLSKLGSRRAVLNDLSPAATFIAYNYNTPVDAQEFEREAKQVLKKMEQDCGWMYETMHTDGKTKGKINYVVWSELLRCHQCNEENTYWELAVDPVTRYKKNITENILCKRCGSLDSYTKWERVFETYMDILLGHSLKRSKLVPVLINYSFGGKKLEKIPDAFDFLLLEKINQFPMPPNMPILPLPEGQNTKQPLVSSGVSHVHHFYIQRSLFAYSLAERCIAEGHVSLQNTLKYWLQSVGVGFTKLNRYLAASFSQVNRYLKGTLYIAPFIAEVSPVYSLTGKIKRLKNVFFLPSVKPSFIIETKSSTGNGVHESSIDYIFTDPPFGGNLMYSELNFIWEAWLKVFTNNKHEAIESKLQKKRLQEYQELMTRCFNEYYRILKAGRWMTVEFHNKKNSVWNAIQEALQQAGFVVADVRTLDKKQMTMKQMTTASAVKQDLIISAYKPNGGLEERFKLKAGTEDGVWDFVRTHLRQLPIFVKPKDGMAEIIAERLNYLLFDRMVAFHVQRGIIVPISAAEFYAGLEQRFPSRDDMYFLSEQISEYDKKRMTVKEMLQLQLFVTDEASAIQWLKQLLTKKPQTFQEIHPQFLKEIGGWQKYEKPLELMELLEQNFICYDGKGDVPSQIHSYLSTNYKELRNLPKDGPSLRDKANDRWYVPDPNKAQDLEKLREKALLKEFEEYKTFTGRKFKSFRLEAVRAGFKRAWQERDYQTIISVSKKIPENVLQEDQKLLMWYDQAVTRMGVD

SEQ ID NO: 3374 - protein, 931 aa, Bacillus cereus
MGNDEKQLSLLGEHMQADNGPVVCLGMKFENDEARREYFRNELRKILPELKEIEGFPLGEDEDIITLSDPPYYTACPNPWINKCIEEWEQDKVKNYNRNSNEEYHREPFASDVSEGKNDAVYNAHSYHTKVPYKAIMHYLLHYTNPGDIILDGFSGTGMTGVASRRCGNPDIIKSLGYTVQNGKIVKGSGEYVGELGERLTILNDLSPSATLITYNYNSIPNIEEFLKEAKQVLEQVKEECNWMYHTSHENNGSQQGEANINYVVWSDVFQCPNCTKEVVYWDAAVDVDEKKIISDFNCEYCGVELQKSKLQRAWDTYYDQYLQEAITVAKQIPVHVNYSVGKKRFEKKIDETDIELIEKIKNTKSLYSFPIERMPAGDESRRNDRIGLTHAHHYYTNRNLYTLASFVGHAKKSKYFNRLVFFFQASINRATKTNRFRFGGTGGLSGTLYIPSLIFERNVIALLEKKLKDYEKMLFEEKQPGYTAMISTQSTSNVTNINENSVDYIFTDPPFGKNLMYSELNFLWECWLQLITDNKGEAIINNTQLKGLGEYQRLMEESFENYFKVLKPGRWMTVEFSNSQASVWNSIQEAIQKAGFVIANVAALDKKQGSFKAVTTTTAVKQDLVISAYKPKQENIDKINREKNTEESAWVFINQHLEQLPVFIGVKGEAQIISERTPRILFDRMVAYHVQNGLPVPISSADFQGSVAQRFPMRDGMAFLEKQVAEYDKKRTLVKEFAQMSLFVSDENSAIEWIRQQLLKKPQTRQDLHPNYMKEIQHIAKHELLPELDNLLQQNFLSYEGEGEIPDQVASYLRRNYKDFRGLDTNDSALIEKAMNRWYVPDPNKQADLEKLREKALLREFNGYLEELESSKKKLKQFRTEAIRAGFKKAYSEKEFEQIVKVGDRLPEKIIQEDDKLLMYYDNACIRLGL

SEQ ID NO: 3375 - protein, 851 aa, Clostridium thermocellum
MKKLTKEDIDKVRHIEGFPIANDEDIIALSNPPYYTACPNPFIEDFIKEHGKPYDEATDDYHREPFAADVSEGKNDPIYNAHSYHTKVPHKAIMRYILHYTEPGDIVFDGFCGTGMTGVAAQMCGNPDPELKARIEAEMPYVKWGARKAILNDLSPAATFIAYNYNTPVDVAEFEKEAKRILEECEKEYGWMYETQHTINGEIQYGIDGKPIMGRINYTVWSDVFICPTCSNEIVFWDAAVDKEKGKVNDTFYCPHCNSQLTKRSCERAQETHFDARLNEFVTMAKQVPVLINYSVGKKRFEKTPDEYDLALIEKIDNMDIPYWYPTDRMCEGSESRRNDRYGITHVHQFYTKRNLYLNAWLRNKIIKVKDKCISDILLFGFNNVQQRHCKLNAMRFNVSFPSNITSGTLYLPSMIRENNIIDQLSNKYFKRIVKAFKDNTSKYSIVSTNSTTSNIINSNNSIDYIFTDLPFGSNLNYSELNFLWEAWLKVFTNQEPEAIINAVQGKGLLEYQSLMTRCFEECYRVLKPGRWMTVVFHNSQNSVWNAIQESLMRAGFVIADVRTLDKQQGSFKQVTTTSAVKQDLVISAYKPKESFKREFISHAGSEETAWSFIQQHLEKLPVVVVKNGKIELIEERKAYLLYDRMVAYHIMNGIPVPLDATDFYKGLDERFLKRDGMYFLPDQVNEYDTARIVNDVEPIQMELLVTNEKSAIAWLYKQLETPQTYAELQPKFMQEIRAWDKFEKRPELSELLEENFLQNEEGKWYIPDVTKASDVAKLREKKLLKEFEGYLATKGKLKLFRTEAIRVGFAKLWADKNYKLIVETAERLPESVILEDDKLLMYYDLSLGRI

SEQ ID NO: 3376 - protein, 509 aa, Lachnospiraceae bacterium
MHHFYTRRSLLSIAFFMEQVKKSHNSQKMRFVFEQIILGMAKISRYVPSHFSQVNQYLSGTLYIGSQVVEVSPEYILSGKIEKLSKMYSQVPFDGESACVFTGSTTNTPVPNDSIDYIFTDPPFGSNLNYSELNFFWEAWMGCVTNNTMEAIVNQVAGKNLLDYQRLMELCFKEYYRVLKPNRWMTVEFHNSKNSVWNAIQEALQCAGFIIADVRTLDKQQGTFKQILNNSAVKQDLIISAYKPQTGFIREFVANTGTEETAWAFVRQHLSNIPIVVDANNDGKIDILAERQAYLLFDRMVAYHIMQGLPVPIDASDFYRGLDDKFLKRDGMYFLADQVNEYDTARIKTDVEPIQFGLFVTNEKSAIAWLYQQLDDNSGERQTYAQLQPKFMQEVKSVDKYESMPELSVLLEENFLQDEKGQWYIPDVTKEGDVVKLREKNLWKEFEGYLSSKGKLKLFRSEAVRVGFSRLWKEKNYKAIVDIGNRLPEQTIQEDANLLMYYDISLGRI

SEQ ID NO: 3377 - protein, 312 aa, Lachnospiraceae bacterium
MEPRNLTKADIDKVRGIEGFPIAKDEDIIALSDAPYYTACPNPFIEDFIKENGTLYDEATDDYHREPYAADVSEGKGDIVYGAHNYHTKVPYKAIMHYILHYTNPGDVVYDGFSGTGMTGVAAQMCGADDKQLEFQMISQDKKAIWGKRKVVLNDLSPVAAFIAYNQNTGINALVFESETSQILKLFEENYGWMYKTNHISNEGQISLEAQPQGYINYTVWSDVFVCPHCSSEFVFSEVAFDYETKKVIDKFVCPHCKSTLAKKDCSNAMVTMFDEDLNSTIQMSKQKPVLINYTYQGKNLKKTRCRGFGAN

SEQ ID NO: 3378 - protein, 906 aa, Enterococcus faecium
MSLENEQLSFDSEQRENKRVTVLGMEFENDDARREYFREELRKKLPELRKIEGFPIGNDEDIIELSDPPFYTVCPNPFINRFINEWKTEDVEEYSKEPLAVDISFGKNTPIYNAHTYHTKVPYKAIMSYLLHYTKPGDIVYDAFSGTGMTGVASSLMNNKEELLEIKPDITDNDIGVRHAFLSDLAPVGSVISEVYNSSVDSELLVSELTKLLADSKKDLGWVYKTEVNNVEYDINYTVWSDVFSCPNCLTEFIYYEEAFDIEENKLHSDFSCPNCGMLLNKQKSDKVMSEYFDAVVGKKLKVLKQKPVLISYGFGRNKGIKKIGNKDKELLEKIDKYNINKWFPAFKLPKGDEIERVKRNGIEYTHQFYTKRNLIVASDLLDRISKLPESLKRPAYLCFQSIVYSLISKLVRYNMGNRGNGMLSGTYYLPSLMAETNVYNVFKGKVKDIAKALIVKQRSSIVFVSSAITNELQENSVDYIFTDPPFGENIDYSELNFLWESWLKVFTNSSSEAIINDSQNKGLFEYKQLMEESFRNYFKVLKPNHWITVEFSNSKSSVWNAIQDSIQKAGFIIADVSALDKKQGSFKAVTTTTAVKQDLVISAYKPTEENIDKMKAQRNNVESAWTFVTQHLSNLPVFMGDKGDAVIISERTPRILFDRMVAYHVQQGLPVPISSADFQSGIASRYPMRDGMAFLDSQVAEYDKKRILAKEFAQLSLFVSDENSAIEWIRQQLMKKPQSRQDIHPQFMKEIQHIAKYEELPELDELLAQNFLYYDGNGAVPNQISTYLTKNYHELRGLEKSDALLREKAKNRWYVPNPNQQADLEKLREKNLLREFSHYLDEINNSKKKLKVFRTEAIRVGFKKAWTEKEYQTIVTVGERLPEKVIQEDDKLLMYYDNALMRIEM

SEQ ID NO: 3379 - protein, 268 aa, Caloramator australicus
MKLTKDDLDKVRHIEGFPIAKDEDIINLSDPPYYTACPNSFINDFIENFGKKYDENSDDYYVEPFTADVSEGKNDPIYNAHSYHTKVPYKAIMRYILHYTKPGDIVFDGFCGTGMTGVAAAMCENPDPEFKLQLEKEFKERGKKIEWGARRAILCDISPAATFIAYNYNTPVDPAEFEKEAKSILEEVEKECGWMYETIHINDNGEPILDIEGKPIKGRINYTVWSDVFICPSCGEEIVFWDVAVNKEDGQVLNEFKCHSCGAILKKK

SEQ ID NO: 3380 - protein, 133 aa, Caloramator australicus
MNLNVILVGQFLKKNNLERAKTTVYDRALKEFITQAKQVPVLINYTVNGKRYEKKPDEFDLRLIQKIDDMDIPYWYPTNRMPEGDESRRNDKYGITHVHHFYIKRNLWVLSCLNKKNIILSFVIYFLLLYYHP

SEQ ID NO: 3381 - protein, 460 aa, Caloramator australicus
MPEYGNRHVGVLSGTLYIPSLNEENNIISMLKTRINSIHKALIIFKNIKNYNYIISTNSTVNLFYIKNNSIDYIFTDPPFGDNLMYSELNFIWEAWLKVFTNNKSEAIINKIQRKGLKEYQELMEQCFKEMYRILKPGRWITVEFHNSKNSVWNAIQEAMLRSGFIIANVRILDKKKSTTNQLTYANTTNKDLLISAYKPKESFEKKFMLEAGTEDGVWDFVRQHLEMLPVIIENNNKLEIIPERQNYLLYDAMIAYHIQKGLSIPMGAAEFYKGLKERFVERDGMFFLPSQVIKYEEKRYKLELMEQLTFVIVDEKSAIQWIRSELEKQPQTYQEIQPKFLQKKHEFKHEKMPELLDMLKENFLQDEEGRWYVPDPNKQSDIEKLRNKNLLKEFEGYLNTKGKLKVFRTEAIRAGFKDLWQKKDYKTIVKVAERLPETVLQEDNFLLMYYDNAVTRLGD

SEQ ID NO: 3382 - protein, 322 aa, Caloramator australicus
MGRKIKCQFCDELFYKKDYPKHLEKLHNNEFIRIIEEILNNYEEKQIDKCVEKYNFTKDFIKKIFSGNDMLLKESKQLYLTNLSPEKFELETTTIWSFPDRGNWATHSGKYRGNWSPYIPRNILLRYSNEGELILDQFVGSGTTLVEAKLLNRNAVGVDINPIALEITRENLKFNYEYNPKIDIKLGDARNLYFIEDNSIDLICTHPPYANIIKYSENINGDLSHLDVKEFLLEIEKVAKECYRVLKKDKYCAILIGDTRKKGHIIPIGFSVMQKFIDAGFKLKEIIIKEQHNCNSTPYWKNKSLKYNFLLIMHEYLFVFRK

SEQ ID NO: 3383 - protein, 933 aa, Pseudoalteromonas marina
MQQDSLLDDVKVESSKDPVECLGQTFENEEARRAHFSKLLREKLKDPEFRKIEGFPISTDEAILELSDPPYYTACPNPWLNDFIEYWESEKQYSTEEYEREPFVADVSEGKHDPLYKAHSYHTKVPFKAIMRYILHYTNPGDILLDGFCGTGMTGVAAQNCGDRTTVESLGYFVDSKGKIYEDASQKKLISQLGARKVVLNDLSPIATFISSNYNLEPEVESYNSESQRILNEINNELGWMYRTKHEDGSEYPIDFVVWSEVFSCPECSEEIVFSKEALDIDSGKVAKSFSCPGCSTELKKDLMELQYESKHDPYKNGVHQEPKRVPFLIYYKVGKERIYKSPDEYDINVLAEIEKLEFPSNFPIKEMPDMQMMRVGRMKPSNIDHLHHFFMKRPLVTLAKMWEKANGILDYTTRRQCLFFVEQAIWGMSKLARFTPTHFSQVNQYLSGVFYIASHIVDVSPNYILGGKRDRLLKVFGQMNNKNIHSLTSTQDIAKASILPNSLDYIFVDPPFGENIYYSDLNYLIESFHGVMTNSTNEAIIDKVKEKDFGQYQQLMLSCFKNAFIALKPGRWITVEFSNSSAAIWNLLQTSLTSAGFVISSVSALDKKQRSFQSIVSTTAVKQDLVISAYKPSQKFSNKFKGDDNFNAIWDFVENHLNYLPSIKHEDGELTFIPERDPRILFDRVVSYFIVNNRSVPLSSGEFQKELCQKFSFQDGMIFTQPQLLEYEKVKSKGVCIKQLSIFVDDESSAISWLKQNLKDKPKVQSDIHPEFMSAISGWKKNELQLELSTLLEQNFLRYDGKEDVPSQIHTYLSTNYKDMRSLAKDSVSLRLKAKGRWYVPDPSKTGDIEKLRLRILLREFDKYKSEKKKIKQPRTEALRAGFNQLTENQEYQTILDISAKIPPAVLQEDEKLLMFYDNALTLTSNDDDDWD

SEQ ID NO: 3384 - protein, 939 aa, Desulfotomaculum nigrificans
MTILDEQADKKNQPVTCLGMTFANDAERRAYFTEELRKKLPELKQMEGFPIGEDEDILALSDPPYYTACPNPFIPEFIKQWEKEKRELYGDEEEEYHREPFAADVSEGKGDPIYNAHSYHTKVPHKAIMRYILHYTKPGDIIYDGFSGTGMTGVAAGNCGDIESVLDIGYHVKDNGIIIDENGNLVSKLGERKCILNDLSPVASFIAYNYNSPVDSHTFENEAMRIIEEVEEECSWMFETEHVINGEYQQDSSGTIIKGSINYTIWSDVFLCPDCLKEIVFWDVAIDHEKWEVKDVFLCPSCNAELTKRRLERAWETKYDDAINQTITQVKQIPVLINYSVYNKRYEKRPDSRDLEKISKIDELKIPYWFPKNVIPKGEKTVEPLRIGITHIHHFYTKRNLWVLSSLYNKINAVEDERLRSMLFMLVSSYNLTHSTKMSRIIFKKSGTKPVLTGYQSGTLYVSSMPVEKNIYNSIRNMKVDLFCKAISDKQVQQVVGTQSTTKVELPPNSIDYIFTDPPFGANLMYSELNLIWEAWLGILTNSKPEAIINEAQEKMLPDYQKLIEECFREYFRVLKPGRWMTVEFSNSQASVWNVIQESIQRAGFVIANVSALDKKQGSFNAVTSTTAVKQDLVISAYKPSDVLIQELRTNQNTEESAWSFIREHLNKLPIFIGNKGQAQIIVERTPRVLFDRMVAYHVQNGLTVPISSAEFQRGITQRFPMRDGMVFLDTQVAEYDKKRILAKEFVQMNLFVSDENSAIEWLRQQLMIKPQTRQDLHPNFMKEIQHIAKYEKLPELDELLEQNFLKYDGTGPVPSQIHSYLSSNYKDMRDLDKEDPKLQAKAKNRWYVPDPNKAVDLEKLREKFLLREFASYMEEIKKSKKKLKQFRIEAIRAGFKKAWGDKDYQTIVDIGQRLPESILQEDDKLLMYYDNAQIRLGM

SEQ ID NO: 3385 - protein, 948 aa, Dethiosulfovibrio peptidovorans
MNKQKKLFKTKFIPGKLGSGNLFEEELVPANDGPVKCLGLEFENDDARRAHFTEELRKKLQDPEFRKIEGFPIGEDEDILKLSDPPYYTACPNPWIGQFIEEWESQKPEKPADYHYHREPFAADVSEGKNDPIYNAHSYHTKVPHKAIMRYILHYTEPGDIVFDGFCGTGMTGVAAQMCGDRDVVTSLGYQVKPDGTILQEETDEDGKKVWKRFSKLGARKAVLNDLSPAATFIAYNYNTPVDVHAFEREAKRILAEVEEECGWMYETLHTDGKTKGKINYTVWSDVFVCPECTGEVVFWDAAVDKEAGKVRDSFPCPHCHAELTKRKMERAWTTNFDSALNNSVKQAKQVPVLINYSIEGKRGRFEKSPDKNDLTLIEKIENSEIHYWFPNYRMMKGKETRRNDPAGITHVHHFYTKRNLCVLAAVRIRSSSSFLISQLAMWWTLTKLYRYRWAGGIAGAGGGPMAGTLYIPSLIKEISVLVSAVDVFNKNIRKKKLFANFLRHPLSTSSANWIDYNNNSVDYIFTDPPFGANLNYSELSFIWESWLKVWTNNKPEAIENSVQGKGATEYRNLMAGCFKEAYRVLKPGRWMTVEFSNTKASVWSSIQTALTEAGFIVANVSALDKKQGSFKAVTTLTAVKQDLVISAYKPNGGFEDRFEEEAKSEEGVWDFIRTHLKYLPVIKKQGYDLVAIPERDPRILYDQVIAYYVRKGYNVPIDSQDFQLGLSQRFAERDGMYFLPEQVAEYDRKKMIGGGRPLQQSLFISDEASAIEWLRSLLRDKPQSFQDINPLFMKEIGGWSKNEVGLELSTLLEQNFLAYDGKGPVPDQIHSYLSSNWKDMRNLPKEDPALVAKAKNRWYVPDPNKAGDLEKLREKALLKEFEEYKQAKKKLKIFRLEAVRAGFKKAWQERDYKVIITVAEKIPNNVLEEDPKLLMWYDQAVTRVGDE

SEQ ID NO: 3386 - protein, 880 aa, Kingella denitrificans
MSDLFQNHAAKSDPVECLGQTFPSDEARREHYLKLLAEKLKDPEFRKIEGFPIGSDEDILTLSDPPYYTACPNPFLGEFVKHFANSSSHGKTTLPFGGDLEAESRHPVYSFHPYHTKVPPEVIKKLIEHYTRPGEIVLDAFSGTGMTGVAARECGRHGVTVDLSPIATFISAVNVNKNPGHEVAMALKKIIQESRKELGWVYQIKESAILYEANYFVWADVFTCPECVHEFSFFPYGVIHHGNKVETRKAFPCPECGAELNVRRIERIINSSGKKKSLVWVNAGTGRNRINREANDYDQEIVDRVNSYKSPSWYPKDQIDPNGYSAKLAQLGDKAIRDISKFLSERNRLVFSDLWARAAEIRDVSVRNAAKACLTSIFTVVSERQGYFGGGGGMSGNLYMPIVRMEKNIYASLERKVKKLIDAENAKPISGARCIVSAQSATNLNQIPDASIDYIYTDPPFGANIIYSEMNLILEGWLRVLSSEKPEAVINEAKNKAFDDYGLLMRSVFREYYRVLKPGRWITVEFHNTKASVWNLIQTNLAEAGFIVAQVGKLDKGSTTILADIRPGAVVQDLIISAYKPNGGLENRFLLQGASIESAWDFVATHLQHLHVTDVKEGRLAYIAERSGRIIYDRMVGWFIKNGAMVPLSSQEFFAGLKQRFAERNGMFFSEEQASQYDKERAKYQYELQLELFVSDERSAIDWVTEQLRRKPSTYQELHPEFVRQLGAGWKKHEEKPELGKLLEQNFLCFDGSGEVPSQIHSYLSSNHKDLRNLEKNAPVLVAKAKDRWYVPDPNKAQDLEKKREKALLKEFENYKAFTGRKIKESRLEVLRAGFRAAWAAKDYKTIIGIANKLPEETLQEDEKLLTLYDLALTRTEDGI

SEQ ID NO: 3387 - protein, 913 aa, Alcanivorax hongdengensis
MNDQLNFGQTEASAQPVECLGQTFPSDEARREHFLKLLSEKLKDPEFRKQEGFPQGTDEAILAMSDPPYYTACPNPFITDFVLKYGKPYEPAQKYSREPFAADVSEGKNDPIYNAHSYHTKVPHKAIMRYIEHFTSPGDLVLDGFCGTGMTGVACSHVGEGRKSILVDLSPIATFIAKNLNGTLDAVVFVESARALVDSVKLKEPNLYKTKHSGWKVRDRKIVEHKSYKHVDSSQGEVEFVLYSDVVSCPNCGAQYPFYSIAVDEIEDSLRSELSCPSCSVISRETDWETCYENRIDPLMGAAHKEAKTVPVLINYSVGSSRYEKIPDNEDLAAIREMEGKLSHLDFPVVELIPGKETQRNVSRGITHLHHFFTSRELYTVALLLHHIKKHQSASIRHALLFALTACLPYASKMRRFRADRKGGGPLSGTLYVGSLTTPPNVLNSFLRNAETIASSLSYQRAMKKSNIISTQSSTTLSRISDNSIDYIFVDPPFGSNFDYSELNFFWEALLGVVTHQFSEAIVSNSQEKNIADYRYLLTRSFKEFFRTLKPGRWMTVEFSNTKASIWNTIQTSLQEAGFVVANVSALDKKQGSFKAVMTATAVKQDLVISAYKPNGGLEERFETTGGSEESVWDFVRTHLKYLPTVKVRGGVLEFVTERDPRIIFDRMIAWFVRHNTAIPLSSQEFQEGLRQRFPERDGMIFLPEQVAEYDRKRAQATQAPQLEMFVSDERSAIDWLCDFLKKRPSTYAEVHSEFIRQIGAGWRKHESKPELSDLLEDNFFKYDGNGDVPSQIHSYLSTNHKDLRGLEKNDPNLIAKAKDRWYVPDPNKAQDLEKKREKALLKEFQTYLAFTGRRLKEFRLEVLRAGFKEAWASKDYATIIKVAQKIPDAALQEDEKLLLWYDQALTRTEADS

SEQ ID NO: 3388 - protein, 918 aa, Bacillus cereus
MTNNEQLSFLNNTTEVDNTPVVCFGMTFENEEARREYFRNELRKKLSELKQIEGFPIGEDEDIIALSDPPYYTACPNPWINNFIAEWEKEKVEKYGRDVNEEYHREPFDADVSEGKSDPIYKAHSYHTKVPHKAIMKYILHYTKPGDIIFDGFGGTGMTGVAARECDLLNENDKKKIISEIGVVEFGPRNVILNELSPAATFIQQGYNLKADAMTFELEATKLIWEVEKKYSWMYKTLHTDGQYYDVNYFVWSDVYLCPHCTHEIIYWNEAISHEKGEALKHFNCSNCGKELEKKVLERAWTKSNDIIPDRFDNTVKKQLVEINYNVGSKSFKKKPDINDLKILEKLRDIQINNWIPNNNLLKGDKTMEPINVGITSIDLFFTKRNLITTAEIWDKCKDNKTKFLFTSLITRLSKLSNLHISNYFNGGGGAASGNMKGILHPPTISLEQNPFKYWPIRIEAIKKVIKNTQSSLISTSSSTDLRNIPDASVDYIFIDPPFGANLSYSDLNTIWEGWLKVQTNVQDEAIVNKTQMKTLSEYQELITQCLIEHYRILKPGRWITVEFSNTKASVWTSLQQAIERAGFVVANVAVLDKKQGGYNANVHAVAVKKDLAITAYKPVKDIFTDISHINQSEKNTWEFVCMHLSKLPIYSISNSEINIVVERTPRALFDRMVAFYVQNGLPVPMSSAEFQSKIERKFPMRDGMVFLEEQVTEYDKYRLKNSELKQMNLLISDESTAIDWLRQKLVFKPQTRQDLHPQFMKEIQHIEKHEQLPELDELLAQNFLRFEGEETVPDQIVSYLRRNYRDFRGLENIDAKLKTKAMNRWYVPDPNKQADLEKLREKTLLREFDNYVEELGTSKKKLKQFRTEAIRAGFKKAWSEKNYEKIVTVGDRLPEKVIQEDDKLLMYYDNAQVRLDM

SEQ ID NO: 3389 - protein, 947 aa, Nitrosococcus oceani; identical to SEQ ID NO: 3358

SEQ ID NO: 3390 - protein, 925 aa, Methyloversatilis universalis
MNDLFQNHAAKSGPVECLGQTFPSDEARREHYLKLLAEKLKDPTFRKIEGFPIASDEDILNLSDPPYYTACPNPFIEDFVRHYGKPYDSSVHYSKEPFAADVSEGKNDPIYNAHSYHTKVPHKAIMRYILHYTQPGDVVFDGFCGTGMTGVAAQLCGDSSAVAELGYRVDERGNVLTRDEEGALQGFSKIGKRKVILNDLSSAATFISHNYNTPIDVHEFDAESKKIIAEVESEFGWMYQTRHTDGSQVGKINFTVWSDVFLCPECTGEIVYWDVAVDKDAGKAREDFCCPHCSAALSKRNMDRAWSSVFDKEVSGTFRQAKQVPVLINYSVGKKRYEKVPDQFDLELIEKVSDLEPARWVPTAPLPDGYNTRQPMESHGVRHAHHFYTKRNLHVLAAFREKIAKANPKYLFWFTSALTWVGRENRLHLGNYFGGGGGVITSLRGTWYIASLSVETSVLERFALRTRAQLVRHSMDGTNAFVSCGSATALPIGDSSIDYIFIDPPFGGNLMYSELNFVWEAWLRVVTNNQQEAIENKVQGKGLNDYRLLMSRCFKEAFRILKPGRWMTVEFSNTQASVWNAIQTAIQEAGFVVANVSALDKGKGSFKAVTTTTAVKQDLVISAYKPNGGLEDRFSKQGGSEDSVWDFVRTHLKYLPTVKIRARELEFISERDPRIIFDRMVAWFVRHNTPVPMSTQEFQAGLIQRFVERDGMVFLPEQVAEYDKKRMQVAVAPQMEMFVSDERSAIDWLSDFLKRRPSTYQEISPEFMGQLGAGWKKHEVKPELAALLEDNFLKYDGTGEVPSQIHSYLSSNHKDQRGLDKSDPTLVAKAKDRWYVPDPNKAQDLEKKREKALLKEFETYKAFTGRKIKESRLEVLRAGFRAAWAAKDYQTIIGIANKLPEETLQEDEKLLTLYDLALTRTEDGI

SEQ ID NO: 3391 - protein, 844 aa, Thermoplasmatales archaeon
MDKNTIKPLKDLIESVRDIDGFPIGKDQDILALSDPPYFTACPNPYIKDFIEEYGTPYDRNNDKYERTPYIGDVTEGKNDEIYRAHKYHTKVPFKAIMEFIIHYTEKDGLIFDGFCGSGMTGVAAGLLGRRAILTELSPSAAFISNIYTQPINISEYENSANKILKEIINECGWMFKTKHTKDAMEIPSGKNPDFISESNIFVDINYVLWSDVLICPYCKKEYIFWDAAANKNNGKLKSSYLCTYCNSEITKSESGKAIESFYDTSLKKNIELRKQNPVLINYSLNGKRYLKKPDKFDFDIISKINAAEIPYNYPTNRMPEGDESRRNDKNGLTHVHHFYTKRNLWVLSAFASKIGPSNKYYNITSVSAIINKLYRFTSQKGSLGAGGGPLSGTLYVPSLIKEIPMIKALRGHISKTIKLKNFIKDIKPPIIQTASHTDLAQIKNNSIDYIFTDPPFGDNLMYSELNYIWEAWLRVFTNIKKEAIINKTQHKGISEYTNLMTSCFKEMYRILKPNRWVTIVFHNSKASVWNAIQESMNRAGFIIAQVAVLDKKQESFKQVTSAGAVKNDLVINAYKPKCDFSEIFLKKAGKDMEVDFISQQLSHLPIRPNLERTEKMLYSKMLAHYVENGFKIRYDAINFYKLLLDNFIELDGYWFLDDQTKEYNKWKSNLSLDQLKEALTGQQTLFISDEKSALTWLYQFLNIPKDYSEIYTSYQQVATTSDDNIPELREMLDNNFILENGKYRRPLSKEEKDEKSKSREKELYRSFNVLLSKARDAKEKIQNVRREALIYGFTKCYQEGKYDDILTIVDKLHDSVLESSGEIMDFVDIAKIKTSGKKTIEDY

SEQ ID NO: 3392 - protein, 933 aa, Pseudomonas sp.
MNDLLHDQDIGFSGPVECLGQTFASEQKRREHYLNLLAEKLKDPVFRKIEGFPVGTDEAILAMSDPPYYTACPNPWLDDFMRCYGKPYDPSEKYSREPLAIDVSVGKTDPLYRAHSYHTKVPHLAIVPSILHYTEPGDIVLDGFGGSGMTGVAAQWCGSAPATYRHELESGWKKEGKAAPKWGARRVILNDLSPAATFMAANYNLPFDVEAFAMAGKKLLEEFEQKFGWMYETLHSDGKTKGRIEYTVWSQIYTCPHCTGEVNFLVEALDAETKRVKDEFSCPHCSSEISKRRMERLFLSKNDELTGGAIQTPKRLPSLISYIVAGVRYSKVPDENDLSVLAKIEAMPLPESLPVVKIPTMHMTHERARMDYSGITYIHHFFLRRALLSLGVMWAHAQEVTDVRLKGMMLFWIEQSIWSMSVMNKYEPIQFGRADGNASQVGRFMKGVYYVASLHTECSPWYVNEGKHKRLAKAFSEFNRNANTAAITTGTAATIAMQSNSIDYVFTDPPFGENIYYADLNFMVESWHRVTTDANPEAIIDRFKKKALPDYQHLMQRCFSEYYRVLKPGRWMTVVFSNSKAAVWNAIQVALQQAGFVVAEVTSLDKVQGSYRQVTSTTAVKQDLVISAYKPNGGLEDRFDRNGATVESAWDFVQTHLKQLPITKVTKGDTPELLNIVERDPRRIYDRMASWFIRHGALVPISTPEFLAELPTRFREVGGMVFLPEQLVEYEMARARIPQVKQAELFVSDERSAIDWLTNFLGKRPSTRSEIHTEYIPQIGAAKKKGEIIPELDELLEDNFLQCDGTGEIPSRIHSYLSSNFKDLRGLPKDAPALVSKAKERWYVPDPNKAQDLDKKREKGLLKEFESYKIFAGRKIKESRLEVLRTGFSAAWANKDYQTIIAVANKLPDETLQTDEKLLTLYDMALTRTESDS

SEQ ID NO: 3393 - protein, 931 aa, Bacillus cereus
MGNDEKQLSLLGEHIQADNGPVVCLGMKFENDEARREYFRNELRKKLPELKEIEGFPIGEDEDIIALSDPPYYTACPNPWINEFIREWEREKVEKYGRDANEEYHKEPFASDVSEGKNDPIYNAHSYHTKVPYKAIIKFLLHYTEPGDVILDAFCGTGMTGVAAARCANEEDLQSLGFKVEGGKILDSEGNFISKIGKRNTILNDLSTAASFIAHNYNNVVNIEVFEKNMSALIERIEKEYHWFYETLHQTDNQSSIGNINYVIWSDVFSCPNCTNEFIFYDVALNEEGNKIVDEISCPNCKVVLSKEKLERKKTNFYDETLNGVIEQTEQVPVGVFYTYNKKRYFKKIHQSDKDVIREIERVPNLSWYPKSLLPDGKNTKQPLVSHGFRNVHHFYTNRNLFILSKLNEEIQKLDLDRNLGRVLFQSIVGTLTSKLVRYNMGNRGNGILNGTLYVSSLNAESNVFNVIRGKLRDFCKALKDNKSKNVVTVQSASTVGIADNSIDYIFTDPPFGANINYSELNFIWESWLKVVTNNNSEAIINATQEKGITQYQDLMEDSFKNYYRVLKPGRWMTVEFSNPKASVWNAIQEAMQKAGFVIANVAALDKKQGSFKAVTTTTAVKQDLVISAYKPRKENIDKMKEEKNTEESAWTFVTQHLDQLPVFIGIKGEAQIISERTPRILFDRMVAYHVQNGLPVPISSAEFQSGVAQRFPMRDGMAFLESQVAEYDKKRTLVKEFAQMSLFVSDENSAIEWIRQQLLKKPQTRQDLHPNYMKEIQHIAKHELLPELDDLLHQNFLFFEGDGGVPDQIASYLRRNYKDLRSVDTTDLVFVEKAMNRWYVPDPNKQADLEKLREKALLREFSGYLEELESSKKKLKQFRTEAIRAGFKKAYSEKEFEQIVKVGDRLPEKIIQEDDKLLMYYDNACIRLGL

SEQ ID NO: 3394 - protein, 846 aa, Treponema primitia
MERRKLTKTDIDKVRNIEGFPIAKDEDIIALSDPPYYTACPNPFIEDFIKEHGTPYNEATDTYHREPFAADVSEGKNDPIYNAHSYHTKVPHKAIMRYILHYTKPGDIVFDGFCGTGMTGVAAQMCGCPDEEFKQKIENEMPGIEWGARKAILNDLSPAATFIAYNYNTPVDVEEFRKEAEHILAECETECGWMYETIHVDKSGNPVMDLHGNPVKGRINYTVWSDVFICPTCSNEIVYWHVAIDADTEKVMATFDCPHCGSNLKKQDCNYSQETHYDIGLRTNVTISKQIPVRIHYTIGGKRYTKTPDEFDYALIEKISNEEIPFWYPTNRMCEGSESRRNDRYGITHIHQYYTKRNLWSLAVAVNKANNNRTLFILTAIMKTLTKMFRWAPHGKHTAGMSGTLYLPSVTHEYPIFGAIERRIALYKDLLNVAEKYSNDTLISCSDLANTFLPNDSIDYIFTDPPFGGNLNYSELSFIWETWLKVITNNKTEAIINTVHHKGLPEYQALMTHCFFEYYRVLKPGRWMTVEFHNSQNSVWNTIQEALQRTGFILADVRTLDKQQSSFKQVTTSSAVKQDLVISAYKPKNNFKKEFIAKAGSLETAWTFISQHLEQLPVAVIKDKKIELITERQAYLLFDRMVAYHIMNGISVPLDASDFYKGLDEKFLCRDTMYFLPNQVNEYDTARIKNEVEKPELELFVTNERTAIAWLYSQLETPQTYGEIQPKFMREGKTTDKYEAIPELMVMLEENFIQDDNGKWYVPDRTKEGDVVKLREKNLLKDFNSYLITPGKLKQFRTEAIRVGFARLWADKNYKLIVETAERLPESVIQEDDKLLMYYDISLGRV

SEQ ID NO: 3395 - protein, 944 aa, Bacillus methanolicus
MDEKQLSLLDDHEEADNGPVVCLGMTFKNDEERREYFRNELRKKLPELKKIEGFPIGDDEDIIALSDPPYYTACPNPWINDFIEEWEREKKEKYGRDENEEYHREPFASDVSEGKTDAMYMAHGYHTKVPFKAIIRYILHYTKPGDIILDAFSGTGMTGVSAALSGYEKTLKDMNFKLNSDGEILLDGNVFSKIGGRKAILNDISPVASFISYNYTNIPDAEEYEKTAIRILSEVEEECDWMFKTIHSINGQKQIDKDGNYIIGTINYTVYSDVFMCPNCSNEIIFTEVALDFETGKVRSEFDCPYCSAKLNKRILERVSEHRYDPILNKVVTFAKQVPYLINYNVGKQNFTKKVDKEDIDLINRVENTLIPYRVPLVKLPEGINTEQPRKSHGIEYVHQFYTRRALYTLSKLFDLIDRVEDRLKYYIIYTFEQAILGMAKIARYVPTHFSQVNQYLSGTLYIGSQVVDPSLTYLIKNKINRLKKILTEYHDAFNRTNLITTQAAQSLIQIEDETIDYIFTDPPFGANLMYSELNILWESWLKVRTNNQKEAIVNKSQNKSLLDYKELIHECFKQYYRVLKPYRWITVEFSNSQASVWNAIQEAIQKAGFVIANVSVLDKKQGSFKAVTSTTAVKQDLVISAYKPKHETVEKMRQQQNTEESAWTFVRQHLEQLPVFIGHKGEAQIIAERTPRILFDRMVAYHVQNGLPVPISSAEFQAGVAQRFPIRDGMAFLESQVAEYDKKRTLVKEFAQMSLFVTDETSAIEWLRQQLLKKPQTRQDIHPNFMKEIQHIAKHEKLPELDDLLHQNFLKYEGDGPVPDQIASYLRRNYKDLRGLENDDPQLKEKAMNRWYVPDPNKQADLEKLREKALLREFEGYLEELEKSKKKLKQFRTEAIRAGFKKAWSEKDYEKIVKVGERLPENVIQEDDKLLMYYDNAQIRLGL

SEQ ID NO: 3396 - protein, 937 aa, Vibrio scophthalmi
MKQDNLFDIEGENKAPGPVDCLGMTFESDEARRNHFTELLREKLKDPEFRAIEGFPIGTDEAILGLSDPPFYTACPNPWLSDFANLWESQKQLSEEEYFREPFAADVSEGKNDPIYNAHSYHTKVPHKAVMRYILHYTKPGDVVLDSFCGSGMTGVAGQLCGDRSVVESLGYRVLDNDDIQQEFFDIESNETKRETFSKLGKRNILLNDIAPIATLISSNYNQAIDNESFVLEAENIINEIFKEYSWLYKTKHSDGSECDINCVVWSDVFLCPECSGEIVLWNEGIDKEVGKVKNTIECSCCTASLVKKQLIRKDATVFDPALKKTIVQAESVPVLIVYKHNGKRYKKSPDSDDIKLLKVIDECEITFPFPNHRMIEGKETRRNDPSGITHLHHFYTKRNMIVLSALKERIKSSRYYKELQFQLDSLVIRQSKLTRFLVSYFFHGGGGWVGTPLSGTLYIPSFSVEVQPFETWLNRIPKTLSRVDTHPNTSAISTGNAGKLNIPDNSVDYIFLDPPFGSNISYSELSFLWESWLEVRTAIEKEAIESSAQSKSLDCYRALMSECFKEAARVLKPGHWITIEFSNTKASVWNSIQTAIRESGLIVANVSALDKKQGSFKAVTTTTAVKQDLVISAYKPKDDIEIVFNSKTDDFKGVWEFISSHLSFLPITKYQGSDLVKIPERDPRILFDQLITTCIRKGIQVPLSSQDFLKGLLKRFVEREGMVFLPEQVAEYDRKRALSNEVMQLSIFVDDEASAIEWMRQELKEKPKTYSEIHPLFLNELSGWKKNELELELSTLLEQNFIKYDGKDEVPAQIHTYLSTNFKDMRGLDKSDPKLVAKAKDRWYVPDPNKAADLEKVRLRALLKEFETYKVEKKKIKQPRAEALRAGFNTAWEAQDFQTILDISAKIPPAVLQEDEKLLMFYDNALTLTSTEDDEW

SEQ ID NO: 3397 - protein, 931 aa, Thiorhodovibrio sp.
MSKQNTLELNDTAEQKPSGPVTCLGMTFENDEGRRAHFTEELRKKLQDPEFRKIEGFPIGSDEDILALSDPPYYTACPNPWIADFIAEWEAQKPEQPEGYHYHREPFAADVSEGKNDPIYNAHSYHTKVPHKAIMRYILHYTQPGDIVFDGFCGTGMTGVAAQMCSDREVVMSLGYQVKPDGTILQEEADEDGKKVWRPFSKLGSRRAVLNDLSPAATFIAYNYNTPVDVTAFEKEAKRILKEVEKECGWMYETKHSDGRTGKINFTIWSDVFICPDCSKEIVFWDIAVDKENDCVRENMSCPHCSAELTKRGMERAWQSSYDSSIGETVQQAKQVPVHINYSVNGKRFEKAPDGDDLNLIDRINGLNIPYWHPAVRMMEGKETRRNDPIGITHAHHFYTKRNLYALASTIDKTHFDRTLFVVTAIIRTLTKMFRWAPRGKHTAGTSGTLYVPSITHEYPIFGAIERRLAIYKDWLRFAGKYESPNICMCTDSSDTTIERDSVDYIFLDPPFGSNLNYSELNFLWESWIKVATDNKPEAIENSVQNKGANEYRQLMMACFKEAYRVLKPGRWMTVEFSNTKASVWNSIQTALTEAGFIVANVSALDKKQGSFKAVTTPTAVKQDLVISAYKPNGGFEERFKKEAQTEEGVWDFVRTHLKYLPVTKRQGVLLLMVPERDPRILFDQMIALYVRKGFPVPISSLEFQIGLAQRFIERDGMYFLPDQVAEYDRKKMTPGAPQQLSMFVSDEASAIQWLRQLIKEKPQTFSDINPQFMQQLGGWSKNEAQLDLRELLNQNFLCYDGKGPVPEQIHAYLSTNWKELRNLPKDDPTLIAKARDRWYVPDPKKQGDLDLLREKALLKEFEEIKQRSKRFTSKDRFRNEALRVGFKVAWQNRDYATIIQIADKIPHNVLEEDPKLLMWYDQAVTRMGGE

SEQ ID NO: 3398 - protein, 925 aa, Ectothiorhodospira sp.
MNSTDSLDLRSETTSGPVECLGQTFPSDQARREHYLKLLAEKLKDPEFRKQEGFPHGTDEAILAMSDPPYYTACPNPWLAEFVEHYGKPYDAQQTYSREPLAIDVSVGKTDAIYRAHSYHTKVPHLAIVPSILHYTQPGDIVLDGFAGSGMTGVAAQWCASAPADYRHELEMEWKKQGKPAPKWGARRVILNDLSPAATFIAANYNLPFDVDTFAKAGKQLLKEVEQEIGWMYETLHSDSKTKGRIEYTVWSEVFTCPECAGEVNFLDEALDKDSKRVRAAFPCPHCGAELNKGRMDRVLENRLDPCTSKPWQRVKFKPSLIVYKVGNARYEKEPDDQDMATLARIQAMPYPASIPNTPFPVEQMYHGSRIAPKGFTHVHHFFLPRAAHAMGLLWDQASSHPDQRIRAFLKFVVEQAIWNITVLNSYRPTGFSQVSQYMKGVYYVPSQHAELSPRYILGGKIDRLIKLFSASVIGQRQCAAVTTGTAGRLPLSDDSVDYIFTDPPFGENIFYADLNFLVEAWHGVTTESRSEAIIDKPKNKALPEYQHLMQRCFAEYLRVLKPGRWMTVVFSNSKASVWNAIQVALQQAGFVVAEVSALDKVQGSYRQVTSTTAVKQDLVISAYKPNGGLEQRFAERGATPESAWDFVQTHLKQLSVTKAKNSELEFIVEREPRRIFDRLVAWFVRHDVPVPISNDEFLTGLRSRFPERDGMVFLPEQVAEYDKKRAQVAQAPQMELFVSDERSAIDWLADFLKRRPSTYQEVHPEFTTQLGAGWKKHEAKPELMALLENNFLKYDGTGDVPSQIHSYLSTNHKDLRGLEKSDPRLIAKAKDRWFVPDPNKAQDLEKKREKALLKEFQVYQAFTGRRLKEFRLEVLRAGFKEAWGKKDYQTIIAVAKKIPDEALQEDEKLLLWYDQAMTRTEDGL

SEQ ID NO: 3399 - protein, 850 aa, Clostridium papyrosolvens
MELNKETLDKVRNIEGFPIGKDEDIIKLSDPPYYTACPNPFINEFIEKSGTQYDEENDNYNVEPYTADVSEGKNDPIYNAHSYHTKVPHKAIMRYILHYTKPGDIVFDGFCGTGMTGVASQMCGNPDSLFKLSIEQDMKNIRWGARRAILNDLSVAATFIAYNYNKPQTAAKFSADCSDLISEIEKECHWMYKTNHIIDGRPQIGIDGQVIKGNINYTVWSDVYLCPNCNTELVFWNVAVDKENGVVKEHFNCCHCNKDLTKKDLEKLWITKYDKAINGKVVQAKQAPVQINYTVGKKRYDKEPDEYDIQLLNKIDEIEIPYWYPNNVLPEGYNTEQPKKSHGITNVHHFFVKHNLYVLAKIYNASKNNPHILCLIGDMLPRASKMHKIAVSRLNSNLSKTAGILTGTYYIPSNSIAYSLIEMLKSRVADVENYINKTNYNDDCIISCQSTTSMSNINDNSIDYIFTDPPFGENLMYSELNFLWEAWLKVFTNNRHEAIMNKVQNKTLNEYQDLMEKCFMENYRILKPGRWMTVEFHNSQNSVWNAIQEAILKSGFVIANVKTLDKKQGSFKQVTTTSAVKQDLIISAYKPKSSFVHRFLIEAGTEEGVWDFIREHLSKLPVVVECSGMLDTIPERQNYLLYDSMVAFHIQKGATVPLGAADFYLGLIQRFPERDGMYFLPGQVSIYDAKRITQELNEQMSLFVLDEKTAIQWLHIELATPQTYQDVQPKFLQELKQLKYEKMPELRDLLDENFLQDEQGKWYVPDVNKQSDLEKLRDKKLLKEFDEYRNSKGKLKLFRMEAIRAGFKHCWKEKDYKTIVNIGERMPEAVVQEDPSILMYYDNARTRIGD

SEQ ID NO: 3400 - protein, 853 aa, Thermoanaerobacter ethanolicus
MKLTKEMLDKVRDIEGFPIGKDEDIIELSDPPYYTACPNPFINEFIEKYGKPYVEEKDDYNCEPYTADVSEGKNDPIYNAHSYHTKVPHKAIMRYILHYTKPGDIVFDGFCGTGMTGVAAQMCGNPDPEFKLKVEKEFEKEGKKVEWGARRAILGDLSPAATFIAYNYNTPVDVEEFKKEAERILKEVEKECGWMYETIHTLDGVPQYDITGNVIKGKINYTVCSDVFICPSCSNEIVFWDAAVDKDDGKVLDEFKCPHCGAKLTKTSLERAWRTVYDKAIGETIKQAKQVPVLINYTVGKQRYKKKPDKFDLELIQKIEEMDIPYLYPTDAIPKGDKTGEPIRIGITHVHHFYTKRNLYVLSALYERINNIVNLNRRNFYWLISAVTEGGSRLNRERPKGLPSKLSGTLYVSSMIHEVNIIDFIDRKIAKRILINKDAGINLGKVKITTQSCNNFDNINSNSIDYIFTDPPFGDNLMYSELNFLWEAWLRVFTNNKTEAVINKIQKKGLHEYQELMEKAFSEMYRILKPGRWMTVVFHNSKNAVWNAIQEAILKAGFVIANVRTLDKKQGSFNQVTTTNAVKQDLIISAYKPKEGFIKRFLKEAGTEEGVWDFIRQHLEKLPVVIETNGKLDIIPERQEYLLYDSMIAFHIQKGATIPMSAAEFYEGLKKRFIERDGMYFLPDQAAIYDTKRLKLELNEQLAFVIQDEKTAIQWLKFKLLNKPMTYQEIQPMFLEELKQLRYEKLPELLDLLQENFLQDEAGRWYVPDANKQADLEKLREKRLLKEFEEYKNVPGRLKVFRTEAIRAGFKNCWKNKDYETIVKIGEKLPENVLQEDQTLLMYYDNAVTRLGG

SEQ ID NO: 3401 - protein, 849 aa, Thermoanaerobacter ethanolicus
MKLTKEMLDKVRNIEGFPIGKDEDIIELSDPPHYTACPNPFISEFIEKYGKPYEEEKDDYNCEPYTADVSEGKNDPIYNAHSYHTKVPHKAIMRYILHYTKPGDIVFDGFCGTGMTGVAAQMCGNPDPEFKLKVEKEFEKEGKKVEWGARRAILGDLSPAATFIAYNYNTPVDVEEFKKEAERILKEVEKECGWMYETIHTIEGVPQHDVEGNVIKGKINYTVWSDVFICPNCSNEIVFWDAAVDKEDGKVLDEFKCPHCGAKITKTNLERAWRTVYDKAIGETIKQAKQVPVLINYTVGKQRYEKKPDKFDLELIQKIEEMDIPYWYPTDKMPEGYNTEQPKKSHGITHVHHFYTKRNLWVLSAIYDKIKEPKIKFLFTSAIANLAITARYKFHRSGNVPLTGTLYIASLPTETNVIHGFKGKLGVLKKLFKVLDINISNCLIMTQSTNELSNIPSNFIDYIFTDPPFGDNLMYSELNFLWESWLKVFTNNRTEAIINKTQRKGLNEYQELMEKAFSEMYRILKPGRWMTVVFHNSKNAVWNAIQEAILKTGFVIANVRTLDKKQGTFNQVTTTNAVKQDLIISAYKPKEGFIKRFLKEAGTEEGVWDFIRQHLEKLPVVIETNGKLDIIPERQEYLLYDSMIAFHIQKGASIPMSAAEFYEGLKKRFIERDGMYFLPDQAAIYDTKRLKLELNEQLAFVIQDEKTAIQWLKFKLLNKPMTYQEIQPMFLEELKQLRYEKLPELLDLLQENFLQDEAGRWYVPDVNKQADLEKLREKRLLKEFEEYKNVPGRLKVFRTEAIRAGFKNCWKNKDYKTIVKIGEKLPENVLQEDQTLLMYYDNAVTRLGG

SEQ ID NO: 3402 - protein, 921 aa, Nitrococcus mobilis
MTSLFEAGKQISGSVECLGQTFPSDQARRKHYLKLLAEKLKDPAFRKQEGFPQGTDEAILAMSDPPYYTACPNPWLADFVQQYGKPYDPAESYRREPLAIDVSVGKTDPIYKAHSYHTKVPHLAIVPSILHYTKPGDIVLDGFAGSGMTGVAAQWCGTAPAKYRHEVELARKKEGRPAPQWGARRVVLNDLSPVATFIAANYNLPFDVDAFAQAGKQLLKSVEQDVGWMYETLHTDGKTKGRIGYTVWSQLYSCPECAGEVNFTEEALDEKSKRVKESFPCPHCGAELIKSRLDRLYTAKLDPSTGNTIQVPKRAATLISYTDGKTRYEKKPTHDDLAVIQRIESLPLPFQVPTIEIPPMHMTHERARMDYAGVTHIHHFFLPRAAQAMGKLWEKANAYPGARTRAFLLFFVEQAIWGMSVLARYTPTHFSQVNQYLSGVYYIASQHSECSPWYILDGKLSRLEKAFHGYRSQFGFAGINTGAAAQLPLPDASIDYVFTDPPFGENIYYADLNFLVESWHGVTTDAQPEAIIDRFKKKALPEYQHLMQRCFAEYHRVLKPGRWMTVVFSNSKAAVWNAIQVALQQAGFVVAEVTALDKLQGSYRQVTSTTAVKQDLVISAYKPNGGLEQRLAQRGATPESAWDFVQTHLRNLSVTKTRNGEMELIVERDPRRIYDRLVAWFVRHDAPVPLSSDEFLSGVRSRFPERDGMVFLPEQVAEYDKKRAQMAQAPQMELFVSDERSAIDWLTDFLRKRPSTYQGLHPEFITQLGAGWKKHESKPELSQLLEDNFIRYDGAGDVPSQIHSYLSTNHKDLRGLEKSDPRLVAKAKDRWYVPDPNKAQDLEKKREKVLLKEFESYRAATGRRLKEFRLEALRAGFKAAWGNKDYQTIIKVAQKIPEAALQEDEKLLLWYDQALTRTEEP

SEQ ID NO: 3403 - protein, 885 aa, Pelotomaculum thermopropionicum
MAKENQISLDIFLKEGNERKKIQENRFKLTKEHLDRVRHIEGFPIAKDEDIISLSDPPYYTACPNPFIRDFIKEHGKPYDPDNDAYRRQPFAADVSEGKNDPIYNAHSYHTKVPHRAIMRYILHYTEPGDIVFDGFCGTGMTGVAASLCGDRRTVESLGYRVLDDATILDEKGRPFSKLGARKAILIDLSPAATFIAYNYNTPVDVRAFEREARRILDEVERECGWMYLTQHVVDGKVQKDAKGNPIMGKINYTVWSDVFICPSCSRELVFWEVAVDKEEGRVRDEFPCPHCGANLTKRTLERATERVYDREIGEFIIRARQVPVLINYSVGNKRYEKKPDGYDLELIRKIEEIEIPYWYPTDRMPEGYNTEQPKVSHGFTHFHHFYTKRSLACLAVLWNCFRFRNRKITSRLLYSFTSLYQRVTKMAEYRKGGGSGNIPNFYIPSFNREPNVYEVCKRKLRNIITALIAMSLCHSQNTISTQSAGQLHQIKSSSTDYIFTDPPFGGNIMYSEMNFLWEAWLRVFTNNKPEAVENKAQGKGPREYQELMEKCFAECYRILKPGRWMTVVFHNSQNRIWNAIQEAILRAGFVIADVRTLDKKQGTFKQVTSTTAVKQDLVISAYKPNGGLEKRFHLEAGTEEGVWDFVRTHLKHLPVFVEKNGRAEVIAERQNFLLYDRMVAFHVQRGVAVPMGAAEFYAGLKQRFPERDGMYFLPDQVVEYDKKRLTVQEIEQLSLFVTDEKSSIQWLRSELSKKPQTYQEIHPKFLRELHKAPHEKLPELSELLEQNFLKDDNGRWYVPDPGRQSDLEKMREKALLKEFAEYKEGRGRLKVFRTEALRAGFKACWAAKDYKTIIEVARRIPDTVLQEDTTLLMYYDNALMRLEE

SEQ ID NO: 3404 - DNA, 732 bp, Erwinia sp.
atggcagttctcgatctctctgcactgaaccaacttcccaaggttgagcgcgtgatggcgctcgccgaaatcaacaataagctggataagctttccgccgaggaacgggttacctgggggctggagaatctgcccggccaggcggtattaacctccagctttggcattcaggcggcggtgagcctgcatctggtgacgcgccagaagccagatatcccggtgatccttaccgataccggttacctgttcgcggaaacctaccggtttattgaccagctgacggaaaagctcgatcttaacctacaggtgttccgcgctgcgcaaagcccggcgtggcaggaagctcgctacggcaagctatgggagcagggggtagaaggcattgagcgctacaaccagatcaacaaggtggaaccgatgaaccgcgcgctggaaacgttgcagggccagacgtggtttgccggtctgcgccgcgatcagtccggcagccgtgcgcaccttccggtgctggccgtcaaaaaaggcgttttcaagctgctgccgattatcgactgggatgaccgtcaggtttaccggtatctgcaacagcatggcttgagctaccacccgctgcgggagcagggctatctgtcggtcggcgatacccacaccacgcgcaaatggcagccgggcatggcggaagaagaaacccgcttcttcggcctgaagcgcgaatgcggcctgcacgaataa

SEQ ID NO: 3405 - DNA, 912 bp, Erwinia sp.
atgatggatcaaaaacgacttactcacctgcgtcagctggaggcggaaagtatccatattatccgcgaagtggcggcagagttcgccaatccggtgatgatgtactccattggcaaagattcatcggtgatgctgcatctggcgcgtaaagccttttatccggggacgctgccattcccgctgctgcatgtggataccggctggaaattccgcgaaatgtacgcatttcgcgaccgcatggtgaaaaatataggtgccgaactgctggttcaccgcaacccggagggcgtggcgatgggcattaacccgttcgtgcacggcagcgccaaacacaccgacatcatgaaaaccgaagggctgaagcaggcgctggacaagtatggctttgatgcggccttcggcggtgcgcggcgtgacgaagaaaaatcccgcgccaaagagcgtatctactctttccgcgaccgtttccaccgctgggacccgaaaaaccagcgtccggagctgtggcacaactacaacggccaggtcaacaaaggcgaaagcatccgcgtattcccgctctccaactggaccgagctggatatctggcagtacatctttctggaagatatcgaaattgtgccgttgtatctggccgccccgcgcccggtactggagcgagacggcatgctgatgatgattgatgacgatcgcatcgacctgcagccgggtgaagtcattgaacagcgtatggtgcgcttccgtaccctcggctgctggccgcttaccggggcggtagagtcggaagcgcaaacgctgcctggcattatcgaagagatgctggtttccaccaccagcgagcgccaggggcgaatgatagaccgcgatcaggccggctcgatggagctgaagaaacgccagggttatttctaa

SEQ ID NO: 3406 - DNA, 912 bp, Erwinia pyrifoliae
atgatggatcaaaaacgacttactcacctgcgtcagctggaggcggaaagtatccatattatccgcgaagtggcggcagagttcgccaatccggtgatgatgtactccattggcaaagattcatcggtgatgctgcatctggcgcgtaaagccttttatccggggacgctgccattcccgctgctgcatgtggataccggctggaaattccgcgaaatgtacgcatttcgcgaccgcatggtgaaaaatattggtgccgaactgctggttcaccgcaacccggagggcgtggcgatgggcattaacccgttcgtgcacggcagcgccaaacacaccgatatcatgaaaaccgaagggctgaagcaggcgctggacaagtatggttttgatgcggccttcggcggcgcacgccgcgacgaagaaaaatcccgcgccaaagagcgtatctactctttccgcgatcgcttccaccgctgggacccgaaaaaccagcgcccggagctgtggcacaactacaacggtcaggtgaacaaaggcgaaagcatccgcgtattcccgctctccaactggaccgagctggatatctggcagtacatctttctggaagatatcgaaattgtgccgttgtatctggccgccccgcgcccggtactggagcgagacggcatgctgatgatgattgatgacgatcgcatcgacctgcagccgggtgaagtcattgaacagcgtatggtgcgcttccgtaccctcggctgctggccgcttaccggggcggtagagtcggaagcgaaaacgctgcctggcattatcgaggagatgctggtttccaccaccagcgagcgccaggggcgaatgatagaccgcgatcaggccggctcgatggagctgaagaaacgccagggttatttctaa

SEQ ID NO: 3407 - DNA, 732 bp, Erwinia pyrifoliae
atggcagttctcgatctctctgcactgaaccaacttcccaaggttgagcgcgtaatggcgctcgccgaaatcaacaataagctggataagctttccgccgaggaacgggtgacctgggggctggagaatctgcctggccaggcggtattaacctccagctttggcattcaggcggcggtgagcctgcatctggtgacgcgccagaagccagatatcccggtgatcctcaccgataccggttacctgttcgcggaaacctaccggtttattgaccagctgacggaaaagctcgatcttaacctacaggtgttccgcgctgcgcaaagtccggcgtggcaggaagctcgctacggcaagctatgggagcagggggtagaaggcattgagcgctacaaccagatcaacaaggtggaaccgatgaaccgcgcgctggaaacgttgcagggccagacgtggtttgccggactgcgccgcgatcagtccggcagccgtgcgcaccttccggtactggccgtcaaaaaaggcgttttcaaactgctgccgattatcgactgggatgaccgtcaggtttaccggtatctgcaacagcatggcttgagctaccacccgctgcgggagcagggctatctgtcggtcggcgatacccacaccacgcgcaaatggcagccgggcatggcggaagaagaaacccgcttcttcggcctgaagcgcgaatgcggcctgcacgaataa

SEQ ID NO: 3408 - DNA, 909 bp, Erwinia pyrifoliae
atggatcaaaaacgacttactcacctgcgtcagctggaggcggaaagtatccatattatccgcgaagtggcggcagagttcgccaatccggtgatgatgtactccattggcaaagattcatcggtgatgctgcatctggcgcgtaaagccttttatccggggacgctgccattcccgctgctgcatgtggataccggctggaaattccgcgaaatgtacgcatttcgcgaccgcatggtgaaaaatattggtgccgaactgctggttcaccgcaacccggagggcgtggcgatgggcattaacccgttcgtgcacggcagcgccaaacacaccgatatcatgaaaaccgaagggctgaagcaggcgctggacaagtatggttttgatgcggccttcggcggcgcacgccgcgacgaagaaaaatcccgcgccaaagagcgtatctactctttccgcgatcgcttccaccgctgggacccgaaaaaccagcgcccggagctgtggcacaactacaacggtcaggtgaacaaaggcgaaagcatccgcgtattcccgctctccaactggaccgagctggatatctggcagtacatctttctggaagatatcgaaattgtgccgttgtatctggccgccccgcgcccggtactggagcgagacggcatgctgatgatgattgatgacgatcgcatcgacctgcagccgggtgaagtcattgaacagcgtatggtgcgcttccgtaccctcggctgctggccgcttaccggggcggtagagtcggaagcgaaaacgctgcctggcattatcgaggagatgctggtttccaccaccagcgagcgccaggggcgaatgatagaccgcgatcaggccggctcgatggagctgaagaaacgccagggttatttctaa

SEQ ID NO: 3409 - DNA, 732 bp, Erwinia pyrifoliae; identical to SEQ ID NO: 3407

SEQ ID NO: 3410 - DNA, 2376 bp, Aciduliprofundum sp.
atgtataaggtaatatgggattcaactaataatggaatcatattaacaaacagtaataggagagatcagacaataactccccctcgtccagtattctttgaagagttggatctattaggttttaataaattttgggactatcctaaagttcaagagcctctgctctgggcgattggaagaagatattactataaaggagtgcttgtagccgaggctaaaggaggcaacatatttgaacctcctgaaatagtactcaccgaaaaaggacaaaatttcaagttggaaccaatagatgttactaaggtgattgaaaaaaataaagaatctttatttgttctagagaatgaagctttggattttatagagcatacatataaagtctataaaaggaaaagattcttatttgctgtagcttatagtggaggaaaagattcacaggtggtgttagaccttgtaacaagaattatacctccagatgatttagtagttatattttcagatactactatggaaatttcatatacctatgagaatgtagaaaaaactaaaaaagaatacgaaaaacgatatcctggattgaaattttatactgcaaaaccacctaaaccagcgatagagttttggagtgattttggtccaccaagcagaattcacaggtggtgttgcacagtaatcaagacggcaccgttccacaaacttataaaagatgagtttataaatactaaaaatgataaattcaaaatcatagtttttgaaggggtgagaaccgaagagagtgagaaaagatcacactatagcaggatagcaaaaaatgtcaaacaccttatgacagtaaatgcaaggcccgtactctattggaatacatcagagatattcctatatctttttttcagaaatcttttattgaatcgaggatatcgaacgggtttatccagagtaggatgttcagtatgtcccttttcatctgaatggacggaatttgtcttgggtaagttggaagaagatatcgggggatattttagtttattaaagaaatatgctgaatccatggggttaaaagaagaaggacaaataaacaggtatatttctaatggtgagtggaaaaagagatctggagggaggggactcaacaaagactcagatgtaagatttattaccgatcatagttctattaaatccattatgttgaatccaaaggaagattttttggagtggagtaaaactataggagaagtaatgtacaagaagggtccagcaggaaatatttatggagaattgaagattaaaaattccgtgattccctttgaattaaatataaaaaagaataaaacatcaataactttttatgatgtgggatcaaatattgatttaattagtaaggttaagaaagtctcatataaaactgccttttgcatccattgtggcgcttgtgaaatagaatgccccacaggtgctttgaatgtgataccaaaagttaaaataaatagtggtttatgtactcattgtggaaactgtattaattttgttgaaaaaggatgcttggtggccaaatctgtacatgaaaatattggaggtgtgtctatgaaaaaaagaacagggggaatagataaatattctacctttggtcttagagaagagtggttaaatgcattttttaattttggggaagaatggttagaagaaaataacttaggtcccaaacaaatacccgcagtgcttcattggcttattgatgcagagttaatatatcctaaaagcaaaagaaccacacccctaagcaagtatctgagaaaaatatatactaaagatagtttgtttgtatgggaaataatttggaacaatatgtattacaactcccaagtaattagatggtataatgaacaaattagttggggatcaataattactaaaaaagatttgaaagaaaaaattagtttggcttatcccaacctaagcagaggtacactaagtaatccaatagatgctatggttaatatgtttgacaattctcccttgggattggaactaaaaattggcctcttagataaaaaggggagagttgtaaaatctattaaaaaaattggcacagatgatgttcatccattggcagttgcgtacagcctttataaagcagcagaacatattggaaggagagattttacagtatctgaattatatacgaaagaattcaaaggcggaccatataaattatttggaatttcaaaagacaaattagaaagaattttaagaggacttcaagaagataaagaagagattttaagagttgacttagtagctgacttggataacatttacctaagagaagaccttacatctttggatatagtaaaaattgcggaggtgagattaaaatga

SEQ ID NO: 3411 - DNA, 744 bp, Anaerobaculum mobile
gtgtctaattggtattatgaaaaaggttggactcgccataggatatttggattacgaaaggaatggttggaattttacctttctgatcgtgaaggttggcgacaaaactcgaccctgggcaatcgacaggttgattcctttgccacatggctaaaaacggcaggcatagaggataaaaagggtaacttaactgcattgggaatggaatttattagacgtggagtagatgatttatctctttgggaattactttgggtcaacgtcgttttttcttttccaacggcacgttggtatgcacatctgggactaggtacatggtccacaactgagttaaaagcgatgctcgaacaatcagttccccgcttggccgaacgaacggtgatcaatgccataatggaacttgctggattgcttgaacgaactccagtgggaaaagagcttggtcaggggcatgttggtggcaacaagccacgccgcatatcgcgcatcggcagagaacctaacgattctgctataatacactcaattggtaaattatatcttcagcaggacagaacaatacttccgtggtctgagagtcttgcttggccatgggtggtttttggttgtagcctggatagtattctggaacgtttgattaaaatggatcaagattattttatgatagacgataaagggataataatttgccggtccgaaaaggaggaatggcagtgtggcgatatagcgatttcttggctgtaa

SEQ ID NO: 3412 - DNA, 2295 bp, Anaerobaculum mobile
ttggtcgatggatatgatacaggagtgaggagcgatgttcgccccgtattttatgaagaacttgatttactgggctttgagcgctattggagttatccaaaagttgaagaacctcttctctgggctatcggtagccgtagatattactatcgcggtgaattagtggcaaaagccgaaggaggagggttgttctctaagcctgaacttaaaatccatcgaacaggacttacccttgaaccagtaaaggttgagactatgattgataaaaacggggcactccttcaagggttagttcaaaaatcgcttaagttcatttatcagacctatacccgccaaaaacataaagtagatatagtagctgtagctttttctggcggtaaagattccatcgttactctggacctcgttcagcgagttttggagccaaaccagttcgtcgtcgtttttggcgataccggcatggaaatcagcgatacatattatgcagtggaggcagccaaaagacggtggccacacttgtctttttacactgccaaaagtgctaaagataccctgacaagctggcgtgaaatggggcctccaagccgcatacatcgctggtgttgttccgtccacaaatcggtgcctacgttattactactgcgtaagcttttaaacaaaccatcagctaatgcaatgatcattgatggggtgcggaatgaggaaagcagcggcagagcgacttatccttctttgactttagggggcaaacacaagacgcaaataaatgctagccccattattacatggaatgcagctgaagtctttttgtatctctttggtaggcgattgcttttgaacaaggcctatcgttatggtgccacacgcgttggttgtgctgtttgccccatggcttcagtatggtgggatattattagtgggtctgtttattggcaagatatgagatcttttattgaagagctatgttcttacgccattagttcaggtatccatcatgatgaggaaatcaaaaaatatatagagaaaggaagttggaaaggtcgggctggtggccgatatgtttctggcggtggaaatcgtgtgattgagcagacaagcaatgataaggttattttttcactgcgctaccccgctgaagattggcaagaatgggccaaaactcttggtcatgtagtgagaaccggcatagggcagggatacatagagagaggcggcaacacatatccttatttcgtacaaaaaaacgatcacagcgttactgtagaagtgggtggtttggcgaacgcagaccgatgtactcttaaggcatttcgtgctgtagcacttaaaagtgcctattgctgccactgccaagcctgcgaagctgaatgtcctgttggagctttgattacctgtgagcaggttcatatcggcgatgaatgtcaggcttgtggtcgatgtcttgacttgcatggtgagccatgcctaaccgctaaatctatatcaacaagtgggggaggtttaagtatgaatgacaatcacaaaatggttttacacacgtatgaacactttggcatggaaaaaggatggctagctgctttttttgcttcaccctttaattggattaacagtaatactttgggcaaccgacagcttgatgcaatgcttctatggcttaaacatgcggaattaatattgggcgggaatactaaaaatacttttaatataacaaatttaggggaaaaactagctcgattaggagttgacaatttggttacttgggcagtcatctggacgaacttggcacgaaattcaaatgctgtgaagtggtatcttacagctattccctggggtgttacaatgactaaagccgaattagtatgcaaaatgggtgaaacatattctcaaagcgaaactactaggcgaaatgcaatgacagcgctttttggtttacttctaaaaaccccattaggtaatgagttggggcttggtataggaataaatcaaggcaaacgcatcagtaatgtactatataaaaagggttggtttgagccagacccattagctgtgctttatagcctctatcgatatgcggaaaaaacatcacgatatgagttcactgtgcatgaattgtatgagggtactgacgagggtccgtatacattgtttggcgttccgcaggatgcgctaatagggattgtgaagggtttatcagctcgtgatgatagtttaattcgtgttgatattgtacgtgatttagacaatatttttttgaatcatcacaataagtcaattgaggtgcttgattgtgtctaa

SEQ ID NO: 3413 - DNA, 2268 bp, Candidatus Desulforudis
ttgaaagacgaagcagcagagagcattcccggcgcggttcgacctgtttttcacgaagaattggatcttttgggtctccagaattattggaagtatgagccgcatatggtgcctcttctatgggctgtgggacgccgttactattaccgagggcagtttgtggcggaggcgattggtggcagctttttcgagcgcccgcgcatgcatgttcaggctgagggattggcacttgagccggtagatctgtccgggatgttagagaggaacgactctatccttagggacatggtgcacgcgacgctggattgcataaaagcggtccatgagcggtatcgcgaccgcgtggatacagtagcggtggcttttagcgggggcaaggattccctggtgctgctcgaccttgtgcagcgggtgttgccgccggatgaattcgtggtggtcttcaacgacactacgatggagctttccgcaacttacgaagcagtagaagcggccaaaaaacggtggggaaagttgcggtttttcaccgcgcgcgccccgcgcccggcgcgagagacctggcaagaattcggtccgccgagtcgtttacaccggtggtgctgcacggtgcacaagtctgctcccaccctgcgcctgctgagagagatgtgcgggagaccagcggtgagagctctgatatacgacgggaaccgaagagaagaaagcccagcacgcgccgcctacccggcggtttccgaagggaagaagcatcccggccaaattaatgtcagcccgctgctgaattggggccttacagaagttcatctttatctgatgtgtcgggatcttctattgaacagggcgtacaggtggggcgtggtccgcgtcggctgcgcggtttgcccctttgcttcgcagtggagtaacttcgtctgcgggttctgttttcgggaagatgcgcttattttcttagagttgctggagagctatgcaagaaaaaaggggataagcagcgaggtgggtagacggcgattcatcgctgagcgctcctgggcaagccgggccggtgggcgtgaaatggcggcacgggccagggtttttctggaggagcaagacggtcaggttgttttcctgctgcggcgcccccgtgaggattggttggaatgggcaaaggccttaggctccgtagaacttgaagcaccagggcggggggtaataacgaacagcttcggttctttcccttttcgtctccgggactatgaaaaggggctcgcagtcaccatcacccgcgtggcgggtactgaccccattttcaagagtcggttgcgggcggtggccaacaaggcggcctactgtgtcggctgtagaagttgtgaggtggaatgccccacaggggcgctccgtgtggacaaaaaggtggcaatcaacgccgtgcggtgcagccattgcgggcggtgtctctcttttgtagagaagagttgcctggcggcgaagtcactctctgtaactgggagcggtgatcgcgtgaaaggtttgaacagatatcaggagtttggtatgagaaagcagtggcttgcggaataccttaggaatccacagagctggtgggtagagaatacgctgggcaatcgccaactggaggccatgcgtgtctggttgcgggaggcagaacttgccgagaatcagagcctggggcttaccccgctgggagaccggctgcagcagttgggggccgaccacttgctcacgtgggcggtggtttggaccaacctggcccacaactccgccctggtgaactggtacgtgcaggaggtaggctggggcatcaggtggaccaagcgggggcttgtttcgctgatgtcggaggacctaagccagcgcacacgggaaaacgcagtcgacgcacttgtcggtctccttacccacacgccgttgggcgaacaactcgggcttggctgcgcggagaggaaggggagggtgatccaggcggtgaccaaacacggctgggccgacccccatcccgtggctttactttatgcgctctaccgccttgcggagaagttaacacgttacaactttactcttagtgaactgtttgaagaaaaaattgaaagcccctttcttctcttcggtgtcggccgggaactgctgacgcggtatctgcagggcctttcggtgaaccggccggattggatccgtgtagaagccgtccgggatctggacaatgtttacctcgaagaggggcggcgggctttcgaggtgctcgaccttgtactggcgaggacatag

SEQ ID NO: 3414 - DNA, 798 bp, Coprothermobacter proteolyticus
atgtggacatttgactcctatgacgaattggttgatgctataagggaaaggtactctaattttggtcttcgagaagaatggatgacatcattcttgaatcttggagaagactatcttcgtaataacacattagggcccaagcaaaagacagccttaaatgaatacttgagggatgctggtttcatagaaagaaacagaaaaagcacggagttatgtgatgttgtcaggtttggttattctttaggttcactttctgtgctgagcgtgtgggcgattatatgggcaaatctttgtcataactcgggaatctttctatggtgggcaaaccaaccacccggtaattatacgagagagagcatgcttcaggagttgcgacaaactgataaacgagagagaactttgacaaacattactaattcccttataagtacccttcagtccacaccaattgggaaggatttgcgccaaggagaggtcattaaatcgggccgaagcagaattgttcagaaaattggacatccaaagctcaacttagtggaagttatctatgctttctacatgtttgctaggaaacatgaaatgttctccatatccattgaagatatggaaccatatgttgagtcaccgcaaaagattttttgcataacatcggcagagttggcagatgtgttggggagtagcaaaagcgaaaagctcttcaaggttacctggaccaatgacaaagtttacctggatttggatgaagggcttaatgaggttgacgtgctaaaaatgtgtatttccacagggggtgggtaa

SEQ ID NO: 3415 - DNA, 2382 bp, Coprothermobacter proteolyticus
atgtacaacgttaactgggatttggaaactaacggaatcgtactaacttccgaaagcaaaaacacactaattgtaagtcctcgtccggtcttctttgaggaattggagctacttggcttcaatgagttctggaaatatccgcataccaaagaaccacttttgtggcgtactggtcgaagatactactacaaaggtaccatggtagctgaggcaaaaggtggcggtatttacgagaggccccgcatagaacttacggatgcaggaaaaggacttggtcttgagccggtaaaacttcaagctatgcttgaaaagaacaaagagcagttggaagttttggagaatgaagccattgacttcgtgaaccacatatataaaagatataaaggaaaggtcagcgctttcgtggtttcctttagtgctggtaaggattcgcaagtcatattggacattgtttccaaagttattccacctgaggattattttgtgatttttacggacactaccatggaaataccccccacttacgaagctttcgaagaaacaaagaggaaatacagggaaacgtaccctgaactaaagttctacacggcaaggaactggaaaccggcggaggcaacttggaaggaatttggtccacctagtcgactcttgaggtggtgctgttcagtgcataagagtgcgcccatgataaggttagttcgtgaaatagttggcagaaacgatggtgtgcggattgtggtttttgatggtgttagggaagaagaaagcacacgaagaaaaggttactccaggcttgctgagaacgtgaagcattttacgcaaataaatgctgaggtaattaagcgctggacgacaacagaagtttacacgtacatacttgctagagaacttcctttgaacacggcatatcgcctcgggttagacagagttggttgcagtgtttgtccgtttgcctcgcaatggacagagtacatgataggaaggggctacttagaaactgtaaagagctttatcaaccaagtagagaaaacagtagaatccctcggcatagaagataaggctgaagtaagaaagtacatctccgagggtaactggaaaaaacgcggtggcggtgagggcgtcgacacggggaaaacacgcttggacatcatccagaaagaagaaggtcaacgatttgttctaaatgatcccggcgacagatttgaagaatggataaaagtacttggtcctgtgagggttgcgagtgacaatgggaagttggaaggagatcttctggtatcaaatagaacgctgcatttttctgtcgataaaaacactgctggacgtgccatagttgacattgatggaataaaaggcgacaagctacttcttggaagacttaacaaagttgcctataaatcgacttactgtgcgcactgcggagtatgtgaagttgaatgccctacgggtgcattatctgttatcccatcggttttggtgaacacaagcaaatgcattcattgttacagctgtttggattttgttgaaaagggttgccttagagcaaaatctgtggcaactttggtaagtcaaaaggagggaggcaataccatgtcgacgctgtctggttttggaaactatttgacttttgggctgagaagcgaatggttaaaggatttcatgatgaagggaaacaattggttttcagacaacattcttggccctaaacaagttgaagccatgctttattggttacgtgatgcagagcttatcgatagtaagaggaaaacagtaacacccttttatgagcacctaaagggcatatttgaaaaggacgagctgctggcttttgaactagtgtgggttaatctgttttacaattctgctccagtgttttggtacctgagcagagtcccatggggtaaagcttactcttcaaacgagctcaagcaaatggtggaaaacgaggggcttaccataaccaaaagaacaatatcaaacggtatcgatgggttgtttaacactttcgaagctaatcaatatctgcaaaagctcggtgttgtttctgtggtgagacatgaccgagaacgagtggctttaaagatgggtacgaacgatgtgcatccagcagcagtcctttattcgctttaccgctatgcaatacgcaaagggtattacaaccttacggtaaaggagctttataacgaatccaacagtgcttatggtgggccctacgtcatttttggcgtagaaaggcaaagcttagagcggctgcttcgtgggatgcaagaatactacaaaggacttgtcagcgtggatttggtagcggacttggacaacattcacttggacccttcggtcaaggactacaaggagctgctatctgaaaatgtggacatttga

SEQ ID NO: 3416 - DNA, 801 bp, Cyanobacterium stanieri
atggcagggaagaaaactaggcacgttttagggctttcagggggtaaggatagcactgctttagctattcttttacataaagaaatccctgatatggagtattttttttgtgatactcacaaggagttacaggaaacctacgattatctcgatcgcattcaggctcgtttaggcattaaaataaattatcttagcgaaaaaagaggttttgatcattggttagcgattcatgatggtttattgccttctcctcaaatgcgctggtgtacggtaaaaatgaagattaagcccttcgaggagtttgtgggtgatgatgaggctatcagctacatcggcattcgtgcggatgaaaatagggagggttacatttctacaaagccgaatattaaacctgtttttcctttcaaagagaggggtttggtaaaggctgatattattcgtttgctagaggaaagcggtatcggtttacctgaatattataagtggcgtagtcgctctggttgttttttttgtttctttcaacgcaagtatgagtgggtgatgttggcagaaaatcatcctgatttgtttgcgaaagcggtggaatatgaatcaaatcatcgggatggtagaacttatacttggactcagggagagactttattacagcttttggagcgtaaagatgacattatagcacaacatgaaagggcgatcgcccgtaaacaagaaaaagccccgaatcgccctctggcagaagcgttggagtctgtattagatgaggaagattctaccttgccttgtttagtttgtaatttgtaa

SEQ ID NO: 3417 - DNA, 2295 bp, Denitrovibrio acetiphilus
ttgtattcatatacatatagtcaaaaaacgggtggaatcttactgaactctactccaacggggttttccaaagaacctcgaccggtttatgctgccgagctagacttgttaggttttgataaattttgggaatacgataaacagaacgatatcccatacatgtgggcagaagctaatgcttattggtatcgtggtgtttgtgttgctaaactaaaaggtggaaatctctttaatgctccagaaataataatcccagtaaatgacaatggtgagtccatattacctgagccaaatggtaaagcacttcaagtggttgatgttaatgcgatggtagagtcaaacagagaaatgctcgatattattgagcagtccacggtaaaaaaaattatttcagtttatactaaatacaaagacaagctagatttattccatgttgccttttcaggaggaaaagatagtgctgttttgcttgatttggttaaaaaagctctaccgttaggaagctttgttgtcgtgtttggcgatactgggatggaatttcctgacacttacgatgttatagacaagacacgacaaatgtgtgaagcagatggcattcctttttatatagccaaatcaagccttgagccacaagagtcatgggtgctatttggtccaccttcaagggcacttaggtggtgttgtggtgtacataaaagtgctccgcaaacattgaagctaagagcggttacagggaaaaacgattatactggcttagcatttgttggagtccgttcagaagagagcgctaaacgcgctgagtatgattacgaaaactatagtaaaaaacaaagagggcagtacagtcacaactctattctagagtggacttcagcagaagtgtggttatacttatatgcaaataatatcatgataaacgaagcctataaaaaaggaaatgctcgtgctggttgtttattttgcccaatgtctgttaaaaaagcagactttgttaaacagcaaatctatcctagagagataaagacctacttagatataatcaaaaaatcaaatggtagggattttggtggaaattcatatctcgctgatggcggttgggtttcacgacgcagtggtcgcgatttaatagacaatgtgatgaattgttcagaaacattaaaggatggaatgttgacaataaaagttacttctcctagaagtgactggcgtgaatggattaaaactttaggtaatttcgaagatataccttttactattgagcaacaaagtaataattatttggttaaattacctgaatcgtacataaataaaaatcccacatttagaaaactattcaaacaagtttttcgaaaatctgcatattgtgttaaatgtggagtgtgcgaatcaaattgtaattcaggtcgcataactttcgacaatgagttaaaaataactaattgcgaacactgtcttaagtgtcacgatatagtagatggctgccttgcctataactcattgagaataccaacagaggagaaagcaatgtcaataaattgttttgattcagtattgccaaaaaatgattggtttaaccgtttttttaatgaaaagaacgatttttggaatgatcatgggttgggacctaatcaattaaagacctttaagcgctttcttaaagatgcaggcttgactgaaaaaaataattatacagctttagctgaacaaatagccgcattaggctgggaaactaataccgcttggggcattctattaattaatctggccacagataatccgcaaatacgctggtatatatcaaaccttgaaataggaatgaattatcctcgtgaaactgtaatatcaatgttgctagaatctaacagcagtaataatgttgttaaatttgtttatagtgcgtttgggaaacttatggaattaccgcttggtgctactcttcggtttggctatgtaacaaatgagggaaatattgcccgcactaaatgctctatttcagacttgagagtaattctgtatgggctgtttaagtttgcagaaaaatgtaataactataaagagtttacgttagcttctcttatcagtaacggtatagatcgcgatggtataagcccaacaagaatttttggacttgatcgagaagacgtaacaccaatgttacttggtctttcaacaaaatacccagaatttattactgtaagctttactcatgacttagaaaaaataactctcgctgattataaaacgtctgcagatgtaattgaactttttagtgaggatagcggaaatgagcaataa

SEQ ID NO: 3418 - DNA, 2385 bp, Desulfitobacterium dichloroeliminans
atgtactcttacgtttgggataaaaaaactggtggttatttgctaaccacgcagataggcaagttcgttgccaacgaaatacgcccggtatttgcgcctgaactctcgttgacaggactgggcagattctttgaatatgatcggcgtgaaacccgccctcttttgtgggcgcagaaaaatgtctacttgaaaaacggcgaaaaaattgcacagcttaacaatacacagtacggcaagccgttgaacatccaggtctttttcgagggcaagcttaaactcgaaccagtggacgttgcgtcaatggttaccgcaaacgccgacattatggatatcgttgtggctgatgcgaaacgccgcacaaaggaactttatgacgcagatatcggacgttgcgatatcgcctatattgcgttttccggtggcaaagattctgttgcgctccttgacctatgccatcgagtcctaccgctctccgtacccgttattttcagtgacacggatatggaactgccagacacttataaagtttgggaggaaatccaaacccgctacccagagagagagtttatttgcgcgagagcgggaacgtccgcgcttgaaaactggcggacatttgccccaccatcgcgaacgattcggtggtgctgttccgtccacaaaagcacgcccgcacttatgtgtctgaaatataaactacacaaggcggcggttagggttatggcatttgtaggagtgaggggcgacgaaagttacagtcgttccttttacgaagacgctaaggatggcgcaaaaaatgcttcccaactaaaccgcatgccgattttggactggggagcacacgagttgtggctgtatatactcgctaacgatttgctagtgaattgtgcgtacaaaaaaggtctaacccgcgttggttgcctgatgtgtcccgaatcgtctgagaagtacgaatggtttgtggacaaggcttatcctcggctgttgaaaccttacaacgatattataattagcacaagctcaaaaagttttaagacagcagaagaacaaatagaatttatcggaagcctaaattggcaagctcgaaaaaatggactcattcttagagacacaattacaaatccacttgaagtaggcgcgggtctaaaaaccacattccaaagtccgcattttttaaaggatttgttctacgaatggattaagacacttggtatggttgttaaggaacgtgaaacagaccgtcagagattgaaattgccgaacacgcttgatgacggaatactctttagttattatgcgccctatacaggcggaggcactgtaacgtttgagtttcgctccaaggaagaacaggcttcgttattgccagtcttacgctcttttttgcgtaaagtatcggcgtgtgttgtttgccgaagctgtgaagctgaatgtcctgttggagcaatgagtgttaaggacaataaacttaaaatcagcgcaacaaaatgtataaagtgtcgcaagtgctacaattcggacaacaattattgttggaggtataagtctatgtttaagccagaaaccgaaaagaacaacgtaatgcgcagcattgcgaactatgaaaatttcgggttgcgcgaaaaagggaattacttgtgggtttcaactctggttgaattaggcgataagtttttcccttggcacgaaaatcacccgctcggtaagaatatggtgaagtctgcggcccgaatttggttcacacaagcggggcttattttcgcaaatgataagaaacctacaatacttgtagaactgttccggaaattcggtggggcttcatcgctcggttgggaatatatttggcttacgctcgcaaacaatgccattttgataaagtggttcataacatctacagaaatcggaaccacatacactattgaacagttggtaaggatgctgtctgaaagtaatccaactctcggtaaatctacaatagatggcggacttaatgctctgaaagatatgctcagtaaatcccctctcggcggcgaaggtgcggtgaccctccctgaaatgaaagggcgtacagtggttagcctcacccgagaatctaaagatgtgcacccgctcacgctcctctacggtttgtacctcattgctaacaaagccgagcgcgggagctttaccgtgcgcgaattgatgacggcagatatagagtctacctttgtttcgccgctcgttgcttttggtattactccggatacatttaaaaaacagtgcgaaggcttacgaagtaaatacccggactatatttccaccacgttcacgcacggcaacgacgggcttgaggtttttcagaacagatataccatagaagacataatctcgcttgcattgggggagtag

SEQ ID NO: 3419 - DNA, 2355 bp, Geobacter sp.
atgtatagctacgagtgggaccagcgtactcgcgggtaccgcctgacgacacagacagggaagttcgttgcaagcgaaattcgtccggtttttgctgaggagctgacgcttccaggcttcgaggcgcagttggtgttcgacccgtcggagcggttgccgctcctctgggcgaagcagaatgtgtatctgtatcgtggtgaagaaatcgcgaggcttaataaaacccgctacggcaagccgctggacattgaatggaagggggtgttgtcgggtgatgtctcgcacgagggtgtaaagacacgaaaaaaattgaaactggttccggtagatgtcgaggcaatggtaattaaaaactctggcatcatgaccgctctagtgatggacacactcaagcgtatcaaggagatgtatgacgcctatgtgggaaaatgcaatgcggtctatattggctttagcggtgggaaagactcggtggttctactcgacctatgccacaaggttctcccgttagacgtaccggtagttttcagtgacacggacatggaactgccggatacctatcgcgtctgggaagaaatccaaaatcggtacaaaggccgtccgtttttgaaggtctcggccaaaacccacgcattggaaaactggcaacttttcggcccgccgtcgcaggcattgcgttggtgctgttccgtccacaagagcacccccgcaatattagcgctcaaggaaaggcttggtgaaagatcaatcaaaacgctggcatttgttggggtgcgtggggaggaaagccaacggcgttctggttacgaagatattggagatggtttgaaaagccaatcgcaggtgaatgctatgcctatattggcgtggtccgctcatgaactgtggctttatatttttgagcatgatcttgttgtaaacgaagcttaccgaaaagggttgccccgtgtcggatgcctaatgtgtccgatgtcaaccgatcgtcaaaatgacatgatccggatgaatttcccagaagaagtcgcaccgtttgctgacgcagtgcgctcaacgattgaccgcgagtttacctccgaggacgacgcagatgcattcgtttacgaaggcggatggtatgcgcggaaaagcggcgtgtctttaaggcaagtcattggtgaacctggcgtagaacgcaaaaatgaccgcgtgatttatgagtacccacttgaagcagagctggcattaaaggaatggctcaaggctattggaaaagttgaaggcgcggagttgtcatttcgcgaagatgggcagagaggtctgttggaatgtatctgggcaaacggtagagtggaaaagtctgtatccaagtggctcgcatacgccgtccacaaggctattgcttgtgcaggatgtaatgcttgtgatgccgaatgcccgacgggcgcgttgcggttggaaaaggatacctctagtgaaaagaccaagatatttattgatgaggttacgtgcgtaaattgcatgaggtgctttgcacctgatgatggatgttggcggtattactcaaagcgatacgcaggaggtaagacgatgaacatcagcggtattaataaatatatgacttttggcctaaaaccggaatggattgaagttttggcaaacgagggcccgaatttccgccagacaactgcgctgggtagtcggatggttccagcagccgtgacgtggttccgtgaggctgggttgataggtgattcaacggctataaccacaacgcagcttttgatggttggtaagcaacgcggtttcagcgacttgcttttttggcaaatattgtggttccgtttggcaaatgtttccccgcttgtgaaatggtatatctgcaatacggactttaacaccatatatccaatcaagcaaattgatgagactctagcgcaatcagttggttcagcatcggtgagaaaaggcgccttacagtcgctttgccaactgattaaatcatctccgcttggggaaggtgacggggcgttgattgaagcggaaatgaagggcagaatcgttgaaaagctcatgcgccgttcgcgttcggtggatccactggttgtactttacgggctttacgtgatggcagagaaggctggacgtggggcattcacggtgcggcagatgatggcaacagagttcgacggggaggttgtgtcgccactcgctacgttcggcatttcacccgaagaattcaagaagcagtgtatgggacttgcagctgtgtatccaggcttcatctcatgcagctttacgttagggttggacgaggtgcggctgttccctgaaacgaagaatcgggatgatgtgatcggtttgattctgcagaagtag

SEQ ID NO: 3420 - DNA, 2502 bp, Prevotella denticola
atgtataagataacctgggataaagaaactggaggtgtattactccattcacgcattgtggatggaacacttggcatatctccacgccctgtattctgggaagaacttgatttgcttaagctcaacgaattaggatggaaatatcctcatacagaagaacctctgttgtgggcaataaacaaacaatattggtatcaaggtgaactaatgtttgaggctaaaggtgcgaatgtttacgatgcagctacaattatctttcagccaggaaaggataatgttgagttgaatcccattgatgtaaaaaagatgttgaagcgcaacgctgaatttatgtttttgctggagagtgaggctatagagtttattcgcgaaacattcatccagtatgcaggtgcacggaaaagtgtagccaaagttgctgctaatcaacttgactatgaaactctcgcaaaacgtatggaagccaaaattaaaaaaaagatggctattgtgcgtgaagactgtgatagtttcgagattatgccacttgatactgcagaggaacaaggtaaaaaagtattccataccacgaagattgataagtttcttgcttctttctctggaggtaaagactctcaagttgtgttagacctttgcacacgtgcaataccaagcacggaattcgaagttatttattcagatactggatatgaattgccaccatcattagatttgtatcagcaggtgcaagaccattaccataaactcttcccagacttaaagttctcgctaactcgcaaccatgaaagtgtgctgaactattgggataagattggaacaccaagtgataagcatcgttggtgttgctcaattatgaaaacagcaccattgtatcgttcccttaaaatagaggggacaaataagcaagctaaagccctcgcttttgaaggagtaagagctgaagagagtgttatgagaagtaactatgagcgtatagggaaaggggttaagcatgacaccgtaatcaatgctcgtccgatcttaaattggaatactacagagatctttctttacctttttgctcacgatttaccccttaatgaggcttatcggtttgggaaaccaagggtgggatgtttaatctgtccattctcttctccatgggatgatatgatagtgaataaacgatataaacaagatttaaaacctttcttatcacgcttggtaaacatatcaaagcaacgtcatatcccaaatttggaagaatacatcaaagaacataaatggaagttgcgagcaagtgggaatgatattggttcaaaaacaaaagtcctctttccaaaacagtttcctacatttgtagcaaatgtttccaatgctcagaaaaccatagaacattggcttcctgttttgtgtgaatataatataatgggagaggggaataaaaagtttggagaattatgctttgataagactgtctatcgttttgacattacgtataacacagaacatgactatacattcatcttacatgaggtgcaaaatcctaaattggtgcaacttattaaaagaattatttataaaagtgccttctgcataaactgcgaagggtgtgaagtagaatgccctactggagcactttctgtttaccctgagattaaaattgataaatcgaaatgtattcattgtcataaatgtctgttatttcatgaccaaggatgtattgttgcaaattctttaattatgacaacttcaacaaatacaaaaggtggaggtatctcgaaaataggtactttcggaatccatagtgagtggctacaagaatttctttctgacccagatggtttttggacaagcaattctttgggaaacaaacaagaacagagttttaaagcatggctgatagatgctgaaatgattgaccaaaagaaaaatctcacaccatttggtgatttttgtataaagcatcgcgaaaatgagcttgacttaatttgggaactcatttggataaattttgcatatagttctgttcttacaaattggtttatcaacactataaatccagatcaacaattcacgaaagcactacttgatgagttagctttgaatgaatttgatggtacgaagagtactataacttatgccatagggggcttcatgcaaatatttaaatattctccaattggtgattttcttagccaaggacaatcgcatgatggtaagaattattttcgtggacgacatgaaggactttcagaagtggcacttgcttattctatatataagtatgctacttccaaaggtattcgatctttacgcatctcagacttctatgttgaagactgtcaaacaggacctgtgaaagaatttgcaatatccaagcttacgtttacaaaattgcttcgtcaattaaattctgcttcaaatcgagtacttatagcagaattaaatatgggtcttgatagcattacactaagagaagatttaagctcaatggatatactcaaacaactggttttgtag

SEQ ID NO: 3421 - DNA, 2172 bp, Thermotoga petrophila
atgtataaagtaacttgggattgtgtttcgaatggtgttttgttagtgaatgatgcgaatggttccaacgttatagctccgccgcgtcctgttttttttgaagaattagatcttttgggctttaatgaattctgggaataccctaaagctcaagaaccattgctctgggctattggaagaagatattactataaaggggaactagtagctgaggctaaaggcggaaacatatttgaaccacctgaaataatactcatcgaaaaaggacaaaatctcaagttggaaccaatagatattaagaaggtgattgaaaaaaataaagaagctttatttgtgttggagaatgaagctttggattttatagagcatacatataaagtttacaaaaaaaagggatacctatttgctgtgtcttatagtggaggaaaagattcacaggtcgtattagaccttgtaacaagagttgtaccttgcgatgatttagtagttatcttttcagacaccacaatggaaattccgtatacatatgaaaatgtagaaaaaactaaagaagagtatgagaaacgatatcctggattaaaattttacgtagcaaagccaccgaaaccaatgatggagttctggaaggaattcggtccgcctagtagagttcataggtggtgttgtactgttgccaaaaccgcaccttttataagaatcatcaaagcgatttttggaaaaacagcaggtgagaatagtaaaactaaattgattgtttttgatggtattcgctcagaagaaagcgctcgacgcagtaattaccagcgattggggatagaggcaaaacatattttgcaaattaatgcagaagttattagagactggaatactttagaagtgttcttgtacctttactacagaaacttacgtatgaataaagggtatagatatggtttgaacagagttggatgttctgtgtgcccttttgcatcggaatggtcggagtacattatatacagtatgcatagcgatcttattgataaatatgttaaaatattagaaaattatataaattacctaggcgttgaagatccgatgaaaattcaagagtacataatccaaggacaatggaaaaaaagagcaggtggggaaggaattaacagtaatggaaaacacctggaattgatctcagaagatggcaaattggttggtataattaggaatactagaaattctagcgaaaattttcttgaatgggtcaaagtagtaggggacattttctataaacacagcccaaacaataaaacagaaggggaaataaaagttagcaacaacactcatcaatttaatatattaaaaaaacataaaaatgaggtcgttgaaatacaaaccgccaatgataaagtatttgaaaataaaatcaaacgcatactttataaaaccacttattgtgttaattgtggtgcatgtgaagcggaatgtccaactaatgcattgtatgtacttcctagtgtcaaaatagatggtaatttatgtactcattgtggaaattgcttgtattttgttgagaaagggtgtttagttgcaaaatcattacaaatggcagaaggtggtaggaatatgggcaaaatgagcagagatagtaaattaaaaggatttggaagatatttgacttttggtttaagagatgattggttaagtggctttttaaataatccagaagaatggtttgctgagaataatttgggcaacaaacagatagaaagcatgaaagtctggttattagatgctgaactcataactaaggataaattacccactccattggcgaaaaatattagggagatctacttacgacataaaaaccttgcttgggaattgatttgggcaaatttgtattacaactcaccagtttgtagattctttattgaaaatatagagtggaatgaaattaaatccgtaaaagaaattactgaaatggtagcagaactggataacactatatcggaaaggacaataaagagtggtctctcttctctgtttaacacttttgaattttctcctttaggcaaagaattaaagataggaataatagaaaaagagggaagggaaagatacgtaaaaaaattggcacagacaatattcacccattgtcggttgcatacagcctttataaggcagcagagcatgtag

SEQ ID NO: 3422 - protein, 243 aa, Erwinia sp.
MAVLDLSALNQLPKVERVMALAEINNKLDKLSAEERVTWGLENLPGQAVLTSSFGIQAAVSLHLVTRQKPDIPVILTDTGYLFAETYRFIDQLTEKLDLNLQVFRAAQSPAWQEARYGKLWEQGVEGIERYNQINKVEPMNRALETLQGQTWFAGLRRDQSGSRAHLPVLAVKKGVFKLLPIIDWDDRQVYRYLQQHGLSYHPLREQGYLSVGDTHTTRKWQPGMAEEETRFFGLKRECGLHE

SEQ ID NO: 3423 - protein, 303 aa, Erwinia sp.
MMDQKRLTHLRQLEAESIHIIREVAAEFANPVMMYSIGKDSSVMLHLARKAFYPGTLPFPLLHVDTGWKFREMYAFRDRMVKNIGAELLVHRNPEGVAMGINPFVHGSAKHTDIMKTEGLKQALDKYGFDAAFGGARRDEEKSRAKERIYSFRDRFHRWDPKNQRPELWHNYNGQVNKGESIRVFPLSNWTELDIWQYIFLEDIEIVPLYLAAPRPVLERDGMLMMIDDDRIDLQPGEVIEQRMVRFRTLGCWPLTGAVESEAQTLPGIIEEMLVSTTSERQGRMIDRDQAGSMELKKRQGYF

SEQ ID NO: 3424 - protein, 303 aa, Erwinia pyrifoliae
MMDQKRLTHLRQLEAESIHIIREVAAEFANPVMMYSIGKDSSVMLHLARKAFYPGTLPFPLLHVDTGWKFREMYAFRDRMVKNIGAELLVHRNPEGVAMGINPFVHGSAKHTDIMKTEGLKQALDKYGFDAAFGGARRDEEKSRAKERIYSFRDRFHRWDPKNQRPELWHNYNGQVNKGESIRVFPLSNWTELDIWQYIFLEDIEIVPLYLAAPRPVLERDGMLMMIDDDRIDLQPGEVIEQRMVRFRTLGCWPLTGAVESEAKTLPGIIEEMLVSTTSERQGRMIDRDQAGSMELKKRQGYF

SEQ ID NO: 3425 - protein, 243 aa, Erwinia pyrifoliae; identical to SEQ ID NO: 3422

SEQ ID NO: 3426 - protein, 302 aa, Erwinia pyrifoliae
MDQKRLTHLRQLEAESIHIIREVAAEFANPVMMYSIGKDSSVMLHLARKAFYPGTLPFPLLHVDTGWKFREMYAFRDRMVKNIGAELLVHRNPEGVAMGINPFVHGSAKHTDIMKTEGLKQALDKYGFDAAFGGARRDEEKSRAKERIYSFRDRFHRWDPKNQRPELWHNYNGQVNKGESIRVFPLSNWTELDIWQYIFLEDIEIVPLYLAAPRPVLERDGMLMMIDDDRIDLQPGEVIEQRMVRFRTLGCWPLTGAVESEAKTLPGIIEEMLVSTTSERQGRMIDRDQAGSMELKKRQGYF

SEQ ID NO: 3427 - protein, 243 aa, Erwinia pyrifoliae; identical to SEQ ID NO: 3422

SEQ ID NO: 3428 - protein, 791 aa, Aciduliprofundum sp.
MYKVIWDSTNNGIILTNSNRRDQTITPPRPVFFEELDLLGFNKFWDYPKVQEPLLWAIGRRYYYKGVLVAEAKGGNIFEPPEIVLTEKGQNFKLEPIDVTKVIEKNKESLFVLENEALDFIEHTYKVYKRKRFLFAVAYSGGKDSQVVLDLVTRIIPPDDLVVIFSDTTMEISYTYENVEKTKKEYEKRYPGLKFYTAKPPKPAIEFWSDFGPPSRIHRWCCTVIKTAPFHKLIKDEFINTKNDKFKIIVFEGVRTEESEKRSHYSRIAKNVKHLMTVNARPVLYWNTSEIFLYLFFRNLLLNRGYRTGLSRVGCSVCPFSSEWTEFVLGKLEEDIGGYFSLLKKYAESMGLKEEGQINRYISNGEWKKRSGGRGLNKDSDVRFITDHSSIKSIMLNPKEDFLEWSKTIGEVMYKKGPAGNIYGELKIKNSVIPFELNIKKNKTSITFYDVGSNIDLISKVKKVSYKTAFCIHCGACEIECPTGALNVIPKVKINSGLCTHCGNCINFVEKGCLVAKSVHENIGGVSMKKRTGGIDKYSTFGLREEWLNAFFNFGEEWLEENNLGPKQIPAVLHWLIDAELIYPKSKRTTPLSKYLRKIYTKDSLFVWEIIWNNMYYNSQVIRWYNEQISWGSIITKKDLKEKISLAYPNLSRGTLSNPIDAMVNMFDNSPLGLELKIGLLDKKGRVVKSIKKIGTDDVHPLAVAYSLYKAAEHIGRRDFTVSELYTKEFKGGPYKLFGISKDKLERILRGLQEDKEEILRVDLVADLDNIYLREDLTSLDIVKIAEVRLK

SEQ ID NO: 3429 - protein, 247 aa, Anaerobaculum mobile
MSNWYYEKGWTRHRIFGLRKEWLEFYLSDREGWRQNSTLGNRQVDSFATWLKTAGIEDKKGNLTALGMEFIRRGVDDLSLWELLWVNVVFSFPTARWYAHLGLGTWSTTELKAMLEQSVPRLAERTVINAIMELAGLLERTPVGKELGQGHVGGNKPRRISRIGREPNDSAIIHSIGKLYLQQDRTILPWSESLAWPWVVFGCSLDSILERLIKMDQDYFMIDDKGIIICRSEKEEWQCGDIAISWL

SEQ ID NO: 3430 - protein, 764 aa, Anaerobaculum mobile
MVDGYDTGVRSDVRPVFYEELDLLGFERYWSYPKVEEPLLWAIGSRRYYYRGELVAKAEGGGLFSKPELKIHRTGLTLEPVKVETMIDKNGALLQGLVQKSLKFIYQTYTRQKHKVDIVAVAFSGGKDSIVTLDLVQRVLEPNQFVVVFGDTGMEISDTYYAVEAAKRRWPHLSFYTAKSAKDTLTSWREMGPPSRIHRWCCSVHKSVPTLLLLRKLLNKPSANAMIIDGVRNEESSGRATYPSLTLGGKHKTQINASPIITWNAAEVFLYLFGRRLLLNKAYRYGATRVGCAVCPMASVWWDIISGSVYWQDMRSFIEELCSYAISSGIHHDEEIKKYIEKGSWKGRAGGRYVSGGGNRVIEQTSNDKVIFSLRYPAEDWQEWAKTLGHVVRTGIGQGYIERGGNTYPYFVQKNDHSVTVEVGGLANADRCTLKAFRAVALKSAYCCHCQACEAECPVGALITCEQVHIGDECQACGRCLDLHGEPCLTAKSISTSGGGLSMNDNHKMVLHTYEHFGMEKGWLAAFFASPFNWINSNTLGNRQLDAMLLWLKHAELILGGNTKNTFNITNLGEKLARLGVDNLVTWAVIWTNLARNSNAVKWYLTAIPWGVTMTKAELVCKMGETYSQSETTRRNAMTALFGLLLKTPLGNELGLGIGINQGKRISNVLYKKGWFEPDPLAVLYSLYRYAEKTSRYEFTVHELYEGTDEGPYTLFGVPQDALIGIVKGLSARDDSLIRVDIVRDLDNIFLNHHNKSIEVLDCV

SEQ ID NO: 3431 - protein, 755 aa, Candidatus Desulforudis
MKDEAAESIPGAVRPVFHEELDLLGLQNYWKYEPHMVPLLWAVGRRYYYRGQFVAEAIGGSFFERPRMHVQAEGLALEPVDLSGMLERNDSILRDMVHATLDCIKAVHERYRDRVDTVAVAFSGGKDSLVLLDLVQRVLPPDEFVVVFNDTTMELSATYEAVEAAKKRWGKLRFFTARAPRPARETWQEFGPPSRLHRWCCTVHKSAPTLRLLREMCGRPAVRALIYDGNRREESPARAAYPAVSEGKKHPGQINVSPLLNWGLTEVHLYLMCRDLLLNRAYRWGVVRVGCAVCPFASQWSNFVCGFCFREDALIFLELLESYARKKGISSEVGRRRFIAERSWASRAGGREMAARARVFLEEQDGQVVFLLRRPREDWLEWAKALGSVELEAPGRGVITNSFGSFPFRLRDYEKGLAVTITRVAGTDPIFKSRLRAVANKAAYCVGCRSCEVECPTGALRVDKKVAINAVRCSHCGRCLSFVEKSCLAAKSLSVTGSGDRVKGLNRYQEFGMRKQWLAEYLRNPQSWWVENTLGNRQLEAMRVWLREAELAENQSLGLTPLGDRLQQLGADHLLTWAVVWTNLAHNSALVNWYVQEVGWGIRWTKRGLVSLMSEDLSQRTRENAVDALVGLLTHTPLGEQLGLGCAERKGRVIQAVTKHGWADPHPVALLYALYRLAEKLTRYNFTLSELFEEKIESPFLLFGVGRELLTRYLQGLSVNRPDWIRVEAVRDLDNVYLEEGRRAFEVLDLVLART

SEQ ID NO: 3432 - protein, 265 aa, Coprothermobacter proteolyticus
MWTFDSYDELVDAIRERYSNFGLREEWMTSFLNLGEDYLRNNTLGPKQKTALNEYLRDAGFIERNRKSTELCDVVRFGYSLGSLSVLSVWAIIWANLCHNSGIFLWWANQPPGNYTRESMLQELRQTDKRERTLTNITNSLISTLQSTPIGKDLRQGEVIKSGRSRIVQKIGHPKLNLVEVIYAFYMFARKHEMFSISIEDMEPYVESPQKIFCITSAELADVLGSSKSEKLFKVTWTNDKVYLDLDEGLNEVDVLKMCISTGGG

SEQ ID NO: 3433 - protein, 793 aa, Coprothermobacter proteolyticus
MYNVNWDLETNGIVLTSESKNTLIVSPRPVFFEELELLGFNEFWKYPHTKEPLLWRTGRRYYYKGTMVAEAKGGGIYERPRIELTDAGKGLGLEPVKLQAMLEKNKEQLEVLENEAIDFVNHIYKRYKGKVSAFVVSFSAGKDSQVILDIVSKVIPPEDYFVIFTDTTMEIPPTYEAFEETKRKYRETYPELKFYTARNWKPAEATWKEFGPPSRLLRWCCSVHKSAPMIRLVREIVGRNDGVRIVVFDGVREEESTRRKGYSRLAENVKHFTQINAEVIKRWTTTEVYTYILARELPLNTAYRLGLDRVGCSVCPFASQWTEYMIGRGYLETVKSFINQVEKTVESLGIEDKAEVRKYISEGNWKKRGGGEGVDTGKTRLDIIQKEEGQRFVLNDPGDRFEEWIKVLGPVRVASDNGKLEGDLLVSNRTLHFSVDKNTAGRAIVDIDGIKGDKLLLGRLNKVAYKSTYCAHCGVCEVECPTGALSVIPSVLVNTSKCIHCYSCLDFVEKGCLRAKSVATLVSQKEGGNTMSTLSGFGNYLTFGLRSEWLKDFMMKGNNWFSDNILGPKQVEAMLYWLRDAELIDSKRKTVTPFYEHLKGIFEKDELLAFELVWVNLFYNSAPVFWYLSRVPWGKAYSSNELKQMVENEGLTITKRTISNGIDGLFNTFEANQYLQKLGVVSVVRHDRERVALKMGTNDVHPAAVLYSLYRYAIRKGYYNLTVKELYNESNSAYGGPYVIFGVERQSLERLLRGMQEYYKGLVSVDLVADLDNIHLDPSVKDYKELLSENVDI

SEQ ID NO: 3434 - protein, 266 aa, Cyanobacterium stanieri
MAGKKTRHVLGLSGGKDSTALAILLHKEIPDMEYFFCDTHKELQETYDYLDRIQARLGIKINYLSEKRGFDHWLAIHDGLLPSPQMRWCTVKMKIKPFEEFVGDDEAISYIGIRADENREGYISTKPNIKPVFPFKERGLVKADIIRLLEESGIGLPEYYKWRSRSGCFFCFFQRKYEWVMLAENHPDLFAKAVEYESNHRDGRTYTWTQGETLLQLLERKDDIIAQHERAIARKQEKAPNRPLAEALESVLDEEDSTLPCLVCNL

SEQ ID NO: 3435 - protein, 764 aa, Denitrovibrio acetiphilus
MYSYTYSQKTGGILLNSTPTGFSKEPRPVYAAELDLLGFDKFWEYDKQNDIPYMWAEANAYWYRGVCVAKLKGGNLFNAPEIIIPVNDNGESILPEPNGKALQVVDVNAMVESNREMLDIIEQSTVKKIISVYTKYKDKLDLFHVAFSGGKDSAVLLDLVKKALPLGSFVVVFGDTGMEFPDTYDVIDKTRQMCEADGIPFYIAKSSLEPQESWVLFGPPSRALRWCCGVHKSAPQTLKLRAVTGKNDYTGLAFVGVRSEESAKRAEYDYENYSKKQRGQYSHNSILEWTSAEVWLYLYANNIMINEAYKKGNARAGCLFCPMSVKKADFVKQQIYPREIKTYLDIIKKSNGRDFGGNSYLADGGWVSRRSGRDLIDNVMNCSETLKDGMLTIKVTSPRSDWREWIKTLGNFEDIPFTIEQQSNNYLVKLPESYINKNPTFRKLFKQVFRKSAYCVKCGVCESNCNSGRITFDNELKITNCEHCLKCHDIVDGCLAYNSLRIPTEEKAMSINCFDSVLPKNDWFNRFFNEKNDFWNDHGLGPNQLKTFKRFLKDAGLTEKNNYTALAEQIAALGWETNTAWGILLINLATDNPQIRWYISNLEIGMNYPRETVISMLLESNSSNNVVKFVYSAFGKLMELPLGATLRFGYVTNEGNIARTKCSISDLRVILYGLFKFAEKCNNYKEFTLASLISNGIDRDGISPTRIFGLDREDVTPMLLGLSTKYPEFITVSFTHDLEKITLADYKTSADVIELFSEDSGNEQ

SEQ ID NO: 3436 - protein, 794 aa, Desulfitobacterium dichloroeliminans
MYSYVWDKKTGGYLLTTQIGKFVANEIRPVFAPELSLTGLGRFFEYDRRETRPLLWAQKNVYLKNGEKIAQLNNTQYGKPLNIQVFFEGKLKLEPVDVASMVTANADIMDIVVADAKRRTKELYDADIGRCDIAYIAFSGGKDSVALLDLCHRVLPLSVPVIFSDTDMELPDTYKVWEEIQTRYPEREFICARAGTSALENWRTFAPPSRTIRWCCSVHKSTPALMCLKYKLHKAAVRVMAFVGVRGDESYSRSFYEDAKDGAKNASQLNRMPILDWGAHELWLYILANDLLVNCAYKKGLTRVGCLMCPESSEKYEWFVDKAYPRLLKPYNDIIISTSSKSFKTAEEQIEFIGSLNWQARKNGLILRDTITNPLEVGAGLKTTFQSPHFLKDLFYEWIKTLGMVVKERETDRQRLKLPNTLDDGILFSYYAPYTGGGTVTFEFRSKEEQASLLPVLRSFLRKVSACVVCRSCEAECPVGAMSVKDNKLKISATKCIKCRKCYNSDNNYCWRYKSMFKPETEKNNVMRSIANYENFGLREKGNYLWVSTLVELGDKFFPWHENHPLGKNMVKSAARIWFTQAGLIFANDKKPTILVELFRKFGGASSLGWEYIWLTLANNAILIKWFITSTEIGTTYTIEQLVRMLSESNPTLGKSTIDGGLNALKDMLSKSPLGGEGAVTLPEMKGRTVVSLTRESKDVHPLTLLYGLYLIANKAERGSFTVRELMTADIESTFVSPLVAFGITPDTFKKQCEGLRSKYPDYISTTFTHGNDGLEVFQNRYTIEDIISLALGE

SEQ ID NO: 3437 - protein, 784 aa, Geobacter sp.
MYSYEWDQRTRGYRLTTQTGKFVASEIRPVFAEELTLPGFEAQLVFDPSERLPLLWAKQNVYLYRGEEIARLNKTRYGKPLDIEWKGVLSGDVSHEGVKTRKKLKLVPVDVEAMVIKNSGIMTALVMDTLKRIKEMYDAYVGKCNAVYIGFSGGKDSVVLLDLCHKVLPLDVPVVFSDTDMELPDTYRVWEEIQNRYKGRPFLKVSAKTHALENWQLFGPPSQALRWCCSVHKSTPAILALKERLGERSIKTLAFVGVRGEESQRRSGYEDIGDGLKSQSQVNAMPILAWSAHELWLYIFEHDLVVNEAYRKGLPRVGCLMCPMSTDRQNDMIRMNFPEEVAPFADAVRSTIDREFTSEDDADAFVYEGGWYARKSGVSLRQVIGEPGVERKNDRVIYEYPLEAELALKEWLKAIGKVEGAELSFREDGQRGLLECIWANGRVEKSVSKWLAYAVHKAIACAGCNACDAECPTGALRLEKDTSSEKTKIFIDEVTCVNCMRCFAPDDGCWRYYSKRYAGGKTMNISGINKYMTFGLKPEWIEVLANEGPNFRQTTALGSRMVPAAVTWFREAGLIGDSTAITTTQLLMVGKQRGFSDLLFWQILWFRLANVSPLVKWYICNTDFNTIYPIKQIDETLAQSVGSASVRKGALQSLCQLIKSSPLGEGDGALIEAEMKGRIVEKLMRRSRSVDPLVVLYGLYVMAEKAGRGAFTVRQMMATEFDGEVVSPLATFGISPEEFKKQCMGLAAVYPGFISCSFTLGLDEVRLFPETKNRDDVIGLILQK

SEQ ID NO: 3438 - protein, 833 aa, Prevotella denticola
MYKITWDKETGGVLLHSRIVDGTLGISPRPVFWEELDLLKLNELGWKYPHTEEPLLWAINKQYWYQGELMFEAKGANVYDAATIIFQPGKDNVELNPIDVKKMLKRNAEFMFLLESEAIEFIRETFIQYAGARKSVAKVAANQLDYETLAKRMEAKIKKKMAIVREDCDSFEIMPLDTAEEQGKKVFHTTKIDKFLASFSGGKDSQVVLDLCTRAIPSTEFEVIYSDTGYELPPSLDLYQQVQDHYHKLFPDLKFSLTRNHESVLNYWDKIGTPSDKHRWCCSIMKTAPLYRSLKIEGTNKQAKALAFEGVRAEESVMRSNYERIGKGVKHDTVINARPILNWNTTEIFLYLFAHDLPLNEAYRFGKPRVGCLICPFSSPWDDMIVNKRYKQDLKPFLSRLVNISKQRHIPNLEEYIKEHKWKLRASGNDIGSKTKVLFPKQFPTFVANVSNAQKTIEHWLPVLCEYNIMGEGNKKFGELCFDKTVYRFDITYNTEHDYTFILHEVQNPKLVQLIKRIIYKSAFCINCEGCEVECPTGALSVYPEIKIDKSKCIHCHKCLLFHDQGCIVANSLIMTTSTNTKGGGISKIGTFGIHSEWLQEFLSDPDGFWTSNSLGNKQEQSFKAWLIDAEMIDQKKNLTPFGDFCIKHRENELDLIWELIWINFAYSSVLTNWFINTINPDQQFTKALLDELALNEFDGTKSTITYAIGGFMQIFKYSPIGDFLSQGQSHDGKNYFRGRHEGLSEVALAYSIYKYATSKGIRSLRISDFYVEDCQTGPVKEFAISKLTFTKLLRQLNSASNRVLIAELNMGLDSITLREDLSSMDILKQLVL

SEQ ID NO: 3439 - protein, 723 aa, Thermotoga petrophila
MYKVTWDCVSNGVLLVNDANGSNVIAPPRPVFFEELDLLGFNEFWEYPKAQEPLLWAIGRRYYYKGELVAEAKGGNIFEPPEIILIEKGQNLKLEPIDIKKVIEKNKEALFVLENEALDFIEHTYKVYKKKGYLFAVSYSGGKDSQVVLDLVTRVVPCDDLVVIFSDTTMEIPYTYENVEKTKEEYEKRYPGLKFYVAKPPKPMMEFWKEFGPPSRVHRWCCTVAKTAPFIRIIKAIFGKTAGENSKTKLIVFDGIRSEESARRSNYQRLGIEAKHILQINAEVIRDWNTLEVFLYLYYRNLRMNKGYRYGLNRVGCSVCPFASEWSEYIIYSMHSDLIDKYVKILENYINYLGVEDPMKIQEYIIQGQWKKRAGGEGINSNGKHLELISEDGKLVGIIRNTRNSSENFLEWVKVVGDIFYKHSPNNKTEGEIKVSNNTHQFNILKKHKNEVVEIQTANDKVFENKIKRILYKTTYCVNCGACEAECPTNALYVLPSVKIDGNLCTHCGNCLYFVEKGCLVAKSLQMAEGGRNMGKMSRDSKLKGFGRYLTFGLRDDWLSGFLNNPEEWFAENNLGNKQIESMKVWLLDAELITKDKLPTPLAKNIREIYLRHKNLAWELIWANLYYNSPVCRFFIENIEWNEIKSVKEITEMVAELDNTISERTIKSGLSSLFNTFEFSPLGKELKIGIIEKEGRERYVKKLAQTIFTHCRLHTAFIRQQSM

SEQ ID NO: 3440 - protein, 468 aa, Methanoplanus limicola
MSKAFLGKLVLNWCDACHTPVLGKKCSCGAETRQVSVTPPGDIRPAFEKDIEHINKIYSEYFGTILIPEGHLVILNKVPDKDRMEEVIMGGAVVCAIRYLPDEKRWEVLPRVHASQYFRPEKGYVIADNGAVEPVKSGTSLLAPGLVNMHPDVKAGDEVFLVSRDMEAIAVGRSKVGYEESKEMERGQIVRTRKPKPSVCVPGAATWDDAVNSNKYIMDSHESEAVRFTNSVVEKNPNMPATVSYSGGKDSLATLLIVLKAIGKVPLIFSDTGLEFPETYKNITDVSEKYGLEIINTSGAEEFINKFEIHGPPAVDVRWCCAVCKLNPVKSIITEKWGECLSFIGQRKYESLARMKSPRIWRNFKVQVQLSAAPIQHWTAMHVFLYLFREGAPYNELYEERIDRIGCFMCPSSDLATFEIIKENYPELWSTWEEKLNSWKEKNNLSEEWITKGEWRKRGGPDDTSSYS

SEQ ID NO: 3441 - DNA, 2814 bp, Pelotomaculum thermopropionicum
ttgagtcgggatggtatatggcggcccggtgactgggcctggagctgggggtatcgtgaaccggtgaaggttatcgaagccctggacctgtggggaaagaacgtctgccgcgtctgggtgccgggccgggacgcggttatccgccttcaggaaaacgaattatcctcgataacagaggcaggcatacccagtagggaacggcttatttacaccgtcgccgcggcccgaatcgctgaaagcctggccaggccggatatcctcctggcaccactcgaaggcagcgtcactcctttgccccaccaactctacgctctttcccgggctgtttccggcagcagggtccggtatcttctagctgatgaggtcggcctcggcaaaacaatagaagccggtctaatcatgcgcgaactaaagctcagggggctcgtcaggcgcacgatggtggtggcgccgaagggcctggtgatgcagtgggtgcaggaaatggaaaaccgttttcgggaacgctttcacctgctgatgcccgccgagatcacagctctatcgtgctttgaatgggatgccaacgtctggcagcggtttgaccaggtcgttgttcccatggatgccgtaaagcctttggaatcgcgccgggggtggagcagggaccaggtaagccgctataaccgggaacgcttcgaaaaccttatcgctgcgggttgggatttgattattgtcgatgaagctcaccgaattgccggtagcacggataccgtggccaggtaccgcttaggccaagcgctggctgaagctgcaccgtatcttcttctcctcacggcgacgccccaccagggaaaaactgattccttccaccggcttatggccctccttgatagggaggctttccccgatgttgagtccataaagcgggagagagtggccccgtacgtaatccgcaccgaaaaacgccgggccattgatgagaagggtcagccgttattcaaaccgcgccgcacccagctggtacccgtggtatggcagtccaggcatcaaaagcagcgggaactatatgaagcggtgacggaatatgtgcgggaaggatacaaccgggcgctgaaagaaaagcgaaactatatcggctttttgatggttctcatgcagcgcctggtagccagcagcaccagggctatccggaccgccctggaacggaggctggaagtgatcgaacaggaagctcctcttcaaattaacagtgaaatagagctggaagaagactggtgggaccttgacgggcaggagcagctcgagcaaattctgaagcaccgtttagtcgcctttgctagtgaacgggaagaggtcaagcgtcttttatccctggcgcgtcagtgcgagtccctgcccgacgcgcgggccgaagccttgctggagtggatgtaccggctgcaggccgaagagaacgaccccgagctcaagtttctcatctttaccgagttcattccgacccaggagatgctcaaggagtttctggaaaacaggggctttagtgtcgtttgtctaaacggatccatggggctggaagaaaggcggagggtccagcaggaatttgccggccatgccagggtgcttgtatccaccgatgccggcggcgagggcttaaatctgcagttttgccacgtggtcatcaactacgatttgccgtggaaccccatgcgcttagaacaacgtatcggacgggtggaccgcatcggccaggaacacgttgtccgggcactcaactttgtcctgcaggacactattgaataccgggtgcaggaagtcctccaggaaaaactggccgcaatcctggcggatttcggcgttgacaagatgagcgatgttctcgactcggctgaagtagcgacggatttcgaggacctgtataaagaggctatcctcagcccggaagaagttgagtcccgtattgaacggctggaggctgaacttcggcagcgcatccaggaagtaactatggctaaccggcttttgggagaagaggcagaacttgattcccggctggtggagaagatttccggccatccgcttccgtactgggtagagcgcatgaccatcaactttttggtaagcgaaggcggaagagtagagcccaaattggcaggttatgatttgacctggcccgacggcttcactatgaaggacgtggctttctcccggcaggaagcagataagcactcaatgtcttatctcagcctggaagaaccgagggttcgcggcctggtcacccgcatgcccttggccgtggcaggtcagcccgttgcgaaggtcaggctcaaaggactgccgcaggaaataagcggctactggtctttatggcggatatctcttatggcggaaaacatgcgtgaggttcgggttctacccttgttccagcaggaaaaagacggcaaaatactcatgcccaccgcccgcaggatatgggatttgttattacaggaagaaacctcgctcgaaatccagggttatattacaggcgaaaaatccgaggaaatctttgagaggctccagaagcaggctgtacgatacgggcataatcttttcctggaacttaaagcagagtatgaagagcatctgcagaaagagcgggaaaaaggccggtatgcgttccaaattcgccagcaggccattatgaggattggcctgcccgccgtgcgccagcaccgcctggccgaattggaacgccagaagaaagagtgggccctgctgctcaagcagaaggaaaaaatcttgccggaactaagcgcgattaccattgtctacatagaaggtggagtcccatga

SEQ ID NO: 3442 - DNA, 2919 bp, Halopiger xanaduensis
atgacgaactctacccagttctctccggggcagcgggtaattctcaacggagcgccggctgaagtcatcaaaacccaaacggtcggagagatcgagtacctaagagcatacatcgacggcgagggcgccaagacggtctgtctcgacgatgtcgagattcaaccgcatcgatccggaatcgaggaactgtccaaccagcaaatcgatgactttcacccggatcatgacgctgtgtccgcgcagtggttcgacctccacacgcaggcgacgaaactcaagctcgcccacgagcaggggcagctcctgagcatttcgaactcgctcgttcgactggagccctaccagctcgacgccgtgaactgggtgatgcagaaactccggcagcgagcgctcatcggcgacgacgtcgggctcgggaaaacgatagaggcggggctcatcctcaaggaactcgctgcccggaatcgcgccgaccgcgtcctgttcgtcgttcccgctcacctccagaagaagtggatccgggatatggatcgcttcttcgacgtcgacctcaccgttgcagaccgggcatgggtcgaaggtgagcgacgacggctcggcgaggaggccaacatctggaatcaagaccagcaacagctcgtcaccagcatggcgttcctgcgacaggacgagttccggcctgcactccgggacgcgttctgggacgtcgtcgtggtcgacgaggcacacaaggccgcaaagcgtggagactcgccgagcaagacggcaaacatggtcgataccgtcacggggaactccgactcgctgctgcttctcagcgcgacgccgcacgacgggaaaggcgaggcgttccgctcactcgtcgagtacatcgacccgttccttgtcgccgagaaccgggaactctcacaggagacagtcgaccgcgtaatgatccggcgcggaaaaactgacatctacgacgaggatggtgaacgcgtcttcccagaccgggaggtcaactcggtatccgtctcgatgacgcacgacgagcggcagttctaccgcgcggtcaccgattacgtcaaaaacgtctacaaccgctcggagaagctgaacgaacctgcggtcgggttcgcgatggcgctcatgcagaaacggctggtgagcagcgtcggcgcgattcacgcgacgctccgccgacgactggatgacctcctcgacgaggaggcggaaacggacgggctctctgaggaagcacgagcctatctcgacggcgaggatctggacgaggacgacaagcaacacgcggaagacgagattgctggcctgaccgtcaccagcaccgacgaacagctccaagaggagatcgatacgctccgcgatctcgtctcgctggccgaggatttgccggtcgactctaaggcccagaaggtcagacggttcatctcccaactcctcgaggaacaaccggacgagaaactcctgttgttcacggagtaccgcgatacgctcgactacctactcgagtacgtgcaggacgagccgtgggcggacgagattctcgtgattcacggtgacgtggacaaggaagagcgggcgcggatcgaagacgagttcaaccacggccagccgcggctcctgttcgcgactgacgcagcgagcgaggggatcgacctccagcacagctgccacatcatggccaactacgagcttccgtggaacccgaaccgcctcgaacagcggatcggccgcatccatcgctacggacaggaggaggaggtcaaggtctggaacttcctcttcgacgacacccgcgagagcgagatcttcgagatgctccaaaccaaggtcgaggagatccgctcccagctcggaaacacggcggacgtgctcggcatcctcgacgacatcgacgtggactcgctcatcatggagtccatcgagaacgacgaaccgccgagtgcgaccaaagaggaactcgaggagatgatcgaggagcgtcagcggacgctcgaggagtggtacgagcggagcctcgtcgatacgagcacgttcgacgcggagagccgtcggcagattcaggaggtcgtcgacgagtcagaggacgtctacggaagcgagggagacattcgcgagttcttcgagcgagcagtcgaagccttcggaggcgaattcgagaagcgcggcaccaacctctatcaagccgaactaccggacgggatcaattcacccggccaagacgcgacgttcggcccgttcacgttcgatcgcgacttcgcgatggatcacgaggacatcacctacctcgctcccgatacggacgtcctgcaacgactcatggcacgcgtgttggaggacgagcgtggagaggtcggactcaaactgcttccgttcgtcgacactccggggatcacctacaactatcgcgtggcgttcgaggacggcaccggcgacgtgattcgcgaggagaccatccccgtcttcgtggatgctgcgcaagaggatgctcagcaggcgcttggtgaacgtgtcgtcgagggcgactcggtagcagcaaagcccgacgtcgacgaccttcggacggttctcgacgctcaatccgacttacggacggctgccgatcgatacgtgagcgtgcgggttaacgagatcaagaaccatcttcaggagaagcgtcacgaggagaccgctcgagagctggagaatctcgaggaatacgcacaggcagaacgagaacggatcgagtccttcatcgaggagtacgagcgcaaagccgacgccggctcggatatggacatcgcgatccgtggtcaacaggagcggctcgaacagcttgaggacagaatcgaaaagcgtcgcgaagaactccggcgtcgagagcagattatctcccttgcgcccgaggtcgagaactactgtctcacgctacctctttag

SEQ ID NO: 3443 - DNA, 2910 bp, Halorubrum lacusprofundi
atgcaggacctcgcacccggagacacgattcttctcaacgacaaccctgcagaggtcatcaagacgtactccgtcggcaacctcgactacctcagggcctacgtcgaggacgtcggcgtcaagaccgtctgtatcgccgacgtcgacatcgagccccaacgcgagcaactcggtgccctcgaacccatgacggccgaccagctccatcccgaccacgacgcagtgtccgccgaatggttcgacctccgctcacaggcgctccagctccagatcgcccacgaacaggggcaactcctgagtatctcgaactcgctcgtccgcctcgaaccgtaccaactcgcctgcgtgaactgggtgatgcagaaactccgccagcgagcgctcattgcggacgacgtcgggctggggaaaaccatcgaggcgggactcatcctcaaagagctcaccgcacgcaaccgcgccgaccgcgtcctgttcgtcgtcccagcccacctccagaagaagtggattcgcgatatggaccgcttcttcgacatcagccctacaccagctgatcggcagtgggtcgagggcgaacgccgccgcctcggcgaggagacgaacatctgggaccaggaccaccaacagatggtcacgagcatggcgttcctccgccaggaagaattccgcgaggaactcgacgacgcgttctgggacgtcgtggtcgtcgacgaggcacacaaggcagccaagcgcggcgagtccccgagcaaaacgtcgaagatggtcgaacgagtggctgacaactccgattcgttgctcctgctcagcgcgacgccacacgacggcaagggcgaagcgttccggtcgctcatcgagtacatcgacccgttcctcgtcgccgaagaccaggacctctcgaaggaagcagtcgaccgcgtgatgatgcgccgcggcaagcagactatctatgacgacgacggcgagcgcatcttcccgaaccgtgatgtcggaaccatcccggtcgagatgacccacgaggagcgccagttctaccgagcggtcaccgactacgtcaagaatgtttacaaccgctctgaacagctcaacgagcccgctgtcggcttcgcgatggcgctgatgcagaaacgcctcgtcagcagtatcggggcgatcaaggcgacgctcagtcgtcggctcgcgaacctcgtcgaccagcaatccaccacaaccaatctgtccgaagaagcgtcggcctatctcgaaggtgaagacctcgacgaacaggatcagcagaaggccgaagaagagctctccgggctcactatcacagagagtgacgcacaacttgaagaggaaatcgagacgctcagggacctcgtctcactcgctgagggaatcccggtcgactcgaaggcccagaaagtacgtcgatacatccagcaactgctcgaagaacagcccaacgagaagatactgctgttcacggaataccgggatacgctcgactatatcctcgatctcgtgaaggacgagccgtgggccgacgagatcctcgtcatccacggtggtgtcgacaaggaagaccgcactcgcatcgaggacgagttcaatcacggccagtcccgattgctcttcgcgaccgacgcagccagcgaggggatcgacctccagcacagctgccacatcatggtcaactacgaattgccgtggaacccgaaccgtctcgaacagcgcatcggtcgcctccaccgctacggccaggagaaagaggtcacggtgtggaacttctcgttcgaggatactcgtgagagtaaggtcttcgagatgctccaagacaaggtcgagagcatccgtgggcagctggggaacacagccgacgtcttggggatgctcgacgacatcaacgtcgactcgctcatcatggaatccatccggaacgacgaaccggcgagtgcgacgaaagaagagctggaagaactcatcgacgaacgccagcggacgctcgcggagtggtacgagcggagtctgatcgatacaacgacgttcgatgaggagagccggcgcaagattcaggacgtgatggaccagtccgaggatgtctacggcagcgaagcagatctccgggagttctttgagcggggtatctcggcactcggtggcgacgtcgagaaggcagggaacaacctcttccgagctgagttgcccgagtcgctccgccgctcgcgggacggtgacccctacggccccttcaccttcaatcgggagttcgcgatggaccacgagggaatcgagtacatctccccagatgcggaactggtccaagagcttatgcagcaagtgctggacagcgagcagggtactgttgggatcaaactgctcccgttcgttgatgaccccggtatcacctacaactatcgagtcaggttcgaggacgggacgggcgaggtgattcgcgaggagatccttccggtgttcgtcgacgcggcacaccgagacccccaacaacgactcggccagcgagtcatcgggggagacagcatcataggctcgcccgaggagggtcgcgtccggccgctcctcgagcacgagcgagagatacgaacctccgctgatcgatatattagccagcgcgttgagtcactcagagacgaactccagcagcgacggcgcgaggagacgcagcaggaactggatgacctcgaagcctacgcggaagccgaacgcgagcgtatcgagacgttcattgccgactacgaacgcaaggctgaggccggtactgacatggacatcgccattcgaagacagcgggatcggctctcgaagctggaagagcgaatcgagaaacgccgtcgtgaactacgacggaaggcgcaggtcatctccttggcaccagaagtcgagaatgtttgtctcacgctcccgatatag

SEQ ID NO: 3444 - DNA, 720 bp, Dehalogenimonas lykanthroporepellens
atgaaagttaccgactaccacgcaaagctttatgctcatgaactcacgaggcgctgttcatcagacagcgtcgaaaaactgacctcagtactcgccgacgctcaggtcgatttaaaccctcatcaggtcgaagcggctctttttgcttttagaaatcccttctcacgcggcgccattctggccgacgaagttggcctcggcaagaccatcgaagcgggactgcttctatcacagcaatgggcagaacgcaaacgacgactcctggtgattgtcccggcaaacctccgaaaacaatggagccaggaactggcggacaagttcaatttacctgaggttatcctggaaaaccggagtttcaacgacgaaatccgcaccggcaatctgaaccctttcaaacaggaagccgtgattttgtgctcttaccagtttgccaagaaaatggagccctatatacggcaagtacaatggacgctggtggtcatcgatgaggcacacaggttacgtaatgtttataaaacatccagtaaaatcgcggctgtcatcaagcaggcggtagctccattcccgaaagtacttctaaccgccactccgcttcaaaactcgctcctggaattgtacggactggggcaaaaagacgccctgctggatgaaatcagtaaccgtttgcaacagaataccgaaacaaagaccctcttttgtctgcggtgggtgttacaataa

SEQ ID NO: 3445 - DNA, 3228 bp, Desulfovibrio magneticus
atggccaacggaaacgacgaaaccaaaatcaaagcgttgctcggggaattcgttcgcgaaaccgtccccgagtacatcctggacggcgcccacgccattgtggccggcggcggcatccagaagctcacggtcaaccggcacgacaacttctgggatgtggaaggtcaggtccagggtgacgatttccaggtctacgcctcggaactttcggtcaacctgcgtgaaggcaacatcaactttttctgcaactgtccggattccttctccggcgtgtgtcgccatgtcggggccacggcgctcaaatgcctgcgcaccctggacgaggcctccggcgacggagagacgtccgacagcgcagcccacgccgcacgcggagaatggcggcagaccttccgcacctatttttccaccgagcccgagcccgaacccggccgccactacctcatcttccgcttccaccccgagcccggccggctccaggtggcctttttccgggccaggcagaacaagtccggcatctcccaggtccactccgagatcaccctggagcagatcatcaagaacccggactggtccgagctgtcccccaccctgcctgtcgtggccgagatgcttgagcaccacctcgactacgccggccaccgggtggaaattccgcccggactgctggcctggtttttctgggccatcggcaaggaatactacctctactggcgcgacaccgaacagcccgtgcgcatcgagtccaagaccatgcgcctgcagctggcccccaggctccaggaagacggcctgtcctttgacatcctgcttggcagcccgggcaagtcgcccttttccatcctcggccaggaggtctatttctacggccagatgcccatctgggtgtgctggaaaaacgccttctatccggtccagaccggcctgccgccccagctcgtgtcggacatgacgcaaaatccgccctttatccccaccgccgacgtgtcggaattcctcgaccgggtgtggacccatctgcccatgaccgacctgtacggccaggaagagttcctggtcaaaatgcagccgtttttcgtgccggccaacttcgatccgaagatcttcctcgacgaggaaggaagcctccttactctgcaaatccagaacgtctaccagaccgagcacggcgagatcacggtccccggccccaaccccgatctcatgaccgcctcgtatctccacgacggcaaatcgtatctcatcgcccgggactgcgaccaggagcaggcgcttatttccatgctggcggaaatgcgcttccaggccagaaacaacgccaactggttcctggaaaccgaggaagccattgtctttttgctcgacgcctaccccaaactcatcgagaagtatcgggtctttggcgaaaagaacctgacccgctacaaggtacgcctgtccaccccggtcatcgtggccgaagtggagtccaaggaagaggaaaagtggttcaacctcgacttgcaggtgcaatacgacgaccagcgtgtgcccatcgagaagatctggaaggcctggacccaaggcaagcggtatgtccagctcaaggacggctcctacaccagcctgcccgaatcgtggttggaaaagctcgcccacaagctgcgggccctgggctacgacacggacaagccgccccagaccaagttcaagcagttcgaggccccggtcctggacaagctcctggaggacatgcccgaggcccgcaccgactcgttttggaacaacctgcgccagaagatccacagcttccgcgagatcgtccaggtgcggccacccaagggcttaaacgccaccctgcggccctatcaggtccaggggctttcctacctcaatttcctgcgcgaatacggtttcggcggcatcctggccgacgaaatgggcctgggcaagaccgtccagaccctgtcgttcattcagcacaacgtcgagcgcggggccattggccccaacctcatcgtcgtgccgacctcggttttgcccaactgggagcgcgaggcccagaaattcgtgcccgacctcaagcagctcatcatctacggggcacggcgcgaaaacatgttcaggcgcatcgccgaatccgacctcgtcatcaccacctacgcgctcctgcgccgggacctcgacgagctgctcaaatacgaattcgcctccatcatcctcgacgaagcccagaacatcaagaaccccaatacgatcaccgcccgggccgtgcggcgtctggccggcaagacccggctttgcctgtccggcacgcccatcgagaacaacctcttcgagctgtggtcgctgttcgagtttctcatgccgggcttcctcggcggccagaacgccttccagcgcggcatcgtcaagcccatcaaggacggcgacgccgaaacccttgattacctgcgcggccgggtcaaacccttcatcctgcggcgcaccaaaaacgaggtggccaaggatctgccgcccaaggtggaaaacacctactactgcaatcttcttgacgagcagttggagctttacgccgccctggccaaaaagctcaaggaacaggtgttggccaccgtcgatgaaaagggcatggccaagtcgcagatgtcgattctcgacgcgctgttaaagctgcgccagatctgctgccacccgcgcctgctcaagctcgacctgcccggcgtcaacaccaacctgccctcgggcaagttcgatgccttcaaggacctcatcacggactgcatcgaggaaggccacaaggtgctggtcttttcccagttcgtgcagatgctccatatcatccggtcctggatgagcatcagccagatgccgttttgctacctcgacggttccagcaaggaccgcttcgatcaggtggacaagttcaaccagaccgaggacatcaaggtgttcctcatctccctcaaggccggcggcacggggcttaacctcaccagcgccgactacgtcatccactacgacccgtggtggaacccggccgtggaaaaccaggccacggaccgcacccaccgcatcggccagttgcgccaggtcttctcctacaagctcatctgccagaacacggtggaagaaaagatcctcaagctccaggaacagaaaaaggacgtggccgaggccgtcatccccggccaggacgccttcaagtccctcacgcgcaccgacctggaatcgctttttgacgtctag

SEQ ID NO: 3446 - DNA, 3189 bp, Geobacillus sp.
atgatacaagttggggatattgtcaaaggacctttatggccggaagtagtagaaataaaaaattgtacgatgattcaaaatcaattttatcaagtggaggcttatgggaagaatacgagcaagtattaccaagtcattattctccctgaacaattaaccaatattgaaattatcaatacatcaaataaaaaaacatattcttcggaagaattgcaagactatttacgttactttgaattcgttgtcgataaaagattttcaaaaacgcgcgcattagggaatcagcatctgatccctttgccacatcaaattgaagcggtgtatggaagaatgcttcgcgtgccttcggtgcggtttttactggcggatgatccaggtgcgggaaagacgattatggcagggatgttaattcaagaattaaaggcgagacaaagcgccaatcgaattttaatactcgttccgccgctagtattgaaacaatggcagcaagaactaaaagaaaagtttaatgaagatttccttattgttacccgctcgacattaaacgaatacagcggcaaaaatccgtttgtcgaaaatgactgtgtcattacgtccctttattgggctgcgcgagatgatgtcagggatcttgtcattgaagcggattttgatcttgtgattgtggatgaagcgcataaaatggcggcatatacatcaggggtaaagaaaaagaaaacaaagcgtaccaaattgtatcaacttggagaaatcatcttgcggcatagcgatcattgtttattgttaacggctactcctcataaaggagatgtcgaaaattttcgccatttaatgcggcttattgaccctgatattttttcttccatcggtataaaagaaacgttgcgtgataaaacaaatccgtttattattcgccgactgaaagaacatttaaagtattttgatggaactcctttatttccaaaacgaacaacaaaaacgattacataccatttatcagaacaagaattaaaactgtacgaagcagtgactcaatacgtcaaagaacattttaatcgcgccatcaatcggggaaataatagtacggcgtttgcgatgatgttattgcaaaggagattaagttcatctattgaagcgattcatttatcgttgaaacgccgttatcatcgattgatgaatttgctggaggaagcgaagcaaaaacaagtgattccatcggaagaaatacttgtcgatgagtatgaagaagcaacgttagaggaacaagaaattttcgaaatgaaaagcgagacgtgtgtggatgccattgatctagcagaattagagttagaaatcgaggagctgaaaaaattaatagcttactcaggttatcttcgtgaacatggtgtagaacgtaaatggatggagttagaaaagacgttatttggtgtagagggattgttgcaaaaaggagaaaaaattctcattttcaccgagtcgacggatacgttgcattatttagaaaagaaacttcgagcgcatggagtggaagtcgcaaagattattggaaaattttcgatggaagaacgccggaaacaagtggaaagattcaaacatgaatgtccgattatgctggcgacggatgctggaggcgaatcgattaatttgcaattttgcaatcaaatgattaactatgatattccttggaacccaaataagctggagcaacgaatgggaagaattcatcgcattgggcagagaaatgaagtatttgtatttaacttagtggctggcaatacacgagaaggggacgttttattaacgttaatgacgaaaatggaacagatgcgaaaagatttaggccatgatttagtatacgactttatcggtgatcgattggaagacaaagtggcagatttgccaacattaatgcagcaagcgattcttcaaagagaacgattagaagatataaagaaaagtattgacgaagtgttggcggaagaatatgcggatctattaaaaatagcaaaagaagaacgtcttgcagtagaaacgatcgatttaccaggaatgaagagggaacagtatgatctcgctgtgcaaaaaatccctgcgcgcgcttatgcgcaatttgcgatcaatacgttaagccgtcatcgtgtaaaggtatattcttctcaaaacaaccatgtttttcgcattgatcgtatgccaaaatttattcgggaatttgcgagaaaacaccatattagcttaaaaggaaaagaagaatcgtaccgttttaccgatatagctaaatatgcaaatgaagaagttgcattgatgaaaaatgaccatccgttatttgctgtatcattgcaattaatgaaagaagaaatcgaagggttggtgctgccattttttgaagcgaaaatcccaattcgcgaagcattaatggtagaagcctatgaaattggtctaacagatggcacaggaagagaattattccgggatattgtttactttgcgagacggaaaaacggagaaatcatagaaatcgactcttactggctttatggttattcattggagctagtatcattgcatcccattgaacaaaatgaatcaacgttgcttgctcatgctctcaacaaggtgatgcaaaaacgggaagagttagttttatctaacgaagcgcaattaaataaaaaaatacagttccttcgccgtgcttttgaccatcaatatcaagaaacggtatttagactggaaaaatatcgccgagagaacgatgcaaatcggaattcggcactaatcaatcagatgaaagcaaaattagtggacattgaagaacgccgccaagcccgtttagaggaaatcgaacgggaacgaaatataaatatcattccgccgaaaaaaattgcttcattcaccttattacctgacgacaaaacatcgtaccgccttttttccgttgattataaagaagcagtcgaacgttatgaacaagcgaacggtcgtaaccatgtaaaaatgtatccttctttatctctagttgattttatgagcgaggatgaacaaggaaatccgcgattcattattctaacagataatccggaaatgacattaccagagtctcatttggaagatttagcagagcttcaaggaagtgtgtatatgtatttcgttcgaaatggagaagtaatacatgaacgattaattctcatttaa

SEQ ID NO: 3447 - DNA, 3180 bp, Halobacillus halophilus
atgctcaagaaaggtgaaatagtcgggggatctttctggccagagcctgttcaaattaagcatgtcgaaagcattgatgaggagttgtttttggtagaagctgtcggtcgtgaatccaatcaattcttcgaaaattatttagaagaatttcaattagaaaaagtggaacattattctgagatcgaaacttcagatcaatggaagaatcgctttcaacactatttacagtatcacgtattgcgaacagaaaaagaatactctcaagcacgggctcgtgggaataagaatatgatacctctgcctcaccaaattgaagcggtttatagtaagatgcttcaggcccctcaagtacgttatctattggctgatgatccaggagcaggtaaaacgattatgtccggtatgctgatcagggaattgaaagcacgaaatatggttcgcaaaacgttaattctagttcctccgctagtattaaaacagtggcaggcagagttaaaagaaaaattcgatgaagatttcttaattataactcgtgattacttgaaagcttcgggtgaaaccaacccctttgaaatgcaccagcaagtgatagcatccatgtattgggcttctagagaggatattaaaaatatgatcctaaattctcactttgatttagtgattgtagatgaggctcataagatggcagcttacacagtaggacagaaaaaaagaaaagtgaaacgcacgaaaatgtttcaacttggggagaacctgttacgtcattcagaacattgcatgcttctaacagctactccgcataaaggagacaaagaaaactttaggcacttaatgagccttatcgatcatgatattttttctcaactgaatcgaagtgactctattttcgaaaagagtaatccatacgtaatccgtcggttaaaagaaaagatggttaaatttgacggaacacccttgtttccgaaacgaacgacaaagacacttggtttcgagttaagctctgcagaagtagagctatacgacgctgtgacggactacgtacgtcattactttaaccgtgcgaaaaagaatgataaaccgaatgttgcttttgctatgatgattttacaacggaggcttagctcttctgtggaagcaatctacctctctctattacgaagaaaagaacgactgcagaaagttttggagacaggacagaggtttcagcaattaatagacacagaagaatatgaagaaagctcctttgaagatcaggaattgatggagcaatatgcagaaggtgaatttgaagaacttgatatggacgaacttcaggtggaaatagaaatgcttgatcatttgatccgcaaagcaaatgtggtacggcagcaggagaatgagagaaaatttcttgaactggaaagcaccttatttggagcagacggacttcttgctcaaggggagaaaatactaattttcacggaatcaaaagatacactgaattatttagaaaagaaattgaaggcttatgtaccggatattgctaaaattgtgggtggtttttccatggacaggcgtcaagaagaggtggagaagtttcgcaacgatttgcaaatcatgcttgctacggatgctggtggagaatccattaaccttcagttctgtaatcagatggtaaattacgacataccatggaatccgaatcgattggaacagcgaatggggcgtattcaccgtatcggtcaaaagaacgaagtgtttgtctttaatttagtagctacaaatactcgtgaaggggatgtgctttcacgtcttcttacaaagatggaacagatgagggaagaccttggtcaggaattggtatatgatttcatcggtgaagtattggaagatcatcaggctgatttaccttctattatggaacaatccattataggcagggaaaatctcgataatgtgattgagcgtatggaaaagaccttatccgaagaacatgaacgattgctagagttagctaagaatgagcgtcttgatgaaaactttgatttaccaggagctaaacgctctttcgataaagtttcaatccatagcattcctcggcggttctatggtcacttcgttttacaaggtttagaaagtacgaggacacgtgtgagcgtctcgggagacaagtctacagctcgcatcgaccgttttcctaaacgtatacgtgattttgcccgcggacgtaagttaatgtttgatttcgatgaatctattcgttttgcattaactacgaactcagaaactattcaactttccatgttacaaaatgacagtcctgtgtttaacataattatgcaattgacctttaaagaaattcagcaggctgttttgccattttatgaagttcaagcctccgttcctgaagatatgaaaattgagttgaatcaggtaacgattgtggatggaaatggtcgtgagcttgaacaacagttaatgatgactgggaaacgcgagaatggtggttttgtccaagtctctccttatttcttatttcaccaaacattagaggtggagggtacgttcgttcaagaagaccaagacattaaacggtacgtcattaagcatgcaagaaaccttttaaaaacaattcaacgtaagcgagaggattatgctaatagaaaaagagtctttttaagaaagtcttttgaagagcagattgaaacattacagcaacgtttagaaaaataccagagagaaaacgtagaaagaaaaaatagtgcattaatcaaccagacttatgcacagatagatgaaatagaagaccgcagtaaagagcgtttgaatgaaattgatcgggaacgctccatccaactaaaaccagtaaagcggatagcacaatttaaagtttcatccaatggtgtatcaaatggacgtgttattcctcaggactttctctctctaattgaggagtatgaattgaaaagtggtaggttgaatgttcaattacaacctgcttttggactcgtagattttattagtgaggatgttgagggcgaaaataggttgatcgtcgtcactgacgatttatatcagtttaaacaacaactggtgctggaggattatagtgatataacagaacgggttttcgtgtatgagctcagagaacatggaattaaagagcatcagttggatcaagggttaatgtttacttattaa

SEQ ID NO: 3448 - DNA, 3114 bp, Thauera sp.
atgcagcccggcgacaaagtccgcttgaaggccaacccgggcagggttggcatcctcggtaacgaaaccgatggcccaccgcatcgactccgggttctcgtcaccttcacggatggagacgagcaattcgtgctcaagaattcgctcgagaaggtcgaccgggcatcggccggcccctatgcaatggtggccagtggtcgttacggccgagtcgaggatctccgtggtgcgatcacgtattaccgcttaagcggtcggctggcgaacctcatctacagcctgaacacgacgaacacgcagttccttgcctaccagttcaagcccgtactgcagttcctcgactcgccttcgaacggcatcctcattgcggacgaggtcggcctcggcaagaccatcgaggccggcctgatctggacggagctccgcgcccgtgtcgatgcgaagcgcctcttggtgatctgtcccgcgatgcttcgcgaaaagtggaaggccgaactctccgagcgcttcggggtgagcgcggagatcgtcgatgcacgcggcctgctcgaccacctgcagagcgtacgagaacgcccccagcagcagttcgcgctgatcgccagcatgcagggtttgcgcccggccaagggctggaatgacgatgaggagccctcccaggcaaccactgcaaagctggcgcgctttctgaacgaggcggacctcgaagagcccctgctcgacatgctgatcatcgacgaggcgcactacctgcgaaacgacgaaacggctacccatcgtctggcccggctgcttcgtccagtcgtgcagagcatggtgatgctgtcggcgacaccgatccagttgcggagcgacgatcttttcaacctgctcaacctgatcgacgaggactccttccccttccccacctcgttccaatactccctgcaggaaaacgcaccgatcgtcgccttgcgcgaccggatcctgagtcacgtggtcacgcccacggatttcgtagagaccttgcgtgaggcagttggtggtcgcatcttcggcgacaacgctcagctcgagcacctcatcaatcatccgccctctgccgaggacctttcctcgccgcgcggacgctcagaaattgccgatcagctggaccgaatcaacccgctgaccaaggtcgtcacgcgaaccctgaaacgcgacgtgcaggaaatgcgcgtgcagcgagatccggtgacggtccgcgtagagatgaacccgatcgagcgcgagttctacgatcaagtgaccgaggcggttcgcgagttctgcgcgcgcatcgacatctctgaaggcttcatgctgacgattccgcagcgccagttgtccagctgcgtggcagccgcgtgcaagggttggctcgatcgcacggaagtcgatgacgaagagcttgaaagcgaggtcttcgagctctacggcgatgccgaggacaacgagaaacgcccgaaccttggcgccctattgcgaacactcgtaggcattgcacgacgcgttggcgaccacacggcactcgaatcggtggacagcaagtacgacatgctggtccgcaacctgaagcaatactgggccgcctaccccggcaagaagatcgttctgttctccttctaccgcaacacgctccactacctcgcacgccggctggcggcagaagggatccagtctgcagtgcttcacggcgggatggacaagcatggcgtgctgcggcacttcgagtcgaccgaaggccccgacatcctgatttcttcagaggtcgcttccgagggtgtggacctccagttctccagcctgctcatcaactacgacctgccctggaaccccgcccggatcgaacagcgcattggtcgtatcgaccggatcggacaggaagccgagaagatcctgatctggaatttcatctacacgcacacgattgatgaacggatctacgaccgactgctggagcgcctcgacattttccgccaggcgctcggcagcatggaggcgatgctgggcaccgagatccgcacgctgagctacgagctgctgtcgcacaagctcacaccggagcaggaacaagaacgcatcgaccgcgccagtcttgctatcgagcgagtgagcaggcagcaggcgctgctggaagaggaagccacccaactgatcgcccacggcgatttcatccagaacaaggtacaggccgccaaggagctgggtcgcttcatccgaggcgaagatctgctcgcctacgtgaaggattttctcgagcgagagtttccggggacgcgtttgcttgcggacgatgacgacgagctcgagcatgtgatcgagctctcgaccgaggcccgcgtcgctttctccgagtttctccagcaacaacggcttcagggcgcaacgcgccttcttggcgccgcaccgccaaggctcatcttcgagaaccgtcatgggcggaacccgtccggaaaggaacggatcacgcaagatcatccgctcgtgcgcttcgtggcggatgagttgaagaaggctggaaaggggccgctatacagcccggttgcggcggtggaaatcctgggcaacacggttggaaacatcgagcgcgacatctacgtctatgcgatcgcacgctggaccgtctcgggtgcccgcgacatcgagcggctggagtatctggtccagcggcttgcggacggttggttgctcgacggcgagcaggcggagtttctcgtgaatgccgccggtctccagggccgggactggctgggcgcaagcacaagcctgaaccatgcgcacaccgccggggtgctcgacgactgccgtgccgagctcgaagagcgttttcgcgcatttcgtgacgcacagatccgcgagaaccgagatcgcgtcagcttcatggtgaacacccttcggcatcacctggataaccagcgcaggcgcttccacgaacgaatcgagaagtatcgactgcacggtaccgacaagcagaggcgactgattccagcggaagagggccggctcaagaagctcacccagcgcatcgaggcacggatcgctgagttgcgcctgaaggagtcgatccaggcccacgacagcatggtgtcaggcggcgtcatccgagtggtctga

SEQ ID NO: 3449 - DNA, 2916 bp, Halorhabdus utahensis
atgacggacacgacattctcttccggccaacaagtgattctcaacggcacgtccgcggaggtcatccagacgcggacagttggtgacatcgagtatcttcgagcatacatcgacggcgagggcgtcaagacggtctgtctggacgacgtcgatatccagccacaccaaaccgggctggagaccctctccgggcagcaactcgatgatcttcatccggatcacgaggccgtatctgcccagtggttcgacctccacacgcaggcgacgaagctgaagctcgcccacgagcagggacagttgctgagcatttccaactcgctcgtccggctggaaccctaccagctggcgtgcgtcaattgggtgatgcagaaactccgacagcgtgcgctcatcggggacgacgtcggtctcgggaagaccatcgaggcggggctcatcctcaaagaattgagtgcccgaaaccgggccgaccgcgtcctcttcgtcgtccctgcccacctccagaagaagtggatccgggatatggatcgcttcttcgacgtggatctcaccgtcgctgaccgggcgtgggtcgaaggcgagcgtcggcgtctcggagaggaggccaatatctggaatcaagaccagcagcaactcgtcaccagtatggccttcctgcggcaagaggagttccggtcggcgctccgagacgcgttctgggatgtcgtcgtggtcgacgaggcccacaaggccgcgaagcggggcgactccccgagcaagacggcgaacatggtcgagactgttgcgggcaactccgactcactcctcctcctcagtgcgacgcctcacgacgggaagggagaggcattccggtcgctcgtcgagtacatcgaccccttcctcgtcgccgagaaccgcgagctctcgcaggagacagtcgaccgtgtgatgatccgacgcggcaagacggacatctacgacgacgacggcgagcgcatcttccccgaccgggaggtcaactctgtctccgtctcgatgacccacgacgaacggcagttctaccgcgccgtcacggactacgtcaagaacgtctacaatcgctctgagaagctgaacgagcccgcggtcgggttcgcgatggcgctcatgcagaagcggctggtcagcagcgtcggcgcgattcacgccacgctccgccggcggctgaacgatttgctcgatgaacagacggcgacggacgaactctccgaggaggccgaggcctacctcgacggcgaggatctggacgaggacgacaagcagcgagcggaagacgagattgccgggctgaccgtcgccagcaacgatgaacaactccaagaggagatcgacacgctccgcgatctcgtctcactcgccgaagacctgcccgtcgactcgaaggcccagaaggtacggcggttcatcagccaactcctcgaagagcaaccagacgagaagctcctgctgttcaccgagtaccgggatacgctcgactacctcctcgacttcgtacaggacgagccgtgggccgaagagattctggtcatccacggtgacgtcgacaaagaggagcgggcccgcatcgaagacgagttcaatcacggccagtcgcgactgctgttcgcgaccgacgcggcgagcgaggggatcgacctccagcatagctgccacattatggcgaactacgagttgccgtggaatcccaaccggctcgaacagcgcatcggccggatccaccgctacgggcaggacagggaggtcaaggtctggaacttcctctttgatgacactcgtgagagtgaaatcttcgagatgctccagaccaaagtcgaagagattcgctcgaagctcggcaacacggcggacgtgctcggaatcctcgacgacatcgacgtggactcgctcattatggagtccatccagaacgacgagccgccgagcgcaaccaaggaggaactcgaggacctgatcgaggagcgccagcgcacgctcgaagagtggtacgaacggagtctcgtcgacaccagcacgttcgacgcggagagccgccggcagatacaggaggtcgtcgacgagtccgaagacgtctacgggagtgccggtgacattcgggagttcttcgagcaggcagtcgaggccttcggcggcgagttcgagaagcgcggcaccaatctctatcaggccgaattacccgaggacatccgacccccggatgaggatgcgaccttcggcccgttcacgttcgaccgcgaatttgcgatggagcacgaggaaatcacgttcgtagcgcccgacacggacgtcctccagcgactcatggcacgcgtgctggagttcgatcggggagatgtcggcctcaaactcctcccgttcgtcgacacgccgggagttacctacaattatcgcgtagcgttcgaggatggcaccggagaggcaatccgggaggagacaatccccgtcttcgtcgacgcggagcaacgggatgcccaacaagggctcggtgagcgcgtcgtcgagggcgagacggtgtctgcgaaaccaggggtggatgacatccggacagtagtggacgccgaagacgaacttcgtgaagccgccgaccgctatgtgagtgctcgggtgaacgagatcaagtccgacctcagttccaaacgccacgaagagactgcccgggaactcgaaaacctcaacgagtacgcacagtccgaacgcgagcgcatcgagtcctttatcgaggagtacgaacgcaagtccgaggccggctcggatatggacatcgcgatccggggccagcgtgagcgtctcgaaaaactcgaagagcgaatcgagacgcgtcgccaagagctgaaacgtcgggagcaggtcatctcgctggcgcccgaggtcgagaactactgtttgacactaccactctga

SEQ ID NO: 3450 - DNA, 2916 bp, Haloarcula hispanica
atgacggattcttcattctcgtccgggcaacgagtccttctcaacggaacaccggctgaagtcatcaaaacacagacagtcggcgagatcgaatatttgagagcgtatatcgagggggaaggcgtcaagactgtctgtctcgacgatgtagagattcagccacagcagtccggaatcgaggaactggccaaccagcgaatcgacgaccttcatccggatcacgatgcggtcgcggcgcagtggttcgacctccggacgcaggcgacgaagctcaaactcgctcacgaacagggacagctcctgagcatctcgaactcgctcgttcggctcgaaccgtatcagcttgacgccgtaaactgggtgatgcagaagctccggcagcgggcgcttatcggtgacgacgtcgggctcgggaaaacgatagaggcgggcctcgtcctcaaggaactcgctgcacggaatcgcgctgaccgcgtcctgttcgtcgttcccgcccacctccagaagaaatggatccgggatatggaccgcttcttcgacatcgacctgaccgtggcagaccgcgcgtgggtggaaggtgagcgccgacggctcggcgaggaggctaacatctgggcccaagaccagcaacggctcgtcaccagcatggcgttcctgcggcaggacgagttccggcctgcactccgggacgcgttctgggacgtcgtcgtggtcgacgaggcccacaaggctgcaaagcggggggactcaccgagcaagacggcacggatgattgacgccgtcacggggaactccgactcgttgctgcttctcagcgcgacgccacacgacgggaagggcgaggcgttccgctcgctcgtggagtacatcgatccgttcctcgtcgccgaaaaccaggaactctcacaggaaacagtcgaccgcgtcatgatccgtcgcgggaagaccgacatctacgacgaggacggtgaacgcgtcttcccggaccgcgaggtcaactcggtatcggtctcgatgacccacgacgaacgacagttctaccgggctgtcaccgactacgtgaaaaacgtctacaaccgctcggagaagctgaacgaacccgcggtcgggttcgcgatggcgctcatgcagaaacgactggtgagcagcgtcggcgcgattcacgcgacgctccgacgacgactggacgaccttctcgacgaagaggcagagacagacggtctttccgaggaagcacgagcctatctcgacggcgaggatctagacgaggacgacaagcaacacgcggaagacgagatcgccggtctgaccgtcaccagtaccgacgaacaactccaagaggagatcgatacgctccgcgacctcgtgtcgctggcggaggatctaccggtcgactccaaggcccagaaagtcagacggttcatctcccaactcctcgaggaacagccggacgagaaactcctgttgttcacggagtaccgcgatacgctggactaccttctcgaattcgtgcaggacgagccgtgggccgacgagattctggtgattcacggcgacgttgacaaggacgaacggacccggatcgaagacgagttcaatcacgggcagtcacgactcctgttcgcgaccgatgcagcgagtgaggggatcgatctccagcacagctgtcacatcatggctaactacgagcttccgtggaacccgaaccgcctcgaacagcggatcggacgcatccatcgctacggacaggaagaggaggtcaaggtctggaacttcctcttcgacgacacccgcgagagcgaaatcttcgaaatgctccagaccaaggtcgaggagatccgctcccagctcggaaacacagcggacgtgcttggcatcctcgacgacatcgacgtggatgcgctcatcatggagtccatcgagaacgacgacccgccgagtgcgaccaaagcggaactcgaggagctgatcgaggagcgccagcggacgcttgaggagtggtacgagcggagcctcgtcgatacgagcacgttcgacgcggagagtcgccggcagattcaggaggtcgtcgacgagtcagcggacgtctacggaagcgagggagacattcgcgagttcttcgagcgagcagtcgaagccttcggaggcgaattcgagaaacgcggtaccaacctctatcaagccgagttgcctgatgggatcaattcgcccggccaagatgcgacgttcggcccgttcacgttcgaccgcgacttcgcgatggatcacgaggacatcacctacctcgctccggacacggacgtcctgcaacggctcatggcacgcgtgttggaggacgagcgcggtgcggtcggactcaaactgctgccgttcgtcgacacgccggggatcacctacaactatcgcgtggcgttcgaggacggcactggcgatgtgattcgtgaggagaccatccccgtcttcgtggatgcgacgcaaggggacgctcagcaggcgcttggtgaacgtgtcgtcgaaggcgactcggtagcagcaaagcccgacgtcgacgacttgcgaacggttctcgacgctcaatccgacttacgggcggccgctgaccggtacgtgagcgtgcgtgtcaacgagatcaagaaccatcttcaggagaaacgtcacaaggagactgcccaggagttggaaaatctcgaggagtatgcacaggcggaacgagaacggatcgaggccttcatcgaggagtacgagcgcaaatccgacgccggctcggatatggacatcgcgatccgtggccaacaggagcgacttgcacagctcgaagagcgaatcgagacacgtcgccgtgaattagagcgccgagaacagatcatctcactggcgcccgaggttgagaactactgtttgactctcccattgtga

SEQ ID NO: 3451 - DNA, 2910 bp, Halophilic archaeon
atgcaggacctcgcacccggagacacgattcttctcaacgacaaccctgcagaggtcatcaagacgtactccgtcggcaacctcgactacctcagggcctacgtcgaggacgtcggcgtcaagaccgtctgtatcgccgacgtcgacatcgagccccaacgcgagcaactcggtgccctcgaacccatgacggccgaccagctccatcccgaccacgacgcagtgtccgccgaatggttcgacctccgctcacaggcgctccagctccagatcgcccacgaacaggggcaactcctgagtatctcgaactcgctcgtccgcctcgaaccgtaccaactcgcctgcgtgaactgggtgatgcagaaactccgccagcgagcgctcattgcggacgacgtcgggctggggaaaaccatcgaggcgggactcatcctcaaagagctcaccgcacgcaaccgcgccgaccgcgtcctgttcgtcgtcccagcccacctccagaagaagtggattcgcgatatggaccgcttcttcgacatcagccctacaccagctgatcggcagtgggtcgagggcgaacgccgccgcctcggcgaggagacgaacatctgggaccaggaccaccaacagatggtcacgagcatggcgttcctccgccaggaagaattccgcgaggaactcgacgacgcgttctgggacgtcgtggtcgtcgacgaggcacacaaggcagccaagcgcggcgagtccccgagcaaaacgtcgaagatggtcgaacgagtggctgacaactccgattcgttgctcctgctcagcgcgacgccacacgacggcaagggcgaagcgttccggtcgctcatcgagtacatcgacccgttcctcgtcgccgaagaccaggacctctcgaaggaagcagtcgaccgcgtgatgatgcgccgcggcaagcagactatctatgacgacgacggcgagcgcatcttcccgaaccgtgatgtcggaaccatcccggtcgagatgacccacgaggagcgccaattctaccaggcggtcaccgactacgtcaagcacgtctacaaccgctcggagcagctcaacgagcccgccgtgggcttcgcgatggcgctgatgcagaagcgcctggtcagcagtatcggggcgatacaggcgacgctcagccgtcgactcgggaaccttgtcgaccagcaatcaaccacaaccaatctgtccgaagaagcatcggcctatctcgagggtgaagacctcgatgaacaggaccagcagaatgccgaagaagagctcgcagggctcacgattactgagagcgacgcccaactcgaagaggagatcgagacgctcagggacctcgtctcactcgctgagggaatcccggtcgactcgaaggcccagaaagtacgtcgatacatccagcaactgctcgaagaacagcccaacgagaagatactgctgttcacggaataccgggatacgctcgactatatcctcgatctcgtgaaggacgagccgtgggccgacgagatcctcgtcatccacggtggtgtcgacaaggaagaccgcactcgcatcgaggacgagttcaatcacggccagtcccgattgctcttcgcgaccgacgcagccagcgaggggatcgacctccagcacagctgccacatcatggtcaactacgaattgccgtggaacccgaaccgtctcgaacagcgcatcggtcgcctccaccgctacggccaggagaaagaggtcacggtgtggaacttctcgttcgaggatactcgtgagagtaaggtcttcgagatgctccaagacaaggtcgagagcatccgtgggcagctggggaacacagccgacgtcttggggatgctcgacgacatcaacgtcgactcgctcatcatggaatccatccggaacgacgaaccggcgagtgcgacgaaagaagagctggaagaactcatcgacgaacgccagcggacgctcgcggagtggtacgagcggagtctgatcgatacaacgacgttcgatgaggagagccggcgcaagattcaggacgtgatggaccagtccgaggatgtctacggcagcgaagcagatctccgggagttctttgagcggggtatctcggcactcggtggcgacgtcgagaaggcagggaacaacctcttccgagctgagttgcccgagtcgctccgccgctcgcgggacggtgacccctacggccccttcaccttcaatcgggagttcgcgatggaccacgagggaatcgagtacatctccccagatgcggaactggtccaagagcttatgcagcaagtgctggacagcgagcagggtactgttgggatcaaactgctcccgttcgttgatgaccccggtatcacctacaactatcgagtcaggttcgaggacgggacgggcgaggtgattcgcgaggagatccttccggtgttcgtcgacgcggcacaccgagacccccaacaacgactcggccagcgagtcatcgggggagacagcatcataggctcgcccgaggagggtcgcgtccggccgctcctcgagcacgagcgagagatacgaacctccgctgatcgatatattagccagcgcgttgagtcactcagagacgaactccagcagcgacggcgcgaggagacgcagcaggaactggatgacctcgaagcctacgcggaagccgaacgcgagcgtatcgagacgttcattgccgactacgaacgcaaggctgaggccggtactgacatggacatcgccattcgaagacagcgggatcggctctcgaagctggaagagcgaatcgagaaacgccgtcgtgaactacgacggaaggcgcaggtcatctccttggcaccagaagtcgagaatgtttgtctcacgctcccgatatag

SEQ ID NO: 3452 - DNA, 2907 bp, Natrinema pellirubrum
atgactgacttcgatcccggtgatacggtcctcctcaatggacgcactgccgaggtcattaagacctactccgtcggcgatctcgactatctccgggcctacgtcgaagacgccggcgtgaaaactgtctgtatcggcgacgtcgaggtcgaacccaaacgcgatcagcttggggaactgcgctcagcatcagccgaacagctacatcccgaccacgaggctgtctcggccgagtggttcgatcttcgttcgcaggcccttcagcttcaaatcgcccacgagcaggggcagctgctgagtatctcgaactcgctggtccgcctcgaaccgtatcagctcgccgcagtcaactgggtgatgcagaagctgcgccaacgtgcgctcatcgccgacgacgtcggcctcgggaagaccatcgaagcagggctcatcctcaaagagctcaccgctcgcaaccgtgctgaccgtgtcctgttcgtcgtccctgcccacctccagaagaagtggattcgggacatggaccgattcttcgacatcaacctcacgccggccgaccgacagtgggtcgagggtgaacgccggcgactcggcgaggaggccaacatctgggaccaagaccaccagcagatggtcaccagtcaggccttcctccgacaggacgagttccagccggccctcgaggaagcgttctgggacgtcgtgatagtcgacgaggcgcacaaggccgccaaacggggtgagtcccccagtaagacatcgaagatggtcgaacgggtcgccggtaactctgactccttgctgctgctcagcgcgaccccacacgacggcaaaggggaggcgttccgctcgctcgtcgagtacatcgatcccttcctcgtcgctgaggaccaagacctctcgaaggaggccgtcgaccgcgtgatgattcgtcgcgggaagcaaacgctgtacgacgatgacggcgagcgcatcttccccgaccgtgaggtcaacaccgttcccgtggagatgacccacgacgagcggcagttctatcgggccgttactgactacgtccagaacgtctacaaccgctccgagaagctgaacgagccagcggtcgggttcgccatggcgctgatgcagaaacgtcttgtcagcagtatcggcgccatccaagcgacgctgagtcgtcgtttgggtgacctcgtcgatgagcagtcgacctccaccagtctctctgaagaagcctccgcgtatcttgacggcgaagacctcgacgaggaggacaaacagcgagccgaggaggaactctcggcgctgaccgtcaccgagagcgatgcgcaactcgaagaggagatcgaaacgctccgcgacctcgtctccctcgccgaaggcatctccgtcgactcgaaggcccagaaggtccgccgctacatccagcagctgctagaagagcaacccgacgagaaactcctcctgttcaccgagtatcgcgacacactggactacctcctcgacctcgtgaaagacgaaccttgggccgacgagatcctcgtcatccacggtgacgtcgacaaggaggaacgtgcccgcatcgaagaggagttcaaccacggccaatcccgtttgctgtttgcgaccgacgcagcgagcgaggggattgacctccagcacagctgccacatcatggtgaattacgagctgccgtggaacccgaaccgcctcgagcagcgaatcggccggctccaccgctacggccaggacaaggaggtcaaggtctggaacttcacgttcgaggacactcgtgagggcgagatcttcgacatgctccagaacaaggtcgagaacatccgcggcaaactcggcaacacggctgacgtgttggggatgctcgacgacatcaacgtcgactcgctcatcatggagtccatccagaacgacgaaccggcgagtgcaaccaaagaggaactcgaggagctcatcgacgagcgtcaacgcacgctccaggagtggtacgaacgcagccttatcgacacgagcacgtttgaccaagagagccgggagaagattcaggaggtgatggacgagtccgaggatgtctacgggacggaggccgacatccacgagttcgtcgaacgcggcgtcgaggcgctcggtggcgacgtcgagaaagccgggagcaatctctacagggcccagctgccacgctctctacggcaaggaacggacgaggagtacgggccgttcacgttcagccgagacttcgcgatggaccacgatggtatcgactacgtctcacccgatgatgatctggtccagcggcttatgcagcaaatcctggatggtgagcagggcgatgttgggctaaagctcctcccgttcgtcgacgagccggggatagcgtacaactaccgcgtgacgttcgaagacgggacaggcgaggtcatacgggaagatatgatccctgtgtatgtcgatgcccgccatcatgacccccggcagcggatgggtcagcgtgttgttcagggtgacagtatcaaagggtcgcccgacgcggaccgtgtgcgatccctgatacagagtcaggatcagctgcgagaagccgcggaccggtacatcagccagcaggtcacgtccttgcgggaagaactacacgagcgccgccgagaggagacccagcaagaactggatgacctcgaggagtatgcggaggctgaacgccagcgaatcgaggagttcatcgagaactatgagaggaaagcagaggctgggtcaaatatggatatcgcaatccgtggtcaacaagaacggctcaacaaacttgagcagcgtatcgaagaccggcgccaagaattgcagcggaaggctcgggtcatctcacttgcgccagaggtggagaacgtttgctttgctctcccggtctaa

SEQ ID NO: 3453 - DNA, 2802 bp, Acidothermus cellulolyticus
atgggtgttgaccacctaggcgactggtgctacagccccgagcacggggagctctgccgggtcatcgagacccagacgctctggggtgagaccgtctgccgtgtctggctgccgggcaaggatgccgtcgtgcgggtgcccgccgcgcgcctccggcccgtgcaggaggcaagtgtcggcaccgtggacgggatcgcttatctcgccgcggcggcgcgggtcgccgatgcgctgacccaggacgtcctgcttgcgcctatcgaatcgtccgtcatcccgctgccgcatcagattcgagcgctctccagggccgtttccaacgaccgcgtgcgctatctcctggcggacgaggtgggcctcggcaagaccatcgaggcaggtcttatcatgcgggagctcaagctccggggcctggtgaggcggacgctggtcatcgccccgaagggcctggtgacccaatgggtggcggaaatgcgcacccacttcggggaggagttccgcctgctcatcccgagcgacttctccgcctaccgccgcatcgcccaggaagacaacctctggcagagccatccacaggtggtctgccccatggactctgtgaagcccctggacggccggcgcggctggtcgagggaacaggtggccgagtacaaccgggagcgcttcgaagacctgatctccgccggctgggacctggtcatcgtcgacgaggcccatcgcctgggtggaagcacggaccaggtggcccgctacaagctcggccaggggctggccgaggccgcgccctacctgctcctgctctccgccacaccgcaccagggcaagaccgacgctttccaccgcctgatctccctggtcgacgcgcaggccttccccgacgtgagcagcgtgacaaaggagcgggtacaaccgtacgtcatccgcacggagaagcgccgcgccatcgacgcggagggcaagccgcttttcaaaccccggcgcacggagcttgcgcccgtctcctgggaggatcgccaccgggatcaacggctgctctacgaggcggtcaccgaatacgtgcgcgaaggctacaaccaggccatgcgcgagaagcgcagctacatcggattcctcatgatcctcatgcagcgcctggtggtctccagcacccgcgccatccgcaccaccctggagcggcgcctcgaagcgctcgaggccccacaggaacagctcacactcttccccatggtctccgaggaggagtgggccgacctggacggccaggagcagatggacacgctactcaagacccgccttgaggccctgacaaatgaaagggccgaggtgaagctgctcctggaagcggccaagcgctgcgaaagccagggcccggacgccaaggccgaagcgctcctggactggatctaccgtctccaggccgagaaaggcgacccggatcttaaggtgctggtgttcaccgagttcgtgccgacccaggagatgttgtacgagttcctgaccgagcgcggcttcgaggtggtatgcctcaacggctccatggacttggaggagcgcaagcgggtccaggacaccttcgccaaggatgcccgcatcctcatctcgacggacgccggtggtgagggcctcaacctccagttttgccatgtggtcatcaactacgacattccctggaacccgatgcgcctggaacaacgcatcggccgggtggaccgcataggccagacccacacggtgcgcgccatcaacttcgtgtttgaagactcggtcgaacaccgtgtctgcgaggtcctggaggagaaactggcggtcatcttcgaagagttcggcatcgacaagaccggtgacgtgctcgactctgcccaggcgggccagattttcgacgatctgtatgtggaagccatcctcaatcccgatgtggtggaaaccaaggtcgacgaggtcctgaaaagcattcaggagcaggcccgcgagtctcggcaaagcgtttccgtgctcggctctgtcgaagacctagatcctggagaggcacagcgactgctggcccacccgctcccgcattgggtcgagcgcatgacggtaagctacctgcaggctcacggcggcaaggccgagcggaagaacggcgcctgggatctcacctggccgggcggcgagcaactgagcaatgtcgtcttcaccagcaaggaggctgcagagaggcctctgagtcgccacgtgacgctggaaaatcccaaggtgcgtgggctagccatgcgccttcctccctttgccccgggacaaccggtcccggtcatcacgctccctggccttgcccaagagatcatgggtttctggtcgctctggcgaatctcgatctcgaccgccgactggaatcgtcgccggatcatgcctttgttcctggccgacgacggtcgggtgtttgcgccgactgcccggcacatctgggatcaactggtggtaacgaagcccacgatcctgcggcatttggacgtcgagacctcgcatcaagccttcgagcaactcctggagccggcggaacgacaggggaagacgatctacgacgagctggtgcaggctcaccgggagcgtcttgctcgggaacgtgagaagggcgagtacgccttcgctgcgcgacgcagagccatcgagcgcatcgggctgccccaggtccgtaaccatcgcctgagtctcttggagcaggaggaagaacgcttccacgaacaactcgagcgccgggcccagattctgccggaaatggcgcccctgcttctcgtccgcgtggagggaggcacccatgggtag

SEQ ID NO: 3454 - DNA, 2802 bp, Anaerobaculum mobile
atggaaataaacaatacagaatggtactacaactcggatcataacggcctttgccgtgtaattgaaacccagacgctttggggcgagactatttgccgtgtctggatgcctaataaaaatgctgttgttcgtatatcagcttcacagcttaaaccgttaagtgaaattacaatcgataataaacaccggatagcctatcttgctttcgcagcgaaggttgtcgatgctttgactcaagatgttttgcttgcgccaatagaatcacaggtcatcccattgcctcaccaagttaaagccctgtctaaagctgtttcctcgaattgggttcgctaccttttggcggacgaagttgggcttggcaagaccattgaagcagggctcataatgcgtgagttaaagctccgcggcttagttaagcgcactttggttgttgtacctaaagggttagtagcccaatggatagccgagatgcgctttcattttaaagaagagtttcgttttatcatagcaagcgacttttctgcttatcgacgaatagctagtcaagaaaacctgtggcaaattcatcctcaagtgatctgttcaatggattcagtgaaacccttagataaccgacgcggatggtcgatggaacaggttgctgagtataataaagaacgcttcgagaatctgatctctgccggatgggacctgatcatagtagacgaggcacaccgtttaagcggtagcacggatcaggtggcccgttataaacttggtctgggactttcggaagctgctccttatttgcttttgctctccgctacgccgcatcaaggtaagacggatgctttccataggctgctttcgctcctagatgcccaagcatttcccgatgtaaatagcgtatctaaagatcgggtgcagccgtatgtaattcgaacggagaagcgtaaagccatagatgtgcaaggtcagccgctattcaagccgcgatatacacagttggtgtcagtttcttgggaagattgtcacagacagcaaaaattgctttacgaagaagtaactgaatatgtacgcgaaggctataacaaagcgaagcttgaaaagcgcaattatattggatttctaatgattttaatgcaacgattggtagtatcgagtacgcgagctattcgcacgtcgcttgaaaggcgtctcgaagtgcttgaagagccgcttgaacagttgtcattatccccagccattatagaggaagattgggccgatttggatggtcaagaacaagcagatatagccattagacttcggtccgaagctttaaaggatgaaaagacggaggtaagccgtcttttagatttagccaaagattgtgaaagccaaagttacgatgctaaggctgaagcgcttgttagctggatttaccgacttcaggctgatgaaggtgatccgggtcttaaagtgctggtttttacagagtttgtgccaactcaggagatgctttacgagtttttaacggagaggggcatctctgcagcctgccttaatggctctatggatatggacgagcgtgttcgagtgcaaaaagcttttgcggaagatgtgcgtgttctaatttcgacggacgctggtggcgagggccttaatctccaattttgtcacgtggtgataaattacgatatcccctggaacccaatgcgcttggaacagcgtattggcagggtagatcgtattggccagtcgcgtatggttagagcttttaattttgtatttgatgactccgtggaaaagcgagttcgggaggtattggaagaaaagctggatgtcatatttcaagaatttggcatagacaagactgctgatgtacttgattctgcccaagcaggccagatgttcgatgatctttacgtcgaagccatactgaatccagaaaatgtggaaaccaaggttgacgaggtggtaaaaagcattcgacaacaggctatggagtcaaaacagagtgcctctttgcttggatctgctgaagatttaaaccctcgggaggcacaacagttgttggctcatccttttccatattgggtagaacaaatgacgataaactatattttggccaatggtggcatggctgagaaaaaagatggcgcatgggatctaacttggccagacaatgagaaaatggctaatgttgtatttgacaaagaagaaatgataaaaaatccgtcaaaatactatctcacctttgaggaccccaagataagagctctgaccatgaatcttccgccatttgtgccagggcaaccaataccgataattgctgttcaaggtcttccattggagatagttggtttttggtcgctatggcgaatttcaatctctactgttgactggaatcgttatagggtcatgcccttattcttagctgatggtggtcagatatttattcccaccgccaggcatatttgggatcaattattaaccacatatccccggataatttgtcacatggatgttgacagttctcgcctggcttttgagcaactttggaaggcaggagaacaacaaggcaagtttatctatgatgaactgctccaggcccataaaagacatcttatctgggagcaagaaaagggcgagtatgcctttgatgcacgacgtaggataataatgcgaattggtctaaaacaggtacgtaatcaccgcctgaagatcttggaacgagaggaacgatatttccatgaggagcttaaacttaaagcaaaggttatgccggaaatggttcctatgctaatggctcgcatagaaggagaaaccgccgatggctag

SEQ ID NO: 3455 - DNA, 2766 bp, Bacteroides vulgatus
atgaaatacaatggcaagagtgttgaaataataggcagcaagactttatttggaaaggatacagtatggattcatattcttgaggacaacacctttgtacaagttttgcgttctgaccttgaagatgatataactgatgataagaaaatcggtatgtcatacgttcgttatgtagccatagctgcacgaataaaagaggaaatggcacaaaaaagattacttgctccatacgaaagtagtctgataccacttcctcatcagattttagtactggaaaaggtaatgcaaggcatacagacaagatttcttctggctgatgaggtaggtatgggaaagactattgaagcaggtcttatcataaaagaaaagaaattaagaggtgagctgaaacgaatcttgcttgttgttcccaagtcggcaatgcttcaatggcaacaagagctcaaggagcatttcaatgaaagcttctacatatatgacagtgaattcatttccggtatggctcgtacattcgcaagttttgaagccgaagaagagttaaacttttggaagcagcataatcagattatcgtctctacagatgccctaaagccattgatagcaagacagggatggactcaggataaaatagatgaatacaacaagtaccgtcttgaggctgtggtaaatgcagattttgatatgcttatcttggatgaagcccatcgtatgggtggttctactgcattagtgtcaagatatcaaatggcagaaaccttatgtaactctgttccaaatgtcctattactttcagcaaccccacatcgcggaaaaagtgatcatttcagaagagtacttcaattaattgattcggatgcttttacaggggagggcacgccaagtattcaagaaattgagccatacataatgcgttctgaaaaacgtaatgccgtagactatgatggcaaaaagttattccaacccagaaatacagtaagaatcaatgtaaatcttgataatgaccaacatagattacaaatagctctttataagcatgtaactgaatacgtacgctattgttttggaaaagctaagcacggcaacagaaatgcaactggtcttgtaatggtcatgatgcaaaaactggccagtagtagtaccgctgccatactgtctgccatgcagaccagattatggcgtttgcagaacggctgtgtagatgacatcagtaattatgatgaagaagaaacggtagattttgaggatttgaacactgaagattattctgtggaatatccgaatgcaaactatattaatgaagaaactgctttagcagaacttattgccgaagctcaaaactgtattgcatacgaacaggatgcaaaaactacagcattgattcagaacatctattctctgcaagacaaatataatgattcaaagcttaagattctagtattcacagaattcagaaaaacacaagcctatcttaatgaacaactggaaaaggctggatttaccacagttggcataaatggcaacatggacttgcaagagcgacagaaagcattaataaaatttaaaaacaatgctcaggtcatgattgcaacagatgctgcaggcgaatctctgaacatgcagttttgtaatatcgtgttcaactatgatttgccgtggaatcctatggctatagaacagaggataggacgtgtggaccgtattggacaaaagcatcctgtcattgcatataatatgttgacaaacaactctgtagatacccgagtttatgagattattgtagaaaaacttgatgccatactgaatgaactgggaattgataaaagtggagatgtactggattctacaataaacatgaaagatgtaaatcatctctaccttcaatcattactcgaccctaaaagatttgaatttgcaagtgagagttggttatatgagatacggcaaaaattacacgattataaggccacagaaggtttgctgccagctttctctgaacaagatattgtgaaagaaagtgcaggagaagtaaaatacagccctcttccagtttggcttgaagagctgctgaacctttatgccataagtgaaaacggaaaaataaacaagttacttacaggtgtaactgaatatgaaataaacggacagaagataaacgcatgttttgattcttcatcaatagggtttaatcctgaatgtgaacatttaaccttgcagcatccatatattaagcgtttgctcgatggtattgacgggaatagccaaaagaaaattccggttatcacatcacacgatggaaatgacattaatggtttcctcactgtttggaaaatatctgccaagaacaattatgaaactaaaacaacctacagtgctcaatttgtggcagataatggtaaagtttacgctccatacggcaatgatgtttggaacagacttgtacaaaccaaagatgcatttgaatattgtggtgaaatgccttataatttggattttgacaataattccattctacagaataatctacatgcagtgtttcacaggatggaatgtgaaatagaaaataatcttaaaagcatatttgaaaagaaggttagagcaatagattattctgaacaaagaattagcaaaattggtattagcaatataagaaattcaaaactgaaaaggctaaaagaagaaagaaagaattggcaagccgcattcgaaaaatcaaaaagtattatcccagatgtaacaatgattttgacagttagagtaaatggatag

SEQ ID NO: 3456 - DNA, 2901 bp, Chloroflexus aggregans
atgtttgccgaaggcgactgggtgctcgttcacccgcaaaacgccgtcggtaaaatcattgaacaacgttgcttatggggcaataccttcttccgcgtctggcttccatcaaccgactcgatcatccgcgtgaacgcggccaacttgttaccggttcagtccatagtcctcagccctcatcatcttatctacctcaccgccgcgacacggatcgccgatgcgctgagccaagatgtcttgcttgcacccgttgaatcgtctgtcatcccgttgccgcaccaactgcgcgcactttcgcgggccatttccaccgaccgcgtgcgctatctgctggccgatgaggtgggtctcggcaagactatcgaggccggtctgattatgaaagaactcaagctccgcggcttggtgaggcgaacgctaattatcgccccgaagggtctcgtgacccaatgggtggccgagatggcgatgcacttcaatgaacagttccatgcgatcctgtctgaggattacaagagcttaaaacgaatcgcggcaatcgccaagacagaggctcgcggaatgcggacaacatccttggaaccatcttccctcatctcgcctccctcgtccatcttcaccgccaatgcaaacccgtttaccgcatttgatcaggtcgtcgtttccatggactccgtcaagccgccatcaaatgccgacagcgcggcctgggaacgtttcgaggacctgatctccgccggctgggacttggtgatcgtagacgaggcccatcgcttaggaggaagcaccgatcaggtggcccgctacaggcttggtcaaggattggccgaggctgcaccctacctccttctgctctctgccacgcctcatcaaggcaagaccgaggccttctaccgactgatcgccttgctcgatagtcaagccttccccgatgtgaatagcgtgacgaaggagcgggtacagccctacgtcatccgcaccgagaagcgccgtgccattgatgcagagggcaagccgctgtttaagcctcggcgcacagaattagcgccggtctcttgggaggaacgtcatcgggatcaacggctgctctacgaggcagtcaccgaatatgtacgcgaaggctataaccaggccatccgcgagaaacgcaactacatcggttttctgatgatcctgatgcagcgcctggtggtctctagcacacgcgcgattaagacaacgctcgagcgccgtcttgaagtgctcagtgccgagaactcaaggttgagtcagcgggagttgttcgatgcagcgcttaacgctgacgacttttacgatctagacggtgaagaacagctccaactgctgttgaggacacgtattcaggggatacgtgacgaacagaccgaggtaacgctgctgttagaattggcaagacgatgtgaagcccaaggcccagatgccaaagccgaagcactcctagactggatttaccgtctccaagccgaggaaggcgacccaaaccttaaggtgctggtgttcaccgagttcgtgcctacccaagagatgctgtacgaatttctcacccaacgcggcttcacggtggtatgcctcaacggcgctatggacatggcagcgcggaagcaagttcaagacgcctttgccaacaatgcgcgcatcctcatttcgacagacgccggcggtgaggggcttaacctccagttctgccacgtggtgatcaactacgacatcccttggaacccaatgcgcctcgaacaacggatcggccgcgttgaccgcatcggtcagacccatacggtccgcgccgtcaattttgtgttccaggactcggtcgaacaccgtatccgcgaggtccttgagcaaaagctggcagtcatcttggaagagttcggtatcgacaagaccggtgacgtgctcgactccgcccaagcgggtcaaatcttcgatgatttgtatgtggaggccatcctcaatcctgccgaggtggagcagaaagttgacgaagtcctgaacagtatccgcgcccaagcacaggagttccggcagagtaccgccttgctgggcgcgaccgaagacttagacccgcacgaggccgaacgactgctcgcccacccgctccagcattgggtcgaagcgatgactaccgcatacctacgaagtgtaagggacgaggggcggagtgcgaacggcaaaaaaccgggcgcggaaccgattggcaaagaggggtctcatacgatctggcatctcatttggccggatggccacgaagagactgtttgctttacccataccaccctccgcacgccacatttggggcttgaagacccccgcgtgctcggtctggcgatgcgtctcccttcctttgtgccgggacaaccgattccggtcatcacgcttcccaaccttgccgcagagatcgtagggttctggtcactctggcggatcgcaatctcgaccaccgattggaaccgtcgccggatcatgcccttgtttctcaccgacaacggtcgggtattcgccccgactgcccgacgaatctgggatcacctggtggtggcgaaccctaccattctgcggcatctcgacagcgagacctcgtatcacatcttcgaacgtctctgggaggcggcggaacaacaggggaacgcgatctaccatgaactggtgcaggctcagcgggagcatctcgcgcgcgagcgtgagaagggcgagtacgcttttgctgcacgacgccgagttatcgaacggctcggactgcccgaagttcgtagctatcgtctgcggcgcttacaacaggaagaagaacaattcagagaacaactcgaacgtagctcgcagattttgccggaaatggtgcctgtgctgatcgtccgggtggaaccagaccaggatggggggtga

SEQ ID NO: 3457 - DNA, 2901 bp, Desulfovibrio aespoeensis
atgaatagctccatatggcaatacagcaccgttcataacagcgcctgcaaggtcatcgaagaacagaccttgtgggggcaaacggtttgccgtgtctggttgccgaaccaggacgcggtggtgcgcgtgccccgctccgcattgcggccgctgagtgccgacttgcagccggagatcgaggctggacgcattgcctatgtggccgccgcagccaaggtagccgaggtgctcgaaggttccaccagcgccaccgagggccatgtgctgctggctcccatggagtccaacgtcattccgctgccgcaccagatccacgccttgtctcgggccatctccggtgaccgcgtgcgctacctgctggccgacgaggtgggtctcggcaagactatcgaggccgggctggtcatgcgcgagctcaaactgcgcggactggtgcgtcggacattggtcgtctcgccgaagggaatcgctacccagtgggtggcggaaatgcagacccacttcaacgagcagttccagctcgtgctgggcgacgacatcggcacattgcaacgcctggctccaggggcggatcaccggagctcagcctggtcgatgtttgatcaggtcatcgtctccctggattcggtcaaacccatggacaagcggcgcggctggaccgccgagcgcgtcgccgaatacaaccgcagccggttcgaggatctgattaccgccggttgggatctggtgatcgtggacgaagcgcatcggctgggcggcagtaccgaccaggtcgcccgctacaagctcggcaaggggctggcggaagccgcgccctatgtgctgctcctttcggctacaccccaccaggggaagaccgatgccttccatcggctgatgaacctgctggatgacgatgcctttccggatatggacagcgtctcccgcgaccgggtggctccgtatgtcatccgtaccgagaagcgcaaggccatcgatgccgacggcaagccgctcttcaaaccccggcggacgcagatggccccggtggcctgggagagccgtcaccaactgcagcagcttctctacgaggcggtgaccgactatgtgcgcgagggctacaaccaggccctgcgcgagaagaagcgccacattggttttctgatgatcctaatgcagcgcctggtggtctccagcacccgggcgattcgcaccacgctggagcgtcggcttgcggcactcaaggatggtgagcaacaagccagcctgcgcctggcggaactggaaaacggcgcggacggattggaaagcccagacgatgaaatagccgagctatatgacatggacggccaggagctgctcgatgagctgctgaaatcccacgtgtcggctctgcagagcgaaggaagccatgttgagaccctgctcgacgcggcggtccgttgtgaacaggctggaccggatgccaaggccgaggctctgatcgagtggatctacaagctgcaagccgaggaaaacgaaccggatatgaaggtgctgatcttcaccgagttcgtgccgacccagcagatgctgaaggagtttctggaagcccggggaatctcggtggtcaccctgaacggctccatggccatggaggaacgtggggcagcccaggatgccttccgcaaatcgcaccgcgtattggtctccaccgatgcgggcggtgagggtctgaacctgcagttcgcccatgtcatcatcaactacgacatcccctggaatcccatgcggctggagcagcgtatcggccgcgtggaccgtatcggccagcccaaaaccgtacaggcgatcaatttcgtatttgaggattcagtcgagttccgggtccgcgaagttctggagcagaagctctcggtgatcttcgacgagttcggcatcgacaagaccggcgacgtgctcgactcggcccaggccggtgagttgttcgaggatgtgttcgcctcggccatccttaatcctgacggcatcgaaacctccgtcgatcacacggtggccaggattcgggatgagattcagcaggtgcgcgagtcctccgccatctacggcatatccgaagagccggatgtgcaaaccgctgagcgtctgcgctcgcatccgctgccccactgggtggaacggatgacggtgggctacctcaattcacacggcggcgcagccagtcgcaagcgctcatggtgggatctgaattggccggatggccaggaacaccgcaaagccgtattcagcgctcgggaagcggatcgtctaaccgacgcaaccctgctcaatctcgaaaacagccgtgtccgtggtcttgccctgaacctgccccaggtcgcggcaggtcagccattgccgtgcgtaaccgtaagcgggctgccagccagcatctccggactctgggggctctttgagatccgccttcaggccggaatgcaccagaagacacaactcctgcgcatccccatggtgcggcgtggctatgtcagcgtgtttttgagcgaggaaggcaaactgtttctgcccacggcccggcatatctgggatgcgctgcagacagcggaagccgaggtgcaagccaccctcgggcaggatgactctatcaccgcccatgagcgtttgcagattgctgccgaacaggccggacaggagctattcgatgcattacagcaggcgcatctcgccgctgtggctcgcgaggaggaacgtggcatcgtttcctttgcctcgcgccgcaaggccatagagcgggttggattgccagaggtacggcaattcaggttctctcgttgcgatgcggacgaatccgagtggaggcatgaactgcaatcggcgaggcagatcgtgccggaaatccggccgttgttgatgctgcggatcatcaagggaggcgctcaatga

SEQ ID NO: 3458 - DNA, 2898 bp, Dichelobacter nodosus
atggagtcgctttggcaatacagcaccgttcataacagcgcctgcaaggtcatcgaagaacagaccttgtgggggcaaacggtgtgccgtgtctggttgccgaaccaggacgcggtggtgcgtgtgccccgctccgctttgcggccgctgaatgccgacctgcagccggagatcgaggctggacgcattgcctatgtggccgccgcagccaaggtagccgaggtgctcgaaggttccaccagcgccaccgagggttatgtgctgctggctcccatggagtccaacgtcattccgctgccgcaccagatccacgccttgtctcgggccatctccggtgaccgcgtgcgctacctgctggccgacgaggtgggtctcggcaagaccatcgaggccgggctggtcatgcgcgagctcaaactgcgcggactggtgcgtcggacattggtcgtttcgccgaagggaatcgctacccagtgggtggcggaaatgcagacccacttcaacgagcagttccagctcgtgctgggcgacgacatcggcacattgcaacgcctagctccaggggcggatcaccggagctcagcctggtcgatgtttgatcaggtcatcgtctccctggattcggtcaaacccatggacaagcggcgcggctggaccgccgagcgcgtcgccgaatacaaccgcagccggttcgaggatctgattaccgccggttgggatctggtcatcgtggacgaagcgcaccgccttggtggcagcaccgatcaggtcgcccgctacaaactcggcaaggggctggcggaagccgcgccctatgtgctgctcctttcggcgactccccaccaggggaagaccgacgccttccatcgcctgatgaacctgctggatgacgacgcctttccggatatggacagcgtctcccgcgagcgggtggcctcgtatgtcatccgtaccgagaagcgcaaggccatcgatgccgacggcaagccgctcttcaaaccccggcggacgcagatggccccggtggcctgggagagccgtcaccaactgcagcagcttctctacgaggcggtgaccgactatgtgcgcgagggctacaaccaggccctgcgcgagaagaagcgccacatcggctttctgatgattttgatgcagcgcctggttgtctccagcacccgggcgatccgcaccacgctggagcgtcggcttgcggcactcaaggatggtgagcaacaagccagcctgcgcctggcggaactggaaaacggcgcggacggattggaaagcccagacgatgaaatagccgagctatatgacatggacggccaggagctgctcgatgagctgctgaaatcccatgtgtcggctctgcagagcgaaggaagccatgttgagaccctgctcgatgcggcggtccgttgtgaacaggctggaccggatgccaaggccgaggctctgatcgagtggatctacaagctgcaagccgaggaaaacgaaccggatctgaaggtgctgatcttcaccgagttcgtgccgacccagcagatgctgaaggagtttctggaagcccggggaatctcggtggtcaccctgaacggctccatggccatggaggaacgtggggcagcccaggatgccttccgcaaatcgcaccgcgtattggtctccaccgatgcgggcggtgagggtctgaacctgcagttcgcccacgtcatcatcaactacgacatcccttggaacccgatgcggctggagcaacgtatcggtcgcgtggaccgtatcggccagccaaaaaccgtacaggcgatcaatttcgtatttgaggattcagtcgagttccgcgtgcgcgaagttctggagcagaagctctcggtgatcttcgacgagttcggcatcgacaagaccggcgacgtgctcgactcggcccaggccggtgagttgttcgaggatgtgttcgcctcggccatccttaatcctgacggcatcgaaacctccgtcgatcacacggtggccaggattcgggatgagattcagcaggtgcgcgagtcctccgccatctacggcatatccgaagagccggatgtgcaaaccgctgagcgtctgcgctcgcatccgctgccccactgggtggaacggatgacggtgggctacctcaattcacacggcggcgcagccagtcgcaagcgctcatggtgggatctgaattggccggatggccaggaacaccgcaaagccgtattcagcgctcgggaagcggatcgtctaaccgacgcaaccctgctcaatctcgaaaacagccgtatccgtggtcttgctctgaacctgccccaggtcgcggcaggtcagccattgccgtgcgtaaccgtaagcgggctgccagccagcatctccggactctgggggctctttgagatccgccttcaggccggaatgcaccagaagacacaactcctgcgcatccccatggtgcggcgtggctatgtcagcgtgtttttgagcgaagaaggcaaactgtttctgcccacggcccggcatatctgggatgcgctgcagacagcggaagccgaggtgcaagccaccctcgggcaggatgactctatcaccgcccatgagcgtttgcagattgctgccgaacaggccggacaggagctattcgatgccctgcagcaggcgcacctcgcctcggtgaacagggaagaggaacgcggcatggtcgccttcacctctcggcgcaaggccatcgaacgagttgggctgcccgaagtgcgccagtaccgtctggcccgctgcgctgctgaggaaaatgagtggcggcatgaactgcaatcagcgcggcagatcgtaccggaaatccggtcgctgctgatgctgcggatcatcaagggaggcgctcaatga

SEQ ID NO: 3459 - DNA, 2928 bp, Methanosalsum zhilinae
atgattaaagaatggcaatactccaccatccacaactcaccctgcaaagtaatcgaagaacaaaacctgtggggaaacatagtttaccgtatctggcttccaaatcaggatactgtggtcagggttccgcagtcagcactgcgaccattgactgcagagattcagccggagatcgaagcaaaccgaattacgtatgttgctgcagcagcaaaggtagctgaagtgctggagggcggttcacatgattcggatgggcctgtgcttcttgctccgatggaatcaaatgtcattccgcttccgcatcagatacgtgttctctcaagagctgtttctggagataaggtacgttatctgctagctgatgaggttggtctggggaagacaattgaagcaggacttatcatgcgtgagctcaaattacgaggtttggttcgtcgtattctggttgttgcgccgaagggtctggctactcagtgggtcagcgagatgcatacgcacttcaacgaggatttccagcttgttttcggcgaagaccttgcaacgataaaaagaataatcagtggtaaccattctcgctattgggcacagggtactaagctccggttcctggatgaacctgatgaactgcagcatgcaaatccatggaggatgttcgatcaggtgatagtatcccttgactctgtcaagcccatggataaacgcaggggatggagtcaggaacgtattgatgagtataaccgctccagatttgaagatctgatcactgccgggtgggatatggtcgtggttgatgaatcacacaggctagggggcagtacggatcaggttgccagatacaagcttggaagaggacttgcagaggctgcaccatatcttctattgctttcagcaaccccacatcagggtaaaagtgatgcatttcatcgtttgatgagcttgttggatgacaaaacctttcctgacatggatagcgttactcgtgaacgagtggcagcttatgtgatccgtacagagaaacgtagagcagttgatggagatggcaatccactattcaaaccacgtgttacaaagatggcacctgttacatgggaagaacgacacagatcacagcaaatgctctatgaggaagtaacaaaatacgtccgtgaagggtacaatcaggcactaagggaaaagaagcagcacattggctttctgatgatactcatgcagagacttgtggtttcaagtacaagggccattcgcactacactggaacgtaggcttgaagttctcaaagacatagaaattcgaacttcccagcgtctggaagagattacagattctggtgatgaagttgatgaactttatgagatggatggacaggaactgctcgatgagcttcttaaatcccgtatttctgccatgcagaacgaaaggatccaggtggaaaaccttcttgaaacggcttaccaatgtgagcagcaagcacctgatgccaaagcagaatcactgatagaatggatctatcagctccaggcagaagagaatgaagcagacctcaaattactgatattcaccgaattcgttccaacccaacagatgcttaaagaattccttgaagcccgaggtatttctgtagtaacacttaatggcttcatggatatggacgaacgaaaaaaggcccaggatgatttctgtgacaaagtacgtgtactcatttctactgatgcaggtggtgaaggcctgaaccttcagttctgtcatgttgtcataaactatgatatcccatggaacccaatgagactggaacaacgtataggtcgtgttgatcgtatcggtcaggccaaagttgtaagagcaataaacttccttttccaggaatctatagaattcagggtccgagaagttctcgaacagaaactttcaataatccttaatgaatttggaatcgacaaaacaggagatgtacttgactccgctcaggctggggaattattcgaaggtatttttgcttctgcaattcttgatcctgataatgttgaagcttcagttgataatacagtatccaagattagagaagagatccatgagattcgtgaatcatcaccgatctttggtatttcggaagaacctgacctgcaaactgcagatcgtctacgatcacatccacttccctattgggtcgaacgtatgacagtaggttatattaaatcccacggcggtcatgcaatacgtaaaagagaatcatgggaccttatgtggcctgacagtaaagttcctatgaattgcaccttcaattcacatcgatcgcaacttaaagatgatgtcgtgttacttaatctggaagataacaagataagaggacttgcacttaacctaccaatgattgcttccgggcagccaattccatgcgtatctatagatgaattatcatccaagatatctggcttttggggattgttcgagattcgtatagtatcgggcacatacaatagcaaccatactatgactattccacaaataaggagacgatatctcagtgtctttgtatccgacgaagggaatatattccttccaactgcccgccatatatgggacatcatgcagacagcagagctaaagattttacattctcttgaccacaaagcatccattgatgcatatgataaagttaccaatgctgctgaatctgctgggcaggcattatttaatacccttaagcaagaacatagctctgcaattgaacatgaagaaataagaggtcatcatgcatttgaagcacggagaaaagccataggacgtcttggtctccccgaggttcgtcaatatcgtttagataaatgtatttccgaagagaacgtatggaaaaaagaacttgaaattgcaaaagagacagtaccagatataaaaccacttttgctaatgcaaatacaaaggagagactga

SEQ ID NO: 3460 - DNA, 2823 bp, Methylacidiphilum infernorum
atgaggtggatagctgagagcatgttcactcccgatcagtgggcatggagccccgaacacagggagccctgcaggatcatcgagtcccagacgctctggggcgagaccttctgccgtgtctggctgccgggcaaggataccgtcgtgcgattgcccgccgcgcgccttcggcccatgcatgaagcaagtgtcggcactgtggaaaagatcgcttatctcgccgccgcggcgcgggtggccgatgcgctgtcccagaacatcctgcttgctcccatcgaatcgtccgtcatcccgttgccccatcagattcgggctctctccagggccatttccaatgaccgcgtgcgctatctcctggcggacgaggtgggcctcggcaagactatcgaggcaggtctaatcatgcgggagctcaagctccggggcctggtgagacgaactctggtgatcgccccgaagggcctggttacccaatgggtagcggagatgcgcacccacttcggagaggagttccgcctgctcatcccgagcgacttctccgcctaccgccgcatcgcccaagaaggcaatctctggcagagccatccacaggtggtctgccccatggactctgtgaagcctttggagggacggcgcggctggtcgagggaacaggtggccgagtacaaccgggagcgcttcgaggacctgatctccgccggctgggacctggtgatcgtggacgaggcccatcgcctgggtgggagcagggaccaggtggcccgttacaagctcggccaggggctggccgaggccgtgccctacctgctcctgctatccgccaccccgcaccagggcaagacagatgccttccaccggctgatttccctggtcgacgccaaggccttccccgatgtgaccagcgtgacaaaggagcgggtacagccctacgtgatccgcacggagaagcgccgggccatcgacgcacaaggcaagccgcttttcaaacccaggtgcacggagctggtaccggtttcctgggaggatcgccaccgggatcaacggctgctctacgaggaggtcaccgaatatgtgcgcgaaggctacaaccaggccatgcacgagaagcacagctacatcggattcctcatgatcctgatgcagcgcctggtggtttccagcacccgtgccatccgcacaaccctgcagcggcgcctcgaagtgctcgaggccccgcaggcgcaggaacagcccacactctttaccatggtctccgaggaggactgggccgacctggacggccaggagcagatcgacacgctgctcaagaccaggctcaaggccctgaagaatgaacgggccgaggtgaagctactcctggaagcggccaagcgctgcgaagcccaaggcccggacgccaaggccgaagcgctcctggactggatataccgcctccaagtcgaggaaggcgacccggacctcaaggtactggtgttcaccgagttcgtgccgacccaagagatgctgtacgagttcctgaccgagcgcggcttcaaggtagtatgcctcaacggatccatggacatggaggagcgcaagcgggtccagaacgcattcgccaaggatgcccgcatcctcatctcgacggacgctggtggtgagggtctcaacctccagttctgccatgtggtcatcaactacgacatcccttggaacccgatgcgcctggaacaacgcatcggccgggtggaccgcatcggccagacccatacggtgcacgccatcaacttcgtgttcgaggactcggtcgaacaccgcgtccgcgaggtcctggaggagaaactagcggtcatcctcgaagagttcggcatcgacaagaccggtgacgtgctcgactctgcccaggcaggccagatcttcgatgatctgtacatggaggccatcctcaatcccgatgtagtggagacgaaggtcgacgaggtactgaaaagcatccaggagcaggcacgggagtcccgacagagtgcttccatgcttggttctaccgaagacctggaccctcgcgaggcccagcggctgctggcccacccgctcccgcattgggtggagtgcatgacagtaagctacctgcaggctcacggcggcaaggctgagaggaagaacggtgcctgggatctcacttggccgagcggcgagcgactgaccaatgtcgtcttcaccagcaaggaggctgaagagaagcctttgagctaccacttgacactggaagatcccaaggtgcgtgggctggccatgtgcctacctccccttgccccgagacaaccagtccctgtcatcacgcttcctggcctttccccagagatcatgggtttctggtcgctctggcgaatctcaatctcgacagccgactggaatcgtcgacggatcatgcccttgttcctggccgacgacggtcgggtgtttgccccgactgcccggcacatctgggatcaactcctgacaactccacccacgatcctccggcatttggacatcgagacctctcataaagccttccagcgactccgggaggcggcagaacgacaggggaagacgatctacgatgagttggtgcaggctcaccgggagcgtcttgatcgggagcgtgagaagagcgagtacgccctcgctgcacgacacagagccatcgagctcatcggactgccccaggtccgcaaccatcgcctgagtctcttgaaacaggaggaagaacgcttcagggaacaactcgagcgcagggcccagatcttgccggaaatggtgcccttgcttctcgtccgcgtggagggaggcacccatgagtag

SEQ ID NO: 3461 - DNA, 2919 bp, Moorella thermoacetica
gtgcagcccggaattctggtccgcagcaccatttatccggaaaaagggataggcttggtcctggggaatgaggagtttttcgaccaggtctacgtgcacgttttctttgaaaagaccagggagaggctcaccctgcccctggccgacttaagtccgctccatgatccgctggccaaaatggaagcaggcagcttttccaccgcttcccgcttccagctgcgctggctggtggagcaaatcctggcagaaaattccggggagggccttttggccgccgggggcttcaagattatccccctgccccaccagctcctggcagtaagcttcgtcctcgaccagttcaagccgcgcgtcctgatcgccgacgaggtcggcctgggcaagaccattgaggctgccctgatctacgaggaactgaaggccaggggtatggtaaaaagggtgctggtggtagcgccgtcggggctttgcctccagtggcgggaggaaatgaaaaccaagttcggcgaagactttatcatctacgatcgcagcaccgtccattctctgaaacagcttcacggggagatgaccaacgtctggaccttggccgaccgggtgattacttccctggacttcatcaagcccaaaaagattaccgccgacctggacgagcgtgcagcacgtgcccgccgctggcacaacgagcaggtttttgcggccgcagccgccgcctggttcgacatggtaatcttcgacgaagcccataaacttaccaaagacatgaccggcgaggaaacggcccgctataaggcaggtcatgccctggtccaagcggcgcccatagtgcttctccttactgccaccccccaccagggggaccagcacaagttccgcaacctgctccggctcatagacccttatttattctccggggaaggccggattacggctgaagacgttaaaaaggtaacggtgcgcaacaataagcgggcggtggttgatttccacgggaaccgccttttcaagcagcgggtggccacagtgtgcctgatccaccgggacgaggtggcggaccaggtggagctggacctctaccgggcggtgaccgattatgtaactactttctacgaactggcccggcagcagaacaatttcaccatgatgttcctgctgctcatttaccagcgcatggtaagcagcagctcccccgccattctgaagtccttatccgcccgtctcgcggccctggaggagctgcgccgccgtgcagccgaccaggagccagagagcgagagggaagaacccgactgggacgacctgcaggaactgacggcggaggagcagttggccgaactaacgcgggccagcgctgccccgcgggccggtatcgttatcgtaccggccgccttggcggccgagatcgcggccctgaaaaaatgcttggccctagcggagcgagccacagccggccgcaacgatatcaagttcaccaggcttctggaaatcattaatgaactcagaatccaggaaaacaatccccgcctaaaatttatcatctttaccgagtttagggagacgcaagcttacttagaggagcgcctgaccagcttgggctaccggacggcgctcattaatggtgccatgtccaccaccgagcgcattgcccaggtggagcgcttccgccgcgaggcggatttcctcatttctaccgatgctggcggcgagggcataaacctgcagttctgccatatcttgatcaactacgatctgccctggaaccccatgcgcttggagcagcgcatcggccgcattgaccgcatcggccaggaacatgacgttaaagtgatcaatctacaactggcggacacggtggagaaccgggtgcgggaggtaatcgaaaacaagctggacaccatccgcagggagttttgcgctggcgaagataagctggctgacattctaggggtcttgcaagatgaattcgattttgagaaggtgtatatcgaggccttgctcaagcagggccgcaaggcagccaacctggatgcattatcctggcagatttttgaacgagcccgggaaatcgttgaggaagaaagattagctctgcctatctccaatttggcccctgaatatgttttagcgtcgcagcgagatttggagaagagagccaagagggtgcaaaggctggtagagcaatacctgcaggtttacggcgccagcctgcacccgtacaagctgagagagggcgtttactactttcaggaccccaggagcggcaggcgcctgcataacgtgatcttccagcagaaatatgccctggccaatgagggggccgagcttttgagtttccagcacccctatatggtggaactgttagcccacctggaggatgccctgcgggaggatacgtcggcaaagcttttggtacgtgagagaaagttcagcggggaaaaagggtttctgtttatataccggctgaccctcacaaactacttggaccctactgtttactatctggtaccttgttttgttagctttgctggggatacggggcgggtaaacggcagaatatcccgctattttcgcgattgggagcagctcatctgcaccgacctggtaaccggagagataccgtataatctaaaggaggcctggcaactggcccggaaggctgtgcagcaggaagcagaggttctcttctttcaggcaaaggaacgtttggagaagaggctgcgggatgaagaggaaaagtttgagaaatactacaaggaccgggaggcggccatcgagaagattgccgtggacaatatccgcgcagccaagaaaaaagagctggaagaggaccgaaagactaggcggcaagaatggttgcgccgccggcagctggtgcccagcctaagcctagagcaagttgcctacgtggagtttgcatga

SEQ ID NO: 3462 - DNA, 2889 bp, Nitrosococcus oceani
atgccttggcaatacagcaccgttcataacagcgcctgtaaggtcatcgaagaacagaccttatgggggcaggccgtgtgccgtatctggttgccgaaccaggacgcggtggtgcgcgtgccccgctccgccttacggccgctgagtgccgacctgcaaccggagatcgaggctggacgcattgcctatgtggccgccgcagccaaggtggccgaggtgctcgaaggctccaccagcgccactgacggtcatgtattgctggctcccatggagtccaatgttatcccgctgccgcaccagatccacgccttgtcccgggctatctccggcgaccgtgtgcgctacctgttggccgacgaggtgggcctcggcaagaccatcgaggccggtctagtcatgcgcgagctcaagctgcgcggactggttcggcgaatcctggtcgtctctcccaaaggcatcgctacccagtgggtggcggaaatgcagacccacttcaatgagcagttccagctcgtgctgggtgatgacatcagcaccttgcagcgcctggccccaggggcggaccaccggaactcagcctggtcgatgttcgatcaggtcatcgttcccctggattcggtcaagcccatggacaagcggcggggttggaccgccgggcgcgttgccgaatacaatcgcagccggttcgaggatctgatcactgctggttgggatctggtagtggtggacgaagcgcaccgcctgggtggcagtaccgatcaggtcgcccgctataagctcggcaagggcctggcggaggccgcgccctatgtactgctcctttcggctacgccccaccaggggaagaccgatgctttccatcgcttgatgaacctgctggatgaggacgccttcccggatatggacagcgtttcccgcgaccgggtggctccttacgtcatccgcacggaaaaacggaaggccatcgatgccgatggcaagcccctcttcaaagcccggcgcacgcagatggccccggtagtctgggagagccgtcatcacctgcagcagctcctctatgaggcggtgaccgactatgtgcgcgagggctacaaccaggctctgcgcgagaagaagcgccacatcggctttctgatgatcctgatgcagcgcctggtggtctctagcacccgagcaatccgcaccactttggagcgtcggctcgcggcacttaaggaaggcgagcagcaagccagcctgcgcctagcggagctggaaaacagtgcggggggatcggaaaacacagacgatgaaataaccgagctctacgacatggacggccaggagttgctcgatgaactgctgaaatcccatgtgttggctctacagagcgaaggcagtcatgtggagactttgctagatgcggcggttcgctgcgagcaggcggggccggacgccaaggccgaggcgttgatcgagtggatctacgagttgcaagccgaggaaaacgagccggatctgaaagtgttgatcttcactgagttcgtaccgacccaggagatgctgaaggagtttctggaagcccggggaatctcggtggtcaccctgaacggctccatggatatggaggtacgtggggcagcccaggataccttccgtaaatcgcaccgcgtgctgctttccaccgatgcgggcggtgagggtctaaacttgcagttcgcccatgtcatcatcaactacgacatcccctggaacccgatgcggttggagcagcgaatcggccgcgtggaccgtatcggccagcccaagatggtgcgagcgatcaacttcgtgtttgaagattcggtcgagtttcgcgttcgcgaagtgttggaacagaagctctcggtgatctttgacgagttcggcatcgataagactggtgacgtgcttgactcagctcaggccggcgagttgttcgaggatgtgttcgcgcaggcgttcgccaaccctgatggtattgaaacttccgtcgatcagacggtgactcggattcgcgatgagattcagcaggtgcgggagtcctccgccatctatggcatttccgaagaactgaatgtgcaggcggctgagcagctgcgctcccatccgctgccccactgggtggagcggatgacggtgggctatctcaattcccacggcggcacagccagccgtaaacgctcctggtgggatctaaattggccggacggtcaggagcatcgcaaggccgtgttcaatgcccgggaagcggaccggctgaccgatgcaaccctgctcaatcttgaaaacagccgtgtccgtgggctggccttgaacctgccgcagatcgcggcgggccagccattgccttgcgtaagcgtgagcggtctgccaaccagcatctccggtctctggggactctttgagatccgccttcaggccggaatgcaccagaagacacaactcctgcgcatccccatggtgcggcgcggttatgtcagcgtgttcctgagcgaggaaggcaaactgtttctgcccacggcccggcatatctgggatgcgctgcagacagcggaagcccaggtgcaagccaccctcgggcgagatgaatccatcaccgcccatgagcgtttgcggattgctgccgaacaggccggacaggagctgtttgacgccttgcagcaggtacatcttgccgctgtggcttacgaggaggaacgcggaattgtctcctttgcctcgcgccgcaaggccatcgaacgggttggattgccggaggtgcggcaattcaggctggcccgttgcgacgcagaagaatccgaatggcgacatgaactgcaatcggcgcggcagatcgtgccggaaatccggtcgctgctgatgctgcggattatcaaaagaggcgcttaa

SEQ ID NO: 3463 - DNA, 2901 bp, Nitrosococcus watsonii
gtggaaatactaccctggcaatacagcaccgttcataacagcgcctgtaaggtcatcgaagaacagaccttatgggggcaaacggtgtgccgtgtctggttgccgaaccaggacgcggtggtgcgcgtgccccgctccgctttgcggccgctgagtgccgacctgcagccggatatcgagaccggacgtattgcctatgtggccgctgcagccaaggtggcggaggtgctcgaaggctccaccagcgccactgacggtcatgtattgctggctcccatggagtccaatgttatcccgctgccgcaccagatccacgccttgtcccgggctatctccggcgaccgtgtgcgctacctgttggccgacgaggtgggcctcggcaagaccatcgaggccggtctagtcatgcgcgagctcaagctgcgcggactggttcggcgaatcctggtcgtctctcccaaaggcatcgctacccagtgggtggcggaaatgcagacccatttcaacgaacagttccagctcgtactgggcgacgacatcggcaccttgcagcgtctggctacaggcacggaccagcggaactcagcctggtcgatgttcgatcaggtcatcgtttccctggattcggtcaagcccatggacaagcggcgcggttggaccgccgagcgcgttgccgactacaaccgcagccggttcgaagatctgattaccgccggttgggatctggtggtggtggacgaagcgcaccgcctgggcggcagcacagatcaggtcgcccgctacaagctcggcaaggggctggcggaggccgcgccctatgtgctgctcctttcggcgactccccaccaggggaagaccgatgccttccatcgcctgatgaacctgctggatgacgaggcctttccggatatggacagcgtctcccgtgagcgggtggccccgtatgtcatccgcaccgagaagcgcaaggccatcgatgccgacggcaagccgctcttcaaaccccggcgcacgcagatggccccggtggcctgggagagccgccatcacctgcagcagctcctttatgaggcagtgaccgactatgtgcgcgagggctacaaccaggccctgcgcgagaagaagcgccacatcggctttttgatgatcctgatgcagcgtctggtggtctccagcgcccgggcgatccgcaccacgctggaacggaggctcgcggtgctcaaggaaggcgaacagcaagccagcctgcgcctggcggagttggaaaacggcgcggagggatcggaaagcccagacgatgaaatggccgagctctacgacatggacggccaggagctgctcgatgagctgctgaaatctcatgtgtcggctctgcagagcgaaggcagccatgtggagaccctgctcgatgcggcggttcgctgtgaacaagcgggaccggacgccaaggccgaggcgttgattgagtggatctacgagctgcaggccgaggaaaacgagccggacctgaaggtgttgatcttcaccgagttcgtaccgactcagcagatgctgaaggagtttctggaagcccggggcatctcggtcgttaccctgaacggctccatggatatggaggaacgcaagcaggcccaggacgccttccgcaaatcgcaccgcgtgctggtttccaccgatgcgggtggtgagggcctgaacctgcagttcgcccatgtcatcatcaactacgacatcccctggaacccgatgcggctggaacagcgaatcggccgcgtggatcgtatcgggcagcccaagatggtgcgggcgatcagtttcgtctttgaagattcggtcgagtttcgcgttcgcgaagtgttggaacagaagctctcggtaatctttgaagagttcggcatcgataagaccggtgacgtgcttgactcagctcaggccggcgagttgttcgaggatgtgttcgcgcaggcgttcgccaaccctgatggtatcgatgcctctgtcgatcatacgatggctcggcttcgggatgagattcagcaggtgcgggagtcctccgccatctatggcatttccgaagagccggatgtgcaaactgctgagcgtctgcgttcccatccgctgccccactgggtggaacggatgacggtgggctatctcaattcccacggcggtgcggccagccgcaagcgctcctggtgggatctgaattggccggacggtcaggaataccgcaaggccgtgttcaacgcccgggaagcggagcacctgaccgacgcaactctactcaatcttgagaacggccgcgtccgtgggctggccctaaacctgccgcagctcgcggctagccaacctttgccttgcgtaagcgtgagtgggctgccagccagcatctctgggctctgggggctctttgagatccgtcttcaggcaggaatgcaccagaagacacaactcctgcgcatccccagggtgcgacgcggctatgtcagtgtgtttctgagcgaggaaggcaaactgtttctgcccacggctcggcatatctgggatgcgctgcataccgctgaagcccaggtgcaggcaacccttggccaggatgaatccattaccgcccatgagagcctgcagattgctgccgaacaggccggacaggagctgttcgacgccctgcagcaggcacacctcgcctctgtggctcgcgaggaggaacgcggagtcgtctcctttgcctcgcgccgcaaggccatcgaacgggttggattgccggaggtgcggcaattcaggctgtcccgttgcaatgcggacgaatccgagtggcggcatgaactgcaatcggcaaggcagatcgtgccggaaatccggtcgctgctgatgctgcggatcatcaagggaggtgctcaatga

SEQ ID NO: 3464 - DNA, 2826 bp, Parvibaculum lavamentivorans
gtgacggggggcggcttcgacatcggcgattggtgctggcacacgcggcaggctacgccttgccgcgtggtcgagcgactggcgctatggggtgaagcggcctaccgtgtgtggctgccctcgaaagacgccgtgctccgcgcacgggcgacggaactggcggtgctttccagcgtgcggcccacggtggggcagattctgcacgccacggcggcggcaaaattgcaggacgcgctcgaagacaacctcctgctggcgcccatccaatccagcgtcattccgttgcctcaccagctctacgcgctgaaccgtgccgtcgggcaggaccgcatccgctacctgctcgccgacgaagtgggtctgggcaagaccatcgaggcgggcctagtgctgcgcgaactgaaactgcgcggtcgcgtcaagcgcatcctggtggtcgcacccaaaggcttggtgcggcaatggcaggcggaaatgcgccagcatttcggcgagccgctccacttcgtagatccttcatcgcttgcggccttgcggcaatggcgcggggacagcgcggaagacaatgcgtggcggatgcacgaccaggtaatctgcgcgctggattcggtgaagccgctggaatcgcggcgtggctggagcctggaccagatccagacctacaaccgcgaacgcttcgaggatctcgtgtcggcggcctgggatctggtcatcatcgacgaagcacaccgcatgggcggcagcaccgaacaggtggcgcgctacaagctgggcgcagcgctggcggaagcctcgccctatttgttgctgctgtcggccacgccgcaccagggcaagaccgaccagttcatgcgcctcatgcagttgctggaccgggacgccttccccgatgaaggcagcgtcagccacgagcgcgtgcagccctttgtgatccgcaccgaaaagcgcgctgcgatcaatgccgaaggccagccgctgttccgaccccggctcacgcgcttgcacgcggtcgcctggcaggctcggcacgcggcgcagcagcagttgtacgaagccgtcaccgactatgtgcgccatggctacaaccaggctctggcggccaagcagcgccatgtcggctttctgatgatcctgatgcagcgactggtgacatccagcaccgccgcaatccgcgccacgctggaaaagcgccaggcggtgctggacacgccgcagacccaagcgcgcctgttcgacacgctcagcccggacgaatgggccgatctcgacggcgaagcgcaggtagacctggcgctgcaagccaatggtctggagctggagaagtcggaggttgagacgctactggcgctggcgcgctccaccgaggccgccgggacggacgccaaggccgaaagcctgctggagctgatctacaagctgcaacaggaagaaggcgacccggcgctgaaggtgctggtgttcaccgagtttgtgcccacgcaggccatgctggcggactatctggaaagccggggcttcacggtcgccacgctcaacggcggcatggacatggaagcccgcacccggactttgcagactttcgcaggggacgctcgcgtgctgatttccaccgacgcgggcggcgaaggtctgaaccttcaattctgccacgtcatcgtcaatttcgacatgccgtggaacccgatgcgcattgagcagcgcatcggccgcgtggatcgtatcggtcagaagcatgtcgtgcgggcgttgaatttcgtgctggaagacacggtggaacaccgtgtccggcaggtactggaggagaagctcgccgtcatcgccgaggagttcggcgtggacaaggccgcggacgtcatggactcggcggaagtggagccggtgttcgatgaactgttcgtgcagagcctccagcatcccgaagccatcgagcgcgaatgcgacagcgtggtctcccagttgcggaccacgctggcggaatcgaaccggaacagcgatctgctggccgtgccgcacgatctcgatgcggaccaggcccgcaagtggcgtgaccacccggctcaattctggctggaacgcgccgtcgtcaacgggctggcagtacgcggcggatcggcgacccaagatggcagcctctggcacgtgcgctgggctgatggtgccgagacgccacaggcctgcttcgacgctcgcgcggcaggcgaaaacccggcggctgaatggctgacgatggaagatccgcgcgcgcgggcgatcatcggcgacgtgccgcgcttcgttgcgggccagcctctgccggtgatccgggtgacgggcctgcccgactcggtcaacggtatctggtcgctgtgggagatcgggctggcggcgccgggtgcgaaccgcaagcgcttcctgccagtcttcataaatgacgaaggccgcccctttgtgcctaccgccaagcgggtttgggatttgctgctgacggaaaccgtatccgtgcagtcggtggcggacgcggaggcttcggtgggctggttcaaggcatcgttcgcggtggccggcgcgcagggtgaagccctgttcgcggcgctggcggacgaacatcgcgcccgtatcaaggaagagcgagatcgcgccacctacgccttcgacgttcgcaatcaggccattggacgcatcggtctaccggccgtgcgccagttccgccgccgccgtctgcaatccgagcacgaggcacgtctggccgcgctggacgatatgcaatccagcgtgccggagctgaatgccgtggcgatggtgcggattgacgccgcagccggcaaaaccagcgagcgtgcgtcatga

SEQ ID NO: 3465 - DNA, 2826 bp, Parvibaculum lavamentivorans; identical to SEQ ID NO: 3464

SEQ ID NO: 3466 - DNA, 2820 bp, Planctomyces brasiliensis
gtgagcgatgcagaccggcctccgacagcagggtttaccgctggctcttgggcattcagccaagaccatcgggagccggtgcgcattctcgaatcgcaaacggtgtggaaccacgccacttatctcgtctggcgacccaccgaggaagccgtcgcttgggtccaagctgaccgcctcacgccgctcgacaaaccggaaacgtcggccaaaggtttcgacaacatcatctaccggatcgccgccgcccgagttgccgaggggctggctgaggatgtcttgcttgctccactcgaagcgggtgtgatcccactgccgcaccagttagtcgccttgtcgaaggcgatgtcgggcgaacgggtgcgatacctgtttgctgatgaagtcggcttggggaagaccatcgaagcggggctggtcattcgagaactcaagctgcgaggcttggtgaagcgtgttctcgttgtcgctccgaagggactcgtcgctcagtgggtgcaggagatgcgaacccacttcaacgaacagttccaacttctctcgcccagcgacttctccgccatccgtcatctggtaaccgacgacaacatctggcggcaattcgatcaggttgtctgtccggttgattcagtaaagccccttgagagacgacgaggctggagccgtgagcggatcgagcggcacaatcaggagcggatcggtgacctgatcgccgctggttgggatttgatcgtggtggatgagtcgcaccggctcggcggcagcacggacaccgtggcccgctacaagctcggcaaagcgctggccgaagctgcgccttacctgctgttgctttcagccacgccgcaccaaggcaagacggagagcttccatcgactgatgacgctgttggatcaggacgccttccccgacatcgggtcgatcaagcacgagaaggtcgctcctttcgtgattcgcaccgaaaagcgacgtgcaatcaacgaccgtggcgagccgctcttcatgcctcggaccacgaagctcgttccggtgcagtgggaggagaagcacgctctgcaagaacagctttacgaggccgtcaccgagtatgtcaggcaaggctacaaccaagccatgcgagacaaccggcaatatctcgggttcctgatgatcctcatgcagcgactcgtcaccagcagcacccgagccatcgcaacagcgctggagcgtcggctggaagtgttgaaatcgacgaccatcacacaggacgatctcaacggcgacgatgccgacctaccggaagaggatagtcaggaacagcttgaagaactgctcgccgcacggatcgccggtctgaaaaacgaacgggaagaagtcaagctgctgctggagacggcacggcgctgtaaggcacaggggtcggatgctcgtgccgaggcgctcctcgacttgctctatcgaacacaacaggaagagaacgatcccgagttgaagttcctgatcttcaccgagttcgttccgacacagaagatgctcagcgagcttctggagcaacacggcttcacgaacgtctgcttgaacgggtcgatggacttggaatcacggcagcgggttcaacgagagttttcacaggatgctcgcattctcatttcgaccgatgccggtggagaaggtctgaacctgcaattcgcccacgtcattgtgaactacgacttgccgtggaacccgatgcggatcgagcagcggatcggacgtgttgaccgtatcggccagaagcaccgggtcaaagcgttcaacatgatctttgcgaacagcgtggaacttcgagtccatcaggtcttggaggagaagctcaagacgatctactccgagtttggagtggacaagaccagcgacgttctcgactcggcagagagcggtgcgtcgttcgagaaggtctacgccgacgccatcctcaacccagatgacattgagaaccgggtcgatcagttgatggtggatgtgcgggaacgtgccgagtccgagaaggcgggcaagtcgctctacgacgaatcgccgctggatgcttcgctggcgaccaagtacgtcaatcatccgattccattctggatcgaacggatgacgacggcctatctccgagccgaaggcggtcgggtggacgagaagccgtttgcctacgacttggaatggcctgatggcgaacggatggaagacatctgcttctttggacgggaggcgcaggaccgggggctgaatcacatcagcctcgaaaatcccaaactgcgctcgctcgtggagaagctgcctcgggcgattgtcggtgagccgataccgaagattgtgttgccggggctgacgggacagattcagggatactggtcgctttggcaaatcgcactgcgatgcagtggccgcccacaggtccgcattctgccgctcttttcgcacgacgacggtcgttgtctgttgccgaccgcccgttcgatctgggagcagcttctccaagatggaactcgggtccaagaacaaggtgtcgtcgaagacggctcggaagtctttgatcgacttcaacgggaagcggaacagcagggcgaaaacctgtttcgagaacttcacacgaagcacaaggagcgactccaccacgaacgtgaaaagggacgctacgccttccaagttcgacgccaagcgctgaatcgaatcggccttcccgaggttcggcagtaccgcatcaaacggctcgatgaagaagagcgtgcttgggacgcagacctgcgacagcaagagcaggtcttcccggaactccagccgattgtcgtcttacgggtggaggcgaaagatggctga

SEQ ID NO: 3467 - DNA, 2910 bp, Thermanaerovibrio acidaminovorans
atgaccctgtcggtggaaaacaacaactggtactacagccccgagcacggggagctctgtcgggtcatcgagacccagacgctctggggcgagaccgtctgccgtgtctggctgccgggcaaggatgctgtcgtgcagttgcccgccacgcgcctccggcctccgcatgaagcaggagtcgccaccgtggacgggatcgcttatctcgccgccgcggcgagagtcgccgatgcgctgacccaggacgtcctgcttgcgcccatcgaatcgtccgtcatcccgttgccgcatcagattcgggctctctccagggccatttccaatgaccgcgtgcgctatctcctggcggacgaggtgggcctcggcaagaccatcgaggcgggtctcatcatgcgggagctcaagctccggggcttggtgagacggacactggtcatcgctcccaagggcctggtgacccaatgggtggccgaaatgcgggcccacttcaatgagcatttccagcttgtcttgccggacgacatcaaaacgctcagccgcatttcggcggtcgcgagtcctgagtcccgagtctcgggtcaagaagactcgcaacccgtgacccgcaactcgtggaccctctttccccaagttgtcgtgccgatggattcggtcaagcctctggacaagcggcgcggctggtccagggaacaggtggccgagtacaaccgggagcgcttcgaggacctgatctccgccggctgggacctggtcatcgtggacgaggcccatcgcctgggtgggagcacggaccaggtggcccgctacaagctcggccaggggctggccgaggccgcgccctacctgctcctgctctccgccacaccgcaccagggcaagaccgacgccttccaccggctgatctccctggtcgatgccaaggccttccccgacgtgagcagcgtgacaaaggagcgggtacagccctacgtcatccgcacggagaagcgccgcgccatcgacgcggagggcaagccgcttttcaacccccggcgcacggagctggcgccggtctcctggaaggagcgccactgggatcaacggctgctctacgaggcggtcaccgaatacgtgcgagaaggctacaaccaggccatcgctgagaagcgcagctacatcggattcctcatgatcctgatgcagcgcctggtggtctccagcacccgcgccatccgcacaaccctggagcggcgcctcgaagcgctcgaggcgccccaagaacagctcacactcttccccatggtctccgaggaggactgggccgacctggacggccaggagcagatggacaccctgctcaaaacacgtctcaaggccctgaagaatgaacgggccgaggtgaagctgctcctggaggcggccaagcgctgcgaaagccagggcccggacgccaaggccgaagcgctcctggactggatctaccgcctccaggccgaggaaggcgacccggatctcaaggtgctggtgttcaccgagttcgtgccgacccaggagatgcttatgcgattcctgaccgagcgcggcatcacagtggtgtgcctcaacggctccatggacctggaggagcgcaagcgggtccaggacgcttttgccaaggatgtccgcatcctcatctcgacggatgccggcggtgaggggctcaacctccagttctgccatgtggtcatcaactacgacatcccctggaacccgatgcgcctggaacaacgcatcggccgggtggaccgcatcggccagacccatacggtgcgcgccatcaacttcgtgttcgaggactcggtcgagcaccgtgtccgcgaggtcctggaggagaaattggcggtcatcttcgaagagttcggcatcgacaagaccggtgacgtgctcgactctgcccaggcgggccgcatgttcgacgagatgtatgtcgaggcgatcctcaatcccgaaaaggtggaggaatccgtagagagcgtggttgcccgcctgcaggagcaggcccgcgaggcgcgcacgaccgcatccgtgctcggcgcgaccgaggacctggagcccggcgaagcccagcggctgctggcccacccgctcccgcattgggtggagcgcatgacggtaagctacctgcaggctcacggcggcaaggctgagaggaagaacggcgcctgggatctcacctggcccaacggcgagcgactgaccaatgtcgtcttcaccagcaaggaggctgaagagaagcctttgagccgccacttgacgctggaagatcccaaggtgcgtgggctggccatgcgcctacctccctttaccccgggacaaccggtcccggtcatcacgcttcctggccttgccccagagatcatgggtttctggtcgctctggcagatttcggtcacgagtcacgagtcgcgggtcgcgagccgtcccgatggactcgtgactctggacccgggacctgagacccgccgaaggcgcatcatgcctttgttcctggccgacgacggtcgggtgtttgcgccgaccgcccggcacatctgggatcaactgctgaccactccgcccacgatcctctggcatttggacatcgagacctctcatcaagccttcgatcaactccggggggcggcggaacgacaggggaagacgatctacgacgagctggtgcaggctcaccgggagcgtcttgctcgggagcgtgagaagggcgagtacgccttcgctgcgcgacgcagagccatcgagcgcatcggactgccacaggtccgtaaccatcgcctgagtctcttggaacaggaggaagaacgcttcagggaacaactcgagcgcagggcccagatcttgccggaaatggcgcccttggctttagtccgcgtggagggaggcgtccatgggtag

SEQ ID NO: 3468 - DNA, 2685 bp, Thermoanaerobacter brockii
ttgttcaaagttggagattgggtttttgatattgataaaaaaagagcaatgaaaataattgatgtatttgagctgtggggttatgtgtcttacagcatatatgacccgattgaaaaggtgacctatactgtgtcagataaaaggcttgtaagtacagaaaagaaaaatgactttgacttaaattatttcaaatatgtaatcatagcttcgcgcatttcaaatgaactggctcagggttttttgtcttcgataggcggcagtattataccactgccgcatcaaatgtatgcgctaaacagggcactgtcaaagagtacagtaagatatcttttggcggatgaagttggtttgggaaaaacaattgaggcaggacttatcataaaagagcttaaagcaagagggcttgtgaaaagaattttgattataagtcctaaagggcttataactcaatggcatgatgagttagaattaaagtttaatgaagattttaaaattatacttcctcaggattttgaagttttgaagagaatttatggagagggaaatatatgggataagtttccacaagttataacttcattggattcagtaaaacctgttgaaaagagacaggggtggacgaaagagcgcattaaagaatttaataaagaaagaatggaaaacctcgttatggctggatgggatataatcgttgtagatgaagctcaccgcttggcaggttcgagcagcgatgtagcaaggcacaaacttggaattgagttgtcgaaagcgagtccttatctcttattattgacagcaacacctcatcaagggaaaacagattcgtttttgaggcttatgagacttattgataaagaagcatttcctaatgagaaagctattgtaagagagcaagttgctccatatattattcgtacggaaaaaagagaagctgttgatagagatggcaatccgctttttaagaaaaggataacgaaaacggtgaatatatcatgggaaataaagcatagtttacaaagggaactttatgagaaagttacgaagtatgtagctgagggatataacagagctaaaaaggaaaaaagatattatattgggtttttgatggttcttatgcaaaggttagtcacaagcagtacccatgctataaaagttaatttagaaaataggcttgagtttttaaaaaatgaggtcgtaggagtagaatctattgaagaagatatgttttttgaatatgacgcacaaaaggtattagatgaattgctaaaaataaaatctcttgatataaaaaaagaaatagatgagttagaggaacttttaagattggcgaagcaagctgaaagtcaatatattgatgcaaaagcagaggtgcttatagattttattgatcagctttcaatggagtataaaaatagtcaaaaatttattgtttttacagaatttttagctacacagcaatatttgaaggattttcttgaaagtaaaggatataaagtagctatattaaatggttctatgtctatggaagaaagagatgcttcattgaaagagtttaaaaattacaaagatgttttgatttcgactgatgctggtggagagggtttaaatctacaattttgcaatattgttataaattatgacttgccatggaatcctatgaaaatagaacagaggataggtagggttgatagaatagggcaggaacgagatgtattggttttaaattttatgctgaaggatacggttgagtttagagtgagggaagttttggaagaaaaattaagagtgatttatgagcagtttggtgttgataagatgggtgatatacttgactctgtacagtcagagatggattttacggagctttatatgagaagcattgagatgcctgaagatatagagtataacgtaagtattatggaagataaaataaaggaaaaggcagagcaaataaataggataaaaggattgttgagagaagagaaggaacttgatttaaatgtagtaagtaaaattagtgggttaccgattaatgagtggattagggatatgtatataaataaaatggctgctgaaggggtagaaatttctattgatatgttggatgaaaatttgatttcgttgaataatgaagaaattaaaaatatgataaaaaatttgcctgtatatataaaaagtagcaagataccgattttatatttaaaagatgtttcaaatgaagaaggatattggtctttatgggaaattagcattaatggagattctgagaagtttagacatgtctttcccgtttttttaaacaaggataaaaaagtaagaattgcttctgcaaatctgatgtgggatatttttttgaagaatgaaaaagaagtaattttcaaggggtataaatcaattgatgagaaaatgtatgattttatacatgatactgcaaaaaatatagcttatgattattttgagaaaataaagaagaattattttgagaatttacttaaggaaaaagagcgatatgaatacgcttttaagttaagaaaagaagctattttaaggatagggcttgaggctgtaaggcgtcggagacttgtggaattagaaaatgaggaaagaagatggaaagaagaaattgaaaagtctatggatatattgcccatgttaaagcctttgtacattgtgtatttggagtga

SEQ ID NO: 3469 - DNA, 2685 bp, Thermoanaerobacter pseudethanolicus; identical to SEQ ID NO: 3468

SEQ ID NO: 3470 - DNA, 2682 bp, Thermoanaerobacterium saccharolyticum
ttgtacagtgtaggccagtgggtttttgattgtgaaataaatagatacgtacaagtagtttcttcaaatgaactatgggggtataaaacatacaatgtttatgaccctatcgataaaagtcttcgcttagtatctgatgaggtacttagacattactcacaaagagacgattttgatatacattattttaagtatatcgttatatcttctagagtatttaatgaattgtcaaatgggatactgtcgccaataggcggcagtatcattccacttccccatcaaatatatgcattaaaccgtgttttatcagatagtaaaataagatatttgcttgcagatgaagtggggttaggaaagacgatagaagcaggtctcataatcaaagagcttaaagcaagaggatttataaaaaggatattaattattagtccaaagggacttataaatcagtggcatgatgaaatgaaaaataaatttgatgaaaattttaatatactgctgccacaagattttgacgctattaaaaggctatacggcgatggcaatgtttggagaaaatttgatcaagtcattacatccattgattctgtaaagccattggaaaagagacaaaggtggacagaagaagatatagagaaatacaataaagaaagaattgaggatttagctaatgcaggttgggatataattattgcggatgaagcccacaggatagcaggatcatcgtctgatgtagctcgatataaattaggtaaagttttagccgatgcaagtccatatcttttactgcttactgctacgcctcaccaaggcaagacagattcttttttgaggttagtaagattgcttgataaaaatgcatttccagatgaaaatgctattgtaagggaacaagtggtaccttacatagtgagaactgaaaagagggaagcattagactctgaaggcaatccactttttaaaaacagaatcacaaaaactaaaaatatatcatggagtgcaaggcatagcttgcagaaagaactatatgaaaaagtgacagagtatgtatcaaagggatataatttggcaaggagagagaagaaaaactacataggttttctgatggttttaatgcagagattagttacaagcagcacacacgcaattaaagagaatttagagagaagaattgagattctaaaaaacagcggaacaagcagtaataattttgatgaagatgacttttatgaatatgacgcacaggaagctctagatgaacttataaaaattaaatatcaggacataaaaaaagagcagagagaagtagaggatttgttgcatttagcagagcgcgcagaaagccaatatgttgatgtaaaagcagaaacattattagaagatcttgatttattgcagatggagcatagtgaaaaacctaaagtcattatatttacagagtttattgcaacgcaggaattcttgcgaaattttctacaagaaaaaggatattctgttgctattttgaatggcacaatgtcgatggaagaaagaaacaatgcaatagacgaattcaagaaaagtgctgatatacttgtgtctacggatgcaggcggtgaaggccttaatcttcagttttgcaatataatgataaattatgatctgccttggaatccgatgaaaatcgaacagcgcattggaagaattgacaggatagggcaaaagagagatgtagtggtaataaattatgttttatctgatacgatagaattcagagtaagacaggttttggaagaaaagcttaagataatatttgaacaatttggcgtagacaaaatgcaggacatattggattctgtacagtcagagatggactttactgatttgtatatgaaaagcatagaaaacccagatgatattgattttatagtcagtgaagtcgaaattaagataaaagaaaatgctgaaaagataaacaatataaagggcattttaaaagacgaaaaagaattaaatatagaaatgattgaaaaaatcaataatacaccgataaagcattggttaaagcagatgtatattaataaaaagctttctgatggtgataaaatcaccatgtttatagatgatgattttttatcattaaacaataaagatttggaggatatggttaaaaatatacctcaatatatatatgatgggaaaatacctgttgtatcaattgatggtgttccaaatgaaaatggatactggtcactatgggaagtagggatcaatggatataataatagttttaaaaggatatttccgttatttataaataaaagtggcgtcctgcggattgcatcagcaaatatgctatgggacatattcttgaaagatgacgtttcaataatttttgagagatttgaagatctttcagaagaaaattataatatgatatttgaaaaggctaaaaatatagcttttgataaatttgaagaacttaaaaaatcatactttgaaaaatgtgaaaaagacttgaataggtataaatatgcattaaaattgagaagagaggcagcagaaagaattggtttagatgctgttaaaaggtataggcttaaggagatagaaaaagaagaaaatgaattaaatcaaaaaatgagagattatgaaaaaatattgccggttttgaatcctttatttattattgaattgttgtaa

SEQ ID NO: 3471 - DNA, 2682 bp, Thermoanaerobacterium thermosaccharolyticum
ttgtacagtgtaggtgagtgggttttcgattgtgagaaaggtagatacgtacaagtagtttcttcaaatgaactttggggttataaaacatataatgtttacgatactattgataaaagcgtctacttagtatctgaggatgtgcttagacatagttcacaaagaagcgattttgatatacattattttaagtatatcgttatatcttttagagtatttaatgagttgtcaaatgggatactgtcgccaataggcggcagtatcattccacttccgcatcaaatatatgcattaaaccgtgtattatcagatagtaaaataagatatttgctggcagatgaagtggggttaggaaagacgatagaagcgggtcttataatcaaagaacttaaagcaagaggatttataaaaaggatactaattattagtccaaagggacttataaatcagtggcatgatgaaatgaaaaataaatttgatgaaaattttaatatactgctgccacaagattttgacgctattaaaaggttatacggcgatggcaatgtttggagaaaatttgatcaagtcattacatctattgattctgtaaaaccattggaaaagagacaaaggtggacagaagaagatatagagaaatacaataaagaaagaatcgaggatttagctgctgcaggttgggatataattattgtggatgaagcccacaggatagcaggatcaacgtctgatgttgctcgatataaattaggcaaagttttagccgatgcaagtccatatcttttactgcttactgctacaccacaccaaggtaagacggattcttttttgaggttagtaagattgcttgataaaaaggcatttccagatgaaaatgctattgtaagggaacaagtggcaccttacatagtgagaactgaaaagagggaagcattagactctgaaggcaatccactttttaaaaacagaatcacgaagactaaaaatatatcatggagtgcaaggcatagcttgcagaaagagctatatgaaaaagtgacagagtatgtatcaaagggatataatttggcaaggagagagaagaaaaactacataggttttctgatggttttaatgcagagattagttacaagcagcacacacgcaattaaagagaatttagagagaagaattgagattctaaaaaacagcggaacaagcagtaataattttgatgaagatgacttttatgaatatgacgcacaggaagctctagatgaacttataaaaattaaatatcaggacataaaaaaagagcagagggaagtagaggatttgttgcatttagcagaacgtgcagaaagccaatatgttgatgtaaaagcagaaacactattagaagatcttgatttattgcagatggagcacagtgaaaaacctaaagtcattatatttacagagtttattgcaacgcaggaattcttgcgaaattttctacaagaaaaaggatattctgttgctattttgaatggcacaatgtcgatcgaagaaagaaacaatgcaatagacgaattcaagaaaagtgccgatatacttgtgtctacagatgcaggcggtgaaggtcttaatcttcagttttgcaatataatgataaattatgatctgccttggaatccgatgaaaatcgaacagcgcattggaagaattgacaggatagggcaaaagagagatgtagtggtaataaattatgttttatctgatacgatagaattcagagtaagacaggttttggaagaaaagcttaagataatatttgaacaatttggcgtagacaaaatgcaggacatattggattctgtacagtcagagatggactttactgatttgtatatgaaaagcatagaaaacccagatgatattgattttagagtcagtgaagtcgaaattaagataaaagaaaatgctgaaaagataaacaatataaagggcattttaaaagacgaaaaagaattaaatatagaaatgattgaaaaaatcaataatacaccgataaagcattggttaaagcagatgtatattaataaaaagctttctgatggtgataatattaccatgcttatagatgacgactttttatcattaaacaataaagatttggaggatatggttaaaaatatacctcaatatatatatgatgggaaaatacctgttgtatcaattgatggtgttccaaatgaaaatggatactggtcactatgggaagtagggatcaatggatataataacagttttaaaaggatatttccgttatttataaataaaagtggcgtcctgcggattgcatcagcaaatatgctatgggatatattcttgaaagatgatgtttcaataatttttgagagatttgaagatctttcagaagaaaattacaatatgatatttgaaaaggctaaaaatatagcttttgataaatttgaagaacttaaaaaatcatactttgaaaaatttgaaaaagacttgaataggtataaatatgcattaaaattgagaagagaggcagcagaaagaattggtttagatgctgttaaaaggtataggcttaaagagatagaaaaagaagaaaatgaattaaatcaaaaaatgagagattatgaaaaaatattgccggttttgaatcctttatttattattgaattgttgtaa

SEQ ID NO: 3472 - DNA, 2682 bp, Thermoanaerobacterium xylanolyticum
ttgtacagtataggccagtgggtttttgattgtgagaaaggtagatacgtacaaatagtttcttcaaatgaactatgggggtataaaacatattgtgtctatgatcctatcgataaaagtcttcgcttagtatctgatgaggtacttagacattactcacaaagagacgattttgatatacattattttaagtatatcattatatcttctagagtatttaatgaattgttaaatgggatactgtcgccaataggcggcagtatcattccacttcctcatcaaatatatgcattaaaccgtgttttatcagatagtaaagtaaggtatttacttgcagatgaagtgggattaggaaagacgatagaagcaggtcttataatcaaagaacttaaagcaagaggatttataaaaagaatactaattattagtccaaagggacttataaatcagtggcatgatgaaatgaaaaataaatttgatgaaaattttaatatactattgccacaagattttggcgctattaaaaggctatacggcgatggcaatgtttggaggagatttgatcaggttattacatcaattgattctgtaaagccattggaaaagagacaaaggtggacagaagaagatatagagaaatacaataaagaaagaattgaggatttaactaatgcaggttgggatataattattgtggatgaagcccacaggatagcaggatcaacgtctgatgtggctcgatataaattaggcaaagttttagccgatgcaagcccatatcttttattgcttactgcaacaccgcaccaaggaaagacagattcttttttgaggttaataagattgcttgataaaaaggcatttccagatgaaaatgctattgtaagggaacaagtggcaccttacatagtgagaactgaaaagagggaagcattagactctgaaggcaatccactttttaaaaacagaatcacgaagactaaaaatatatcatggagtgcaaggcatagcttgcagaaagaactatatgaaaaagtgacagagtatgtatcaaagggatataatttggcaaggagagagaagaaaaactacataggttttctgatggttttaatgcagagattagttacaagcagcacacacgcaattaaagagaatttagagagaagaattgagattctaaaaaacagcggaacaagcagtaataattttgatgaagatgacttttatgaatatgacgcacaggaagctctagatgaacttataaaaattaaatatcaagacataaaaaaagagcagagggaagtagaggatttgttgcatttagcagaacgtgcagaaagccaatatattgatgtaaaagcagaaacactattagaagatcttgatttattgcagatggagcacagtgaaaaacctaaagtcattatatttacagaatttattgcaacgcaggaattcttgcgaaaatttctacaagaaaaaggatattctgttgctattttgaatggtacaatgtcgatcgaagaaagaaacaatgcaatagacgaattcaagaaaagtgccgatatacttgtgtctacagatgcaggcggtgaaggtcttaatcttcagttttgcaatataatgataaattatgatctgccttggaatccgatgaaaatcgaacagcgcattggaagaattgacaggatagggcaaaagagagatgtagtggtaataaattatgttttatctgatacgatagaattcagagtaagacaggttttggaagaaaagcttaagataatatttgaacaatttggcgtagacaaaatgcaggacatattggattctgtacagtcagagatggactttactgatttgtatatgaaaagcatagaaaacccagatgatattgattttagagtcagtgaagtcgaaattaagataaaagaaaatgctgaaaagataaacaatataaagggcattttaaaagacgaaaaagaattaaatatagaaatgattgaaaaaatcaataatacaccgataaagcattggttaaagcagatgtatattaataaaaagctttctgatggtgataatattaccatgcttatagatgacgactttttatcattaaacaataaagatttggaggatatggttaaaaatatacctcaatatatatatgatgggaaaatacctgttgtatcaattgatggtgttccaaatgaaaatggatactggtcactatgggaagtagggatcaatggatataataacagttttaaaaggatatttccgttatttataaataaaagtggcgtcttgcggattgcatcagcaaatatgctatgggacatattcttgaaagatgatgtttcaataatttttgagagatttgaagatctttcagaagaaaattacaatatgatatttgaaaaggctaaaaatatagcttttgataaatttgaagaacttaaaaaatcatactttgaaaaatttgaaaaagacttgaataggtataaatatgcattaaaattaagaagagaggcagcagaaagaattggtttagatgctgttaaaaggtataggcttaaagagatagaaaaagaagaaaatgaattaaatcaaaaaatgagagattatgaaaaaatattgccggttttgaatcctttatttattattgaattgttgtaa

SEQ ID NO: 3473 - DNA, 2850 bp, Thermobifida fusca
atgagtcctgccgctgccgcggcttttgcacccggttctctcgtggcaggacgcggacgggaatgggtggtgctgccctctaccgaggaggactttgtgctggtccgtcccctcaacggggacgaggctttcaccacgctgctgtaccgagacgaggtgacgcccgcagagtttcccgccccgtccacggaactgtcccagatcggggaccatgtttccgcgtctctgctgcgcaccgcgatgcgggtggggtgcacgtcccccgcgcttccgctccggtgtttagggtcgatccgcgtgcagccgcgccgctaccagttcgtgccgctgctgttggcgttgcgcatggagacggttcggctgctcatcgcggacgatgtcgggaccgggaaaacggttgaggccgcgctgatcgctaaagaactagtggagcggggggaggcacggcgtatggcggtggtgtgtcccccggcgctggccgaacagtggcaggcagagttgcgggacaagttcggtatcgaagccgaactggttctcccctcgactgtgcgctgcctggaacgtccgctgcgcgccgaccaatcggtgttcaagacgtacccgtacacgatcgtctccaccgacttcatcacctctgagcagcgtcgcgcccagttcctcacccactgccctgacctggtgatcgtggacgaggcgcacacgtgggtgaatgcttcgcccacgaggctgcgccagcagcgtcaggaactgctacggaacgtggccgcacagcaggaccgccatctgatcctggttaccgccaccccgcacagcgggagggagaacgcgttccacgacctgctgggcatgctcaccccagaactcgccgaggcggattgtcgaagccggcgagggcgggcactcctggcccgtcattgtgtgcggcgtcaccgccgcgacatccagcggttcctcgaccaggagacagttttcccgcaaggacgcgagttccgggacgaaaagtacgagtggagcccggcctacgctgagttcaacgccgaagtgctggcgtatgcgcgggaagcggctgctgaccccagcggcaccaagctgcagcagcgggtgcgctggtggtcggcgttggcgctgctccggtcggtggtttcgtccccggcggccgcagccgcagcgctccgcacccggtcgacaacattctcggcggcgcgcagtgcggctgacgtcgacgcgctcgcccgcgagtcggtgtatgacgcagacagtgccgccacagagggcggggacgcggtccccggcgcggcagtcgaccccgacaccttgccggagagcacccggagacgcctgcgcgcgctagcggaacgggccgagaaactccagggcgtggagcacgacgctaagctgcgggcgctgatcgccacggtcaaaggtctgctcgccgacggctgcgacccggtcgtgttctgccggtacattcccaccgcccactatgtcgctgaagagttgcggcaggcgttgccgaagaactgcgcagtggaggcggtcaccagtgagcttcccccacgcgagcgggaggaccgtgtcgcacacctcgcggcaacggaccgccgacgcgtgctggtggccacggactgcctgtccgagggtgtcaacctgcacgagcttttccccgcggtcgtccactacgacatggcgtggaatccggtccggcacgagcagcgggaaggccgggtagaccggttcgggcagcgggcgaaacgggtgcgcgtcgtcacgctttacggggctgacaacggtatcgacggccctgtgcgggacgtgctgctccggaagcaccgcacaatcacggcgcaggcggggggtgcggtcccggtgccgacgtccagcgaatcggtgctgcaggcgctcgcggaaagcctcctgctgtgcggtccacacccccagctcggccgcacccccggtcttgctgaggccagcgctgtgctgcaccgcgaaagggaactggtgtcggagcctgcaccgcaccagggcgcaacgttcgcgccctccaccggggacgtcccggatgtggtggaacatctggagcgtctcatccccgccatcgacgacgaactgggccgtccccgcgatatcgcttcctttgtggcacgcgtgttcacgaggctgggagtgccagtccacgccgatgccgggaagctcaccgtgccccctcagtcgctgccgccgggggtgcgcgctgccctgggggtcgctgacaccgcccaccaggatctggtgttccggcgtgacctgcctgccgggccgcacgagcacgtgctggtgcgcactgatccagcggtgcgcgcgttagcccgctacgtggtggagaccgcgttcgaaccggatccgggaacgcgtcctgtcgtgcaacgctgcggggtgacgtggaccggccgcgtaactgtccgcaccgtgctgctgctggtgcgctaccggtttctgctcaccctgcctggggtggacgggccgcgcactgtggtggtggaggaggctcgtattcgcggctaccgggcgggggcccacggacgcgagtggcttaccgacgctgagactgcggcactcgtagacactccccctgacgctgatctgccaccggaactagtgcagtgccacgctcggcgcgccgttgcggagcttgacgaaatccgcggcgacctcgccgagtggggggtggtgcgcgccgaacagctccgccacgcccactacggcatccgcgcgtctgctgggtcccgtggccaaggactggcactcgtcccccatggccgtgccgacgtggttggcgtgtacgtctaccttccgctgggggacgccccgtga

SEQ ID NO: 3474 - DNA, 3174 bp, Geobacillus sp.
atgttaaaagttggagaaatcatcaaaggtccattttggccagagatcgttgagataaaaaactgtgagaaaattgatgaagatctttaccaagttgaagctatcggaaggaaaacaaataaatattatgatcgatatattgaaaaatatcaactggaacaattagaaacgattaaacaagaagattcgtttttccaaccggaacgtcttcaacattatttacaatattatattttaaaaactgaagaacgttattcgcaatcaagagctaggggaaacaaaaaaattattccgcttccccatcaaattgaagccgtatacagccgaatgttgcagtctccacaagtacgatatttacttgcagacgacccgggcgcaggaaaaacaattatgtccggaatgttaatccgagaattattagcaaggggcagagcggaaaggattttaattcttgtaccccctcttgtattaaaacaatggcaagaggaactaaaggaaaagtttggcgaagaatttatcatcgttaatcgaaactttttaaatagctcaaacgaaatcaatccttttgaaacctacgataaaatcattacttctttatattgggcggcaagggacgaaattaaatccctcatcttaaaaagtcggtttgatttagtgatcgtggatgaggcgcataaaatggcggcatatacaaggggaacaaaaaagcgaaaagttcagcgtacaaaaatatttcaattaggcgaggcgttacttagccatacggaacattgtttacttttaactgctacgccgcataaaggggataaagaaaactttcgccacttaatgagtttaattgaccatgatattttttcccatctaaacaacggagaatccatgtatgaaaaaagcaatccatttattattagaagattgaaagaatcgatggtcaattttgacggaacgccgttatttcctaaaagaacgacgaaaaccattacttttgacctgagtccggaagaaaaagaaatttatgataaagtgacggaatatgtccgttatcactttaaccgggccaaacaaaataacaatcagaatgttacgtttgccatgatgattttgcagcgtcggttaagttcttctttcgatgctatttatctgtcattagtaagaagaaaagagaaattagaagaacttttatacaatgaacaaaaaaatcaacaagttgaagttcatgattttgacgaattggctgcagaagatcaggaagaagtggaggcacaattagaaggtgaaacggaagctattgatttgcacgaattacaattagaaattgatcaattaacgaatttaatcgacaaaatcaatattcttcgccaaagggatgttgaaagaaaatatattgaacttgaaaaaacgttatttggtacaaatggattagtagctcaaggtgaaaagttgttaatttttactgagtcaaaagatactttgtattacttggagaggaagctgttggctcacgttccggaagtggcgaaaattgtcggtggtttttcaatggaccaaaggcgtgcagaggttgagaaattccgtaatcatgtacaaatcatgttggcaacggatgcaggcggcgaatccattaacctccagttttgtaatcaaatgatcaattacgatattccttggaacccgaaccggctagaacaaaggatggggcgtatccatcgaatcggtcaaaaaaatgaagtatttgtctttaatttggtggccggaaatacaagggaaggcgatgtgttaattcggttattggaaaaaatggaacaaatgcgtacagatttaggtcaagaacaagtttatgattttatcggtgacgtgttaaaagaacaaggagtagatttggccacacttatggaagaatcgattagcggacgagaaaacttagatgaattgattgcaaaaatggaaaaaactttgtcagatgagcataagcgtttaattgaattggccaatcgagaaagaatggacgaacaaagttttgatttaccgggaatgagaaaaacattccaagaacttttaattaatagtttgccaaaaagagtttacggtgagtttgtcattaatcaatttcaaaatacgagaatccgcatgaatatatccagtgatcaatccgtctgccgaatcaatcactttccgaaaaatatacgtgaattagcaaaaaaacaacggattttattaaaaacggagcaatctgtccgatttgcattaaaaccggaagttgaaacagaagatattcaactattacaaaatgatcatccgttatataaattagctttggaacttgggggtacagaaacgcaacaagtcaccataccggtggcaaaagtcaaagcaaacgttccggaacgaattcaaatagaattggacaaagttaatgttgtggatggaacaggaagagaattggaacagtcactgattcttttaggtaaacgggaatcaggagaatggattgaaatagacccttatcttttatttaatgggagatttgaatatataagtacaatgggcatagaagatccttcgtttaaacgtgaagcaatattacatgcaagaaaaatcctccagagtgtacagttaaagcgtgatgaatatttaaacaaaaaaagtatttatttgcgaaaatcttttgaccaacagatgagaacattgcaagagcgactcatgcaatttcaacaaactaattttgataataaaaacagtgcattaataaaccagacttattcccaaattgatgatttagaagaaagaagtagagaacggttggaagaaatcgaacgtgaacgaagtattcaattgcaaccgattaaaaaaattgcacaacttatcttagaaccggcaaagagtgattgtagcagaatcatcccggatgacgtttttgaaaatgtaaaactatatgaatacgcaaacggaagattaaatgtacgaaaaagaaaagcatttggactcgttgattttacgagtgaaacctccaacgaggaaaaacgatatatcattgtcacaaagtcccttaatcatttacttgaaacaatcagatatgaagattatgcgggagtggaagaattggtatttatctatgtcttggatcagcagcaaagaattgttcaagaattcaatttaatagagttgaaaagatga

SEQ ID NO: 3475 - DNA, 2829 bp, Marinobacter sp.
gtgagtaaagccaagaggcgtctgttaccggtcaaaaactgctgggttaaaaaagtgtcttctgcggaagagagtattttgggccgcgtcgttagctcagtggacaggggtgatgacgtcattgtcagcgtaaaatggcagaagaccgggcaagtttccgcggaatctctgagtaagctacgaagcggattcaagctgcagatggaggttcaggatctcccaaattcgcgagtcagaacgtcgcttggtgaaggtgttattcaacgagtgcgaaccattggtgactgtgaccaggcactggtcgacttctaccagctgggccagcaggtttggttaccctatgaaaatctgcgccagataaagggggcgaggcaccgctttattttgggtgatacaggccccgatgacagcgcagagcgctttcgacttaagtctttggcccacgccttggagatctggaacgagaacacaggctcgctctcccatttagagatagatccactcccacatcagatacatctggtacaccacatactcgcatctggccatttaaattggctgatcgccgacgatgttggtctcggtaaaacaatcgaaaccggtatgcttctggctgctctgaaacaacgaggccaactgaaacgagttctgttagtcacgccagcaggtctgacaaaacagtggcaggaagaactgaattacaaattcaagatgggcgagttccagattttcggtgaggattttacaatcaatgagcctcgccattggaagatgtttgattttgtcattgcctcaatcgatcgattgaagattccggaaaatttagaacgaattcagcaggctggcaaatgggacataattgtttttgacgaggcccaccggttgagtcgccggcagtacggaatgaagctggaggcgtctcaacgatttcagttggccgcaaatttgcgaggccatacggacgccttgatcttgttgagtgcgactcctcatcaaggtatgcaagataaatttcaggcactgttggaactgctgcacccggaacgcaaagaggatatcgccacgctcgcgttgaatccggaaatcatcggcgaaatggtttttcggaataacaaagcggatgtgacggatgcagaaggcaattttctgttcagagggaaaacaaccagctctgttccagtgcatgtgtccgaagcggcaaaggagtttgaccggaagcttcaggactacctgcgcaaaggctatgcagcaggcgcagcccttggagtcagggggaacgccattggctttgtaatgactgtgtaccgcaagctggcggcttcgagtgtagcggccattcatcaagcgttgatcaatcgaaaagccagacttgaaggcgaactggttaaagggttcaaattggaagaacttgagtcacaggaccagcgctttttcggcgaatgggaagagcagcttcactccgatgcacgggagttctttgaaggtgagctggagcatctcgatgagctgatttccgaggcgggggcactgcgtgatgacgacaggaaattgcagggcttcgccgaccagctgatcgccaagattcttacgcccaattctaaagaaaaagttctgatctttactgaatatcgtgcgactcaggcctatattcgcgagattttggaaaaacggttcggcgagggctcagtagagttgattaacggctcaatgcctcacgctcagcgcagggatgccattgcgcggttcgaagaaggcgcaaacttcttagtttccacggaagctggcggtgaaggtatcaatcttcagcggaagtgtcacatcatggtgaattacgacttgccctggaaccccatgcggctggtacaaagaatcggccgattgtatcgatatgggcagaaaaagcgtgtcgttgtgtttaatctccattctccagacacggctgatgagcaggtaatggaactgatgtacacccgaattgaacgagtcgttgacgacctggcaggggtgagtgacgaatacaacgaacagctgcgtgacgatattttgggtgagctggcggatttgctcgatgtaaaccagattctggaacaagcgactatggagggaattacgcgaactcaggagcgcatatcagatgccctggatcgcgcaaaatccgcaacagagaagcagcgagagcttttcgagcatgcggcaggttttaatcccaatgagactgacagcagcctgcgcattgatcatgagcacggtgtggcgtttgttctggggatgttccagatgctggatattgagattgttgaaaccacccacgaaggaagactctttcatatccggctatcagaatctgcacagcaggagctgggaattagtcgcagtcgttacgaggtcaccctcgaccgggagttggttgtaaatcgaccgaacactcacatgctggatttagactcgtttctaatgcaatttctactcaaaaaagcgaaaagctacgattttatgggtttgagtgccgtgataaagaatcaatcccttgggcaaggagctctgctgaccagcctccttcgctggcaaaacgatcagggcaaccgaatgaggcaggaatatacggcctatcttgtaaagcccaatggtgaagtacaaacaaaccctgaagccttcgggagttggttgaaaacgaaaggttttacgggaacgctgaattctgtttccagcgagaatcaggtgatgttcaagcaagcggaactcgcagcggataacaggctgaaagaggtgagtaatctgaatttgcatccagaaaataatcagtgggtttcaggtgcctggttagggtga

SEQ ID NO: 3476 - DNA, 2910 bp, Natronorubrum tibetense
atgactagggacttcgaatccggtgaccgcatcagactcaacggtgacccagcagaagtcatccgtacctacgaagtcgggaatcttccctaccttcgtgtctacgttgagggtggcggtgcgaaaacggtctgtctcgaccacgtctccaccgaaccacgcagtgatgcactcgataccctcgacgatcaggtgacagacctccacccccgacacgaagcagtctcgtcggagtggtttgacctccgaaccgaggcgctccagctcaaaatggcccacgagcaggggcagctcctgagcatctcgaactcgctcgtccgcctcgaaccataccagctcgcctgcgtgaatcaggtgatgcagaagctccgccagcgagcactcatcgccgacgacgtcggtctcgggaagaccatcgaggcaggcctcatcctcaaagaactcgaagcccgcaatcgagctaacagcgtcctcttcctcgttcccgcacacctccagaaaaagtggattcgggatatggagcgcttcttcgacatcgacctcacggttgcggaccgccagtgggtcgacgccgagcgtcgacgactcggcgaggaggcgaacatctgggaccaggagggccagcgtctagtcaccagcatggcgttcctccgtcaagacgagttccagtccgagatcgagaacgccttctgggacgtcgccgtcatcgacgaagcgcacaaggccagcaagcggggcgagtctcccagcaagacctcgcttatggccgagcgcgtcgccaatcactgtgaatccctactgttgctaagtgcgacaccgcacgacggtaagggagaggcgttccgatcccttatcagctacatcgatccattcctcgtcgccgaggaccaggacctcactcgggagacggtgaaccgcgtcatgatccggcgcggaaaggagaccatctacgacgataacggggagcgcatcttccccgaacgagatgtccaaacggccaccgtctcgatgtctcctgcagaggagcaactgtacgagcgcgtaactgagtacgtccgtgaggtctacaacagatctgatcaactgaacgagcccgccgtcggattcgcgatggcgctcatgcaaaagcggcttgtaagcagcgtaggcgcgattcgagagacactccgacgacgccttcacgggctgcttgaacccgacgagcggggcctctcgaccgatgcgacggcctacctcgaaggcgaggatttggaggactctgaccgtgaacaggcggagcaggaactcgaacgtctcacggtcgcccagggtgatgaggcgctccagaaggagatcgacacgctgcaggaactcgtcgccatggctgaggacctcccagtcgacaccaaagcccggaaggtcaaacgctacatcgaacagctcttcgaggagcatccggacgagaagctcattctgttcactgagtaccgcgatacgttagactatctcctcgatctcttcgccgacgaaccgtgggcagacgagattctgaccatccacggagatgtgagcaaagacgagcgaacccgcattgaggacgaattcaactacgggaagtcgcgactactgatggcgaccgatgcggccagcgaggggatcgacctccagcacagctgccacatcatgatcaactacgaactcccgtggaatccgaaccgcctcgaacagcggattggtcgaatccatcgctacggccaggacaaggaggtaaaggtgtggaacttccagttcgatggcactcgggaatccgagattttcgagctcctccaagacaaggtcgaggagattagatcgaaagttggtgcgacggcagatgtcctcgggatgctggacgacgtcaatatcgactctctcttgatgaaatccgtccagaaccaggaaccagcctcagccaccaaagaggaactcgaggagctgatggaagagcgtgaacagacgctccttgagtggtacgaacgaagtctcatcgattgcagtacgttcgacgctgagagtcgacaggagattcagtcgatcgtcgacgactcggaggacgtcttcggaagtgaacaggagatccgggagttcttcacccgagcgatcgaggcgttcgaggggtcagtcgagaaacgtggaaaccagttgtacgaggcagaagtcccaccagaagtaactgacagcggtcagcctgagacgatgggcccattcaccttcagtcgagatttcgccatcgatcacgacggaatcgagtacctctccccggatgcggacgttctgcaggccctccgtgatttggttctccagcacgggcaacacgcagggaaggccggaatgaagctgctgccgtttgtggaccagcccggcatcacattcgtctacaaagtcgccttcgaagatgcaaccggcaagacgattcgtgagcaactcattcccgtctacgtcgacctcgctggactcgacgcccagcgttcactcggtgagcgagtcctcgatgcagatacgattcacgctcgtccggatgagagtacggtctctcggctactcaagcaacgaggtgacctcgaggacgccgccgagaggtacatcagtagtatggtcgccgacatccgcgaagatctgctcgaaacccgtcagcaggacgttcagaaagaactctctgacttggaagcctatgagcaagcagaacgagatcggatacagtcgttcatcgattcgtacgaacaaaaagccacaacagggtcggatatgcgcatcgcgattcggaaccagaaacaacgtcttgagcagttagaaacccggatcgagtcccgaaaggcagagctacggaagcgagagcaggtcatctcccttgcgccagatattgaggcgtactgtctgactcttcccgtatag

SEQ ID NO: 3477 - DNA, 2916 bp, Haloarcula argentinensis
atgacggagtcttcattctcgcccgggcaacgaatccttctcaacggaacgccggctgaagtcatcaaaacacagacggtcggcgagatcgaatatttgagagcgtatatcgacggcgaaggtgtcaagactgtctgtctcgacgatgtagggattcagccacagcagtccgacatcgaggagttggccaaccagcgaatcgacgaccttcacccggatcacgatgcggtcgcagcgcagtggttcgacctccggacgcaggcgacgaaactcaaactcgcccacgagcagggacagctcttgagcatctcgaactcgctcgttcggctggagccgtatcagcttgacgcggtaaactgggtgatgcagaagctccggcagcgggcgcttatcggtgacgacgtcgggcttgggaaaacgatagaggcgggactcgtcctcaaggaactcgctgcacggaatcgcgccgaccgcgtcctgttcgtcgttcccgcccacctccagaagaaatggatccgtgatatggaccgcttcttcgatatcgacctgaccgtggcagaccgcgcgtgggtggacggtgagcgccgtcggctcggcgaggaggctaacatctgggcccaagagcagcagcggctcgtcaccagcatggcgttcctgcgacaggacgagtttcggcctgcactccgggacgcgttctgggacgtcgtcgtggtcgacgaggctcacaaggctgcaaagcgggggaaatcaccgagcaagacggcacggatgattgataccgtcacggggaactccgactcgctgctgcttctcagtgcgacgccacacgacgggaagggcgaggcattccgctcgctcgtggagtacatcgacccgttcctcgtcgccgaaaaccaggaactctcacaggagacagtcgaccgcgtaatgatccgtcgcgggaagaccgacatctacgacgaggacggtgaacgcgtcttcccagaccgggaggtcaactcggtctcggtttcgatgacgcacgacgagcggcagttctaccgggcggtcaccgactacgtcaaaaacgtctacaaccgctcggagaagctgaacgaacccgcagtcgggttcgcgatggcgctcatgcagaaacggctggtgagtagcgtcggcgcgattcacgcaacgctccgtcgacgactggacgacctcctcgacgaggaggcggaaacggacggtctgtccgaggaagcacgagcctacctcgatggcgaggatctagacgaggacgacaagcaacacgcggaagacgagatcgccggtctgaccgtcaccagcaccgacgaacagctccaaacggagatcgatacactccgcgacctcgtctcgctggcggaggatttaccgatcgactccaaggcccagaaagtcagacggttcatctcacagctcctcgaggagcaaccagacgaaaaactcctgttgttcacggaataccgcgatacgctggactaccttctcgaattcgtgcaagacgagccgtgggccgacgagattctcgtgattcacggcgacgttgacaaggacgaacggacccggatcgaagacgagttcaatcacggccagtcacgactcctgttcgcgaccgatgcagcgagtgagggaatcgatctccagcacagctgtcacatcatggctaactacgagcttccgtggaacccgaaccggcttgagcagcggatcggacgcatccatcgctatggacaagaagaggaggtcaaggtctggaacttcctcttcgacgacacccgggagagcgagatcttcgaaatgctccaaaccaaggtcgaggagatccggtcccagctcggaaacacagcggacgtgcttggcatcctcgacgacatcgacgtggactcgctcatcatggagtccattgagaacgacgaaccgccgagtgcgaccaaagaggaacttgaggagatgatcgaggagcgtcagcgaacgctcgaggagtggtacgagcggagcctcgtcgatacgagcacgttcgacgcggagagccgccgacagattcaggaggtcgtcgacgagtcggaaaacgtctacggaagcgagggtgacatccgcgagttcttcgagcgagcagtcgaagccttcggcggcgaattcgaaaagcgcggtaccaatctctatcaagccgaactaccggacgggatcaattcgcccggccaagacgcgacgttcggcccgttcacgttcgaccgcgacttcgcgatggatcacgagaacatcacctacctcgctcctgatacggacgtcctgcagcggctcatggcacgcgtgttggaagacgagcgcggagaggttggactcaaactccttccattcgtcgacacgccggggatcacctacaactatcgcgtggcgttcgaggacggcaccggcgacgtgattcgcgaggagaccaaccccgtcttcgtcgatgctgcgcaagaggacgcccaacaggccctcggagaacgtgtggtcgagggcaactcggtggcagcaaaacccgacgccgacgaccttcggacggttctcgacgctcagtccgacttacggacggccgccgatcgctatgtgagcgtgcgggtcaacgagatcaagaaccatcttcaggagaagcgttacggggagaccgctcgggagctggagaatctcgaggagtacgcacaggcggaacgagaacggatcgagtccttcatcgaggagtacgagcgcaaagccgacgccggctcggacatggatatcgcaatccgtggccaacaggagcgtctcgaacagctcgaagaacgaatcgagacacgtcgtgaagaactccgacgtcgagagcagatcatctcccttgcgcccgaggttgagaactactgcttgacgcttccactctga

SEQ ID NO: 3478 - DNA, 2910 bp, Halosimplex carlsbadense
atgaatgacctcgtacctggagaggcgattctactcaacgatcagcccgcagaggtcatcaagacgtattccgtcggcgacctcgattatctcagggcctacgtcgagaacgtcggtgtgaaaaccgtctgtatcgacgacgtgaacatcgaaccgaaacgtgaacaactcggcacactcgacaccgcaaccgccgggcaactccatcctgaccatgaggcggtttcggccgagtggttcgatttacggtcacaggcgctccagcttcagatcgcccacgaacagggtcagctactcagtatctcgaactcgctcgttcgtctcgagccctaccaactggcctgcgtcaactgggtcatgcagaagctccgccagagagcgctcatcgcagacgacgtcgggctggggaagaccatcgaagcggggctgatcctcaaagaactcaccgcacgcaatcgtgcagatcgggtgctgttcgtcgtcccagcacatctccagaagaagtggattcgagatatggaccgattcttcgatatctcactgacgcctggggaccgccagtgggtcgagggcgaacgtcgtcggctcggtgaggaagctaacatctggaatcaggaccaccagcagatggtcgcgagcatggcgttcctgcgccaggaagagttccgggacgaactcgacaacgcgttctgggacgttgtcatcgtcgacgaagcgcacaaggcggccaaacgaggcgagtcccccagcaagacctcgaagatggtggaacgagtcgcggacaactccgactcattgctcctcctcagtgcgacaccacacgacggcaaaggagatgcgttccgctctctcatcgaatatatcgatccgttcctcgttgcggaggaccaggacctctccaaagaggcagtcgaccgcgtgatgatgcgtcgcggcaagcagactatctacgacgacgacggggaacggcttttcccgaatcgagaagtcgggacgatcccggtcgagcggacgcacgaagaaaagcagttctaccaagcagtcacagaatacgttaagcacgtctacaatcgctcagagcagctcaacgaacccgcagtcgggttcgcaatggcgttgatgcaaaagcgcctcgtgagttctattggagctatccaagccaccctgagccgccggctagcgaatctggtcgatcaacaatccactgcaacctcactttccgaagaggcgtccgcatacctcgaaggtgaagacctcgaggaggctgataaacaaaaggccgaagaagaacttgcaggcctcaccatcaccgagagcgacgcccagctcgaagaagagatcgaaacgctacgtgacctcgtctctctcgccgaaggaatctcggtcgattcgaaagcccagaaagttcgtcggtacatccagcaactgctcgaggagaacccgaacgagaaggtgttgctgttcacggagtaccgggatacgctcgattacatcctcgatctcgtgaaggacgagccgtgggcagatgaaatcctcgtgattcatggcgacgtcgacaaagaggaccgagcgaatatcgaagacgagttcaatcacggccagtctcgtctgcttttcgcaacggacgcagcgagcgaagggatcgacctgcagcacagctgccacatcatggtcaactacgagctgccgtggaatcccaaccgactcgaacagcggatcggtcgcctccatcgctacgggcaggagaaggaagtgaaggtgtggaatttcacgttcgaagacactcgcgaaggcgagatcttcgagatgctgcaggagaaagtcgagaacatcagggggaaactcgggaacaccgccgacgtcctcgggatgctcgacgacgtcgacgtggactcgctcattatggaatctatccggaacgacgaaccgacgagtgcgacgaaagaggaactcgaggaactcatcgacgaacgacaacggacgctcgcagagtggtacgagtgcagtctcatcgacaccagcaccttcgaccaggagagccgagagaggatccaggaagtcatggatcagtccgaagacgtctacggtagcgaggccgacattcgagaattcttcgagcgcggcatttctgcactgggcggcgaggtcgaaaaagctgggaccaatctattccgagccgatctaccggagaatcttcgtcgaaccaccgatggcgacctctacgggccgttcacattcaaccgcgagttcgcgatggatcacgatgacatcgactacgtctctccagacgcgcggctggttcaagagttgatgcagcgtgtcctcgacagcgaacagggttctgtgggtctcaaaatgctcccgttcgtcgatgatccagggattacctacaattaccgagtccgatttgaggacggtaccggcgaagtgatccgtgaagagatactcccggtcttcgtcgatgcagcacacaacgatccacaagagcgtcttggacagcgagtcgttgacggggacagtatcaaaggcagccctgatggggagcctgtccaagtgctactggaaaacgagagtgagatgcgttcatccgctgatcgttatattagccagcgtgtcgaatctcgtcgagacgaactacaaaaatggcgacgagaggaaacgcagcaagaactcgatgacctcgaagcgtacgcagagtctgaacgagaacgaatcgagacgttcatcgcggactacgagcggaaagccgaatcagggactgacatggacatcgcgattagaagacagcgggatcggctttcgaagctcgaggatagaatcgagaaacgccgccaggagcttcagcgaaaatctcaggtcatctcacttgccccagaaatcgagaacctgtgcctgaccctccccatctaa

SEQ ID NO: 3479 - DNA, 2793 bp, Planctomycete KSU-1
gtgggaaccggtgaatgggtttatagcattgaatatcggcaaacatgtcagattatcgatgttcaatcattatgggatgaggttatatatcgtgtttggcttcctattcaggataccatagttcgcattccggcaagcagactaaagcctcttgacgaagcagtatcaaatactcctgcgcaccttacctacactgcaactgccgcacgcctggctgacgccctaacgcatgatatattacttgcgcccattgaatccagggttattccccttcctcaccagatgagggcattgtcacaagctataaatagtcatcgtgtacggtatctccttgcagatgaggttggactgggtaagactattgaagctggactcattatgcgtgagcttaaacttcggggacgcgtaaaaagaacccttgtaatagctccaaaagggttattgactcagtgggtcgctgagatgcaggtacatttcaatgaggattttaaacttctgatacccggcgatttttctgcttacaggaagatcatggctgagagtaatatctggcagtcttacgatcaggttgtctgccctatggattcaataaagccgctggaagggaggcgtggatggtcaaaagagcaagtggcggcatataatcaggaacgatttgaggatatcatagctgctggatgggatttggttattgtggatgaggcacaccgtctgagtggaagttcagaggaagttgcccgttacaaacttggacagggactggcagatgcgtctccttatctccttcttctgtcggcaacgccacatcaaggcaagaccgatgcattttatcgattgatatcattgctcgatacattgaactttccgggtatcgaaagtattacaaaagaacgggtgaagccttacgttatcaggacagagaaacgtagtgcaatagatgcaaatggaaaaccattatttaaaccaaggcaaacaagactgatcccaatatcatgggaacaacggcataaagaacaacaactcctctacgaggctgtgacagagtacgctcgtaagggttacaatcaggctataattgagaaaaagaattacatagggtttttgatgatccttatgcagcgtctgattacatcatcaaccagggcgatccgcactacgttggaaagacggttggaaatacttcaaggatctgatgaacagcttacattacccctaacactttccgaggatgaatggttagaacttgatggtcaggagcaaataaatgcattcttagctacgcgtctcgtggccctgaagaacgaaagagaagaggtaagattacttcttaatgcagcaaaaagaacagaatcgtccgggccagatccaaaggctgaggcactccttgattggatatataaaatccagcaggaggaaggaaaccctgaattaaaattcctggtctttacagaattcgttcctactcaggaaatgttaagagagttttttaaagaacgaggattttctgttgtctgtttgaatggttccatgggtatggatgaaagaaaagtagcacaggataacttttcccaaaaagcccgtatccttatctcaacggatgccggtggcgaagggctcaaccttcagttctgtcatgtagttattaattacgatatcccgtggaatcccatgcggcttgaacagcgaataggacgtgttgaccgcataggtcagacacatcctgttaaagccataaactttgttttaaaaggaacagttgaacacagggtgcaggaggtattggaggaaaaacttgctatcatacttaaggaatttggagttgataaggccggggatgtattggactcattacaggctgaacaaatatttgatgatttgtatattaatgccatcatacaccctgaaactttcgatgataagattgaattagtggtaaccaacgtaaaggagcaggtaaagtcagttcgtgaaagcacgtctattttgggctctcaagaagaacttaatcctttagaggccaggaggttgtcagaacatcctcttcctcattggatagaaactatgacaattaactatctgaaatctcacggaggtgtggcagaaagaaaagggaagacatggaatctgacatggccatcaggtgaaaaaatgaataatatcgtatttaccttagataatgcagaaggatttccatcagcacgacagttaacgttggaagacagctgtatcagaggtgtttctatgaatattccaccttttgtttctcctcaaccaattccctgtcttattttttcggatatttcaacagaaattcaaggtttctggtcgctatggaaggttgcaattcagacttcaaactggaataggcaacggataatgccgttgtttctgcatgatgatgggaggattctttatcctacggcaagatacatttgggataaaatgatttctaacgtttacaacgtacggcattatttagatggtcaggaatcacaggatatttttaataaattatggaagactgctgaaaaacagggcaggtctcagtatgagcagcttgttcaggaacataaagaatttcttacccaggagattaataaatgggagtatgcacttactgtacgcaggaaaactatcgaacggttgggattaccacaggtcagggcttatcgtcttttacatttggaacaagaagatcgggaacgacgtgaggagattaatcagaaatcaaagattagtcctgaattagtaccgctactgctgattcgtgtaggggaaaaaatagatggatag

SEQ ID NO: 3480 - DNA, 3192 bp, Bacillus cereus
atgatgaaagtaggtgaaattgtctcgagttcacggtttcctgaaagtgtagaaataaaaagatgtgaagcttttggagaatacttcattattgaggcaattggtcaagaaacaaacaagtattacgaaattatgctagaacaagaaaaaatccatgattttaaacatttaaaacaagaaaaagaagttgcaaacttaaaagcgttagatgttcaaaggtacatacaatatttattgttaaaaaatgaagtgaaattctctaaaacaagagcattagggaataagaatttattaccattaccacaccaaattgaagcagtgtatgggaaaatgcttcaagtgccacacgttcgttttttattagctgatgatccaggtgctggaaaaacgatcatgtctggaatgctcattaaggaattaaaagcaaggttgagtgttgagcgaattttagttttagttcccccacttgtattgaagcaatggcaagaagagctggaacagaaatttgatgagcattttcatattattaatcgagtggtactgaaggagtacggtggtaaaaatccgtttatatccaatagattgtgtttaacttctatgtactgggctatgagggatgatgtaaaggcattaattcaagaagcacagtttgatttggtaattgttgatgaagcgcataagatggcggcgtatacacatgggacggttaaaaagaaaacatttcgaacaaagttatatcagttaggggaatcgctcctaagaaaaacaaatcactgtttattactaactgcaacaccgcataaaggtgattctgaaaactttagacacctaatgaagttaatcgatgaagatattttttccagcagtaagacaactgaaagtttaaaagaaaaaacgaatccgtttattattcgtcgtttaaaagaaaacttaaagaattttgatggcactccattatttccaaaaagaactacgaaaacaattcaatttaatttaacagatgaagaattagcattatatgatgcggtaactgaatacgttcgtgagtattttaatcgcgcaatgaataatggaagcaacagtacagcatttgcgatgatgttattgcaacgtcgattaagttcttccactgatgcgatttatttgtctttaaaaagaagatatagtcgactaattaagttgtataaacaaacagaagctgagcgcaataagtacataaagaaaatgaaaaaccttgaaacagaaaactacttagaagaaggtagcgatattcaagaaaaactagaaaaacaattagaaaaatcaattgatgtaattgatacgaaagaattgaaaaaagaattaatcgtattaaaagagctaattcagcaggctgaaaatattaaactgtatgttgtggagaaaaaatatcaagagttagaagaaacgttatttggagcgagtgggcttttaaatcatgatgaaaaaattttaatttttacagaatctgtagatactttgagttatttagaagaaaaacttttgaaacgggtaccgaaaatagccaaaattattggaagcttatctatggagcaacgccggaaacaagttgaaatgttccgtaatgaatgccaaattatgatagctacagatgctggtggggagtctattaaccttcaattttgtaatcagatgataaattatgatattccatggaatccgaataaactagagcaacgtatgggacgtattcatcgtattggacaaaaaaatgaagtgtttgtttttaatttagtagcccaaaatacgcgtgaaggtagtgtgatgactaagttactagataaaatggagttgatgaaatcagatttaggatctgatctcgtatatgattttatgggggatattctggaagatcattatgatagtttagcagatttaatgcaacaagctgttataaaacgtgaaaacctggatgaagtcattgcaggtatggaaaaaactttatctgaagagcatcagaagttgttagccttaatgaaagaagagcgaatgactgaagataacgtcgatcttacaaatttaaaacgtgagaaaaatgatttaactgtacaattgataccaaagcgtacatttacagatttagcaacatatgtcttagaaaaaaaacgtgtgcgtattttcaaatctcaagatgggaaagttatgcgtattgagcgtttgccaaagtttatacgagattacattccagagttacaagattatcaaggagatagctatcgctttacaaattcaatagaatttgaagaagctgaattaccaatgataactgaaaatcatccgttatttaatgcaactttggaattgatgaaaaaagaagtggaaggccgaacatggcattgttatactgtgacagctcatgttcccgaaaatctatatgtggaaatttatcatgtaagtattgtggatggtacaggggaagaattagaaaatcactatattcatcttgcaagacgagaaagcggagaatttattacattagatcaaggctggattttcgctaatgattttatcaataatggattttatacagaaacagataccactagtcaatgtatgagtgaagtaatgaagcaatctatcatagtcagagataacattttaacaaagagggaaaaacagttaaataaactagtaacatttctggagaagacatttaatcaacaatatcgcgaaacattagaaagactagagacatatcaacaggaaaaccttgataatcgaaatagtgccctaataaatcaaatgaatgcgcaactcattgatttggatatcaaaaaagaagaacggttaaatgtaatttatcgtcaaaaaaatatttctatgaagccaccaaagagaattatatcaatgaaactaatgccaaatggtgtatgtgatagagtaataacaaaagattattatgaagctgtaatgagctatgaaagagaaaatggtcgtttgaatataaaaatgtttaataatctaggtttggtagattattatagtgaaaggtttaatggggaagaacgttatattatattaacggagaatgaggagtttattcctagtgatttttataaggaggatttaactggaattttagataaactgtacatttatgtaatacataataaaaaagttattagtgaaaaaaagatggagaatgttaaatag

SEQ ID NO: 3481 - DNA, 2670 bp, Clostridium thermocellum
atgcttcaaattggtgactatgtttttgacaaaacaaaaaatgaacgtgtgcagatattggaaatcagcgaagtatggggctttgtatcatataaagtatttaatacctctaccggaaaggtttataagttatctgctgacgatatttgtgccgaaatacctgaaaaacattataatgagagctatcttcggtatgttgccttgctttcaaaaatcaaaaataagatttcccaaggcatcttatcaaaactatcgtgtggcatcattccattgccgcatcagcttcatgttttgaatagagctttgtcaaacaataatgtgagatacatattggctgatgaagtaggacttggaaagaccattgaagccgggctcattattaaggaattaaaggccagaggacttatcaggcggatattaattgtttgtcccactggtctagtaacgcaatgggatatggaaatgaaggagaagtttaacgaaaagttccatgttatattgccggaaaattatgacgctattcgtcaaataacaggaaatgaggatgtttacgggcagtttgatcaggttatatcacccatggattctatcaagccgttggaaagacgggcaggctggacggaagaaaagattgctaaatacaatgaggaacggatttattccattattaacagcggatgggatttgattgcgattgacgaagctcacagggttgccggcagttcaggagaagtagcacgatacaaacttggtaaattactggcagctgctagtccgtacctgttattacttactgctacgcctcataatggaaaaaccgagccatttttgcgattaatacgaatgattgatgaaaaggcttttcccaatgccgatgctgttgtaaaagagcaagtagctccttatgttataagaacagaaaaacgtgaagcaatagatcataatggcaacaaactttttaaaaaccgaattataaaagttattgaaatgcactgggatgaacggcattccatgcaacgcaagttgtatgaaatggtatcagattatgttgctaaaaattacaacaaagccatgcgaaaccgtggaaaaaatatgtggtttgtattcctgcttattatgatgcagcgtatggttacaagcagtacaagtgctgtcagggaaagtatggaacgtcgtgtgagagttttggaagaacaagcatttaaatatcagtcaatgtctgaagaggaatttgcggaaatggaattggaggaaaacatggaagaagcaattgctgccatttctttaggcatcgaagaagaaataactcagcttaacgatattattgcagttgccaagcaggcggaatttcaatatcttgatgtcaaagttgagcctctttttgaaattattgatgatttatttgctgaggaccggcaaagaaaaatcattatttttacggaatttgtagcgactcaaagctatcttgtaaaactgttaaaagaccggggatattcaacgtccatactaaatggcagtatgagtatagaggaacgaaatgcagtgttgcatgagtttaaaacacaaacagatattcttatctccaccgacgctggtggtgaaggtttgaacttgcaattttccaactgcattattaattatgacttgccttggaatccgatgaaaatagagcagcgtattggacgcgttgaccgtatcggacagcaaagagatgtagtggtttataattttatattggcagatactgttgaaaaccgtgtaaaaaccgttttagaagaaaagctatccgtaatactgagagagatcggaattgacaagtattcagacatattggacagcgaaactgctgagcttaactttacggatgcttatatgcaatccattcgtaatcctaacgatattgaatttaatattcgacggattgaggaggatttaaaaacgcaggttaaaaacacgatgcaaataagagagcttataaaagaagaaaaagatcttacttcaatgataggagcaggctctacttttgactttgaacatgcattacgtcagatggttacttattatgaaaattataagggcaatccatttttacccattgagaatttcagcattaatgatcctattatttttgaacatttaaataaagaaatcgaacaagactggagaatgcctctgttaagcgtttcaattaaggattttccaaatgaaaaaggctattttatgctgtggaagatatcacttatttctgacagcagagaacaaaaggttatcccgatttttatcaattgtgactttatcctgcgccctatggcaggcaaaaagatatgggaggcaattcttgacaaagacagaattattactgttcggaaaggagaagagattgatacagaaactaaaaataaactttacaaagtgtcacaggaatttgcttacgatacttttttaacaatgaaagcggaattagaaaaaagaaatgaagaaacatacagaaaatatctatatgctttgaacctacgcatcgaagccgcacagcggataggaatcgaaaatatcagaaagcataaactgatgactttaaaccgggagaaagcagagatagaagccaattatcaggcgggcaaaaaaatttgtcctgactttaagccaatattgatagcgtatatggagtga

SEQ ID NO: 3482 - DNA, 2673 bp, Lachnospiraceae bacterium
atgctggaaatcggcgatttcgcttttgacacgctttcgcaagcgaatgtgcagatgctggagagaattgaagtatggggatacgtctcctacaaggttttcaatccagcaaccgggaaggtctataaagcgactgaagaacaattaaatcctgaaggtaataccattcgctatgatgaaaattatttgcgatatgtgatgcagctttcaaaaatcaaaaacgagaccgccggaggcttcctttcgtcactggcaagcagtatcattccgttgcctcatcagctccatgtgctcaatcgagcaatggagactaacaatattcgctatattctggcggatgaagtgggtctcggtaaaaccatcgaggcaggtatgattatcaaagagctgaagagtcgaggacttgtcagcagagtgcttgtagtctgcccgactggcttagtaacccaatggggcagtgaaatgcaggagaagttccatgagaaatttcatgtcatacttccctctgattatgacacgattcgcaggcttacagatagcaacgacgtgtatggacagttcgaccaggttatctctccgatggattccatcaagccgctggaaaagcatgcaggttggacagaggaacgtatagaacagtacaacgaggagcgtatttattccatcatcaacagtggctgggacttgattatcattgatgaggcccaccgtgttgcaggctcctccggagaagtggcacgatataaattgggcagcctgttagcgcaggccagtccatatttgctactgctttcagctactccgcataacggaaagactgagccgttcctacgcttagtaaggctgctggatgaggaggctttcccgaatgcaaaatcaattgttaaagaacaggtgtcgcctttcttaattcgcacagaaaagagagaagcaattgataacaacggtaatttgctcttcaaaaacagagtaacacaccttgtttccttgacttgggacgagcgtaacaatctacaaagggaactttatgagttggtaagctcttacgtttcaaaaacctacaacaaggcactacgtaataaaaagaaaaacatgtgcctaatatttttacttattatcatgcagcgcatggtaaccagtagtacagcagcaatccgtcagagtttggagcgccgcctgaatgttctgcgtagtcagcggactcaccttggaaatttgaccgaggaagatctggaggaactggatatcgaggacggtgtcgaagaagcactggaggccatctcgctggatatggaactggaaactgaagagcttcagatgattatttctgttgcaaagcaggcgcagttccagaatcaggatgctaaggtggagcctttgctggaagctatcgattctattatgagcgatgataatactcagaagataatcattttcacagagtttgtcgctacacagaagtacctgcagacactgttggtaaatcgtggcttttccgttacggtcttaaacggcagcatgaatattgaagagcgtaatgaggctatgctggagttcaaaaacaacaccagtatctttatttcgacagatgccggtggcgaaggtctcaaccttcagtttgccaatatcatcattaactacgacctgccttggaatcctatgaaaattgagcagcgttgtggtcgtgcagaccgtattggccagcagcgagatgtacatatctacaattttattgtttcggatactgtggaaaatcgtgtgcgtgaagtgctggaagaaaaactctctgttattttgaaggagatgggcgtagataagtattccgatgttctggatagcgaagtagctgagtgcgattttacagaggtctatatgcgctcggttggtcatccaggacaggttgaaaagaatacctatccaatcgaagcagagatgaagcaacagcttgccaatgcgaagaaatataaagatgtcattcgtgaagaaaaagacctgacacgtctggtcggaacagaacctgatttcgatgtggatgtggccctacgcaccatgatgacctattatgagtgctggaaaggcaatgaccctcgtctgattgaccgtatcagtattggcgatgaggaaataaccaaacatctaaagactgaaatcctccaagacagaatgagtcccttgctctcagtgagcattgcaaatttcccgaatgaagcaggttgctttatgctgtgggagctctccatatctgatgacgaaagcggaaagaggattattccaatcttcgtgaatgatgctatgattttacgcccgatggctggaaagcgtttgatggaggtattccttgatggaaccagtcgtttgacaattgggacagctccgaatatgagtgcagagcaatatgctggcctcgaaaagctcagtatggaatttgcttatgatacctttatggaattgaaggaaaagcagctgcagctcaatcaggaaagttacaacaaatatatgtatgctttacagcttcgtatggaagctgccgagcacattggaattgacaatatccgccgaggtcgcttggcgaagttagaaaaagagaaggccatcattgaagctgaacacaagaaaggtgcacaagtgtatcccaatttccgcttgatgctggcagtcagattggaggcataa

SEQ ID NO: 3483 - DNA, 2649 bp, Caloramator australicus
atggttgaggtaggtaaatatgtttatgctaaggaattaaaaagacacgttaaaattttagatgttgttgaactttggggatataaaatatttttagctttagatacgtcaacaaataaacttttaaaacttaatgaagaaaatatagaattgcaaataaaaaataatatttatgaatttaaatatattttatattcagctaaaattaaaaatgaaatatcaaatggaatactgtcgccaataagcggcagtattcttccacttccccatcaaatttatgctttaaaaagggcaatttcaaatgacaatattagatatattttggctgatgaagttggtcttggaaagacaattgaagccggattaattttaaaagagctaaaaataaggggacttataaaaaggattttaataataacgccaaaggggcttgtaacgcagtggcaagaggaacttagggaaaaatttaaggaggaatttaatataatattgcctcaatattttgattcactaaaaaagatttatggcgacgggaatatttggacaaaatttgatcaggtaataacatctcatgattctgttaagccagtagaaaacagagctggctggacaaaagaagatatagatttattaaatagtgaaagatttatcaatttaatttcgtcaggatgggatttaataattattgatgaagctcatagattgtcaggatccagttcagatgttgcaagatataaacttggtaaggcactatctttatccacaccatatttactattattatccgcaacaccgcatcagggtaaaagcgattcttttttaagacttttaaaatttttagatgaagaagcatttccaaatgaaaaagcaataacaagacaagtagtatcaccctatgtaattagaactgaaaaacgagatgcaatagactttgatggatataaattgtttaaaaatagatatacaaagataattaatataaattggacggaaaaacatgaattgcaaagattgctttatgaaaaggtaacaaattatgtttcaagaggatataatagagctataaaagaaagaaaaaattatataggttttttaatggttctcatgcaaagacttgtaacaagcagcacaagggcaataagggactttgttgagagaagaattgaagttttaaataatcaatattttgataatgaaaaatatgatattgaagatatatatgatggttatggagaggaagcactggaagaattaattgcaacgacaagctttgatattaaaaaggaaattgaggaacttaaagaaattttgacagttgcacaacaagcagaatatcaatttattgatgcgaagcttgagatgctttacgatataatttttaaaataagaatggaagaaaatgaagcgaagtttttaatatttaccgagtttattgggacacaaaactatttaaaggaaatgttatcaaagaaaggatataaaattgcattattaaatggttctatggatatggatgaaagaaaagaagtattaataaattttaaagaagatgcggatattttaatatctactgatgcaggaggagaagggttaaatcttcaattttgtcatatcgttattaattatgatatgccatggaacccgatgaaaatagaacaaagaataggaagagttgatagaattggacagcatagggatgttttagtatttaatttcatattagaggatactattgaaaatagagtaagaaaaattctagaagaaaaattacaaattatatataaagaatttggagtagataagataagcgatgtccttgatagttttgatgcaggggttgattttacagatgtttatataaaatcaattgctaatcctaaatatatggatgtctttataaaaagtgtggaggaaaaaattaaagaaaaaacaaaaaatttatctgaattaaaagaaatccttaaggataaaaaagaattaaatttagatcttatttatgatttaccatcacaagatataatatattatttaaaggaaatgtataaatataaatgtctatcgataggtgaagaagtaaaattagattttattccaattaatttatttgacgaaagaataaaaagccttttaaatattcaagaattccctattaaagataagatacctagagttaatcttagtaataaatttgaaaaaggatattggagtctttgggaagtaaatattagtgataatgaaaggtattgcaaagttttttctgtatttattaattctataggtgattatagaccagcaacatcaaaggctttatttgaattgtttttaaaagaaaatattgattttgatggagagtgtggattgagacaggatatatttagtattataagtaaaattgccaaggatattggatataactattttagcgatatgaaggaagattattttaaaaatgttgaaaaagaacttgaaaagtataaaactgcctataatcttagaaaagaagctgcaatgaaaattggaatagaatcaattaaaaaacatagattaagtcaaattgaaatggaagaaaaaaataaattgaatttaatagaaaataaaaagaaaataattcctaatttgaagcttttatatatggtatatgtggagtga

SEQ ID NO: 3484 - DNA, 2790 bp, Pseudoalteromonas marina
atgtttgatgtcggagaatgggcttggagcaaggcccatcagcagcatgttaaggtaatagaaaattctggcctatggggccagagtttttaccgtgtttggttacagcaacaagactctgttgtgaaagttgttgatgatgatttagttcatgctgatgatcagcaagagccaagtgaacactttatttcatatgttgcagtggctgcaaaaatagcgaacgcacagcaagaagatgtattactagccccaattgaatccaatgtcattcctcttcctcatcaattaaaagcactcaataaagcgatggctcgtaagcaagtacgatacttgtttgctgatgaagttggtttaggtaaaaccatagaagctggcttagtgatgcgagagctaaaactgagaggcatggctaaacgcatattagtgtgtgctcctaaaggtttagttagccagtgggtaagtgaaatgagtactcattttaatgagagttttcacttacttttaccgggagagcaaaagcctgttgatgagcatgacaatgtttggttgcgccatgaccaagttgtttgccctgttgatagtattaaaccgatagagagccgcaaaggctggcctttaaagcaagttcatgaatataacaaacatcgatttgatgacttacttgccgcaggttgggatttaattgtcatcgatgaagcccatcgtttaggtggcagcactgaattagtcgctcgatataaattagggcaagggttagcggaagctgcaccttatttattgctactttcagcaacacctcatcaaggaaaaagcgatgcttttcatcgcttaatggccttacttgaccctgaagtgtttcctgatatttctagtgtgaccaaagagcgagtgcagccatatgttgtacgtaccgaaaagcggatatctattgatggtgaaggcaaaccattattcaaacctagaaaaacagagttagtccctgttgcttggcaacagaagcactccattcaacgtcatctttacgaggaagtaactgaatacattaaagaaggctacaaccaagccaaagccaaaaaacaaaatgctattggctttttaatgattttgatgcagcgactagtcagctctagtagtgccgcgatagccaaaacattatctagacgtttaattgctttagatacaatggtggttgaagaagagttaccactgtctttcgctgatgattgggcagagctagatggacaatcacagttagatgaaatgattgttgaaagtaaacaagccttagagaacgaaaaagcagaagtagcacatttactgaaattagctgagaaatgtgtggcaaatgaaagtgatgctaaagcggaagtattgttagattggctttataaactgcaacaagaagagcaatcacctgatttaaaaatgctagtgtttacagagtttgtgccgacacaagcaatgttagataaattttttactgatcgcggtattagtgttgtttgcttaaacggttcaatggatctaggtgagcgaaaaaaagtacaagcatcttttgcgggtgatactcgtatacttatttcgacagatgcgggtggtgaaggtttaaatcttcagttttgtcatgtgattgttaactatgacatgccttggaacccgatgcgcatggaacaaaggataggtcgtgttgatcgtatcggtcagcctcatgtggttagagcattaaaccttgtactagaagatactgtagagcatagagtgcgtgatgtacttgaaagtaagttgcaagttattttagaagagtttggtgtcgataaaaccagtgatgttctcgattctgctgaggcgaatcacttatttgacgaattgttcatggagacattgactaaccctgatgtaatggaccaagagcttgctaaagcattacaaacaatacaaaacgcaggaaaggataaaaaatcacaagataatttgttttctgatggagagcaattactcgctgagacttatcaaaaaacggctaatcaccctttacctcattggatttctgcaatggttgagcaatatctcctatggcaaaatcaacaaggcattaaggccagatttgataaatcctcaacgggtggtttagatattacttggccagatggtgctttatggaatgatataacttttgttggtaaagacgctcagcaagatcttaggctaaaacacattactttggagaaccctaaagttagagggttgtgtacccatttacctatttggagtgatgtgcaatcgatacctgttgtaaaagtaccaacattaccaacaggtgcttctggctactggtctttgtggagtgttcgttttgccgggagcgatgagagacaagttaaatacttacctatttatgttaaacctgatggtagcttttttgctcccgcctcaaatcggatttgggatgcattatgctccgatacggtagaagtgattacaggccccagtagtgtgaaaagctctgatatttaccaaatgttgcgagctgttgcagaagaacaaggaaaattagcttttgaagatatgctaattaattataaagctgatttgtcagagaaaattgataaaggagaatattcttttgctgctcgaaaacgagcaatagaaagaataggattgcctgaagtaaaaaattatcgtttacgtcaattagcagatgaacaacttacttgggcacaacaaataaaagaaaaacagcaagtataccctgagttatcacttcatattgtttttgagataaagggataa

SEQ ID NO: 3485 - DNA, 2820 bp, Alcanivorax hongdengensis
atgacgggcaaggtgtacgccgttggcgattggtgctggcacaagcggctgactgcgccttgccgggtggtggacagtcaatcgctgtggggagaaaacacctatcgggtttggctgccagccaaggatgccgtggtgcgcgcccgcgccgaggagctcggctcactggctgacgtgcagccgacggctgatcagattctgcatacagctgccgcggccaagctgtgcgctgcgctggaggacaacctgctgctggccccgatacagtccagcgtggtgcccctgccgcatcagcttcatgcgctgaacagggccatgagccgggaccgcattcgctacctgctggcggatgaagtcggcttgggcaagaccattgaagctggcctgatcctgcgagagctcaagctgcgtggcatggtgaagcgcgtgctggtggtcgctcccaagggcttggtgcgtcagtggcaggcggagatgcgcttgcacttcggcgaggcacttcgcttcatcgaggcagccgacctggccgcctttcgcacctggcggaacaacgatgacaacctgtggcgcatgcatgatcaggtgatctgttcgctggactcggtaaaacccatcgaagcccgccgtggctggagcctggaacaactcgacacctacaaccgcgaacgcttcgaggacttggtatccgccggttgggacctggtgatcatcgacgagtcgcaccgcatgggtggcagcaccgagcaggtcgctcgctacaagttgggcgctgcgttggcagaagctaccccctatttactgttgttgtctgctaccccccaccagggcaagaccgatcagttcatgcgtctgatgcagttgctggatcgtgagtctttccccgacgagaacagtatcaatcgcgaccgggtacagccttatgtgatccgtaccgagaaacgttccgctatcgatgccgagggccagccactattcaagccgcgtgcaaccaggcttcaggccgtggcatggcagaaccgccatgcagctcagcagacactctacgaagcggtgaccgactatgtgcgccatggctacaaccaggccatggccgccaagcagcgccatatcggtttcttgatgattttgatgcagcgccttgtcacatccagtacggcagccattcgtgccacactggaaaagcgccaaagtctgctgaaagaaccgcaatcgcaagccagcttgtttgatacgacaagcatggatgaatgggctgagttggatgggcaagcgcaagtggatattgcggtgcaggccagtggttgggagcaggagaaagcggaagtcgagatgctgctcgacctggcgcgcgaaaccgagcgccaaggtagcgatgccaaagccgaagccctgttggaactgatctacaagcttcaacaggaagagagcgatccgcagctcaaggtgttggtgtttaccgagtttgtgcccacgcaggtcatgctggcggagttcctggaaagtcgtggtttttccgtggtgttactcaacggcagtatggatctggatgcacgaaccagggcacagcaggacttttccggcgatgtgcgcgtgctgatctcgacggatgccggtggtgaaggtttgaaccttcagttctgccatgtgattgtcaatttcgacatgccctggaaccccatgcgattggaacagcggataggccgcgttgaccgtatcgggcagcctcatgtggtgcgggccatcaacctagtactcgaagacacggttgagcaccgagttcgccaggtgctggaagagaagctggagatcattgcccaggagttcggtgtagacaaagcggcggatgtcatggactcggtggaagtggagccgatttttgacgaactgttcgtgcacggcttgcaggacccagaccgtattgaccaggaatgtgatgccgtcatcgaccaggtacgggataaggtagccgcaagccgcacggacagcgacctgctgacggaggactacaacctggaagcggatgatgcccgaaaatggcgcgaccatcccgcgcagtattggctggagcgcgccatcactaccgggctgccctcgcgtggcggccaggcggaaaaacgcgatgcatcgtggagggtgacctggccggacggcagtgaatcgccccgtgtttgctttgatgcgcgcaccgccgagcaacaccccgaaatcgagtgggtcaccctggaggacgctcgcgcccgcgcatttatcagtgaactgccacgctgcgtggcggggcaacccctgccaatagtttcaatacgtgggctgcctgaatcggttaccggcgtatggtcactctgggagatcagtttggacgcttcccatgtctctgaccgattcagccgtcgtcgcttcctgcctgtcttcattgccgaggatggacgcagctttgtgcctaccgctaaacgaatttgggacttgttactgacagagcaattgtctctctcctctgagctggaaatcgaacaggctggcgatgattttgagcgtgctttaagtgctgcccgagatcaaggtgcgcggttgtttgctgaattacaggaagaacaccatagctggcttaccgaggaacgggagcgagcgcgctatgcctttgaagctagatatcaggctatcggccgcattgggcttcctgccgtcagggagcacagacgcaagcgcctggatgcggaacacgaaacccgtatggcagcgctacaggatgccgagcagggaaccccggagcttaacgctgtattgatgttgcgggttggcagtagtgggaggaatgcagcgtga

SEQ ID NO: 3486 - DNA, 2829 bp, Methyloversatilis universalis
gtggccggcagcggattcaccatcggcgactggtgctggttcactcggcaggcatcgccctgccgggtgatcgaacgccaggacgtgtggggcgaggcggcctaccgcgtctggctaccagccaaggacgcggtggtgcgtgcgcggtcggtagatctggcctcgctggaaagcgtgcgcctgagcgtggagcagatcctgcacaccacggcggcagccaagctgctggatgcactggaggacaacctgttgctggcgccgatccagtccagcgtagtaccgctgccgcaccagctctatgcgctgaaccgtgcgatcagtcgtgaccgcatccgctacctgctggccgatgaggttggcctcggcaagaccatcgaggccggcttggtgctgcgcgagttgaagctgcgcggccgggtgaagcgcatcctagtggtggcgcccaaggggctggtacgccagtggcaggcggagatgcgtctgcacttcggtgagaagttccagttcatcgaaccgtccgagctggcggccttccggcagtggcgcagtggcggcgcgggcgaggaagagaacctgtggcgcatgcacgaccaggtgatctgctcgctcgattcggtgaagccgatggagagtcgtcgcggctggagcctggagcaactcaacacctacaaccgcgagcgcttcgaggacctgatctcagcgtcgtgggatctggtcatcatcgacgaagcccaccgcatgggcggtagcaccgaacaggtggcccgctacaaactaggtgcggcactggccgaagcctcgccctatctcttgctgctgtcggccacaccgcaccagggcaagaccgaccagttcatgcggctgatgcagttgctggatcgcgaagccttcccggacgagagcagcgtcagccgcgaccgggtgcgccccttcgtgatccgcaccgaaaagcgcgcatcgatcaacgccgaaggtcagccgctgttcaagccacgtgtgacccggctgcaggcggttgcctggcaggcccgccacggctcgcagcagcgactgtatgaggcggtgaccgactatgtgcgccacggctacaaccaggctatggcggccaagcagcgccacatcggctttttgatgatcctgatgcagcggctggtgacctccagcacggcagccatccgcaccacgctggaaaagcgccaggccttgcttgatgcgccgcagccgcaggccaacctcttcgagagcaccagcgccgacgagtgggcggacctcgacggccagtcccaggtggatctggcgatgcaatccagcggctgggagctggagaagtctgaagtcgagatgctgttggagctggcgcgggaaaccgaggccgccggcaccgatgccaaggccgaggcactgctggagctgatctacaagctgcagcaagaggaaggcgacccggcgctcaaggtgctgattttcaccgagttcgtgccgacgcaagcgatgttggccgattacctcgaaagccggggtttctcggtggcgacgctcaacggcagcatggacctggaagcgcgcacgcgggcacaacaggtgttctccaaggatgtgcgcgtgctgatttcgacggatgccggtggtgaaggtctgaacctgcagttctgccatgtcatcgtcaacttcgacatgccgtggaacccgatgcggatcgagcagcgcattggccgggtggaccgcatcggacaaaagcacgtggttcgcgccatcaactttgtgctcgaagacaccgtggagcatcgggtgcgccaggtgttggaggcaaagctcgaggtcatcgcgcaggagtttggcgtcgacaaggcggccgacgtgatggattcggtcgaggccgacccgatcttcgacgagctgttcgtgcatggcctgcagaacccggatgccatcgaacaggagtgcgacgcggtggtgtcgcagcttcgatccaccctggcggagtcgaagaagaacagcgatctgctcactactgagcacgatctcgacgcagacgatgcccgcaagtggcgcgaccacccggcgcagttctggctggagcgcgccatcaccagtggattagctgcgcgcggcggctccgccatcaaggtgggcaatgcgtggcgggtgaagtgggcagacggcagcgagtcggcacaggcctgctttgacgcccgcacggcggatgagaacccggagttggaatgggtcacgatggaagacccacgcgcccgggctgtgatcagcgagctgccacgctttgtcgccgggcagccgctgccggtgatccgcgtgaccggtcttccggattcggtacgcggcatctggtcgctatgggagatcagtctggcggctgaatgcttgagccggaagcgcttccttccggtgttcatcaacgaggaaggccggcccttcgtgccgaccgccaagcgcgtctgggatctactgctcactgaaaccgtagacgtgcatgccgtgacgggtgccgaggagtcggtgaggtggttcgaggcatcgcattccgctgccagcacccagggtgaacggatcttcacggagctgctgaccgaacaccgcgcccggctgaaggaagagcgagaacgtgcggtgtatgcgttcgaggcccgaggtcaggccatcggacgaattggcttacccaccgtgcgtgagcaccggcgcaagcggctgcaacaagaacacgatgcacgcatggccgccctggacgacatggatgcaagcgtgccggatttgaatgccgtgatgatggtgcgcgtctccggcgatgtgatgcccggaggacaggtgggatga

SEQ ID NO: 3487 - DNA, 3435 bp, Treponema primitia
atgccggaagcaccgcccattagagaagggcaaatagtaaaaagccccctttttaacgaacccatgaaggtagagaccatccgcgaagatggttcaggcgctttaactattggtatggtcggcacccagactgaacggttccgtagagttacgcttacacccgaagaaatcgcctcccttactattctaaatgagatctatacctataatggtgatggtaggctccttcgtctgggaatccaagcctactctcttggcatcgcctatgaatttgacccttattttggcctttccatatccagagtagacccccttccgcaccagttagaagctgtttacgattaccttctaaagttgcctcgtgttcgttttcttcttgccgacgatgccggggctggcaaaactattatggcgggccttttaattcgggaactggaactgcgaggccttgccgagcgtattttgatagtttgtccagccaaccttgctttccagtggcagcgggaactcaaagaaaaatttgagaccaaattcgaagtgatgaaaggcagcgatattcgcgaacaattcggctttaaccaatggcaggagaaaaaaagagtcatcacttcccttgaccttgctaagcgggaagatattcttcccggtttacagcaaacccgctgggatctcgttattgtagacgaagctcaccgtatgtccgcttccgatgaatcccataaaagtcagcgttacagactcggtgaattactgagggataccacagatcatctacttttattaaccgctacaccacaccgaggcgatccaaacaattttacgctctttttgcaattgcttgatactgatgcttttgccgatgttaagtcgatccatcaggccatggaaaatcgttgtgccccgttctatttgcgtcgtacaaaagaagctatggtctattttcctgaacaaaaagaagatggtacttgggcggcgaaaaaaatattcaccaagcgaattacacgtactgttgatttcaatattgacggccctgagtacgaattatacaaagcggttaccaattttgttcgagaacaaagtgtcaaagctgccgctatgggtgatactcctcgcgctcgtgctgtaggtttcttaatggccctctatcaacgccgtcttgcgtccagtacctatgctatgcgccattctcttgaaaaccgggctcggcgtctggaagaaggtctcaaacatgctcagcaactggcaacccaggctcctcttgatttgcctaccgaagaagaactcgatgaaatggaagatattgaacgcgaacgcctcgaagcaattcttgaagctataacaattgcagggaatgaaacacaaattcaagaggaaatacaaaagttaaaggaacttgcccttcatgcccaagaaatagaaaatgcaggagtagaagcgaaactgtcccgtctgaaagatttactccaaacagaaggtttttttgatcataacgaccaacgccttctggtgtttaccgaattcaaagacaccctcaattacctcatgtcaaaattcaaagagtggggttttagtgttggttgtatacacggcagtatgaaacccggttcccgtgatgaagccggtacacgcctttttactgaacagcaattcagggaaggggcaatacaaatccttgtagccaccgaagcagccggtgaaggtattaatcttcaggtttgtaatatcctttttaattacgacatcccctggaatcccaaccgtcttgaacaacgcatggggcgtatccatcgttatggtcaacgtaaagattgccttatcttcaatttcgtggctaccaacaccattgaaggcagagtccttggaaccctgcttttcaaattacaggaaatccgtaatgctcttgatgacgatgcggtattcaatgtggtgggtgaagttctgccttccgcccatattgagcgggtattgcgcgattattatgccggaaaacttggtgatgtcgatcttgaagacagattgttaagaaatgttgatgaacggcaattccgcgccatttgccaaaatgctctggaaggccttgcatcaaaaaaacttaacctcgccatgctggtggaacgccgtgcaaaagcccaggaacatcgagtagtgccggaaaccatatcccgttttctctttgaaagttccgattacgtgaaaatgccttttaaaattgtagccggtataccccatacctttgaccctggaaaaacgccttcgtcccttcatcgttttgagcgggaagacgattggcggctccctgctctggtaaacaggtatccccgctgttcaactgaccgtgaaatagccgagaaacataccctggaatgggtaacccctggacatcccctttttgaggcagttcgccgccatgtttctttatctgcccttgatgtctttagccagggtacctgtttctattctttgaataacgaacaagctacccgcattgatttttaccgtgcccgtgtagttgatggcttgggacagattattcatgaacgtttctttgctgtacaattaaaaaaagatgaaattcctgaactttgtgaaagtagcgccttaggcgattttactcctgcaacgattcctgatatcttaccccaagtagcgtttatccctgaagcggatgccttcatgcagactaatgcgtatcagccctttcttgaagaaattcgcaatgaacggcttttagagcttaagcggatagtttcccatgttgaactatcgctaaacgaacttatccaaaaggccgatgaagaaattggtaaaattgctgccgaagttgagatgaaaacaccaggatccgaaggccgcctcatcatggccgagaaccgccatgatgaacttcgtacccggcgtgataggcgcagagaggaacttgaaaggcaacgttctctttcgctccagggtatagagcgcattaccagtgttcttgtactgccgcatcctgaccgcgaagacagtgaagtacgccatctacgtcaaaaccttgagacagaagcaattgctatgcagatagtaatagaatatgagaaaaaacgtggttgccaagttgatgatattcataagaaaaatcttggatacgacattaccagtcttaagccctgctccggcgagcttcgtcttatcgaaataaaaggcattggcgcgtctacgggaaatatcctcttaacccctaatgaacgtcatgttgccgaagaccgtccagattgctattggctctatatagtaacaaattgcgatacagaccctgtaatgcaggatccgatacaagacccggcgagattcccttggaacgaagtaaaaaaagtcgctcattatactcttgcaattaatgccatgaccaaacctatggaagtgcatgaaaatcctccgcactacggagaatcaaaatga

SEQ ID NO: 3488 - DNA, 2796 bp, Vibrio scophthalmi
atggcaacacttttaaatgtcggtgattgggcttggagtcaagcccatcaacaatacgtgaaagtgatagaaagctctggcctttggggccagagcttttatcgtgtttggctccaacaacaagatagcgttgtaaaagtttcttcggatgatttgtctaaaacttctatggataaatcgcctagcacacattttttctcttatattggtatcgcagccaaaatagcgaatgcccaaaaagaggacattctacttgctcctgtagaatcaaatatcattccattgcctcaccaattgaaagcgcttgacaaggttatgtcgcgcaagcaagtccgttatctatttgctgacgaagtagggcttggtaaaaccatcgaggctggcttggttatgcgagagcttaagctaagaggtatggctaaacgaatcttagtgtgtgcacctaaaggcttggtaagccaatgggtaagtgagatgagcactcactttggggaatcatttcatctgctcatccctggggagaataaacctgtagatgagaacgacaatgtttggcttcgacatgatttggttgtttgtcccgttgatagtataaagccaattgagagcagaaaaggctggtcggttaaacaagttcatgagtacaacaagcatagatttgatgatttgctgtctgccggatgggatctcattgtcgtcgatgaagcgcatcgattaggtggcagtaccgagctcgttgcacgttataagttagggcaaggtctggcggaagcatcaccctacttattgctgctgtcggcaacacctcaccagggcaagagtgacgcttttcacagacttatggccttacttgataaagaggcttttcctgatgtttcgagtgttacgaaagaacgtgttcagccctatgtcgtaagaactgaaaagcgaatatcaatagacggcacaggtaagccattatttaagcctagaaagacagagctaattcctgtggcctggaagagtagacacgctttacagaggcacttgtacgaagaagtcactgagtatgtaaaagaaggttataaccaagcaaaagctcaaaaacaaaatgctattggctttttaatgatcttgatgcagcgccttgttagctcgagtagtgcagcaattgcaatgacattgtctaggcgattacagtcactcgagaatactgttattgaagatgagcttccgctagcttttgccgatgactgggcggacctagatggccaagcgcaattagatgagttgattgcaactagcaagcaagcgttggcaaacgagaaggctaatgtacagcgtttgttaaatattgctagcgaatgcgttgccaaagaaagtgatactaaagcagaagcactgattgattggctctatcaacttcaacaagcagaacaagatcctgaactaaaaatgttggtctttaccgaatttgtaccaacccaacagatgctcacgaagttctttaccgatagggggatcagtgttgtcacgcttaatggctctatggatatgcatgagcgaaaaagggcacaggcttcgtttgctggtgatacgcgacttttgatctctactgatgctggtggtgaaggtttaaaccttcaattttgtcacgtcatagtaaactacgatatgccttggaatccaatgagaatggagcagcgcattgggcgtgttgatcgtatcggtcagccccatgtagtacgagctctaaactttgtactggaagactctgtggagcatagagtgcgagatgtattggaatcgaagcttcaagtcatcttagatgaattcggagtagataaaactagtgacgtacttgactcagccgaggcaaatcatctctttgatgagctctttatggaatccatatcgaacccggcaacgatggatcaggaattagcgaaagccttgaaagtgattcagggtggagctcgagataaacgttctcaagacggtttgttttcagatggtaagtcgttaaatccaagtgattaccagaaagttattgatcaccctttgccttattgggttgagcggatggtgaatcagtacctaagttttaagagctctcaaggtgcggatgcgtcatttactcgtgctgagaatggagcgatatgtgttaaatggccagatggcgctaactgggaagacattacctttattggtaaggaagcgcagaaaacaccaggattaaagcacattactcttgaaaacccaaaggtgagaggcttgagcacacacttaccaatttggagcgaagtccaaaacatacctcttgttcgagttccttccctgccttccggtgtgaccgggtattggtccctctggagcgttcgattttctggtcaggatgagcgtcaattgcagtatttgccaatctatataaatacagcaggccagtatttctctaccgcatctaatcgagtgtgggatgcaatatgttcagatattatcgagtccgacttaagctcaaatccagagtctaaaaaagcatatcaattgcttagagagtctgcagaggtccaaggaaaaattttgtttgattctatgctagctgagcatttgaacgaactagaacttagcgttgagaaaggagagtattccttcaaagccagaagaaatgcaattgaacgaataggtctgccagaagttaagagctatagaatgcgtcagttggatattgaatacagtcaatggaaggttgatattgatgcaaagcgtgagatataccctgagttaaaccttcatctagtgtttgaaattaaaggatag

SEQ ID NO: 3489 - DNA, 2748 bp, Ectothiorhodospira sp.
gtgtggggcgaggtggcctatcgcgtatggctgccggccaagaacacagtggtacgtgcccgcgcccaggatctcggtgatctggcagcggtgcgcccggcggttgagcagatcctgcatacggcggcatccgcaaagctgctggatgcgctggaagacaacctgctgctggcccccatccaatccagtgtggtgccgctaccccaccagctgtatgcgctgaaccgggccatgagccgcgaccgcattcgctacttgctggcggacgaggtgggcttgggtaagaccatcgaggcgggcctgatcctgcgcgaactgaaactgcgcggcatggtgcggcgggtgctggtggtggcccccaagggcctgatccggcaatggcaggcggagatgcgtttgcatttcggggagcacctgcgctttatcgaagccaccgagctggctgcctttcgcgcctggcgcgctgagggcacccagaatgacgacaatctctgggccatgcacgaccaggtgattgtgtcgctggactcggtcaagcccattgaaggccgccgtggctggagcctggaacaactcaacagctacaaccgcgagcgtttcgaagacctggtttccgccggctgggatctggtgattattgatgagtcccaccgcatgggtgggagtaccgaccaggtcgcccgctacaagctgggagccgcccttgcagaagcggctccctacctgttgctgctgtctgctacgccacaccagggcaagaccgatcagtttttgcgcctgatgcagctgctcgaccgcgaggcctttgttgatgaaggcagcatccaccgcgaccgggtgcagccctttgtcatccgcaccgaaaagcgttccgccatcaacgccgatggccagcccctcttcaagccacgctctacgcggctgcaggcagttgcctggcaagcacggcacacggcgcagaagcagctgtatgacgcggtcaccgattatgtgcgccacggttacaaccaggccatggccgccaagcagcgccacatcgggtttctgatgatcctgatgcagcggctggtgacctccagcaccgcagcgatccgtgccacgctggagagacgccaggcgttgctggatgcgccgcagccacaggccaatctgttcgatagcgtggacctggacgaatgggccgaactcgacgggcagtcacaactcgacgtggcgctgcaagccagcaactgggagcaagaaaaggccgaggtcgagatgctgcttgatctggcccgggaaaccgagcggcaaggcaccgatgccaaggccgaagcgctgctggagctgatctacaagctgcaacaggaagagaacgaccccgagctgaaagttctggtgttcaccgagtttgtgcccacccaggccatgctggccgagtttctggaaagccgcggattttccattgtcctgctgaacggcggcatggatctggaggcgcgcacccgcgcccagcaagcattttcccgcgacgtgcgtgtgctggtctccaccgacgccggcggtgagggcctgaacctgcagttctgccatgtgatcgtcaacttcgatatgccctggaacccgatgcgcctggaacaacgaatcggccgagttgaccgcattggccagccccatgtggtgcgcgccatcaacttcgtgctggaagacacggtggagcaccgggtgcgcgaagtactggagcagaagctggagatcattgcccaggagttcggtgtcgacaaagccgccgacgtgatggactccgtggaagtcgagccgctgtttgatgagctgtttgtgtatggcttgcaagatcctgcgtccatcgacaaggagtgcgacgcggtcatcaaccaggtacgcgagaaagtggccgcaagccgcgccgatacggatctgctgaccgatgatcacccgctggaagcggttgagtcccagaaatggcgggaccacccggcgcagtattggctggagcgggcggtaacaaccggcctgcccacccgtggcggcacagcggagcagtcagaccatgcctggcgtttgacctgggcggatggcagtgaatctttccctgtctgcttcgatgcgcgaaccgctgagcagaacccggagatggaatggatcacgctggaagatccccgagcccgtgcgctgatcggcgatctgccgcgctgcgtggccggacagccgcttcctatcgtacaggtaaccggtctccctgacaccgtacagggcacatggtcactgtggagcgtgagcctggccgcttccaacagttctgccaacttcacccggcgtcgcttcctaccggtctttgttaccgatgatggacgcagctttgtccccacggccaagcggatctgggatctgttgctgaccgaagacgtgcgcctgacggcggacccggacagtgagcatgcagccgcactcttcgagcaatcgctgacggcagccaaaggtatgggtgagcggctgttctcggagctgcttgaagaacaccgaagctggcttgccgaggaacgtgagcgcgcccgctacgcctttgagtcacgctttcaggccattggccgcatcggcctgcctgccgtccgcgagcaccggcgcaagcgccttgaaaccgaacatcaggcccgtatggcagatctggcggaagcagaagcctgcacgccagagctgaatgccgtgctgatactgcgcattggctcggcgggaggggccgcagcatga

SEQ ID NO: 3490 - DNA, 2673 bp, Clostridium papyrosolvens
atgttcagtattggggattgggttttagataaagaaaataagaaaactgttaaggttattgaaagcaatgacctgtggggttataagtcatacgcagtgttcgatcctggtgagcagaagtcatattttttatcggaggataagatttgcaatgtggatgctggagaggatttcagcatccattctttcaaataccttgtaacttcggcacgaataaaaaatgagcttgcaaacggtatactgtcttctattggtgacagcataataccattgccgcaccagatttatgcacttaacagagctttatcgagtaataaagttcgatacattattgctgacgaggttggtcttgggaagactatagaagcaggcttaatcataaaagagcttaagacaagaggtctaataaacagagttcttattgtctgccccaaaggtcttatgacccaatggcataatgaaatgaagatgaagtttaatgaaaacttcaatattgtactacccgaagactttgactccattaagaggatatatggagaaggaaacatatgggcaaatttttcgcaggtcatatgttctcttgactcgataaaacctttggaacgccgtaatggctggagcaaggagaaaattgacgagtacaataaggaaaggctcggaagccttatctttgcaggttgggatattattataatcgatgaagctcacagaattggaggctctacttctgatgtagcaagatataagctgggtagtgctttagcagatgtaagcccatatctacttctacttacagccacaccgcatcagggaaaaacagaacctttcttaaggttgatccgtcttttagatcaagatgctttcccagacagcaatgctattgtcaaagagcaggtaagcccctatgttattaggacagagaaaagagaagctgtggacagcgaggggaatcggctgtttaagaatagggttactaaagctgtaaatattgaatgggaacagagacatagccttcaaaagcagctctacgagatggttacaaaatatgtgacagaaggctataacaaggcaagaaaggagaaaaagaattatattggcttccttatggtgctgatgcaaaggcttgttacaagcagtaccagagccataagagagaacttggagagaaggcttgaaatacttcaaaacagttcaaccagacttgtaaacttgagcgaagccgatttaatggaagcagatgcagaagagactgttgaggaactgatcgcagtccagtccattaatatgaagaaagagattgaagaaataaaagatatgctggtggttgccaatcaggcagagtatcagtatgtcgataccaaagctgaaaaactgctggaattcatttataagatacagatggagtatgaagattttaaagtaatcatttttactgaatttgtagccacacagcagtttttaaaggagtatcttgaaagcaaaggttttaagatagcgactttaaatggttctatggatattgaagaaagaaatacaaccttgaaagagttcaaggaaagagcagacatacttatttctaccgatgctggcggagaaggtttaaatttgcagttttcaaacatagtaattaattatgacctgccctggaatccaatgaaaatagagcagcgtatcggtagggtggacagaattgggcagcagagagatgtatatgtatttaacttcatgctttcagaaacggtagaattcagaatcagagaggttctggaagaaaagctggccactatttttgagcagttcggtgtggataagatggaagatgttcttgactgtaccgacgcagagtttgactttacagacatctttgtaagaggcattaccgatcctaaaaatgcagattattatattgaaaagttagagaaggaagtaagagataaaacagaaagaattaatgaaatcaaaggcttgttgcgggacgaaaaagtaatagataagagcttggttgcaggaattagtaaccttcccataaagagctggctgaaacaaatgtatagtaatttccaattgtcccagggaaaagaggtaaatctgattgagcttgccatgatagatttgaataaccagcaagtaaaaaagatgctgaaaaatatgcccgtatgggcaagaggtcataaagtaccagcccttgagcttgcaggggtatctaacgaaaaaggctattggtctttatgggatgtaagcatcaatgatagtgacgtaaataaacagatattccctttgtttgtcaatgaaagcggagttatgcgggcagcttcttcaaaaatattgtgggaagcctttttgaaggagaatgcaaatccagcgttaaaggggtatagggagtttgaagacaccacctatactatgctttgtgaaaaagccaaagactatgcttacaatctgtttgagaatatgagagaaggttatttaaacaagctgtccaaagaacaggcaaaatatgagtatgctttcaaactgcgaagagaagcggcccagaggataggacttgaaagcgtaagaagctacagagcaaagtccataggcaaggaagaagaagcatggcgatttaagatcgaaaaagaaaaagcgataattccaattcttaaacctctatgtattgtatacctggagtga

SEQ ID NO: 3491 - DNA, 2685 bp, Thermoanaerobacter ethanolicus
ttgttcaaagttggagattgggtttttgatattgataaaaaaagagcaatgaaaataattgatgtatttgagttgtgggggtatgtttcttacagcatatatgatccgattgaaaaggtgacctatactgtgtcagataaaagacttgtaagtacagagaagaaaaatgagtttgacttaaattatttcaaatatgtaattatagcttcgcgcatttcaaatgaactggctcagggttttttgtcttcgataagcggcagtattataccactgccgcatcaaatatatgcgctaaacagggcactgtcaaagagtacagtaagatatcttctggcagatgaagttggtttgggaaaaacaattgaggcaggacttatcataaaagagcttaaagcaagagggcttgtgaaaagaattttgattataagtcctaaagggcttataactcaatggcatgatgagttagaattaaagtttaatgaagattttaaaattatacttcctcaggattttgaagttttgaagagaatttatggagaggggaatatatgggataagtttccacaagttataacttcattggattcagtaaaacctgttgaaaagagacaggggtggacgaaggagcgcattaaagaatttaataaagaaagaatggaaaacctcgttatggctggatgggatataatcgttgtagatgaagctcaccgcttggcaggttcgagcagtgatgtagcaaggcacaaacttggaattgagttgtcgaaagcgagtccttatcttttattattgacagcaacacctcatcaagggaaaacagattcatttttgaggcttatgagacttattgataaagaggcatttcctaatgagaaagctattgtaagagagcaagttgctccatatattattcgtacggaaaaaagagaagctgttgatagagatggtaatccactttttaagaaaaggataactaagacagttaatatatcatggaacatgaagcatagcctacaaagggaactttatgagaaagttacgaagtatgtagctgaaggatataacagagctaaaaaggaaaaaagatattatattgggtttttgatggttcttatgcaaaggttagttacaagcagtacccatgctataaaagttaatttggaaaataggcttgagtttttaaaaaatgaggtcgtaggaatagaatctattgaagaagatatgttttttgaatatgacgcacaaaaggtattagatgaattgttaaaaataaaatctattgatataaaaaaagaaatagatgagttagaggaacttttaagattggcgaagcaagctgaaagtcaatatattgatgcaaaagcagaggttcttatagattttattgatcagctttcaatggagtataaaaatagtcaaaaatttattgtttttacagaatttttagctacacagcaatatttgaaggattttcttgaaagtaaaggatataaagtagctatattaaatggttctatgtctatggaagaaagagatgcttcattgaaagagtttaaaaattacaaagatgttttgatttcgactgatgctggtggagagggtttaaatctacaattttgcaatattgttataaattatgacttgccatggaatccgatgaaaatagaacagaggataggtagagttgatagaatagggcaggaacgagatgtattggttttaaattttatgttagaggatacgattgaatttagagtgagggaagttctggaagaaaaattaagaatgatttatgagcagtttggtgttgataagatgggtgatatacttgattctgtacagtcagagatggattttacggagctttatatgagaagcattgagatgcctgaaggtatagagtataacgtaagtattatggaagataaaataaaggaaaagacagagcaaataaataggataaaaggattgttgagagaagagaaggaacttgatttaaatatagtaagtaaaattagtgggttaccgattaatgagtggattagggatatgtatataaataaaatggctgctgaaggggtagaaatttctattgatatgttggatgagaatttgatttcgttgaataatgaagaaattaaaaatatgataaaaaatttgcctgtatatataaaaagtagcaagataccgattttatatttaaaagatgtttcaaatgaagagggatattggtctttatgggaaattagcattaatggagattctgagaagtttaaacatgtattccccgtttttttaaacaaggataaaaaagtgagaattgcttctgcaaatctgatatgggatatttttttgaagaatgaaaaagaagtaatttttaaggggtataaatcaattgatgaggaaatgtatgattttatacatgatactgcaaagaatatggcttatgattattttgagaaaataaagaataattattttgagaatttagttaaggaaaaagagcgatatgaatacgcttttaagttaagaaaagaagctattttaaggataggacttgaggctgtaaggcgtcggagacttgtggaattagaaaatgaggaaagaagatggaaagaagaaattgaaaagtctatggatatattgcctatgttaaagcctttgtacattgtgtatttggagtga

SEQ ID NO: 3492 - protein, 239 aa, Clostridium papyrosolvens
MKVTDYHAKLYAHELTRRCSSDSVEKLTSVLADAQVDLNPHQVEAALFAFRNPFSRGAILADEVGLGKTIEAGLLLSQQWAERKRRLLVIVPANLRKQWSQELADKFNLPEVILENRSFNDEIRTGNLNPFKQEAVILCSYQFAKKMEPYIRQVQWTLVVIDEAHRLRNVYKTSSKIAAVIKQAVAPFPKVLLTATPLQNSLLELYGLGQKDALLDEISNRLQQNTETKTLFCLRWVLQ

SEQ ID NO: 3493 - protein, 937 aa, Thermoanaerobacter ethanolicus
MSRDGIWRPGDWAWSWGYREPVKVIEALDLWGKNVCRVWVPGRDAVIRLQENELSSITEAGIPSRERLIYTVAAARIAESLARPDILLAPLEGSVTPLPHQLYALSRAVSGSRVRYLLADEVGLGKTIEAGLIMRELKLRGLVRRTMVVAPKGLVMQWVQEMENRFRERFHLLMPAEITALSCFEWDANVWQRFDQVVVPMDAVKPLESRRGWSRDQVSRYNRERFENLIAAGWDLIIVDEAHRIAGSTDTVARYRLGQALAEAAPYLLLLTATPHQGKTDSFHRLMALLDREAFPDVESIKRERVAPYVIRTEKRRAIDEKGQPLFKPRRTQLVPVVWQSRHQKQRELYEAVTEYVREGYNRALKEKRNYIGFLMVLMQRLVASSTRAIRTALERRLEVIEQEAPLQINSEIELEEDWWDLDGQEQLEQILKHRLVAFASEREEVKRLLSLARQCESLPDARAEALLEWMYRLQAEENDPELKFLIFTEFIPTQEMLKEFLENRGFSVVCLNGSMGLEERRRVQQEFAGHARVLVSTDAGGEGLNLQFCHVVINYDLPWNPMRLEQRIGRVDRIGQEHVVRALNFVLQDTIEYRVQEVLQEKLAAILADFGVDKMSDVLDSAEVATDFEDLYKEAILSPEEVESRIERLEAELRQRIQEVTMANRLLGEEAELDSRLVEKISGHPLPYWVERMTINFLVSEGGRVEPKLAGYDLTWPDGFTMKDVAFSRQEADKHSMSYLSLEEPRVRGLVTRMPLAVAGQPVAKVRLKGLPQEISGYWSLWRISLMAENMREVRVLPLFQQEKDGKILMPTARRIWDLLLQEETSLEIQGYITGEKSEEIFERLQKQAVRYGHNLFLELKAEYEEHLQKEREKGRYAFQIRQQAIMRIGLPAVRQHRLAELERQKKEWALLLKQKEKILPELSAITIVYIEGGVP

SEQ ID NO: 3494 - protein, 1075 aa, Desulfovibrio magneticus
MANGNDETKIKALLGEFVRETVPEYILDGAHAIVAGGGIQKLTVNRHDNFWDVEGQVQGDDFQVYASELSVNLREGNINFFCNCPDSFSGVCRHVGATALKCLRTLDEASGDGETSDSAAHAARGEWRQTFRTYFSTEPEPEPGRHYLIFRFHPEPGRLQVAFFRARQNKSGISQVHSEITLEQIIKNPDWSELSPTLPVVAEMLEHHLDYAGHRVEIPPGLLAWFFWAIGKEYYLYWRDTEQPVRIESKTMRLQLAPRLQEDGLSFDILLGSPGKSPFSILGQEVYFYGQMPIWVCWKNAFYPVQTGLPPQLVSDMTQNPPFIPTADVSEFLDRVWTHLPMTDLYGQEEFLVKMQPFFVPANFDPKIFLDEEGSLLTLQIQNVYQTEHGEITVPGPNPDLMTASYLHDGKSYLIARDCDQEQALISMLAEMRFQARNNANWFLETEEAIVFLLDAYPKLIEKYRVFGEKNLTRYKVRLSTPVIVAEVESKEEEKWFNLDLQVQYDDQRVPIEKIWKAWTQGKRYVQLKDGSYTSLPESWLEKLAHKLRALGYDTDKPPQTKFKQFEAPVLDKLLEDMPEARTDSFWNNLRQKIHSFREIVQVRPPKGLNATLRPYQVQGLSYLNFLREYGFGGILADEMGLGKTVQTLSFIQHNVERGAIGPNLIVVPTSVLPNWEREAQKFVPDLKQLIIYGARRENMFRRIAESDLVITTYALLRRDLDELLKYEFASIILDEAQNIKNPNTITARAVRRLAGKTRLCLSGTPIENNLFELWSLFEFLMPGFLGGQNAFQRGIVKPIKDGDAETLDYLRGRVKPFILRRTKNEVAKDLPPKVENTYYCNLLDEQLELYAALAKKLKEQVLATVDEKGMAKSQMSILDALLKLRQICCHPRLLKLDLPGVNTNLPSGKFDAFKDLITDCIEEGHKVLVFSQFVQMLHIIRSWMSISQMPFCYLDGSSKDRFDQVDKFNQTEDIKVFLISLKAGGTGLNLTSADYVIHYDPWWNPAVENQATDRTHRIGQLRQVFSYKLICQNTVEEKILKLQEQKKDVAEAVIPGQDAFKSLTRTDLESLFDV

SEQ ID NO: 3495 - protein, 1062 aa, Geobacillus sp.
MIQVGDIVKGPLWPEVVEIKNCTMIQNQFYQVEAYGKNTSKYYQVIILPEQLTNIEIINTSNKKTYSSEELQDYLRYFEFVVDKRFSKTRALGNQHLIPLPHQIEAVYGRMLRVPSVRFLLADDPGAGKTIMAGMLIQELKARQSANRILILVPPLVLKQWQQELKEKFNEDFLIVTRSTLNEYSGKNPFVENDCVITSLYWAARDDVRDLVIEADFDLVIVDEAHKMAAYTSGVKKKKTKRTKLYQLGEIILRHSDHCLLLTATPHKGDVENFRHLMRLIDPDIFSSIGIKETLRDKTNPFIIRRLKEHLKYFDGTPLFPKRTTKTITYHLSEQELKLYEAVTQYVKEHFNRAINRGNNSTAFAMMLLQRRLSSSIEAIHLSLKRRYHRLMNLLEEAKQKQVIPSEEILVDEYEEATLEEQEIFEMKSETCVDAIDLAELELEIEELKKLIAYSGYLREHGVERKWMELEKTLFGVEGLLQKGEKILIFTESTDTLHYLEKKLRAHGVEVAKIIGKFSMEERRKQVERFKHECPIMLATDAGGESINLQFCNQMINYDIPWNPNKLEQRMGRIHRIGQRNEVFVFNLVAGNTREGDVLLTLMTKMEQMRKDLGHDLVYDFIGDRLEDKVADLPTLMQQAILQRERLEDIKKSIDEVLAEEYADLLKIAKEERLAVETIDLPGMKREQYDLAVQKIPARAYAQFAINTLSRHRVKVYSSQNNHVFRIDRMPKFIREFARKHHISLKGKEESYRFTDIAKYANEEVALMKNDHPLFAVSLQLMKEEIEGLVLPFFEAKIPIREALMVEAYEIGLTDGTGRELFRDIVYFARRKNGEIIEIDSYWLYGYSLELVSLHPIEQNESTLLAHALNKVMQKREELVLSNEAQLNKKIQFLRRAFDHQYQETVFRLEKYRRENDANRNSALINQMKAKLVDIEERRQARLEEIERERNINIIPPKKIASFTLLPDDKTSYRLFSVDYKEAVERYEQANGRNHVKMYPSLSLVDFMSEDEQGNPRFIILTDNPEMTLPESHLEDLAELQGSVYMYFVRNGEVIHERLILI

SEQ ID NO: 3496 - protein, 1059 aa, Halobacillus halophilus
MLKKGEIVGGSFWPEPVQIKHVESIDEELFLVEAVGRESNQFFENYLEEFQLEKVEHYSEIETSDQWKNRFQHYLQYHVLRTEKEYSQARARGNKNMIPLPHQIEAVYSKMLQAPQVRYLLADDPGAGKTIMSGMLIRELKARNMVRKTLILVPPLVLKQWQAELKEKFDEDFLIITRDYLKASGETNPFEMHQQVIASMYWASREDIKNMILNSHFDLVIVDEAHKMAAYTVGQKKRKVKRTKMFQLGENLLRHSEHCMLLTATPHKGDKENFRHLMSLIDHDIFSQLNRSDSIFEKSNPYVIRRLKEKMVKFDGTPLFPKRTTKTLGFELSSAEVELYDAVTDYVRHYFNRAKKNDKPNVAFAMMILQRRLSSSVEAIYLSLLRRKERLQKVLETGQRFQQLIDTEEYEESSFEDQELMEQYAEGEFEELDMDELQVEIEMLDHLIRKANVVRQQENERKFLELESTLFGADGLLAQGEKILIFTESKDTLNYLEKKLKAYVPDIAKIVGGFSMDRRQEEVEKFRNDLQIMLATDAGGESINLQFCNQMVNYDIPWNPNRLEQRMGRIHRIGQKNEVFVFNLVATNTREGDVLSRLLTKMEQMREDLGQELVYDFIGEVLEDHQADLPSIMEQSIIGRENLDNVIERMEKTLSEEHERLLELAKNERLDENFDLPGAKRSFDKVSIHSIPRRFYGHFVLQGLESTRTRVSVSGDKSTARIDRFPKRIRDFARGRKLMFDFDESIRFALTTNSETIQLSMLQNDSPVFNIIMQLTFKEIQQAVLPFYEVQASVPEDMKIELNQVTIVDGNGRELEQQLMMTGKRENGGFVQVSPYFLFHQTLEVEGTFVQEDQDIKRYVIKHARNLLKTIQRKREDYANRKRVFLRKSFEEQIETLQQRLEKYQRENVERKNSALINQTYAQIDEIEDRSKERLNEIDRERSIQLKPVKRIAQFKVSSNGVSNGRVIPQDFLSLIEEYELKSGRLNVQLQPAFGLVDFISEDVEGENRLIVVTDDLYQFKQQLVLEDYSDITERVFVYELREHGIKEHQLDQGLMFTY

SEQ ID NO: 3497 - protein, 1037 aa, Thauera sp.
MQPGDKVRLKANPGRVGILGNETDGPPHRLRVLVTFTDGDEQFVLKNSLEKVDRASAGPYAMVASGRYGRVEDLRGAITYYRLSGRLANLIYSLNTTNTQFLAYQFKPVLQFLDSPSNGILIADEVGLGKTIEAGLIWTELRARVDAKRLLVICPAMLREKWKAELSERFGVSAEIVDARGLLDHLQSVRERPQQQFALIASMQGLRPAKGWNDDEEPSQATTAKLARFLNEADLEEPLLDMLIIDEAHYLRNDETATHRLARLLRPVVQSMVMLSATPIQLRSDDLFNLLNLIDEDSFPFPTSFQYSLQENAPIVALRDRILSHVVTPTDFVETLREAVGGRIFGDNAQLEHLINHPPSAEDLSSPRGRSEIADQLDRINPLTKVVTRTLKRDVQEMRVQRDPVTVRVEMNPIEREFYDQVTEAVREFCARIDISEGFMLTIPQRQLSSCVAAACKGWLDRTEVDDEELESEVFELYGDAEDNEKRPNLGALLRTLVGIARRVGDHTALESVDSKYDMLVRNLKQYWAAYPGKKIVLFSFYRNTLHYLARRLAAEGIQSAVLHGGMDKHGVLRHFESTEGPDILISSEVASEGVDLQFSSLLINYDLPWNPARIEQRIGRIDRIGQEAEKILIWNFIYTHTIDERIYDRLLERLDIFRQALGSMEAMLGTEIRTLSYELLSHKLTPEQEQERIDRASLAIERVSRQQALLEEEATQLIAHGDFIQNKVQAAKELGRFIRGEDLLAYVKDFLEREFPGTRLLADDDDELEHVIELSTEARVAFSEFLQQQRLQGATRLLGAAPPRLIFENRHGRNPSGKERITQDHPLVRFVADELKKAGKGPLYSPVAAVEILGNTVGNIERDIYVYAIARWTVSGARDIERLEYLVQRLADGWLLDGEQAEFLVNAAGLQGRDWLGASTSLNHAHTAGVLDDCRAELEERFRAFRDAQIRENRDRVSFMVNTLRHHLDNQRRRFHERIEKYRLHGTDKQRRLIPAEEGRLKKLTQRIEARIAELRLKESIQAHDSMVSGGVIRVV

SEQ ID NO: 3498 - protein, 972 aa, Halopiger xanaduensis
MTNSTQFSPGQRVILNGAPAEVIKTQTVGEIEYLRAYIDGEGAKTVCLDDVEIQPHRSGIEELSNQQIDDFHPDHDAVSAQWFDLHTQATKLKLAHEQGQLLSISNSLVRLEPYQLDAVNWVMQKLRQRALIGDDVGLGKTIEAGLILKELAARNRADRVLFVVPAHLQKKWIRDMDRFFDVDLTVADRAWVEGERRRLGEEANIWNQDQQQLVTSMAFLRQDEFRPALRDAFWDVVVVDEAHKAAKRGDSPSKTANMVDTVTGNSDSLLLLSATPHDGKGEAFRSLVEYIDPFLVAENRELSQETVDRVMIRRGKTDIYDEDGERVFPDREVNSVSVSMTHDERQFYRAVTDYVKNVYNRSEKLNEPAVGFAMALMQKRLVSSVGAIHATLRRRLDDLLDEEAETDGLSEEARAYLDGEDLDEDDKQHAEDEIAGLTVTSTDEQLQEEIDTLRDLVSLAEDLPVDSKAQKVRRFISQLLEEQPDEKLLLFTEYRDTLDYLLEYVQDEPWADEILVIHGDVDKEERARIEDEFNHGQPRLLFATDAASEGIDLQHSCHIMANYELPWNPNRLEQRIGRIHRYGQEEEVKVWNFLFDDTRESEIFEMLQTKVEEIRSQLGNTADVLGILDDIDVDSLIMESIENDEPPSATKEELEEMIEERQRTLEEWYERSLVDTSTFDAESRRQIQEVVDESEDVYGSEGDIREFFERAVEAFGGEFEKRGTNLYQAELPDGINSPGQDATFGPFTFDRDFAMDHEDITYLAPDTDVLQRLMARVLEDERGEVGLKLLPFVDTPGITYNYRVAFEDGTGDVIREETIPVFVDAAQEDAQQALGERVVEGDSVAAKPDVDDLRTVLDAQSDLRTAADRYVSVRVNEIKNHLQEKRHEETARELENLEEYAQAERERIESFIEEYERKADAGSDMDIAIRGQQERLEQLEDRIEKRREELRRREQIISLAPEVENYCLTLPL

SEQ ID NO: 3499 - protein, 971 aa, Halorhabdus utahensis
MTDTTFSSGQQVILNGTSAEVIQTRTVGDIEYLRAYIDGEGVKTVCLDDVDIQPHQTGLETLSGQQLDDLHPDHEAVSAQWFDLHTQATKLKLAHEQGQLLSISNSLVRLEPYQLACVNWVMQKLRQRALIGDDVGLGKTIEAGLILKELSARNRADRVLFVVPAHLQKKWIRDMDRFFDVDLTVADRAWVEGERRRLGEEANIWNQDQQQLVTSMAFLRQEEFRSALRDAFWDVVVVDEAHKAAKRGDSPSKTANMVETVAGNSDSLLLLSATPHDGKGEAFRSLVEYIDPFLVAENRELSQETVDRVMIRRGKTDIYDDDGERIFPDREVNSVSVSMTHDERQFYRAVTDYVKNVYNRSEKLNEPAVGFAMALMQKRLVSSVGAIHATLRRRLNDLLDEQTATDELSEEAEAYLDGEDLDEDDKQRAEDEIAGLTVASNDEQLQEEIDTLRDLVSLAEDLPVDSKAQKVRRFISQLLEEQPDEKLLLFTEYRDTLDYLLDFVQDEPWAEEILVIHGDVDKEERARIEDEFNHGQSRLLFATDAASEGIDLQHSCHIMANYELPWNPNRLEQRIGRIHRYGQDREVKVWNFLFDDTRESEIFEMLQTKVEEIRSKLGNTADVLGILDDIDVDSLIMESIQNDEPPSATKEELEDLIEERQRTLEEWYERSLVDTSTFDAESRRQIQEVVDESEDVYGSAGDIREFFEQAVEAFGGEFEKRGTNLYQAELPEDIRPPDEDATFGPFTFDREFAMEHEEITFVAPDTDVLQRLMARVLEFDRGDVGLKLLPFVDTPGVTYNYRVAFEDGTGEAIREETIPVFVDAEQRDAQQGLGERVVEGETVSAKPGVDDIRTVVDAEDELREAADRYVSARVNEIKSDLSSKRHEETARELENLNEYAQSERERIESFIEEYERKSEAGSDMDIAIRGQRERLEKLEERIETRRQELKRREQVISLAPEVENYCLTLPL

SEQ ID NO: 3500 - protein, 969 aa, Halorubrum lacusprofundi
MQDLAPGDTILLNDNPAEVIKTYSVGNLDYLRAYVEDVGVKTVCIADVDIEPQREQLGALEPMTADQLHPDHDAVSAEWFDLRSQALQLQIAHEQGQLLSISNSLVRLEPYQLACVNWVMQKLRQRALIADDVGLGKTIEAGLILKELTARNRADRVLFVVPAHLQKKWIRDMDRFFDISPTPADRQWVEGERRRLGEETNIWDQDHQQMVTSMAFLRQEEFREELDDAFWDVVVVDEAHKAAKRGESPSKTSKMVERVADNSDSLLLLSATPHDGKGEAFRSLIEYIDPFLVAEDQDLSKEAVDRVMMRRGKQTIYDDDGERIFPNRDVGTIPVEMTHEERQFYRAVTDYVKNVYNRSEQLNEPAVGFAMALMQKRLVSSIGAIKATLSRRLANLVDQQSTTTNLSEEASAYLEGEDLDEQDQQKAEEELSGLTITESDAQLEEEIETLRDLVSLAEGIPVDSKAQKVRRYIQQLLEEQPNEKILLFTEYRDTLDYILDLVKDEPWADEILVIHGGVDKEDRTRIEDEFNHGQSRLLFATDAASEGIDLQHSCHIMVNYELPWNPNRLEQRIGRLHRYGQEKEVTVWNFSFEDTRESKVFEMLQDKVESIRGQLGNTADVLGMLDDINVDSLIMESIRNDEPASATKEELEELIDERQRTLAEWYERSLIDTTTFDEESRRKIQDVMDQSEDVYGSEADLREFFERGISALGGDVEKAGNNLFRAELPESLRRSRDGDPYGPFTFNREFAMDHEGIEYISPDAELVQELMQQVLDSEQGTVGIKLLPFVDDPGITYNYRVRFEDGTGEVIREEILPVFVDAAHRDPQQRLGQRVIGGDSIIGSPEEGRVRPLLEHEREIRTSADRYISQRVESLRDELQQRRREETQQELDDLEAYAEAERERIETFIADYERKAEAGTDMDIAIRRQRDRLSKLEERIEKRRRELRRKAQVISLAPEVENVCLTLPI

SEQ ID NO: 3501 - protein, 971 aa, Haloarcula hispanica
MTDSSFSSGQRVLLNGTPAEVIKTQTVGEIEYLRAYIEGEGVKTVCLDDVEIQPQQSGIEELANQRIDDLHPDHDAVAAQWFDLRTQATKLKLAHEQGQLLSISNSLVRLEPYQLDAVNWVMQKLRQRALIGDDVGLGKTIEAGLVLKELAARNRADRVLFVVPAHLQKKWIRDMDRFFDIDLTVADRAWVEGERRRLGEEANIWAQDQQRLVTSMAFLRQDEFRPALRDAFWDVVVVDEAHKAAKRGDSPSKTARMIDAVTGNSDSLLLLSATPHDGKGEAFRSLVEYIDPFLVAENQELSQETVDRVMIRRGKTDIYDEDGERVFPDREVNSVSVSMTHDERQFYRAVTDYVKNVYNRSEKLNEPAVGFAMALMQKRLVSSVGAIHATLRRRLDDLLDEEAETDGLSEEARAYLDGEDLDEDDKQHAEDEIAGLTVTSTDEQLQEEIDTLRDLVSLAEDLPVDSKAQKVRRFISQLLEEQPDEKLLLFTEYRDTLDYLLEFVQDEPWADEILVIHGDVDKDERTRIEDEFNHGQSRLLFATDAASEGIDLQHSCHIMANYELPWNPNRLEQRIGRIHRYGQEEEVKVWNFLFDDTRESEIFEMLQTKVEEIRSQLGNTADVLGILDDIDVDALIMESIENDDPPSATKAELEELIEERQRTLEEWYERSLVDTSTFDAESRRQIQEVVDESADVYGSEGDIREFFERAVEAFGGEFEKRGTNLYQAELPDGINSPGQDATFGPFTFDRDFAMDHEDITYLAPDTDVLQRLMARVLEDERGAVGLKLLPFVDTPGITYNYRVAFEDGTGDVIREETIPVFVDATQGDAQQALGERVVEGDSVAAKPDVDDLRTVLDAQSDLRAAADRYVSVRVNEIKNHLQEKRHKETAQELENLEEYAQAERERIEAFIEEYERKSDAGSDMDIAIRGQQERLAQLEERIETRRRELERREQIISLAPEVENYCLTLPL

SEQ ID NO: 3502 - protein, 969 aa, halophilic archaeon
MQDLAPGDTILLNDNPAEVIKTYSVGNLDYLRAYVEDVGVKTVCIADVDIEPQREQLGALEPMTADQLHPDHDAVSAEWFDLRSQALQLQIAHEQGQLLSISNSLVRLEPYQLACVNWVMQKLRQRALIADDVGLGKTIEAGLILKELTARNRADRVLFVVPAHLQKKWIRDMDRFFDISPTPADRQWVEGERRRLGEETNIWDQDHQQMVTSMAFLRQEEFREELDDAFWDVVVVDEAHKAAKRGESPSKTSKMVERVADNSDSLLLLSATPHDGKGEAFRSLIEYIDPFLVAEDQDLSKEAVDRVMMRRGKQTIYDDDGERIFPNRDVGTIPVEMTHEERQFYQAVTDYVKHVYNRSEQLNEPAVGFAMALMQKRLVSSIGAIQATLSRRLGNLVDQQSTTTNLSEEASAYLEGEDLDEQDQQNAEEELAGLTITESDAQLEEEIETLRDLVSLAEGIPVDSKAQKVRRYIQQLLEEQPNEKILLFTEYRDTLDYILDLVKDEPWADEILVIHGGVDKEDRTRIEDEFNHGQSRLLFATDAASEGIDLQHSCHIMVNYELPWNPNRLEQRIGRLHRYGQEKEVTVWNFSFEDTRESKVFEMLQDKVESIRGQLGNTADVLGMLDDINVDSLIMESIRNDEPASATKEELEELIDERQRTLAEWYERSLIDTTTFDEESRRKIQDVMDQSEDVYGSEADLREFFERGISALGGDVEKAGNNLFRAELPESLRRSRDGDPYGPFTFNREFAMDHEGIEYISPDAELVQELMQQVLDSEQGTVGIKLLPFVDDPGITYNYRVRFEDGTGEVIREEILPVFVDAAHRDPQQRLGQRVIGGDSIIGSPEEGRVRPLLEHEREIRTSADRYISQRVESLRDELQQRRREETQQELDDLEAYAEAERERIETFIADYERKAEAGTDMDIAIRRQRDRLSKLEERIEKRRRELRRKAQVISLAPEVENVCLTLPI

SEQ ID NO: 3503 - protein, 968 aa, Natrinema pellirubrum
MTDFDPGDTVLLNGRTAEVIKTYSVGDLDYLRAYVEDAGVKTVCIGDVEVEPKRDQLGELRSASAEQLHPDHEAVSAEWFDLRSQALQLQIAHEQGQLLSISNSLVRLEPYQLAAVNWVMQKLRQRALIADDVGLGKTIEAGLILKELTARNRADRVLFVVPAHLQKKWIRDMDRFFDINLTPADRQWVEGERRRLGEEANIWDQDHQQMVTSQAFLRQDEFQPALEEAFWDVVIVDEAHKAAKRGESPSKTSKMVERVAGNSDSLLLLSATPHDGKGEAFRSLVEYIDPFLVAEDQDLSKEAVDRVMIRRGKQTLYDDDGERIFPDREVNTVPVEMTHDERQFYRAVTDYVQNVYNRSEKLNEPAVGFAMALMQKRLVSSIGAIQATLSRRLGDLVDEQSTSTSLSEEASAYLDGEDLDEEDKQRAEEELSALTVTESDAQLEEEIETLRDLVSLAEGISVDSKAQKVRRYIQQLLEEQPDEKLLLFTEYRDTLDYLLDLVKDEPWADEILVIHGDVDKEERARIEEEFNHGQSRLLFATDAASEGIDLQHSCHIMVNYELPWNPNRLEQRIGRLHRYGQDKEVKVWNFTFEDTREGEIFDMLQNKVENIRGKLGNTADVLGMLDDINVDSLIMESIQNDEPASATKEELEELIDERQRTLQEWYERSLIDTSTFDQESREKIQEVMDESEDVYGTEADIHEFVERGVEALGGDVEKAGSNLYRAQLPRSLRQGTDEEYGPFTFSRDFAMDHDGIDYVSPDDDLVQRLMQQILDGEQGDVGLKLLPFVDEPGIAYNYRVTFEDGTGEVIREDMIPVYVDARHHDPRQRMGQRVVQGDSIKGSPDADRVRSLIQSQDQLREAADRYISQQVTSLREELHERRREETQQELDDLEEYAEAERQRIEEFIENYERKAEAGSNMDIAIRGQQERLNKLEQRIEDRRQELQRKARVISLAPEVENVCFALPV

SEQ ID NO: 3504 - protein, 933 aa, Acidothermus cellulolyticus
MGVDHLGDWCYSPEHGELCRVIETQTLWGETVCRVWLPGKDAVVRVPAARLRPVQEASVGTVDGIAYLAAAARVADALTQDVLLAPIESSVIPLPHQIRALSRAVSNDRVRYLLADEVGLGKTIEAGLIMRELKLRGLVRRTLVIAPKGLVTQWVAEMRTHFGEEFRLLIPSDFSAYRRIAQEDNLWQSHPQVVCPMDSVKPLDGRRGWSREQVAEYNRERFEDLISAGWDLVIVDEAHRLGGSTDQVARYKLGQGLAEAAPYLLLLSATPHQGKTDAFHRLISLVDAQAFPDVSSVTKERVQPYVIRTEKRRAIDAEGKPLFKPRRTELAPVSWEDRHRDQRLLYEAVTEYVREGYNQAMREKRSYIGFLMILMQRLVVSSTRAIRTTLERRLEALEAPQEQLTLFPMVSEEEWADLDGQEQMDTLLKTRLEALTNERAEVKLLLEAAKRCESQGPDAKAEALLDWIYRLQAEKGDPDLKVLVFTEFVPTQEMLYEFLTERGFEVVCLNGSMDLEERKRVQDTFAKDARILISTDAGGEGLNLQFCHVVINYDIPWNPMRLEQRIGRVDRIGQTHTVRAINFVFEDSVEHRVCEVLEEKLAVIFEEFGIDKTGDVLDSAQAGQIFDDLYVEAILNPDVVETKVDEVLKSIQEQARESRQSVSVLGSVEDLDPGEAQRLLAHPLPHWVERMTVSYLQAHGGKAERKNGAWDLTWPGGEQLSNVVFTSKEAAERPLSRHVTLENPKVRGLAMRLPPFAPGQPVPVITLPGLAQEIMGFWSLWRISISTADWNRRRIMPLFLADDGRVFAPTARHIWDQLVVTKPTILRHLDVETSHQAFEQLLEPAERQGKTIYDELVQAHRERLAREREKGEYAFAARRRAIERIGLPQVRNHRLSLLEQEEERFHEQLERRAQILPEMAPLLLVRVEGGTHG

SEQ ID NO: 3505 - protein, 933 aa, Anaerobaculum mobile
MEINNTEWYYNSDHNGLCRVIETQTLWGETICRVWMPNKNAVVRISASQLKPLSEITIDNKHRIAYLAFAAKVVDALTQDVLLAPIESQVIPLPHQVKALSKAVSSNWVRYLLADEVGLGKTIEAGLIMRELKLRGLVKRTLVVVPKGLVAQWIAEMRFHFKEEFRFIIASDFSAYRRIASQENLWQIHPQVICSMDSVKPLDNRRGWSMEQVAEYNKERFENLISAGWDLIIVDEAHRLSGSTDQVARYKLGLGLSEAAPYLLLLSATPHQGKTDAFHRLLSLLDAQAFPDVNSVSKDRVQPYVIRTEKRKAIDVQGQPLFKPRYTQLVSVSWEDCHRQQKLLYEEVTEYVREGYNKAKLEKRNYIGFLMILMQRLVVSSTRAIRTSLERRLEVLEEPLEQLSLSPAIIEEDWADLDGQEQADIAIRLRSEALKDEKTEVSRLLDLAKDCESQSYDAKAEALVSWIYRLQADEGDPGLKVLVFTEFVPTQEMLYEFLTERGISAACLNGSMDMDERVRVQKAFAEDVRVLISTDAGGEGLNLQFCHVVINYDIPWNPMRLEQRIGRVDRIGQSRMVRAFNFVFDDSVEKRVREVLEEKLDVIFQEFGIDKTADVLDSAQAGQMFDDLYVEAILNPENVETKVDEVVKSIRQQAMESKQSASLLGSAEDLNPREAQQLLAHPFPYWVEQMTINYILANGGMAEKKDGAWDLTWPDNEKMANVVFDKEEMIKNPSKYYLTFEDPKIRALTMNLPPFVPGQPIPIIAVQGLPLEIVGFWSLWRISISTVDWNRYRVMPLFLADGGQIFIPTARHIWDQLLTTYPRIICHMDVDSSRLAFEQLWKAGEQQGKFIYDELLQAHKRHLIWEQEKGEYAFDARRRIIMRIGLKQVRNHRLKILEREERYFHEELKLKAKVMPEMVPMLMARIEGETADG

SEQ ID NO: 3506 - protein, 921 aa, Bacteroides vulgatus
MKYNGKSVEIIGSKTLFGKDTVWIHILEDNTFVQVLRSDLEDDITDDKKIGMSYVRYVAIAARIKEEMAQKRLLAPYESSLIPLPHQILVLEKVMQGIQTRFLLADEVGMGKTIEAGLIIKEKKLRGELKRILLVVPKSAMLQWQQELKEHFNESFYIYDSEFISGMARTFASFEAEEELNFWKQHNQIIVSTDALKPLIARQGWTQDKIDEYNKYRLEAVVNADFDMLILDEAHRMGGSTALVSRYQMAETLCNSVPNVLLLSATPHRGKSDHFRRVLQLIDSDAFTGEGTPSIQEIEPYIMRSEKRNAVDYDGKKLFQPRNTVRINVNLDNDQHRLQIALYKHVTEYVRYCFGKAKHGNRNATGLVMVMMQKLASSSTAAILSAMQTRLWRLQNGCVDDISNYDEEETVDFEDLNTEDYSVEYPNANYINEETALAELIAEAQNCIAYEQDAKTTALIQNIYSLQDKYNDSKLKILVFTEFRKTQAYLNEQLEKAGFTTVGINGNMDLQERQKALIKFKNNAQVMIATDAAGESLNMQFCNIVFNYDLPWNPMAIEQRIGRVDRIGQKHPVIAYNMLTNNSVDTRVYEIIVEKLDAILNELGIDKSGDVLDSTINMKDVNHLYLQSLLDPKRFEFASESWLYEIRQKLHDYKATEGLLPAFSEQDIVKESAGEVKYSPLPVWLEELLNLYAISENGKINKLLTGVTEYEINGQKINACFDSSSIGFNPECEHLTLQHPYIKRLLDGIDGNSQKKIPVITSHDGNDINGFLTVWKISAKNNYETKTTYSAQFVADNGKVYAPYGNDVWNRLVQTKDAFEYCGEMPYNLDFDNNSILQNNLHAVFHRMECEIENNLKSIFEKKVRAIDYSEQRISKIGISNIRNSKLKRLKEERKNWQAAFEKSKSIIPDVTMILTVRVNG

SEQ ID NO: 3507 - protein, 966 aa, Chloroflexus aggregans
MFAEGDWVLVHPQNAVGKIIEQRCLWGNTFFRVWLPSTDSIIRVNAANLLPVQSIVLSPHHLIYLTAATRIADALSQDVLLAPVESSVIPLPHQLRALSRAISTDRVRYLLADEVGLGKTIEAGLIMKELKLRGLVRRTLIIAPKGLVTQWVAEMAMHFNEQFHAILSEDYKSLKRIAAIAKTEARGMRTTSLEPSSLISPPSSIFTANANPFTAFDQVVVSMDSVKPPSNADSAAWERFEDLISAGWDLVIVDEAHRLGGSTDQVARYRLGQGLAEAAPYLLLLSATPHQGKTEAFYRLIALLDSQAFPDVNSVTKERVQPYVIRTEKRRAIDAEGKPLFKPRRTELAPVSWEERHRDQRLLYEAVTEYVREGYNQAIREKRNYIGFLMILMQRLVVSSTRAIKTTLERRLEVLSAENSRLSQRELFDAALNADDFYDLDGEEQLQLLLRTRIQGIRDEQTEVTLLLELARRCEAQGPDAKAEALLDWIYRLQAEEGDPNLKVLVFTEFVPTQEMLYEFLTQRGFTVVCLNGAMDMAARKQVQDAFANNARILISTDAGGEGLNLQFCHVVINYDIPWNPMRLEQRIGRVDRIGQTHTVRAVNFVFQDSVEHRIREVLEQKLAVILEEFGIDKTGDVLDSAQAGQIFDDLYVEAILNPAEVEQKVDEVLNSIRAQAQEFRQSTALLGATEDLDPHEAERLLAHPLQHWVEAMTTAYLRSVRDEGRSANGKKPGAEPIGKEGSHTIWHLIWPDGHEETVCFTHTTLRTPHLGLEDPRVLGLAMRLPSFVPGQPIPVITLPNLAAEIVGFWSLWRIAISTTDWNRRRIMPLFLTDNGRVFAPTARRIWDHLVVANPTILRHLDSETSYHIFERLWEAAEQQGNAIYHELVQAQREHLAREREKGEYAFAARRRVIERLGLPEVRSYRLRRLQQEEEQFREQLERSSQILPEMVPVLIVRVEPDQDGG

SEQ ID NO: 3508 - protein, 966 aa, Desulfovibrio aespoeensis
MNSSIWQYSTVHNSACKVIEEQTLWGQTVCRVWLPNQDAVVRVPRSALRPLSADLQPEIEAGRIAYVAAAAKVAEVLEGSTSATEGHVLLAPMESNVIPLPHQIHALSRAISGDRVRYLLADEVGLGKTIEAGLVMRELKLRGLVRRTLVVSPKGIATQWVAEMQTHFNEQFQLVLGDDIGTLQRLAPGADHRSSAWSMFDQVIVSLDSVKPMDKRRGWTAERVAEYNRSRFEDLITAGWDLVIVDEAHRLGGSTDQVARYKLGKGLAEAAPYVLLLSATPHQGKTDAFHRLMNLLDDDAFPDMDSVSRDRVAPYVIRTEKRKAIDADGKPLFKPRRTQMAPVAWESRHQLQQLLYEAVTDYVREGYNQALREKKRHIGFLMILMQRLVVSSTRAIRTTLERRLAALKDGEQQASLRLAELENGADGLESPDDEIAELYDMDGQELLDELLKSHVSALQSEGSHVETLLDAAVRCEQAGPDAKAEALIEWIYKLQAEENEPDMKVLIFTEFVPTQQMLKEFLEARGISVVTLNGSMAMEERGAAQDAFRKSHRVLVSTDAGGEGLNLQFAHVIINYDIPWNPMRLEQRIGRVDRIGQPKTVQAINFVFEDSVEFRVREVLEQKLSVIFDEFGIDKTGDVLDSAQAGELFEDVFASAILNPDGIETSVDHTVARIRDEIQQVRESSAIYGISEEPDVQTAERLRSHPLPHWVERMTVGYLNSHGGAASRKRSWWDLNWPDGQEHRKAVFSAREADRLTDATLLNLENSRVRGLALNLPQVAAGQPLPCVTVSGLPASISGLWGLFEIRLQAGMHQKTQLLRIPMVRRGYVSVFLSEEGKLFLPTARHIWDALQTAEAEVQATLGQDDSITAHERLQIAAEQAGQELFDALQQAHLAAVAREEERGIVSFASRRKAIERVGLPEVRQFRFSRCDADESEWRHELQSARQIVPEIRPLLMLRIIKGGAQ

SEQ ID NO: 3509 - protein, 965 aa, Dichelobacter nodosus
MESLWQYSTVHNSACKVIEEQTLWGQTVCRVWLPNQDAVVRVPRSALRPLNADLQPEIEAGRIAYVAAAAKVAEVLEGSTSATEGYVLLAPMESNVIPLPHQIHALSRAISGDRVRYLLADEVGLGKTIEAGLVMRELKLRGLVRRTLVVSPKGIATQWVAEMQTHFNEQFQLVLGDDIGTLQRLAPGADHRSSAWSMFDQVIVSLDSVKPMDKRRGWTAERVAEYNRSRFEDLITAGWDLVIVDEAHRLGGSTDQVARYKLGKGLAEAAPYVLLLSATPHQGKTDAFHRLMNLLDDDAFPDMDSVSRERVASYVIRTEKRKAIDADGKPLFKPRRTQMAPVAWESRHQLQQLLYEAVTDYVREGYNQALREKKRHIGFLMILMQRLVVSSTRAIRTTLERRLAALKDGEQQASLRLAELENGADGLESPDDEIAELYDMDGQELLDELLKSHVSALQSEGSHVETLLDAAVRCEQAGPDAKAEALIEWIYKLQAEENEPDLKVLIFTEFVPTQQMLKEFLEARGISVVTLNGSMAMEERGAAQDAFRKSHRVLVSTDAGGEGLNLQFAHVIINYDIPWNPMRLEQRIGRVDRIGQPKTVQAINFVFEDSVEFRVREVLEQKLSVIFDEFGIDKTGDVLDSAQAGELFEDVFASAILNPDGIETSVDHTVARIRDEIQQVRESSAIYGISEEPDVQTAERLRSHPLPHWVERMTVGYLNSHGGAASRKRSWWDLNWPDGQEHRKAVFSAREADRLTDATLLNLENSRIRGLALNLPQVAAGQPLPCVTVSGLPASISGLWGLFEIRLQAGMHQKTQLLRIPMVRRGYVSVFLSEEGKLFLPTARHIWDALQTAEAEVQATLGQDDSITAHERLQIAAEQAGQELFDALQQAHLASVNREEERGMVAFTSRRKAIERVGLPEVRQYRLARCAAEENEWRHELQSARQIVPEIRSLLMLRIIKGGAQ

SEQ ID NO: 3510 - protein, 975 aa, Methanosalsum zhilinae
MIKEWQYSTIHNSPCKVIEEQNLWGNIVYRIWLPNQDTVVRVPQSALRPLTAEIQPEIEANRITYVAAAAKVAEVLEGGSHDSDGPVLLAPMESNVIPLPHQIRVLSRAVSGDKVRYLLADEVGLGKTIEAGLIMRELKLRGLVRRILVVAPKGLATQWVSEMHTHFNEDFQLVFGEDLATIKRIISGNHSRYWAQGTKLRFLDEPDELQHANPWRMFDQVIVSLDSVKPMDKRRGWSQERIDEYNRSRFEDLITAGWDMVVVDESHRLGGSTDQVARYKLGRGLAEAAPYLLLLSATPHQGKSDAFHRLMSLLDDKTFPDMDSVTRERVAAYVIRTEKRRAVDGDGNPLFKPRVTKMAPVTWEERHRSQQMLYEEVTKYVREGYNQALREKKQHIGFLMILMQRLVVSSTRAIRTTLERRLEVLKDIEIRTSQRLEEITDSGDEVDELYEMDGQELLDELLKSRISAMQNERIQVENLLETAYQCEQQAPDAKAESLIEWIYQLQAEENEADLKLLIFTEFVPTQQMLKEFLEARGISVVTLNGFMDMDERKKAQDDFCDKVRVLISTDAGGEGLNLQFCHVVINYDIPWNPMRLEQRIGRVDRIGQAKVVRAINFLFQESIEFRVREVLEQKLSIILNEFGIDKTGDVLDSAQAGELFEGIFASAILDPDNVEASVDNTVSKIREEIHEIRESSPIFGISEEPDLQTADRLRSHPLPYWVERMTVGYIKSHGGHAIRKRESWDLMWPDSKVPMNCTFNSHRSQLKDDVVLLNLEDNKIRGLALNLPMIASGQPIPCVSIDELSSKISGFWGLFEIRIVSGTYNSNHTMTIPQIRRRYLSVFVSDEGNIFLPTARHIWDIMQTAELKILHSLDHKASIDAYDKVTNAAESAGQALFNTLKQEHSSAIEHEEIRGHHAFEARRKAIGRLGLPEVRQYRLDKCISEENVWKKELEIAKETVPDIKPLLLMQIQRRD

SEQ ID NO: 3511 - protein, 940 aa, Methylacidiphilum infernorum
MRWIAESMFTPDQWAWSPEHREPCRIIESQTLWGETFCRVWLPGKDTVVRLPAARLRPMHEASVGTVEKIAYLAAAARVADALSQNILLAPIESSVIPLPHQIRALSRAISNDRVRYLLADEVGLGKTIEAGLIMRELKLRGLVRRTLVIAPKGLVTQWVAEMRTHFGEEFRLLIPSDFSAYRRIAQEGNLWQSHPQVVCPMDSVKPLEGRRGWSREQVAEYNRERFEDLISAGWDLVIVDEAHRLGGSRDQVARYKLGQGLAEAVPYLLLLSATPHQGKTDAFHRLISLVDAKAFPDVTSVTKERVQPYVIRTEKRRAIDAQGKPLFKPRCTELVPVSWEDRHRDQRLLYEEVTEYVREGYNQAMHEKHSYIGFLMILMQRLVVSSTRAIRTTLQRRLEVLEAPQAQEQPTLFTMVSEEDWADLDGQEQIDTLLKTRLKALKNERAEVKLLLEAAKRCEAQGPDAKAEALLDWIYRLQVEEGDPDLKVLVFTEFVPTQEMLYEFLTERGFKVVCLNGSMDMEERKRVQNAFAKDARILISTDAGGEGLNLQFCHVVINYDIPWNPMRLEQRIGRVDRIGQTHTVHAINFVFEDSVEHRVREVLEEKLAVILEEFGIDKTGDVLDSAQAGQIFDDLYMEAILNPDVVETKVDEVLKSIQEQARESRQSASMLGSTEDLDPREAQRLLAHPLPHWVECMTVSYLQAHGGKAERKNGAWDLTWPSGERLTNVVFTSKEAEEKPLSYHLTLEDPKVRGLAMCLPPLAPRQPVPVITLPGLSPEIMGFWSLWRISISTADWNRRRIMPLFLADDGRVFAPTARHIWDQLLTTPPTILRHLDIETSHKAFQRLREAAERQGKTIYDELVQAHRERLDREREKSEYALAARHRAIELIGLPQVRNHRLSLLKQEEERFREQLERRAQILPEMVPLLLVRVEGGTHE

SEQ ID NO: 3512 - protein, 972 aa, Moorella thermoacetica
MQPGILVRSTIYPEKGIGLVLGNEEFFDQVYVHVFFEKTRERLTLPLADLSPLHDPLAKMEAGSFSTASRFQLRWLVEQILAENSGEGLLAAGGFKIIPLPHQLLAVSFVLDQFKPRVLIADEVGLGKTIEAALIYEELKARGMVKRVLVVAPSGLCLQWREEMKTKFGEDFIIYDRSTVHSLKQLHGEMTNVWTLADRVITSLDFIKPKKITADLDERAARARRWHNEQVFAAAAAAWFDMVIFDEAHKLTKDMTGEETARYKAGHALVQAAPIVLLLTATPHQGDQHKFRNLLRLIDPYLFSGEGRITAEDVKKVTVRNNKRAVVDFHGNRLFKQRVATVCLIHRDEVADQVELDLYRAVTDYVTTFYELARQQNNFTMMFLLLIYQRMVSSSSPAILKSLSARLAALEELRRRAADQEPESEREEPDWDDLQELTAEEQLAELTRASAAPRAGIVIVPAALAAEIAALKKCLALAERATAGRNDIKFTRLLEIINELRIQENNPRLKFIIFTEFRETQAYLEERLTSLGYRTALINGAMSTTERIAQVERFRREADFLISTDAGGEGINLQFCHILINYDLPWNPMRLEQRIGRIDRIGQEHDVKVINLQLADTVENRVREVIENKLDTIRREFCAGEDKLADILGVLQDEFDFEKVYIEALLKQGRKAANLDALSWQIFERAREIVEEERLALPISNLAPEYVLASQRDLEKRAKRVQRLVEQYLQVYGASLHPYKLREGVYYFQDPRSGRRLHNVIFQQKYALANEGAELLSFQHPYMVELLAHLEDALREDTSAKLLVRERKFSGEKGFLFIYRLTLTNYLDPTVYYLVPCFVSFAGDTGRVNGRISRYFRDWEQLICTDLVTGEIPYNLKEAWQLARKAVQQEAEVLFFQAKERLEKRLRDEEEKFEKYYKDREAAIEKIAVDNIRAAKKKELEEDRKTRRQEWLRRRQLVPSLSLEQVAYVEFA

SEQ ID NO: 3513 - protein, 962 aa, Nitrosococcus oceani
MPWQYSTVHNSACKVIEEQTLWGQAVCRIWLPNQDAVVRVPRSALRPLSADLQPEIEAGRIAYVAAAAKVAEVLEGSTSATDGHVLLAPMESNVIPLPHQIHALSRAISGDRVRYLLADEVGLGKTIEAGLVMRELKLRGLVRRILVVSPKGIATQWVAEMQTHFNEQFQLVLGDDISTLQRLAPGADHRNSAWSMFDQVIVPLDSVKPMDKRRGWTAGRVAEYNRSRFEDLITAGWDLVVVDEAHRLGGSTDQVARYKLGKGLAEAAPYVLLLSATPHQGKTDAFHRLMNLLDEDAFPDMDSVSRDRVAPYVIRTEKRKAIDADGKPLFKARRTQMAPVVWESRHHLQQLLYEAVTDYVREGYNQALREKKRHIGFLMILMQRLVVSSTRAIRTTLERRLAALKEGEQQASLRLAELENSAGGSENTDDEITELYDMDGQELLDELLKSHVLALQSEGSHVETLLDAAVRCEQAGPDAKAEALIEWIYELQAEENEPDLKVLIFTEFVPTQEMLKEFLEARGISVVTLNGSMDMEVRGAAQDTFRKSHRVLLSTDAGGEGLNLQFAHVIINYDIPWNPMRLEQRIGRVDRIGQPKMVRAINFVFEDSVEFRVREVLEQKLSVIFDEFGIDKTGDVLDSAQAGELFEDVFAQAFANPDGIETSVDQTVTRIRDEIQQVRESSAIYGISEELNVQAAEQLRSHPLPHWVERMTVGYLNSHGGTASRKRSWWDLNWPDGQEHRKAVFNAREADRLTDATLLNLENSRVRGLALNLPQIAAGQPLPCVSVSGLPTSISGLWGLFEIRLQAGMHQKTQLLRIPMVRRGYVSVFLSEEGKLFLPTARHIWDALQTAEAQVQATLGRDESITAHERLRIAAEQAGQELFDALQQVHLAAVAYEEERGIVSFASRRKAIERVGLPEVRQFRLARCDAEESEWRHELQSARQIVPEIRSLLMLRIIKRGA

SEQ ID NO: 3514 - protein, 966 aa, Nitrosococcus watsonii
MEILPWQYSTVHNSACKVIEEQTLWGQTVCRVWLPNQDAVVRVPRSALRPLSADLQPDIETGRIAYVAAAAKVAEVLEGSTSATDGHVLLAPMESNVIPLPHQIHALSRAISGDRVRYLLADEVGLGKTIEAGLVMRELKLRGLVRRILVVSPKGIATQWVAEMQTHFNEQFQLVLGDDIGTLQRLATGTDQRNSAWSMFDQVIVSLDSVKPMDKRRGWTAERVADYNRSRFEDLITAGWDLVVVDEAHRLGGSTDQVARYKLGKGLAEAAPYVLLLSATPHQGKTDAFHRLMNLLDDEAFPDMDSVSRERVAPYVIRTEKRKAIDADGKPLFKPRRTQMAPVAWESRHHLQQLLYEAVTDYVREGYNQALREKKRHIGFLMILMQRLVVSSARAIRTTLERRLAVLKEGEQQASLRLAELENGAEGSESPDDEMAELYDMDGQELLDELLKSHVSALQSEGSHVETLLDAAVRCEQAGPDAKAEALIEWIYELQAEENEPDLKVLIFTEFVPTQQMLKEFLEARGISVVTLNGSMDMEERKQAQDAFRKSHRVLVSTDAGGEGLNLQFAHVIINYDIPWNPMRLEQRIGRVDRIGQPKMVRAISFVFEDSVEFRVREVLEQKLSVIFEEFGIDKTGDVLDSAQAGELFEDVFAQAFANPDGIDASVDHTMARLRDEIQQVRESSAIYGISEEPDVQTAERLRSHPLPHWVERMTVGYLNSHGGAASRKRSWWDLNWPDGQEYRKAVFNAREAEHLTDATLLNLENGRVRGLALNLPQLAASQPLPCVSVSGLPASISGLWGLFEIRLQAGMHQKTQLLRIPRVRRGYVSVFLSEEGKLFLPTARHIWDALHTAEAQVQATLGQDESITAHESLQIAAEQAGQELFDALQQAHLASVAREEERGVVSFASRRKAIERVGLPEVRQFRLSRCNADESEWRHELQSARQIVPEIRSLLMLRIIKGGAQ

SEQ ID NO: 3515 - protein, 941 aa, Parvibaculum lavamentivorans
MTGGGFDIGDWCWHTRQATPCRVVERLALWGEAAYRVWLPSKDAVLRARATELAVLSSVRPTVGQILHATAAAKLQDALEDNLLLAPIQSSVIPLPHQLYALNRAVGQDRIRYLLADEVGLGKTIEAGLVLRELKLRGRVKRILVVAPKGLVRQWQAEMRQHFGEPLHFVDPSSLAALRQWRGDSAEDNAWRMHDQVICALDSVKPLESRRGWSLDQIQTYNRERFEDLVSAAWDLVIIDEAHRMGGSTEQVARYKLGAALAEASPYLLLLSATPHQGKTDQFMRLMQLLDRDAFPDEGSVSHERVQPFVIRTEKRAAINAEGQPLFRPRLTRLHAVAWQARHAAQQQLYEAVTDYVRHGYNQALAAKQRHVGFLMILMQRLVTSSTAAIRATLEKRQAVLDTPQTQARLFDTLSPDEWADLDGEAQVDLALQANGLELEKSEVETLLALARSTEAAGTDAKAESLLELIYKLQQEEGDPALKVLVFTEFVPTQAMLADYLESRGFTVATLNGGMDMEARTRTLQTFAGDARVLISTDAGGEGLNLQFCHVIVNFDMPWNPMRIEQRIGRVDRIGQKHVVRALNFVLEDTVEHRVRQVLEEKLAVIAEEFGVDKAADVMDSAEVEPVFDELFVQSLQHPEAIERECDSVVSQLRTTLAESNRNSDLLAVPHDLDADQARKWRDHPAQFWLERAVVNGLAVRGGSATQDGSLWHVRWADGAETPQACFDARAAGENPAAEWLTMEDPRARAIIGDVPRFVAGQPLPVIRVTGLPDSVNGIWSLWEIGLAAPGANRKRFLPVFINDEGRPFVPTAKRVWDLLLTETVSVQSVADAEASVGWFKASFAVAGAQGEALFAALADEHRARIKEERDRATYAFDVRNQAIGRIGLPAVRQFRRRRLQSEHEARLAALDDMQSSVPELNAVAMVRIDAAAGKTSERAS

SEQ ID NO: 3516 - protein, 941 aa, Parvibaculum lavamentivorans; identical to SEQ ID NO: 3515

SEQ ID NO: 3517 - protein, 939 aa, Planctomyces brasiliensis
MSDADRPPTAGFTAGSWAFSQDHREPVRILESQTVWNHATYLVWRPTEEAVAWVQADRLTPLDKPETSAKGFDNIIYRIAAARVAEGLAEDVLLAPLEAGVIPLPHQLVALSKAMSGERVRYLFADEVGLGKTIEAGLVIRELKLRGLVKRVLVVAPKGLVAQWVQEMRTHFNEQFQLLSPSDFSAIRHLVTDDNIWRQFDQVVCPVDSVKPLERRRGWSRERIERHNQERIGDLIAAGWDLIVVDESHRLGGSTDTVARYKLGKALAEAAPYLLLLSATPHQGKTESFHRLMTLLDQDAFPDIGSIKHEKVAPFVIRTEKRRAINDRGEPLFMPRTTKLVPVQWEEKHALQEQLYEAVTEYVRQGYNQAMRDNRQYLGFLMILMQRLVTSSTRAIATALERRLEVLKSTTITQDDLNGDDADLPEEDSQEQLEELLAARIAGLKNEREEVKLLLETARRCKAQGSDARAEALLDLLYRTQQEENDPELKFLIFTEFVPTQKMLSELLEQHGFTNVCLNGSMDLESRQRVQREFSQDARILISTDAGGEGLNLQFAHVIVNYDLPWNPMRIEQRIGRVDRIGQKHRVKAFNMIFANSVELRVHQVLEEKLKTIYSEFGVDKTSDVLDSAESGASFEKVYADAILNPDDIENRVDQLMVDVRERAESEKAGKSLYDESPLDASLATKYVNHPIPFWIERMTTAYLRAEGGRVDEKPFAYDLEWPDGERMEDICFFGREAQDRGLNHISLENPKLRSLVEKLPRAIVGEPIPKIVLPGLTGQIQGYWSLWQIALRCSGRPQVRILPLFSHDDGRCLLPTARSIWEQLLQDGTRVQEQGVVEDGSEVFDRLQREAEQQGENLFRELHTKHKERLHHEREKGRYAFQVRRQALNRIGLPEVRQYRIKRLDEEERAWDADLRQQEQVFPELQPIVVLRVEAKDG

SEQ ID NO: 3518 - protein, 969 aa, Thermanaerovibrio acidaminovorans
MTLSVENNNWYYSPEHGELCRVIETQTLWGETVCRVWLPGKDAVVQLPATRLRPPHEAGVATVDGIAYLAAAARVADALTQDVLLAPIESSVIPLPHQIRALSRAISNDRVRYLLADEVGLGKTIEAGLIMRELKLRGLVRRTLVIAPKGLVTQWVAEMRAHFNEHFQLVLPDDIKTLSRISAVASPESRVSGQEDSQPVTRNSWTLFPQVVVPMDSVKPLDKRRGWSREQVAEYNRERFEDLISAGWDLVIVDEAHRLGGSTDQVARYKLGQGLAEAAPYLLLLSATPHQGKTDAFHRLISLVDAKAFPDVSSVTKERVQPYVIRTEKRRAIDAEGKPLFNPRRTELAPVSWKERHWDQRLLYEAVTEYVREGYNQAIAEKRSYIGFLMILMQRLVVSSTRAIRTTLERRLEALEAPQEQLTLFPMVSEEDWADLDGQEQMDTLLKTRLKALKNERAEVKLLLEAAKRCESQGPDAKAEALLDWIYRLQAEEGDPDLKVLVFTEFVPTQEMLMRFLTERGITVVCLNGSMDLEERKRVQDAFAKDVRILISTDAGGEGLNLQFCHVVINYDIPWNPMRLEQRIGRVDRIGQTHTVRAINFVFEDSVEHRVREVLEEKLAVIFEEFGIDKTGDVLDSAQAGRMFDEMYVEAILNPEKVEESVESVVARLQEQAREARTTASVLGATEDLEPGEAQRLLAHPLPHWVERMTVSYLQAHGGKAERKNGAWDLTWPNGERLTNVVFTSKEAEEKPLSRHLTLEDPKVRGLAMRLPPFTPGQPVPVITLPGLAPEIMGFWSLWQISVTSHESRVASRPDGLVTLDPGPETRRRRIMPLFLADDGRVFAPTARHIWDQLLTTPPTILWHLDIETSHQAFDQLRGAAERQGKTIYDELVQAHRERLAREREKGEYAFAARRRAIERIGLPQVRNHRLSLLEQEEERFREQLERRAQILPEMAPLALVRVEGGVHG

SEQ ID NO: 3519 - protein, 894 aa, Thermoanaerobacter brockii
MFKVGDWVFDIDKKRAMKIIDVFELWGYVSYSIYDPIEKVTYTVSDKRLVSTEKKNDFDLNYFKYVIIASRISNELAQGFLSSIGGSIIPLPHQMYALNRALSKSTVRYLLADEVGLGKTIEAGLIIKELKARGLVKRILIISPKGLITQWHDELELKFNEDFKIILPQDFEVLKRIYGEGNIWDKFPQVITSLDSVKPVEKRQGWTKERIKEFNKERMENLVMAGWDIIVVDEAHRLAGSSSDVARHKLGIELSKASPYLLLLTATPHQGKTDSFLRLMRLIDKEAFPNEKAIVREQVAPYIIRTEKREAVDRDGNPLFKKRITKTVNISWEIKHSLQRELYEKVTKYVAEGYNRAKKEKRYYIGFLMVLMQRLVTSSTHAIKVNLENRLEFLKNEVVGVESIEEDMFFEYDAQKVLDELLKIKSLDIKKEIDELEELLRLAKQAESQYIDAKAEVLIDFIDQLSMEYKNSQKFIVFTEFLATQQYLKDFLESKGYKVAILNGSMSMEERDASLKEFKNYKDVLISTDAGGEGLNLQFCNIVINYDLPWNPMKIEQRIGRVDRIGQERDVLVLNFMLKDTVEFRVREVLEEKLRVIYEQFGVDKMGDILDSVQSEMDFTELYMRSIEMPEDIEYNVSIMEDKIKEKAEQINRIKGLLREEKELDLNVVSKISGLPINEWIRDMYINKMAAEGVEISIDMLDENLISLNNEEIKNMIKNLPVYIKSSKIPILYLKDVSNEEGYWSLWEISINGDSEKFRHVFPVFLNKDKKVRIASANLMWDIFLKNEKEVIFKGYKSIDEKMYDFIHDTAKNIAYDYFEKIKKNYFENLLKEKERYEYAFKLRKEAILRIGLEAVRRRRLVELENEERRWKEEIEKSMDILPMLKPLYIVYLE

SEQ ID NO: 3520 - protein, 894 aa, Thermoanaerobacter pseudethanolicus; identical to SEQ ID NO: 3519

SEQ ID NO: 3521 - protein, 893 aa, Thermoanaerobacterium saccharolyticum
MYSVGQWVFDCEINRYVQVVSSNELWGYKTYNVYDPIDKSLRLVSDEVLRHYSQRDDFDIHYFKYIVISSRVFNELSNGILSPIGGSIIPLPHQIYALNRVLSDSKIRYLLADEVGLGKTIEAGLIIKELKARGFIKRILIISPKGLINQWHDEMKNKFDENFNILLPQDFDAIKRLYGDGNVWRKFDQVITSIDSVKPLEKRQRWTEEDIEKYNKERIEDLANAGWDIIIADEAHRIAGSSSDVARYKLGKVLADASPYLLLLTATPHQGKTDSFLRLVRLLDKNAFPDENAIVREQVVPYIVRTEKREALDSEGNPLFKNRITKTKNISWSARHSLQKELYEKVTEYVSKGYNLARREKKNYIGFLMVLMQRLVTSSTHAIKENLERRIEILKNSGTSSNNFDEDDFYEYDAQEALDELIKIKYQDIKKEQREVEDLLHLAERAESQYVDVKAETLLEDLDLLQMEHSEKPKVIIFTEFIATQEFLRNFLQEKGYSVAILNGTMSMEERNNAIDEFKKSADILVSTDAGGEGLNLQFCNIMINYDLPWNPMKIEQRIGRIDRIGQKRDVVVINYVLSDTIEFRVRQVLEEKLKIIFEQFGVDKMQDILDSVQSEMDFTDLYMKSIENPDDIDFIVSEVEIKIKENAEKINNIKGILKDEKELNIEMIEKINNTPIKHWLKQMYINKKLSDGDKITMFIDDDFLSLNNKDLEDMVKNIPQYIYDGKIPVVSIDGVPNENGYWSLWEVGINGYNNSFKRIFPLFINKSGVLRIASANMLWDIFLKDDVSIIFERFEDLSEENYNMIFEKAKNIAFDKFEELKKSYFEKCEKDLNRYKYALKLRREAAERIGLDAVKRYRLKEIEKEENELNQKMRDYEKILPVLNPLFIIELL

SEQ ID NO: 3522 - protein, 893 aa, Thermoanaerobacterium thermosaccharolyticum
MYSVGEWVFDCEKGRYVQVVSSNELWGYKTYNVYDTIDKSVYLVSEDVLRHSSQRSDFDIHYFKYIVISFRVFNELSNGILSPIGGSIIPLPHQIYALNRVLSDSKIRYLLADEVGLGKTIEAGLIIKELKARGFIKRILIISPKGLINQWHDEMKNKFDENFNILLPQDFDAIKRLYGDGNVWRKFDQVITSIDSVKPLEKRQRWTEEDIEKYNKERIEDLAAAGWDIIIVDEAHRIAGSTSDVARYKLGKVLADASPYLLLLTATPHQGKTDSFLRLVRLLDKKAFPDENAIVREQVAPYIVRTEKREALDSEGNPLFKNRITKTKNISWSARHSLQKELYEKVTEYVSKGYNLARREKKNYIGFLMVLMQRLVTSSTHAIKENLERRIEILKNSGTSSNNFDEDDFYEYDAQEALDELIKIKYQDIKKEQREVEDLLHLAERAESQYVDVKAETLLEDLDLLQMEHSEKPKVIIFTEFIATQEFLRNFLQEKGYSVAILNGTMSIEERNNAIDEFKKSADILVSTDAGGEGLNLQFCNIMINYDLPWNPMKIEQRIGRIDRIGQKRDVVVINYVLSDTIEFRVRQVLEEKLKIIFEQFGVDKMQDILDSVQSEMDFTDLYMKSIENPDDIDFRVSEVEIKIKENAEKINNIKGILKDEKELNIEMIEKINNTPIKHWLKQMYINKKLSDGDNITMLIDDDFLSLNNKDLEDMVKNIPQYIYDGKIPVVSIDGVPNENGYWSLWEVGINGYNNSFKRIFPLFINKSGVLRIASANMLWDIFLKDDVSIIFERFEDLSEENYNMIFEKAKNIAFDKFEELKKSYFEKFEKDLNRYKYALKLRREAAERIGLDAVKRYRLKEIEKEENELNQKMRDYEKILPVLNPLFIIELL

SEQ ID NO: 3523 - protein, 893 aa, Thermoanaerobacterium xylanolyticum
MYSIGQWVFDCEKGRYVQIVSSNELWGYKTYCVYDPIDKSLRLVSDEVLRHYSQRDDFDIHYFKYIIISSRVFNELLNGILSPIGGSIIPLPHQIYALNRVLSDSKVRYLLADEVGLGKTIEAGLIIKELKARGFIKRILIISPKGLINQWHDEMKNKFDENFNILLPQDFGAIKRLYGDGNVWRRFDQVITSIDSVKPLEKRQRWTEEDIEKYNKERIEDLTNAGWDIIIVDEAHRIAGSTSDVARYKLGKVLADASPYLLLLTATPHQGKTDSFLRLIRLLDKKAFPDENAIVREQVAPYIVRTEKREALDSEGNPLFKNRITKTKNISWSARHSLQKELYEKVTEYVSKGYNLARREKKNYIGFLMVLMQRLVTSSTHAIKENLERRIEILKNSGTSSNNFDEDDFYEYDAQEALDELIKIKYQDIKKEQREVEDLLHLAERAESQYIDVKAETLLEDLDLLQMEHSEKPKVIIFTEFIATQEFLRKFLQEKGYSVAILNGTMSIEERNNAIDEFKKSADILVSTDAGGEGLNLQFCNIMINYDLPWNPMKIEQRIGRIDRIGQKRDVVVINYVLSDTIEFRVRQVLEEKLKIIFEQFGVDKMQDILDSVQSEMDFTDLYMKSIENPDDIDFRVSEVEIKIKENAEKINNIKGILKDEKELNIEMIEKINNTPIKHWLKQMYINKKLSDGDNITMLIDDDFLSLNNKDLEDMVKNIPQYIYDGKIPVVSIDGVPNENGYWSLWEVGINGYNNSFKRIFPLFINKSGVLRIASANMLWDIFLKDDVSIIFERFEDLSEENYNMIFEKAKNIAFDKFEELKKSYFEKFEKDLNRYKYALKLRREAAERIGLDAVKRYRLKEIEKEENELNQKMRDYEKILPVLNPLFIIELL

SEQ ID NO: 3524 - protein, 949 aa, Thermobifida fusca
MSPAAAAAFAPGSLVAGRGREWVVLPSTEEDFVLVRPLNGDEAFTTLLYRDEVTPAEFPAPSTELSQIGDHVSASLLRTAMRVGCTSPALPLRCLGSIRVQPRRYQFVPLLLALRMETVRLLIADDVGTGKTVEAALIAKELVERGEARRMAVVCPPALAEQWQAELRDKFGIEAELVLPSTVRCLERPLRADQSVFKTYPYTIVSTDFITSEQRRAQFLTHCPDLVIVDEAHTWVNASPTRLRQQRQELLRNVAAQQDRHLILVTATPHSGRENAFHDLLGMLTPELAEADCRSRRGRALLARHCVRRHRRDIQRFLDQETVFPQGREFRDEKYEWSPAYAEFNAEVLAYAREAAADPSGTKLQQRVRWWSALALLRSVVSSPAAAAAALRTRSTTFSAARSAADVDALARESVYDADSAATEGGDAVPGAAVDPDTLPESTRRRLRALAERAEKLQGVEHDAKLRALIATVKGLLADGCDPVVFCRYIPTAHYVAEELRQALPKNCAVEAVTSELPPREREDRVAHLAATDRRRVLVATDCLSEGVNLHELFPAVVHYDMAWNPVRHEQREGRVDRFGQRAKRVRVVTLYGADNGIDGPVRDVLLRKHRTITAQAGGAVPVPTSSESVLQALAESLLLCGPHPQLGRTPGLAEASAVLHRERELVSEPAPHQGATFAPSTGDVPDVVEHLERLIPAIDDELGRPRDIASFVARVFTRLGVPVHADAGKLTVPPQSLPPGVRAALGVADTAHQDLVFRRDLPAGPHEHVLVRTDPAVRALARYVVETAFEPDPGTRPVVQRCGVTWTGRVTVRTVLLLVRYRFLLTLPGVDGPRTVVVEEARIRGYRAGAHGREWLTDAETAALVDTPPDADLPPELVQCHARRAVAELDEIRGDLAEWGVVRAEQLRHAHYGIRASAGSRGQGLALVPHGRADVVGVYVYLPLGDAP

SEQ ID NO: 3525 - protein, 1057 aa, Geobacillus sp.
MLKVGEIIKGPFWPEIVEIKNCEKIDEDLYQVEAIGRKTNKYYDRYIEKYQLEQLETIKQEDSFFQPERLQHYLQYYILKTEERYSQSRARGNKKIIPLPHQIEAVYSRMLQSPQVRYLLADDPGAGKTIMSGMLIRELLARGRAERILILVPPLVLKQWQEELKEKFGEEFIIVNRNFLNSSNEINPFETYDKIITSLYWAARDEIKSLILKSRFDLVIVDEAHKMAAYTRGTKKRKVQRTKIFQLGEALLSHTEHCLLLTATPHKGDKENFRHLMSLIDHDIFSHLNNGESMYEKSNPFIIRRLKESMVNFDGTPLFPKRTTKTITFDLSPEEKEIYDKVTEYVRYHFNRAKQNNNQNVTFAMMILQRRLSSSFDAIYLSLVRRKEKLEELLYNEQKNQQVEVHDFDELAAEDQEEVEAQLEGETEAIDLHELQLEIDQLTNLIDKINILRQRDVERKYIELEKTLFGTNGLVAQGEKLLIFTESKDTLYYLERKLLAHVPEVAKIVGGFSMDQRRAEVEKFRNHVQIMLATDAGGESINLQFCNQMINYDIPWNPNRLEQRMGRIHRIGQKNEVFVFNLVAGNTREGDVLIRLLEKMEQMRTDLGQEQVYDFIGDVLKEQGVDLATLMEESISGRENLDELIAKMEKTLSDEHKRLIELANRERMDEQSFDLPGMRKTFQELLINSLPKRVYGEFVINQFQNTRIRMNISSDQSVCRINHFPKNIRELAKKQRILLKTEQSVRFALKPEVETEDIQLLQNDHPLYKLALELGGTETQQVTIPVAKVKANVPERIQIELDKVNVVDGTGRELEQSLILLGKRESGEWIEIDPYLLFNGRFEYISTMGIEDPSFKREAILHARKILQSVQLKRDEYLNKKSIYLRKSFDQQMRTLQERLMQFQQTNFDNKNSALINQTYSQIDDLEERSRERLEEIERERSIQLQPIKKIAQLILEPAKSDCSRIIPDDVFENVKLYEYANGRLNVRKRKAFGLVDFTSETSNEEKRYIIVTKSLNHLLETIRYEDYAGVEELVFIYVLDQQQRIVQEFNLIELKR

SEQ ID NO: 3526 - protein, 942 aa, Marinobacter sp.
MSKAKRRLLPVKNCWVKKVSSAEESILGRVVSSVDRGDDVIVSVKWQKTGQVSAESLSKLRSGFKLQMEVQDLPNSRVRTSLGEGVIQRVRTIGDCDQALVDFYQLGQQVWLPYENLRQIKGARHRFILGDTGPDDSAERFRLKSLAHALEIWNENTGSLSHLEIDPLPHQIHLVHHILASGHLNWLIADDVGLGKTIETGMLLAALKQRGQLKRVLLVTPAGLTKQWQEELNYKFKMGEFQIFGEDFTINEPRHWKMFDFVIASIDRLKIPENLERIQQAGKWDIIVFDEAHRLSRRQYGMKLEASQRFQLAANLRGHTDALILLSATPHQGMQDKFQALLELLHPERKEDIATLALNPEIIGEMVFRNNKADVTDAEGNFLFRGKTTSSVPVHVSEAAKEFDRKLQDYLRKGYAAGAALGVRGNAIGFVMTVYRKLAASSVAAIHQALINRKARLEGELVKGFKLEELESQDQRFFGEWEEQLHSDAREFFEGELEHLDELISEAGALRDDDRKLQGFADQLIAKILTPNSKEKVLIFTEYRATQAYIREILEKRFGEGSVELINGSMPHAQRRDAIARFEEGANFLVSTEAGGEGINLQRKCHIMVNYDLPWNPMRLVQRIGRLYRYGQKKRVVVFNLHSPDTADEQVMELMYTRIERVVDDLAGVSDEYNEQLRDDILGELADLLDVNQILEQATMEGITRTQERISDALDRAKSATEKQRELFEHAAGFNPNETDSSLRIDHEHGVAFVLGMFQMLDIEIVETTHEGRLFHIRLSESAQQELGISRSRYEVTLDRELVVNRPNTHMLDLDSFLMQFLLKKAKSYDFMGLSAVIKNQSLGQGALLTSLLRWQNDQGNRMRQEYTAYLVKPNGEVQTNPEAFGSWLKTKGFTGTLNSVSSENQVMFKQAELAADNRLKEVSNLNLHPENNQWVSGAWLG

SEQ ID NO: 3527 - protein, 969 aa, Natronorubrum tibetense
MTRDFESGDRIRLNGDPAEVIRTYEVGNLPYLRVYVEGGGAKTVCLDHVSTEPRSDALDTLDDQVTDLHPRHEAVSSEWFDLRTEALQLKMAHEQGQLLSISNSLVRLEPYQLACVNQVMQKLRQRALIADDVGLGKTIEAGLILKELEARNRANSVLFLVPAHLQKKWIRDMERFFDIDLTVADRQWVDAERRRLGEEANIWDQEGQRLVTSMAFLRQDEFQSEIENAFWDVAVIDEAHKASKRGESPSKTSLMAERVANHCESLLLLSATPHDGKGEAFRSLISYIDPFLVAEDQDLTRETVNRVMIRRGKETIYDDNGERIFPERDVQTATVSMSPAEEQLYERVTEYVREVYNRSDQLNEPAVGFAMALMQKRLVSSVGAIRETLRRRLHGLLEPDERGLSTDATAYLEGEDLEDSDREQAEQELERLTVAQGDEALQKEIDTLQELVAMAEDLPVDTKARKVKRYIEQLFEEHPDEKLILFTEYRDTLDYLLDLFADEPWADEILTIHGDVSKDERTRIEDEFNYGKSRLLMATDAASEGIDLQHSCHIMINYELPWNPNRLEQRIGRIHRYGQDKEVKVWNFQFDGTRESEIFELLQDKVEEIRSKVGATADVLGMLDDVNIDSLLMKSVQNQEPASATKEELEELMEEREQTLLEWYERSLIDCSTFDAESRQEIQSIVDDSEDVFGSEQEIREFFTRAIEAFEGSVEKRGNQLYEAEVPPEVTDSGQPETMGPFTFSRDFAIDHDGIEYLSPDADVLQALRDLVLQHGQHAGKAGMKLLPFVDQPGITFVYKVAFEDATGKTIREQLIPVYVDLAGLDAQRSLGERVLDADTIHARPDESTVSRLLKQRGDLEDAAERYISSMVADIREDLLETRQQDVQKELSDLEAYEQAERDRIQSFIDSYEQKATTGSDMRIAIRNQKQRLEQLETRIESRKAELRKREQVISLAPDIEAYCLTLPV

SEQ ID NO: 3528 - protein, 971 aa, Haloarcula argentinensis
MTESSFSPGQRILLNGTPAEVIKTQTVGEIEYLRAYIDGEGVKTVCLDDVGIQPQQSDIEELANQRIDDLHPDHDAVAAQWFDLRTQATKLKLAHEQGQLLSISNSLVRLEPYQLDAVNWVMQKLRQRALIGDDVGLGKTIEAGLVLKELAARNRADRVLFVVPAHLQKKWIRDMDRFFDIDLTVADRAWVDGERRRLGEEANIWAQEQQRLVTSMAFLRQDEFRPALRDAFWDVVVVDEAHKAAKRGKSPSKTARMIDTVTGNSDSLLLLSATPHDGKGEAFRSLVEYIDPFLVAENQELSQETVDRVMIRRGKTDIYDEDGERVFPDREVNSVSVSMTHDERQFYRAVTDYVKNVYNRSEKLNEPAVGFAMALMQKRLVSSVGAIHATLRRRLDDLLDEEAETDGLSEEARAYLDGEDLDEDDKQHAEDEIAGLTVTSTDEQLQTEIDTLRDLVSLAEDLPIDSKAQKVRRFISQLLEEQPDEKLLLFTEYRDTLDYLLEFVQDEPWADEILVIHGDVDKDERTRIEDEFNHGQSRLLFATDAASEGIDLQHSCHIMANYELPWNPNRLEQRIGRIHRYGQEEEVKVWNFLFDDTRESEIFEMLQTKVEEIRSQLGNTADVLGILDDIDVDSLIMESIENDEPPSATKEELEEMIEERQRTLEEWYERSLVDTSTFDAESRRQIQEVVDESENVYGSEGDIREFFERAVEAFGGEFEKRGTNLYQAELPDGINSPGQDATFGPFTFDRDFAMDHENITYLAPDTDVLQRLMARVLEDERGEVGLKLLPFVDTPGITYNYRVAFEDGTGDVIREETNPVFVDAAQEDAQQALGERVVEGNSVAAKPDADDLRTVLDAQSDLRTAADRYVSVRVNEIKNHLQEKRYGETARELENLEEYAQAERERIESFIEEYERKADAGSDMDIAIRGQQERLEQLEERIETRREELRRREQIISLAPEVENYCLTLPL

SEQ ID NO: 3529 - protein, 969 aa, Halosimplex carlsbadense
MNDLVPGEAILLNDQPAEVIKTYSVGDLDYLRAYVENVGVKTVCIDDVNIEPKREQLGTLDTATAGQLHPDHEAVSAEWFDLRSQALQLQIAHEQGQLLSISNSLVRLEPYQLACVNWVMQKLRQRALIADDVGLGKTIEAGLILKELTARNRADRVLFVVPAHLQKKWIRDMDRFFDISLTPGDRQWVEGERRRLGEEANIWNQDHQQMVASMAFLRQEEFRDELDNAFWDVVIVDEAHKAAKRGESPSKTSKMVERVADNSDSLLLLSATPHDGKGDAFRSLIEYIDPFLVAEDQDLSKEAVDRVMMRRGKQTIYDDDGERLFPNREVGTIPVERTHEEKQFYQAVTEYVKHVYNRSEQLNEPAVGFAMALMQKRLVSSIGAIQATLSRRLANLVDQQSTATSLSEEASAYLEGEDLEEADKQKAEEELAGLTITESDAQLEEEIETLRDLVSLAEGISVDSKAQKVRRYIQQLLEENPNEKVLLFTEYRDTLDYILDLVKDEPWADEILVIHGDVDKEDRANIEDEFNHGQSRLLFATDAASEGIDLQHSCHIMVNYELPWNPNRLEQRIGRLHRYGQEKEVKVWNFTFEDTREGEIFEMLQEKVENIRGKLGNTADVLGMLDDVDVDSLIMESIRNDEPTSATKEELEELIDERQRTLAEWYECSLIDTSTFDQESRERIQEVMDQSEDVYGSEADIREFFERGISALGGEVEKAGTNLFRADLPENLRRTTDGDLYGPFTFNREFAMDHDDIDYVSPDARLVQELMQRVLDSEQGSVGLKMLPFVDDPGITYNYRVRFEDGTGEVIREEILPVFVDAAHNDPQERLGQRVVDGDSIKGSPDGEPVQVLLENESEMRSSADRYISQRVESRRDELQKWRREETQQELDDLEAYAESERERIETFIADYERKAESGTDMDIAIRRQRDRLSKLEDRIEKRRQELQRKSQVISLAPEIENLCLTLPI

SEQ ID NO: 3530 - protein, 930 aa, planctomycete KSU-1
MGTGEWVYSIEYRQTCQIIDVQSLWDEVIYRVWLPIQDTIVRIPASRLKPLDEAVSNTPAHLTYTATAARLADALTHDILLAPIESRVIPLPHQMRALSQAINSHRVRYLLADEVGLGKTIEAGLIMRELKLRGRVKRTLVIAPKGLLTQWVAEMQVHFNEDFKLLIPGDFSAYRKIMAESNIWQSYDQVVCPMDSIKPLEGRRGWSKEQVAAYNQERFEDIIAAGWDLVIVDEAHRLSGSSEEVARYKLGQGLADASPYLLLLSATPHQGKTDAFYRLISLLDTLNFPGIESITKERVKPYVIRTEKRSAIDANGKPLFKPRQTRLIPISWEQRHKEQQLLYEAVTEYARKGYNQAIIEKKNYIGFLMILMQRLITSSTRAIRTTLERRLEILQGSDEQLTLPLTLSEDEWLELDGQEQINAFLATRLVALKNEREEVRLLLNAAKRTESSGPDPKAEALLDWIYKIQQEEGNPELKFLVFTEFVPTQEMLREFFKERGFSVVCLNGSMGMDERKVAQDNFSQKARILISTDAGGEGLNLQFCHVVINYDIPWNPMRLEQRIGRVDRIGQTHPVKAINFVLKGTVEHRVQEVLEEKLAIILKEFGVDKAGDVLDSLQAEQIFDDLYINAIIHPETFDDKIELVVTNVKEQVKSVRESTSILGSQEELNPLEARRLSEHPLPHWIETMTINYLKSHGGVAERKGKTWNLTWPSGEKMNNIVFTLDNAEGFPSARQLTLEDSCIRGVSMNIPPFVSPQPIPCLIFSDISTEIQGFWSLWKVAIQTSNWNRQRIMPLFLHDDGRILYPTARYIWDKMISNVYNVRHYLDGQESQDIFNKLWKTAEKQGRSQYEQLVQEHKEFLTQEINKWEYALTVRRKTIERLGLPQVRAYRLLHLEQEDRERREEINQKSKISPELVPLLLIRVGEKIDG

SEQ ID NO: 3531 - protein, 1063 aa, Bacillus cereus
MMKVGEIVSSSRFPESVEIKRCEAFGEYFIIEAIGQETNKYYEIMLEQEKIHDFKHLKQEKEVANLKALDVQRYIQYLLLKNEVKFSKTRALGNKNLLPLPHQIEAVYGKMLQVPHVRFLLADDPGAGKTIMSGMLIKELKARLSVERILVLVPPLVLKQWQEELEQKFDEHFHIINRVVLKEYGGKNPFISNRLCLTSMYWAMRDDVKALIQEAQFDLVIVDEAHKMAAYTHGTVKKKTFRTKLYQLGESLLRKTNHCLLLTATPHKGDSENFRHLMKLIDEDIFSSSKTTESLKEKTNPFIIRRLKENLKNFDGTPLFPKRTTKTIQFNLTDEELALYDAVTEYVREYFNRAMNNGSNSTAFAMMLLQRRLSSSTDAIYLSLKRRYSRLIKLYKQTEAERNKYIKKMKNLETENYLEEGSDIQEKLEKQLEKSIDVIDTKELKKELIVLKELIQQAENIKLYVVEKKYQELEETLFGASGLLNHDEKILIFTESVDTLSYLEEKLLKRVPKIAKIIGSLSMEQRRKQVEMFRNECQIMIATDAGGESINLQFCNQMINYDIPWNPNKLEQRMGRIHRIGQKNEVFVFNLVAQNTREGSVMTKLLDKMELMKSDLGSDLVYDFMGDILEDHYDSLADLMQQAVIKRENLDEVIAGMEKTLSEEHQKLLALMKEERMTEDNVDLTNLKREKNDLTVQLIPKRTFTDLATYVLEKKRVRIFKSQDGKVMRIERLPKFIRDYIPELQDYQGDSYRFTNSIEFEEAELPMITENHPLFNATLELMKKEVEGRTWHCYTVTAHVPENLYVEIYHVSIVDGTGEELENHYIHLARRESGEFITLDQGWIFANDFINNGFYTETDTTSQCMSEVMKQSIIVRDNILTKREKQLNKLVTFLEKTFNQQYRETLERLETYQQENLDNRNSALINQMNAQLIDLDIKKEERLNVIYRQKNISMKPPKRIISMKLMPNGVCDRVITKDYYEAVMSYERENGRLNIKMFNNLGLVDYYSERFNGEERYIILTENEEFIPSDFYKEDLTGILDKLYIYVIHNKKVISEKKMENVK

SEQ ID NO: 3532 - protein, 889 aa, Clostridium thermocellum
MLQIGDYVFDKTKNERVQILEISEVWGFVSYKVFNTSTGKVYKLSADDICAEIPEKHYNESYLRYVALLSKIKNKISQGILSKLSCGIIPLPHQLHVLNRALSNNNVRYILADEVGLGKTIEAGLIIKELKARGLIRRILIVCPTGLVTQWDMEMKEKFNEKFHVILPENYDAIRQITGNEDVYGQFDQVISPMDSIKPLERRAGWTEEKIAKYNEERIYSIINSGWDLIAIDEAHRVAGSSGEVARYKLGKLLAAASPYLLLLTATPHNGKTEPFLRLIRMIDEKAFPNADAVVKEQVAPYVIRTEKREAIDHNGNKLFKNRIIKVIEMHWDERHSMQRKLYEMVSDYVAKNYNKAMRNRGKNMWFVFLLIMMQRMVTSSTSAVRESMERRVRVLEEQAFKYQSMSEEEFAEMELEENMEEAIAAISLGIEEEITQLNDIIAVAKQAEFQYLDVKVEPLFEIIDDLFAEDRQRKIIIFTEFVATQSYLVKLLKDRGYSTSILNGSMSIEERNAVLHEFKTQTDILISTDAGGEGLNLQFSNCIINYDLPWNPMKIEQRIGRVDRIGQQRDVVVYNFILADTVENRVKTVLEEKLSVILREIGIDKYSDILDSETAELNFTDAYMQSIRNPNDIEFNIRRIEEDLKTQVKNTMQIRELIKEEKDLTSMIGAGSTFDFEHALRQMVTYYENYKGNPFLPIENFSINDPIIFEHLNKEIEQDWRMPLLSVSIKDFPNEKGYFMLWKISLISDSREQKVIPIFINCDFILRPMAGKKIWEAILDKDRIITVRKGEEIDTETKNKLYKVSQEFAYDTFLTMKAELEKRNEETYRKYLYALNLRIEAAQRIGIENIRKHKLMTLNREKAEIEANYQAGKKICPDFKPILIAYME

SEQ ID NO: 3533 - protein, 890 aa, Lachnospiraceae bacterium
MLEIGDFAFDTLSQANVQMLERIEVWGYVSYKVFNPATGKVYKATEEQLNPEGNTIRYDENYLRYVMQLSKIKNETAGGFLSSLASSIIPLPHQLHVLNRAMETNNIRYILADEVGLGKTIEAGMIIKELKSRGLVSRVLVVCPTGLVTQWGSEMQEKFHEKFHVILPSDYDTIRRLTDSNDVYGQFDQVISPMDSIKPLEKHAGWTEERIEQYNEERIYSIINSGWDLIIIDEAHRVAGSSGEVARYKLGSLLAQASPYLLLLSATPHNGKTEPFLRLVRLLDEEAFPNAKSIVKEQVSPFLIRTEKREAIDNNGNLLFKNRVTHLVSLTWDERNNLQRELYELVSSYVSKTYNKALRNKKKNMCLIFLLIIMQRMVTSSTAAIRQSLERRLNVLRSQRTHLGNLTEEDLEELDIEDGVEEALEAISLDMELETEELQMIISVAKQAQFQNQDAKVEPLLEAIDSIMSDDNTQKIIIFTEFVATQKYLQTLLVNRGFSVTVLNGSMNIEERNEAMLEFKNNTSIFISTDAGGEGLNLQFANIIINYDLPWNPMKIEQRCGRADRIGQQRDVHIYNFIVSDTVENRVREVLEEKLSVILKEMGVDKYSDVLDSEVAECDFTEVYMRSVGHPGQVEKNTYPIEAEMKQQLANAKKYKDVIREEKDLTRLVGTEPDFDVDVALRTMMTYYECWKGNDPRLIDRISIGDEEITKHLKTEILQDRMSPLLSVSIANFPNEAGCFMLWELSISDDESGKRIIPIFVNDAMILRPMAGKRLMEVFLDGTSRLTIGTAPNMSAEQYAGLEKLSMEFAYDTFMELKEKQLQLNQESYNKYMYALQLRMEAAEHIGIDNIRRGRLAKLEKEKAIIEAEHKKGAQVYPNFRLMLAVRLEA

SEQ ID NO: 3534 - protein, 882 aa, Caloramator australicus
MVEVGKYVYAKELKRHVKILDVVELWGYKIFLALDTSTNKLLKLNEENIELQIKNNIYEFKYILYSAKIKNEISNGILSPISGSILPLPHQIYALKRAISNDNIRYILADEVGLGKTIEAGLILKELKIRGLIKRILIITPKGLVTQWQEELREKFKEEFNIILPQYFDSLKKIYGDGNIWTKFDQVITSHDSVKPVENRAGWTKEDIDLLNSERFINLISSGWDLIIIDEAHRLSGSSSDVARYKLGKALSLSTPYLLLLSATPHQGKSDSFLRLLKFLDEEAFPNEKAITRQVVSPYVIRTEKRDAIDFDGYKLFKNRYTKIININWTEKHELQRLLYEKVTNYVSRGYNRAIKERKNYIGFLMVLMQRLVTSSTRAIRDFVERRIEVLNNQYFDNEKYDIEDIYDGYGEEALEELIATTSFDIKKEIEELKEILTVAQQAEYQFIDAKLEMLYDIIFKIRMEENEAKFLIFTEFIGTQNYLKEMLSKKGYKIALLNGSMDMDERKEVLINFKEDADILISTDAGGEGLNLQFCHIVINYDMPWNPMKIEQRIGRVDRIGQHRDVLVFNFILEDTIENRVRKILEEKLQIIYKEFGVDKISDVLDSFDAGVDFTDVYIKSIANPKYMDVFIKSVEEKIKEKTKNLSELKEILKDKKELNLDLIYDLPSQDIIYYLKEMYKYKCLSIGEEVKLDFIPINLFDERIKSLLNIQEFPIKDKIPRVNLSNKFEKGYWSLWEVNISDNERYCKVFSVFINSIGDYRPATSKALFELFLKENIDFDGECGLRQDIFSIISKIAKDIGYNYFSDMKEDYFKNVEKELEKYKTAYNLRKEAAMKIGIESIKKHRLSQIEMEEKNKLNLIENKKKIIPNLKLLYMVYVE

SEQ ID NO: 3535 - protein, 929 aa, Pseudoalteromonas marina
MFDVGEWAWSKAHQQHVKVIENSGLWGQSFYRVWLQQQDSVVKVVDDDLVHADDQQEPSEHFISYVAVAAKIANAQQEDVLLAPIESNVIPLPHQLKALNKAMARKQVRYLFADEVGLGKTIEAGLVMRELKLRGMAKRILVCAPKGLVSQWVSEMSTHFNESFHLLLPGEQKPVDEHDNVWLRHDQVVCPVDSIKPIESRKGWPLKQVHEYNKHRFDDLLAAGWDLIVIDEAHRLGGSTELVARYKLGQGLAEAAPYLLLLSATPHQGKSDAFHRLMALLDPEVFPDISSVTKERVQPYVVRTEKRISIDGEGKPLFKPRKTELVPVAWQQKHSIQRHLYEEVTEYIKEGYNQAKAKKQNAIGFLMILMQRLVSSSSAAIAKTLSRRLIALDTMVVEEELPLSFADDWAELDGQSQLDEMIVESKQALENEKAEVAHLLKLAEKCVANESDAKAEVLLDWLYKLQQEEQSPDLKMLVFTEFVPTQAMLDKFFTDRGISVVCLNGSMDLGERKKVQASFAGDTRILISTDAGGEGLNLQFCHVIVNYDMPWNPMRMEQRIGRVDRIGQPHVVRALNLVLEDTVEHRVRDVLESKLQVILEEFGVDKTSDVLDSAEANHLFDELFMETLTNPDVMDQELAKALQTIQNAGKDKKSQDNLFSDGEQLLAETYQKTANHPLPHWISAMVEQYLLWQNQQGIKARFDKSSTGGLDITWPDGALWNDITFVGKDAQQDLRLKHITLENPKVRGLCTHLPIWSDVQSIPVVKVPTLPTGASGYWSLWSVRFAGSDERQVKYLPIYVKPDGSFFAPASNRIWDALCSDTVEVITGPSSVKSSDIYQMLRAVAEEQGKLAFEDMLINYKADLSEKIDKGEYSFAARKRAIERIGLPEVKNYRLRQLADEQLTWAQQIKEKQQVYPELSLHIVFEIKG

SEQ ID NO: 3536 - protein, 939 aa, Alcanivorax hongdengensis
MTGKVYAVGDWCWHKRLTAPCRVVDSQSLWGENTYRVWLPAKDAVVRARAEELGSLADVQPTADQILHTAAAAKLCAALEDNLLLAPIQSSVVPLPHQLHALNRAMSRDRIRYLLADEVGLGKTIEAGLILRELKLRGMVKRVLVVAPKGLVRQWQAEMRLHFGEALRFIEAADLAAFRTWRNNDDNLWRMHDQVICSLDSVKPIEARRGWSLEQLDTYNRERFEDLVSAGWDLVIIDESHRMGGSTEQVARYKLGAALAEATPYLLLLSATPHQGKTDQFMRLMQLLDRESFPDENSINRDRVQPYVIRTEKRSAIDAEGQPLFKPRATRLQAVAWQNRHAAQQTLYEAVTDYVRHGYNQAMAAKQRHIGFLMILMQRLVTSSTAAIRATLEKRQSLLKEPQSQASLFDTTSMDEWAELDGQAQVDIAVQASGWEQEKAEVEMLLDLARETERQGSDAKAEALLELIYKLQQEESDPQLKVLVFTEFVPTQVMLAEFLESRGFSVVLLNGSMDLDARTRAQQDFSGDVRVLISTDAGGEGLNLQFCHVIVNFDMPWNPMRLEQRIGRVDRIGQPHVVRAINLVLEDTVEHRVRQVLEEKLEIIAQEFGVDKAADVMDSVEVEPIFDELFVHGLQDPDRIDQECDAVIDQVRDKVAASRTDSDLLTEDYNLEADDARKWRDHPAQYWLERAITTGLPSRGGQAEKRDASWRVTWPDGSESPRVCFDARTAEQHPEIEWVTLEDARARAFISELPRCVAGQPLPIVSIRGLPESVTGVWSLWEISLDASHVSDRFSRRRFLPVFIAEDGRSFVPTAKRIWDLLLTEQLSLSSELEIEQAGDDFERALSAARDQGARLFAELQEEHHSWLTEERERARYAFEARYQAIGRIGLPAVREHRRKRLDAEHETRMAALQDAEQGTPELNAVLMLRVGSSGRNAA

SEQ ID NO: 3537 - protein, 942 aa, Methyloversatilis universalis
MAGSGFTIGDWCWFTRQASPCRVIERQDVWGEAAYRVWLPAKDAVVRARSVDLASLESVRLSVEQILHTTAAAKLLDALEDNLLLAPIQSSVVPLPHQLYALNRAISRDRIRYLLADEVGLGKTIEAGLVLRELKLRGRVKRILVVAPKGLVRQWQAEMRLHFGEKFQFIEPSELAAFRQWRSGGAGEEENLWRMHDQVICSLDSVKPMESRRGWSLEQLNTYNRERFEDLISASWDLVIIDEAHRMGGSTEQVARYKLGAALAEASPYLLLLSATPHQGKTDQFMRLMQLLDREAFPDESSVSRDRVRPFVIRTEKRASINAEGQPLFKPRVTRLQAVAWQARHGSQQRLYEAVTDYVRHGYNQAMAAKQRHIGFLMILMQRLVTSSTAAIRTTLEKRQALLDAPQPQANLFESTSADEWADLDGQSQVDLAMQSSGWELEKSEVEMLLELARETEAAGTDAKAEALLELIYKLQQEEGDPALKVLIFTEFVPTQAMLADYLESRGFSVATLNGSMDLEARTRAQQVFSKDVRVLISTDAGGEGLNLQFCHVIVNFDMPWNPMRIEQRIGRVDRIGQKHVVRAINFVLEDTVEHRVRQVLEAKLEVIAQEFGVDKAADVMDSVEADPIFDELFVHGLQNPDAIEQECDAVVSQLRSTLAESKKNSDLLTTEHDLDADDARKWRDHPAQFWLERAITSGLAARGGSAIKVGNAWRVKWADGSESAQACFDARTADENPELEWVTMEDPRARAVISELPRFVAGQPLPVIRVTGLPDSVRGIWSLWEISLAAECLSRKRFLPVFINEEGRPFVPTAKRVWDLLLTETVDVHAVTGAEESVRWFEASHSAASTQGERIFTELLTEHRARLKEERERAVYAFEARGQAIGRIGLPTVREHRRKRLQQEHDARMAALDDMDASVPDLNAVMMVRVSGDVMPGGQVG

SEQ ID NO: 3538 - protein, 1144 aa, Treponema primitia
MPEAPPIREGQIVKSPLFNEPMKVETIREDGSGALTIGMVGTQTERFRRVTLTPEEIASLTILNEIYTYNGDGRLLRLGIQAYSLGIAYEFDPYFGLSISRVDPLPHQLEAVYDYLLKLPRVRFLLADDAGAGKTIMAGLLIRELELRGLAERILIVCPANLAFQWQRELKEKFETKFEVMKGSDIREQFGFNQWQEKKRVITSLDLAKREDILPGLQQTRWDLVIVDEAHRMSASDESHKSQRYRLGELLRDTTDHLLLLTATPHRGDPNNFTLFLQLLDTDAFADVKSIHQAMENRCAPFYLRRTKEAMVYFPEQKEDGTWAAKKIFTKRITRTVDFNIDGPEYELYKAVTNFVREQSVKAAAMGDTPRARAVGFLMALYQRRLASSTYAMRHSLENRARRLEEGLKHAQQLATQAPLDLPTEEELDEMEDIERERLEAILEAITIAGNETQIQEEIQKLKELALHAQEIENAGVEAKLSRLKDLLQTEGFFDHNDQRLLVFTEFKDTLNYLMSKFKEWGFSVGCIHGSMKPGSRDEAGTRLFTEQQFREGAIQILVATEAAGEGINLQVCNILFNYDIPWNPNRLEQRMGRIHRYGQRKDCLIFNFVATNTIEGRVLGTLLFKLQEIRNALDDDAVFNVVGEVLPSAHIERVLRDYYAGKLGDVDLEDRLLRNVDERQFRAICQNALEGLASKKLNLAMLVERRAKAQEHRVVPETISRFLFESSDYVKMPFKIVAGIPHTFDPGKTPSSLHRFEREDDWRLPALVNRYPRCSTDREIAEKHTLEWVTPGHPLFEAVRRHVSLSALDVFSQGTCFYSLNNEQATRIDFYRARVVDGLGQIIHERFFAVQLKKDEIPELCESSALGDFTPATIPDILPQVAFIPEADAFMQTNAYQPFLEEIRNERLLELKRIVSHVELSLNELIQKADEEIGKIAAEVEMKTPGSEGRLIMAENRHDELRTRRDRRREELERQRSLSLQGIERITSVLVLPHPDREDSEVRHLRQNLETEAIAMQIVIEYEKKRGCQVDDIHKKNLGYDITSLKPCSGELRLIEIKGIGASTGNILLTPNERHVAEDRPDCYWLYIVTNCDTDPVMQDPIQDPARFPWNEVKKVAHYTLAINAMTKPMEVHENPPHYGESK

SEQ ID NO: 3539 - protein, 931 aa, Vibrio scophthalmi
MATLLNVGDWAWSQAHQQYVKVIESSGLWGQSFYRVWLQQQDSVVKVSSDDLSKTSMDKSPSTHFFSYIGIAAKIANAQKEDILLAPVESNIIPLPHQLKALDKVMSRKQVRYLFADEVGLGKTIEAGLVMRELKLRGMAKRILVCAPKGLVSQWVSEMSTHFGESFHLLIPGENKPVDENDNVWLRHDLVVCPVDSIKPIESRKGWSVKQVHEYNKHRFDDLLSAGWDLIVVDEAHRLGGSTELVARYKLGQGLAEASPYLLLLSATPHQGKSDAFHRLMALLDKEAFPDVSSVTKERVQPYVVRTEKRISIDGTGKPLFKPRKTELIPVAWKSRHALQRHLYEEVTEYVKEGYNQAKAQKQNAIGFLMILMQRLVSSSSAAIAMTLSRRLQSLENTVIEDELPLAFADDWADLDGQAQLDELIATSKQALANEKANVQRLLNIASECVAKESDTKAEALIDWLYQLQQAEQDPELKMLVFTEFVPTQQMLTKFFTDRGISVVTLNGSMDMHERKRAQASFAGDTRLLISTDAGGEGLNLQFCHVIVNYDMPWNPMRMEQRIGRVDRIGQPHVVRALNFVLEDSVEHRVRDVLESKLQVILDEFGVDKTSDVLDSAEANHLFDELFMESISNPATMDQELAKALKVIQGGARDKRSQDGLFSDGKSLNPSDYQKVIDHPLPYWVERMVNQYLSFKSSQGADASFTRAENGAICVKWPDGANWEDITFIGKEAQKTPGLKHITLENPKVRGLSTHLPIWSEVQNIPLVRVPSLPSGVTGYWSLWSVRFSGQDERQLQYLPIYINTAGQYFSTASNRVWDAICSDIIESDLSSNPESKKAYQLLRESAEVQGKILFDSMLAEHLNELELSVEKGEYSFKARRNAIERIGLPEVKSYRMRQLDIEYSQWKVDIDAKREIYPELNLHLVFEIKG

SEQ ID NO: 3540 - protein, 915 aa, Ectothiorhodospira sp.
MWGEVAYRVWLPAKNTVVRARAQDLGDLAAVRPAVEQILHTAASAKLLDALEDNLLLAPIQSSVVPLPHQLYALNRAMSRDRIRYLLADEVGLGKTIEAGLILRELKLRGMVRRVLVVAPKGLIRQWQAEMRLHFGEHLRFIEATELAAFRAWRAEGTQNDDNLWAMHDQVIVSLDSVKPIEGRRGWSLEQLNSYNRERFEDLVSAGWDLVIIDESHRMGGSTDQVARYKLGAALAEAAPYLLLLSATPHQGKTDQFLRLMQLLDREAFVDEGSIHRDRVQPFVIRTEKRSAINADGQPLFKPRSTRLQAVAWQARHTAQKQLYDAVTDYVRHGYNQAMAAKQRHIGFLMILMQRLVTSSTAAIRATLERRQALLDAPQPQANLFDSVDLDEWAELDGQSQLDVALQASNWEQEKAEVEMLLDLARETERQGTDAKAEALLELIYKLQQEENDPELKVLVFTEFVPTQAMLAEFLESRGFSIVLLNGGMDLEARTRAQQAFSRDVRVLVSTDAGGEGLNLQFCHVIVNFDMPWNPMRLEQRIGRVDRIGQPHVVRAINFVLEDTVEHRVREVLEQKLEIIAQEFGVDKAADVMDSVEVEPLFDELFVYGLQDPASIDKECDAVINQVREKVAASRADTDLLTDDHPLEAVESQKWRDHPAQYWLERAVTTGLPTRGGTAEQSDHAWRLTWADGSESFPVCFDARTAEQNPEMEWITLEDPRARALIGDLPRCVAGQPLPIVQVTGLPDTVQGTWSLWSVSLAASNSSANFTRRRFLPVFVTDDGRSFVPTAKRIWDLLLTEDVRLTADPDSEHAAALFEQSLTAAKGMGERLFSELLEEHRSWLAEERERARYAFESRFQAIGRIGLPAVREHRRKRLETEHQARMADLAEAEACTPELNAVLILRIGSAGGAAA

SEQ ID NO: 3541 - protein, 890 aa, Clostridium papyrosolvens
MFSIGDWVLDKENKKTVKVIESNDLWGYKSYAVFDPGEQKSYFLSEDKICNVDAGEDFSIHSFKYLVTSARIKNELANGILSSIGDSIIPLPHQIYALNRALSSNKVRYIIADEVGLGKTIEAGLIIKELKTRGLINRVLIVCPKGLMTQWHNEMKMKFNENFNIVLPEDFDSIKRIYGEGNIWANFSQVICSLDSIKPLERRNGWSKEKIDEYNKERLGSLIFAGWDIIIIDEAHRIGGSTSDVARYKLGSALADVSPYLLLLTATPHQGKTEPFLRLIRLLDQDAFPDSNAIVKEQVSPYVIRTEKREAVDSEGNRLFKNRVTKAVNIEWEQRHSLQKQLYEMVTKYVTEGYNKARKEKKNYIGFLMVLMQRLVTSSTRAIRENLERRLEILQNSSTRLVNLSEADLMEADAEETVEELIAVQSINMKKEIEEIKDMLVVANQAEYQYVDTKAEKLLEFIYKIQMEYEDFKVIIFTEFVATQQFLKEYLESKGFKIATLNGSMDIEERNTTLKEFKERADILISTDAGGEGLNLQFSNIVINYDLPWNPMKIEQRIGRVDRIGQQRDVYVFNFMLSETVEFRIREVLEEKLATIFEQFGVDKMEDVLDCTDAEFDFTDIFVRGITDPKNADYYIEKLEKEVRDKTERINEIKGLLRDEKVIDKSLVAGISNLPIKSWLKQMYSNFQLSQGKEVNLIELAMIDLNNQQVKKMLKNMPVWARGHKVPALELAGVSNEKGYWSLWDVSINDSDVNKQIFPLFVNESGVMRAASSKILWEAFLKENANPALKGYREFEDTTYTMLCEKAKDYAYNLFENMREGYLNKLSKEQAKYEYAFKLRREAAQRIGLESVRSYRAKSIGKEEEAWRFKIEKEKAIIPILKPLCIVYLE

SEQ ID NO: 3542 - protein, 894 aa, Thermoanaerobacter ethanolicus
MFKVGDWVFDIDKKRAMKIIDVFELWGYVSYSIYDPIEKVTYTVSDKRLVSTEKKNEFDLNYFKYVIIASRISNELAQGFLSSISGSIIPLPHQIYALNRALSKSTVRYLLADEVGLGKTIEAGLIIKELKARGLVKRILIISPKGLITQWHDELELKFNEDFKIILPQDFEVLKRIYGEGNIWDKFPQVITSLDSVKPVEKRQGWTKERIKEFNKERMENLVMAGWDIIVVDEAHRLAGSSSDVARHKLGIELSKASPYLLLLTATPHQGKTDSFLRLMRLIDKEAFPNEKAIVREQVAPYIIRTEKREAVDRDGNPLFKKRITKTVNISWNMKHSLQRELYEKVTKYVAEGYNRAKKEKRYYIGFLMVLMQRLVTSSTHAIKVNLENRLEFLKNEVVGIESIEEDMFFEYDAQKVLDELLKIKSIDIKKEIDELEELLRLAKQAESQYIDAKAEVLIDFIDQLSMEYKNSQKFIVFTEFLATQQYLKDFLESKGYKVAILNGSMSMEERDASLKEFKNYKDVLISTDAGGEGLNLQFCNIVINYDLPWNPMKIEQRIGRVDRIGQERDVLVLNFMLEDTIEFRVREVLEEKLRMIYEQFGVDKMGDILDSVQSEMDFTELYMRSIEMPEGIEYNVSIMEDKIKEKTEQINRIKGLLREEKELDLNIVSKISGLPINEWIRDMYINKMAAEGVEISIDMLDENLISLNNEEIKNMIKNLPVYIKSSKIPILYLKDVSNEEGYWSLWEISINGDSEKFKHVFPVFLNKDKKVRIASANLIWDIFLKNEKEVIFKGYKSIDEEMYDFIHDTAKNMAYDYFEKIKNNYFENLVKEKERYEYAFKLRKEAILRIGLEAVRRRRLVELENEERRWKEEIEKSMDILPMLKPLYIVYLE

SEQ ID NO: 3543 - DNA, 2163 bp, Desulfitobacterium hafniense
atgagtggaaatccattttacagactggcgccctttatccaagaatacatatataagcatcaatggacagaattgcgggctgtgcaggtagaggcctgccgggttatctttgaatctgaaagccatttacttttggctgccggtactgcctcggggaaaaccgaggcagcatttttacctgtcatcaccttgctgcacgaaagcccgcctttaagtattagtgctctctatatcggccccttaaaagctttgatcaatgatcaatttgcccggctcagcgatctgttggaggaggcccatcttccggtctggcattggcatggggatgtctcgccaagccacaagaacaagatgttgaaaaacccccagggaattcttcagattaccccagaatctttggagagtatgctaatcaaccgcagtactgatatcttgcggctgtttgctgatctccgctttattgttattgatgaagtccacgcctttatggggacggatcgaggcagccagattctctgccaactggaacggttgaccaggatgattggccaccagcccaggaggatcggcctttccgcaaccttgggcgattatgccatagcggaaaagtggttgtcatccgggacggagaagaggacaatcactccgaaagttcaagtgggacagcagaaggttcgtctggcggtggagcatttttatttggatgaagagaaaaagatgtccctctatgaccaatatatttttgatcagagcaaaaatagaaagtgcttaatcttcaccaacaaccgggagcaggcggagtacacggtggcgacgttgcgccagttggccgaaggcaaacggatgccggatgtctatcatgttcaccatggaagtatctcagctcccctgagggaagcggcggagaaggcgatgaaggaatcgccggaaccttgtgttacggctgccaccattacgttagaattagggattgatctgggatatctggaacgcattattcaattggaaactcctttttccgtttccagcttcgttcagcgcttaggacgttcaggacgtcggggtactccttcggaaatgtggcttgtgtgcaaggaagatgaggaagtaaatgacctgctgcctaatcagcttccctggtcccttcttcaagctatcgccattattcagctgtatttggaagagcgctggatcgagccggtcagccccaagcattatcctttcagccttctctatcatcagaccatgagcacgctggcagctatgggagaattggtaccggcggcattggcacaaagagtgttaaccttgagtccttttaagaacatttccagtgaggatttcaggcggcttttactttatttgatcgaaattgatcatattgagcaaacagaagagcggggactactggtgggcttaaccggagaacaagtggtgcgtaatttccgtttctactcggtattcccagacaatgaagaatttacggtacgggatgaatccaaagaaatcggcagcattctctcaccaccgcctaaaggggagcgttttgccttagccggacgtacctgggaggtcatggagattgagcttaaacgcagaacggtttacgcgagaccagtcaaagggaaggtccgtaccacctggaacggcgggggaggttctattcattcaagaatcttacagcggatgaagcaggtcctggaggaagatattatttattcataccttcagcccggtgcggttaagcggttgtgtgaagcacgaaatttagccagagctgctggaattttaaaaactaatattctccctttagggggaaatagctactgcctattcccttggttgggaacagtagcttatcggaccctggagaggtgtttgcgttatagaggtgctgatttatacgaaatacggaatgttggcggcctttctccttattttcttacgtttagcacgaagagcggtacgacaattgaggtggattcgcttctgaaagaagtcatcgccggcactgctgatacagagcaactcatgcaagaagatgaggctccacagttagaaaagtatgacgagtttattcctccatctttactcaggaaaggatttaggtatgactatctggatttaaatgaattaagattggcgtttgatattaagaattag

SEQ ID NO: 3544 - DNA, 2568 bp, Desulfitobacterium hafniense
atgaatataaaagaaatgcttcagaatttcggtggtaagataacttatcattatatcgatagttctcgatcaggaaaatacatgaagaccccagaaatattggataccaggcttaggctttacaccaaatttaaatatccccaagggttatattctcatcaggtaatgtgcattatttccttgctaaatggtcaccatactgcactttgcacgagcactgcttcaggtaagtctttagggttctgttacccagcgatgcaggaaatactaaataattcaaacgctagagcattatttgtctaccctattaaagcccttgccaatgatcagattgcgaaactgaaaagtttagcaacggatctagcacttaaaccggatatcgtcaggaaattcgatggggatgttaaagcaactgatcgagtggaagccttagaaaaatcaagaattttggtcgtaactcccgatgtgcttcatacgactttacttcgtttaaatgatgagccgctctattcacgcttctttgagaatctatctttagttattctagatgagtgtcatacctattcaggagtgtttggcagcaatatggcctatgttcttagccgactgcgccaggtttgtcagaaaaaagggagtaatccccgttttatgatgtcaagtgccactgtaggtaatccccaggagcacctccggcaactcactggaattgaggatataacaataatagacgagcgctttaacggaagtcctcagtttgaacgtgaattctttatggttcagccgactcgctatctggaaggttataccttggacttaatgggagaactaatccagcaaaatacccgctttctcgtatttggccagtcacgccaacaaatagaacggctcgttgaaagctttcgattaaaatacccaaaataccgttcaaaagttgaaccctatagggcggggtttactcctactgaacgtcaacaaatagaaaactcatttagaaagggtgagcttgtaggtttggtagcgacctcagcactagaattaggagttgatctacctaatctctcagtgtgcattatccttggcttaccgagtacaaaatcaagcttttggcagcaatccgggagaattggtaggagtaatgagggtgtagtcatcgttctgcgaacagatagtgcctttgataattattttttcaacaatccggagaagctatataataagccctttgagccactggtaattaaccaaaataatgaaccactaatgattggacactatgcctgtgcacgtgcggaaagtggagattttgagaatccttttttagatcaccgtattttcggaagtaaatttagcggattaagtcagagaattaacgagttcgattatacggatgaaatactctatacaaaagaccctcattttgagattaatattcgaagtcttaatgacccaacctatcagattgtcatcggaagagattcacaggatccacccattgggactataacttattcgcaattaatgcgggaggcatatcctcaggctatttttctacaaaggggtaaaaggtatagagtaactaaaatttcctttacaaataaaaaggtttatgtggatgcccgttgtccaatgtactcttctactagacccaagggtgaagtgcgcatcaaggaacgatttaatgggaggattctgcaaaagcattggggttctggggttacgattcggaataccactctagggatattggagaaagtttcaggatatcagattataacaggcaaggaaaaagaagatgttgagtatgcccaacccctcatgagatacttcgtgacacagggagtaataattcacctcaaagatatatcctcattgtcacattcagcagtagtgggtcttactactgctctacataatatttatcctgtcttttatccttgtgcaaaagaagatattgcttcctatgcttgggctaaggcaggcgaagccggagtttttctctatgataacaatgctggtggactggggttgactgctgctgcctttgaccgattcgaagagttgattaagcaagcttatgaaaatgttgtgaattgcgagtattgtttaagtcatccccaggataatggctgtattaactgtgtggtagctaatagatggtatactaccaatgtcaaaagtgatcgacaggcagtcctccgattgtttgaggagataatcgacgtgctgcgacgaatacttcctcgaagcaatcaaaatgggagtgagaacctccctgcaaagagtcaacttatcaaagaaggacactttggccgaaccatgatttctgatggtgccctggtttttactggtaagaatcaagaaggcgttattctatccagtcagcactttcaaagtgtgggcgaagaagagaggctatatgaactcaatgttcagggacgaatcgtaaagtttatggggcgctccttaaccttggtccagggaaatctggaatactggtgtacgaactgcggacaagaaggaatcgagcgcagtgaagtagtttgcccgctttgcggctcccagctctaa

SEQ ID NO: 3545 - DNA, 2637 bp, Desulfitobacterium hafniense
atggaaaaggtatttgaaacccaccaattgttagaggacttgggcttggaggttattcataccgagtcaaaggaaccacgcgctgctcggatttgtcaggcggaaaatcttactccgataatccaagaaactattaaggaaattttacccttgggcttatatcgtcatcaagcgaagtcgattgacagtgcctgcgcaggagagaatattgttatttgtacaggaacagcgtccgggaaaacatttgcctttgcaattccagcccttcaaacgctcctcaaagacccaaaagcacgggccatctttttttacccaacaaaggctttgtcaggtgaccaaaaaagtaaactagaagaattatcttcccgtttcggacttgaagatggagtctactctttcgacggagacactccctttaatagaaggaaagaagctataaaaaaaggccgtattcttctctgtacacctgatgttcttcacgctacaatgctgagactttctaatgaaaaagactatcaggagttttttgcccatcttactcatgtcattctggacgaatgtcatatctattcgggagcctttggtagtaatatggcctaccttatgcgacgtttgcgtcaagtctgtcgaaggttagggaacgagcctcaatttttagcagctagtgcaacttcgaaagacccaaaagggcacctagagaagttagtcggtgtaccttttcaagtccttggggaagaagaggatggaagcccctccgggggacgtaatttttatattgcgattagtcctaatatgcctgaggaacaagcggttatccaattaattgcccgacttatcgaggatcaaaaacgttttattgtctttagtcatacacgcaaaataacagaacaagtttttatggatctaatcaatctattccctgaggtcgaaggaaaagttatgccctaccgttctggctttgagcatggtgatcgccaaagaattgaacaagcccttcgcaagggagatttatttggagttatttctacgtcggcactagaattaggggtggatttgtcggaaatggagtattgtattcttcttggcatcccctcaaccgctatgagcttttggcagagagacggacgtgtcggacgttctccacaaagtcaagggcaagtgattattatcccctctacgaactccgttgatgattattatcgccaccattctgaaaaactcttgacacgggaacttgaagacctcgtcatccatttggataactggcagcttattctattccattttgcttgtgccagagcggaaagtggtaatcacgaacatcctaatctggatcctgaaatatttggtcaagattttgcacaacttgccgacaaaattgaggaattggatataacggatgagattctcatagcaccggaacctcacttggtcatgggaattaggggtatagatgataagacctatgaaattttaagttccggtggagaaaaacgcttaggtactatttcttactcacaaatattgcgggaagcctatcctcaggcagtttatcgccatatgggggaggcttaccgggtagaatggcttaatactaagcattgtactattagggtaaagaaagaagaacgaaacttagcaacttcgcccataggctatatagctgtaaaagagcgtatcaacaatggtacgacttttcgccgtatccgatggggtaacgctctagaaatgttacataccaccatgacagtgaccacagtgaccagtggctatcgagaaaggcgagatggagactggattaatcaggaaaagtatccctcacccttgcagcggcgagtaatatctgaaggagtctggctcaagttcggatcagaattcggaatgattaagaaaaatgctctgaacgcattagcacatgcttttagcaatatttattctatatggtttccctgtgatgctgcagaagtagctacgcactgtgtagtcaatgcaaaggataagtcttccagattatatatttttgacacgacttcgggtgggctaggtataacctccggattttttgaccatttcctagaacttttagatccagtgcgggaacgactagagtattgtgatcactgtgattcggatccagagctttttgataagggctgtccctcctgcatccaaattccccgctggtttgaagataatgagcaccttagcaaatccctagccttagagttgcttagtcaaattcgaacggtgcttgaatcgaatacaccaaatcttactgtttcagaggcctatagaggacgacaagaaggaggcttagccgctgtttcgtctttgaatattgtcgatggggaagttgcggttgaagatttaaagagaggaattgtgattctctatcctggggctattattgcattgccctctgggcagcaaggaaaaatcttaggctggcgaattgaccatggtcaagtggtttatgagactgagctcagcaatggtaagactattggtttgcgaaatacaggtaacaacatagctcttatccaaggggaagaagctattctttgtttggactgcgggtacgagacaattgataggagtgacgtaatttgtccggcctgtggggcagtgttaaggtaa

SEQ ID NO: 3546 - DNA, 2136 bp, Candidatus Accumulibacter
atgagcgaagagcaagcagcctttgatcgcttgcatccagccgttcagcatcacatcgtcaattcgctggggtggaacgggctgcgtcctacgcagcaggcggcagtagcccctattctcgatgggcagcactgcatccttttggcccccactgccggtgggaagaccgaggcggcgatatttcctgttctctcgcggatgctgtcggaagactggcgcggcttgtccgtgctgtatgtttgcccgattcgcgcgctcctgaataacctggaacctcgcctttcctgctatttcggcttggtaggacgacgtgtcggcgtctggcatggcgacatcagtgactcgatcaagaaaagagcgatcaaggatcctccggaccttttgctgacgacacccgagtctctcgaagggatgttgatttcggcaaacgacgacaagcgaaacctgcttcttggcgtcggcttgattattgtcgatgagctgcacgccttctgcggtgacgatcgcgggtggcatgtgcggtgcctgattcaacgagttcagcgacttgctgggcggcgaatccaggtactgggattgaccgctaccgttggaaatccgaaatttttgatcgactggatgcttcccggccagccaacgactgtcattggagcgggccattccggaatcgacgctgacctaactatcgactttgttggttcgctcgaaaatgcggcgacagtcatcttcaagttgcatgctggcgaaaagcgcctggttttctgcgatagccgggcgaagacggaagaactctcggcagtccttcgcggttttggggtccggacgtttgtctctcattcctcgctatccgcagatgagcggagacaagcggaaaaagcatttgccgaagagccgaattgcgtcatcgttgcgacatccacgctggaacttgggatagatgtcggtgatctggatagggtcatccagatcgatgcacctggttcggtagcgtcgtttctgcagcgtatggggcgaacaggccggcgcaagggagaaatgcggaactgtttgttccttgcgacggacgacgaggggctcatgatcgccagtgcaatcgttcgcctctggcgcgaagactttgtcgaaccgataaatcctccggtagcgccatggcacttggtcgcacaacagggaattgcgctgatccttcaaagccgtgggctggagagagcaagccttgaatcgcaattgactgacatctttttcgatctcgactcgaacaagatttcacaaattatcagtacgatgctttctcgttccattctttgggaggacgaaggaattggtgggctgattggcttgggggaggtgggtgaagatgaattcggccgtcgccactttgaggccatcgtttccaccttcaattctccgttgctactgacagtcctacatggtcagcgtgaattgggttttgttgacccaatgagcattcggacaaatgacgaatcggcgccgacgctgattctggcgggcagatattggcgagtggtgacctcggactggaggtcgcgcgtggtctatgtcgagcctagcgaaaacagggggaaggcttcatggctaggatcgtcacgagcgcttcgtcttgaactttgccagaaaattaaggcgctattgattgatcgcaaagtcccggctgttctttcgaaccgtgcgaaaaatcgactcgacaatctgtcatcctcgtttgcttttcttgaggttggcaagaccactgctgaaaagactgttggcgccaaccaaccggaatggagatggtggacgtttgctggtggcgcggccaatttcttgttagccgagatgatgaccctttcagggaacaaatcaattggccacgacaatttttctatcaggctaactttcccgccaaacgtggcagagggaatggcattacctgttgagcttactcaacaaggagaaaagcggataaggcaaatcggtaaggacctaaaatttagtcgatgcctcgaagatgccgacgttgccgcagtgatcaaacctcgactactagatcggggaggtgcggcctcgattacggcacaggcaatagtggcatcgaacgagtatttcgcgccacatcagtcacgggacgcgccctga

SEQ ID NO: 3547 - DNA, 2754 bp, Corallococcus coralloides
atggccggactcgagcgccttcatccgcacctacagcacgcgatcatccacgatctgggctggcgctcgcttcgccctgtccaggagctgacgatcgacgcgatcctcgacggctgcaacgcggtggtgctcgctccgacggccggaggaaagaccgaggcgtcgatcttcccggtgctctcgcggattctcacggaggacctgaagcccgtctgcgcgctctacgtgtgccccatccgcgcgctcctcaacaaccaagaggagcggctctcgtcgtacgcgcgcatggtaggcctcgaggtcttcaagtggcacggcgatgtctcggactcgaagaagaagaagttccgcgagacgcccgcgcacatcctgatgaccacccccgaatcgcttgaggtcatgatgatctccgagcgcaccgacgcgaagtcgctcttctcggggctctcggcggtcatcatcgatgaggtgcatgcgttcgccgccgacgatcgcggcgcgcacctcgcgagtctgctcgaacgcctcgtcgcgatgacgggccgtgacatccagcgcatcggcctctcggccaccgtcggcaacccgcatgtcatcggcgagtggctccagggctcgagcaagcggccgttccgcctcgtcgacccgccgaaggcgaaggcgcagcgtgacctgcgcctcgacctgtgcgttgacatcagcgaggccgcgaaagccatcgggcaggtcgcgcgcggcaagaagagcctcgtcttcgtcgagagccgcagcaaggccgagaaggtcgcgcacgctctcgctggcacaggagtcgaggtcttcatccaccacagctcggtgagccgcgccgaccgcaccctcgctgaggagcagttcgccaaggggcagaacacggccatcgtctgcacctctacgatggagctgggcatcgatgtcggcgacctcgatcaggtcatccaggtcgacgcgccggcctcggtcgcttcgttcctccagcgcctcggccgcaccggccgccgcgcgaacacgcgcgccaactgcacgttcttctgcctgagctctgagtcactgctccagtcggtggcgctgctgcgtctcgccgaggcgggatgggtggaggacgtcacgcccgccgctcacgcgatgcacgtgctcgcgcaccaggtgatggcgctcatcctccaggagggaggcatctcgcggcacacgctgatgccgtgggtcgaggccgcgtacccgttctcatcggtgcgccccgagcgcgtccaagaactggtcgacacgatgctcgagcgcgagattctctacgaggccgacgggctcctgtcgctcggccagcgcggcgagaagctctacggccgcaagaacttcttcgagctctacgccgtcttcaccgcgccgccggtcatgcgcgtgcagcacggcaaggaagacgtcggctacatccaggcgcttttcgtctcgatgcatgacgccagcgcgggcccgctctgtttccgtctctccgggcgcgcgtgggaggtcgggcagatcgactacggcaagggcgtgctccacgtgcgccccgccgactacggccgcgtgccgagctggctcggactgccgggtgtgctctcgaacgcgctctgccagggaatgctcgacgtgctgcttcacgagaagcaggagggcgcgtggctcagcaaggccgccgccgccgagctggctgtcgtgcgtgacagctacgacggcctcctcgaggaaggcacggcaccgctcgaagaccaccccgacggcgtccagtggcacaccttcgcgggcggtgcggtgaaccggctcctcgcggcgggcctcgagcagaagtccgggaagaagtgggtggcggggaacctctcgctgcgttgcaaggacatcgctttctcggctgcggacgacgcgatccgctcgctcgccgacttgaactgggagcgcgtcgctgccggcgctgcccgcgagatggcgcgcggaatgctcagtaaattccaaccatgccttcctgaagaggctgaagaccggcttctgtccgagcgcctcctagatcaagcgggtaccctgcgattcctcgccaacgtgagggtcaacggctcccgcgtggccgcgcgaccgaccggcatgcgccttgccgacgtcgaggtcaccggcccgctgccccttgagcttaccttgcgcggcctcccgggcgttgccgcagcgccgaagaacgacgtccagtgggtggacacgctggcagcactgcgcgctgtcagcgaggaacttcgcgccgccgaggtggtcggcctcgacgtcgagactgcgctcgacttcggcacgctctaccttttgcaaatagccacgcgcacgagaaccttcctcatcgacccactggccgtcggcgacctccagcccatcgtcgacgtgctgagcggccccacccccctgaaggtcatccataacgcccgtttcgaacgccgcgtgctcgcagccctcggaatcgccctcgacggcgtcttcgacacgctggcggcctctcggcgcgcacgcggcaccgacgccctcggcggccacagcctcgcgatggtctgcgagcgcgagcttggcatcgtcctcgacaagtcctcacagacttccaactggagccgccgcccgctcgaagccgaccagttaagctacgccgctctcgacgccgagattctcctcgcgctgtacgatcggttcaaagacgcaggtgtcgcacccggcgcggggggaggtaactga

SEQ ID NO: 3548 - DNA, 2229 bp, Corynebacterium variabile
gtgaccggcttcgaccacctctaccccaccctccagcaccacatcgtctccacgcttggctggccgggactgcgtcctctccaggacgcctcggtgaaaccgttgctcaccggacaagatgccctgctcctggcgcccaccgccggcggcaagaccgaggctgcatccttcccggtcctcacccggatggcgaacgaaaactggcgcggagtatccgtgctctacatctgccccctgaaggcactgctcaacaaccttgaggagcggttgcggacctacgccggatggatcggtcgtaccgtcggcgtgtggcacgcggacgtgaccacctccgcccggcgtcgcatgcagacttctacgcgcccggacatcctgctgaccactccggagtcattggaatcgatgatggtctccaccggtgtcaatgaccgggacttcctcggcaacgtgcagaccgtcatcatcgacgaggtccatgccttcgccggtgacgaccgcgggtggcacctctccgccgtactcgcccgcctggagcacactgtcggacgccacatccaacgaatcgggatgtccgccaccgtcagcaatccggaggatctgctcgagtggctgcagggtggtgcgcggtccgcagccacccgcaccggatccgtgatcgcccctggcgtggtcctccccagcgccggcatctcccccgctgccggtcctgatgctccggagatccgggtggaccggctggagagcttcgatcaagtcgccacgttgctgtcgaagctctatgtcggtgagaagcggctggtcttcgtcgattcccggaagaacgtggagatcctcggcggtctgctggaggacctcggtgtgaaggttttcctctcccactcatccctgtccgcctccgagcgtgccaggtcggaggccgccttcgccgaagagacggactgcgtgatcgtcgcgacctccacactggagctcgggatcgacatcggcaacctcgaccgggtgatccaggtcggagcaccacgcaccgtctcctcgttcctgcagcgtctcggacgcactggtcgccgcgccggcacttcgcgtaactgtctgttcatcgcactgccgggtgcgagcagtgtcgcccgggacgaccaggatgagatgctgctgcagattctgggattgctctcggcatgggccgcggggttcgtggagccggtgattcccccgccgctgccgctgcacatcgccgcccaacagttccttgccgctgccctgtcgcgtggggcgttcagcacgacggactggcgggatatctgggcggggacatcgctgatggacgaggcagttctggaatgcgaggccgctgaggtcctcgaccacctcatctcgtctgggatgctggagaccgacggtgagatggcgctcatcggcgaagctgcagagaaggccttcggtcgacggcatttcatggagttactttccgccttcacctccacacccctgttcacggtgctggacggacgcaccgagatcggcatggtcgaggaccggttggtggcctcgctggacgacagtgacggagagcgggtcctagcgcttgccgggcagaactggaagatcctcagcatcgacttcaagcggaaggtcatccacacggagccttcgtccaagcacggcgtggcccgttggggttcgtcgggcccgtcgttcggttataacgtcgcccagggcatgcggcgggtggtcctcggcgaggaccccgcgggtgttcagctgaccggtcgtgcgtcggaagcgctggagggaatccgtgcctggtggtcgccgacggtcagtgccacctcggacgcggtgtacgttcccgtgggtcgttaccggccggagcaggcggaatggtgggcgtggtgcggtaccggacgcaatcagcaggtcaaggccgcgttgggtgcttcagcctcccacggggacgtcctccccggcgagctgggcttcactaccgacagtatcgccgatgatgcccagttggctccgctggaccaggccgcccgttacgaccgactgcgggtgttcccggaggcgactcccgcgcaggtgcgtgcgagggtcgcctggtacgacagtctcctcgctgatgaacggcctctcccttatgtcagtcccaaggcggtccacggtctgaagttcagcgctgcgctgccggaggataaggcgcgggagatactggcgcggcggctactgctgtag

SEQ ID NO: 3549 - DNA, 2262 bp, Frankia sp.
gtgatctcccggacgtccggggcctcgggggcttccggggccccgggggcttccggggcttccggggcctcgggcttcgccgccctcgacccggccgtccagtatcacgtcgtcaacagtctgcggtggcctgccctgcgcccgttgcaggaggcggcgatacgtccggtcctcgacgggcatgacgtgctgctgctggcaccgaccgccggtgggaaaaccgaggcggtggcgctgcccctgctgtcccggatggccggggagaaatggcgcgggctgtcggtgctgtatgtgtgtccgctgcgggcgttgctgaacaacctcgaaccgcggctggccgcgatgtgcgaatggctcggccggcgggccgccgtctggcatggagatgtcgccgactcggtgcgcgggcggctggccgtggatccgccggatcttctgctgaccaccccggagtcgatcgaggcgatgctcgtctccgcgcgcgtcgatcatcgatggctcttcgccggcctgcggacggttgtcgtcgacgaggtccacgccttcgccggtgacgaccgcggttggcatctgctgggggtgttggcccggttacgcgggctcgccaaccgggcggtacagcggattggtttgtccgcaactgtcgggaacccggacgtactgctcgactggctcgcggacggatccgcccggccgcgcgcggtcgtccggccgagtgacgtgacggccaccacggacgtgacggccaccacggacgcgacagccaccacggacgcgacagccaccacggacgcgacagccaccacggaggtcgggatcgactacgtgggctccctgcgcaacgccgccctcgtggtcgcccgccttcatcaggggatgaagaggctggtcttctgcgattcccgcagccaggtcgaggagttgacggttgcgctgcgtgacctcggggtacggacgtatgtatcccactcgtccctgtcacgggatgaccggcggcaggccgaggccgccttcgcgacatccaccaactgcgtcatcgtcgccacttccaccttggagctggggatcgacgtcggtgacctggaccgcgtcatccagatcggtgcccccgccacggtgatctccttcctgcaacgcctcgggcggaccgggcggcgccccgggacccgacgcaacacgctgttcctggcaacgtcgcagaactctctgtggctcgcggcggctatcacgctgctgtggcaacgcggatacgtcgagccggtcgtcccgcccgtgcttccccgtcacatcgtcgcccagcagatcctcggactggccctgcaggaaggccgcctcgtcgaccgcgacgtctggcagtggctcggcgggcttgcccggactccgggcgcggtcgacgtactggcgcatctggcccgctccgggtttgtcgtgcacaccgacgggctggtatcgatcggcccgcgggcggagaaggaatacgggcgacgctacttcctcgacctcacgtcaaccttcgccggcgaatcgatggtgcaggtctggtggggacgtagcctgctcggccagctgccaccgatcgcgctcgcggctcgaccggagcacggaccgcgggtggttcttctcggcggtcgtgcctggaaggtgaatcatgtcgactggcggagaagacgagtccaggtcgaaccgagccgctacccaggccggtcccggtggaacggcggggcccgggtcatgtcctatccgctcgcccaggctcacctcgacgtcctcgccgggcaaacggccggcatcgagatatcccggcgggccgccgacgcgttggacaagctccgcgcgcagcattcctttgtcagtgtcagtgtcagtgacgagccgggcgaacgcacctacctcacccgcgaccccgagaagcggccgatctggtggacatttgccgggttcgcggccaattcggccctcgcctcggggctcggcgagctggttgacgctgacgcgccggtcggcgatctcaggctgcggcttcgcccgcacgtcaactccgccgcgctacggacaatgctcgatgttcgacgtgacgacctcgttgacgctcttccggccatcgatgtcgaggctgccgatgggctcaagttctccgcggcgattcccctcgaactcgcgatcgagacgctagccgcacgcctcaccgatccatccgccgtccacgcgacgctgaaggcaatcatccgggaggagactgcgcctccgcctgggggatggtag

SEQ ID NO: 3550 - DNA, 2355 bp, Frankia sp.
gtgaccgaacctgtcccgctagcatctgccggcggtacggagtccgccgacctgctgcatccggtggtgctacaccacatcgtgaacacgctgcagtggccgggactgcggccgttgcaggaggcggcagtggagccgctgctcgccggggcggacgcgttgctgctcgccccgacagccggcgggaagaccgaagccgcggcgttcccggtgctgtctcggatggcgtcggagaactggcagggaacgtccgttctgtacctgtgtccgctgaaggcgctgctcaacaaccttgcgccgcgtctagagtcctacaccggttggctcggccgacgcgccgccgtctggcacggggacgttaccgaaagccgccgcaaccggatccgccgcgaacgccccgatgtcctgctgaccacgcctgagtcgctggaggcgatgctggtcagtgtccgcacggaccatcgtggcttcttcgtcggcgtgcgcacgatcgtcgtcgatgaggtgcacgcgttcgctggcgacgaccgtggctggcacctgctcgccgtcctcgaacgcctgcgccgcatcgtcgccgccgagcggaccgccatcaacgatctttgcgttccgcggaacggcgtggtcgcctgcgagcagcccgcccagccagccggctcaggtcacggcgcgggcctggccgaggagcggccagccggcgccgctccccctgagctgcaggtcattggcctgtccgcgacggtcgggaacccggaggagctgctgcgctggctgcaaggctcccgcgtcggacgccggccagcgagggtcatcgcccccgacctgccgaccgcccaggccgtgccgctgcccaccgcaccgccagtcgcctcgccgccggacctcgcgacttccggcgctgccacacgagccgcgccgccggccggcgacatcgagctggactacgtcggctcggtctcgaacgcggccaaggtactcgcggcgctgcaccagggcgagaaacgactcgtcttctgcgactccaagaagattgtcgaggagctgggccaggcgttgcgctcgctcggcgtgacgacatttctctcgcatgcatcgctgtcggtcgacgaacggcgccgctcggaggaagcgttcgcgcaggcccgcaactgtgtgatcgtctcgacgagcacgctggagctaggcatcgacgtaggcgacctcgaccgcgtcatccagatcaacgccccaggcacggtcgcctcgttcctacaacgcctcggacgcaccggacggcgtccagggaccctgcgcaactgtctgttcctcgccctgtccgagagcgccctcgtccacgccgccggactactgcttctctggggtcgcggctgggtcgagccggtcgtcccccctccggaaccacgccacatcgtcgcccagcagctcctcgcctactgcctgcaggaaggccggatcggtgaccagacgtgggtcgacgagtggaatggcctcgctccattcgaccgatctgccgagccgatcgttcgtcatctcgtgcgtatgggccacctggactccgacggcggcatgctgttcgtcggccccgaggccgaacgaaggttcggccaccgccacttttccgagctgaccgcggtcttcaccgctgcaccggagttcaccgtcctgtccggccgcgacgagatcggccggaccgaccccgtcctgctcactgacgaggtcgagggcccgcgcatgcttttgctcgccggccgaagttggcgcgtcacctacatcgactggaaacgccgccgctgcttcgtcgagcccgccgaacgcggcggccgggcacgatggttgacctccggcgatgtagccatgtccttcgacatgaccagggcgatgcgcgaggtcctcctcggtgccgacccaccagttccgctcacgcgccgggcccaggaacggctcgcgaccatccgcgatagccatctcgacgtcgttcaccctggcggaacggtgatcgtccgtaccgacgacctgacggacatccgctggtggacctgggctggagaacgcgcgaaccgcaccctgaccgcgagcctcggggatttggccgactccctccaaaccccgaccgctgcctaccttcgcttgcgcaccgatctgaccccggagatgtggaagaccgcgacggcggacctcgagtcccgcctctgccttccgcacgtcaccgatgaggccctggccggcctgaagttcaacaccgcgctcccaccgcgcctggccgaagccaccctcgccacccgcctcgcggaccttccctccgcgtccacagtcctccgacaacccgtccgctttaccttcttgcaagcctga

SEQ ID NO: 3551 - DNA, 2136 bp, Haliangium ochraceum
gtgagcgagtcggcgtttcaccgcctgcacccgtcgctgcgctacttgatccgcgaagcgctgcggttttcgtccctgcgtccggtgcaggaggcgaccatcgcgccggtgttggacgagcgcgacatcgtggtgttggcgccaaccgcgggcggcaagaccgaggcggcgttttttccggtgctgtcgcgcgtgctgagtgagcgctggcagcccgtccccgtgctctacgtgtcgccgttgcgcgcgctgctcaacaaccaggagggccgcatcacccggatggccgaggccgtgggcctggcgaccgggacctggcacggcgacgtctcggcggccaagaagcgcgcgctgctggcggcgccgccgcatatcttgtcgatcacgcccgagagcctggaggtgttgctcatcaccgcgcccgagcgggccgaggcgctgctgtcgcgcgtgcgcgtggccatcgtcgacgaggtgcacgcgctggcggccgacccgcgtggggcgcatctgttgtcggttctcgagcggctacagcagcgcgctggcggcgggcacattcagcgcatcggtctgtcggcgaccgtcgggaatcccgaagagctggccgcgtggctccagggcagcggcgcgcaggcgcctccgctcgtggtcgcgccgtctggggagcggaaagagccgctgtttcgcttctgcgcctcgcagggcgacggcgacgccgcgctgcggatcgacgaactgggcgcgggtcgcaagcggctggtgttcgtggaggggcggcgccaggccgaggccttggccggagccgtgagcgcgcgcggcacacgcgcctgggtgcatcattcgtccgtggggcgagcgcagcgcgaggaggccgagcgcgccttcgaggaggcacgggacgcggtgctggtggcgacctcgagcatggagctgggcatcgatatcggtgatctcgaccaggtgtaccaacgcgacgcgccgaccacggtatcgtcgctggcgcagcgcctgggtcgcagcggacggcggcccgggaccacgccgcagatgacctttctgctcaagcagcccgaggatttgctcgtggcgttggcggtgacgagcctgttcgagcgcggctgggtggagcccgtgcatccgtcgagtcggctgtggaccgtgctcgtgcatcagatgtttgccaacttgctggagaccggtggacttacgcgcgcgcagctcgtcgcgcggttgcgttccgtgccggcctttgccgggattggcgacaacgagcagcatggcttgatcgtccatctggtcgaggaaggctggctcgacgaacacgacggcgtgctcttgctgggggtgcggggcgagcgcgagtttgggcggcggaactttttccggctgtatgccgtgttcgacaccagcgagacctttgccgtccgccacggacaggagcaggtgggcaccctcgaccgctggttcgtcctgcagctcagcgcgcggcggccggtgtttcgcctggcggggcgtgcgtggaaagtcatcgagttcgacctgcggcgcagcgcgctgcgcgtggtgcctgccgaagccgggacagcgccgcagtggacagggcgggcgagcattctgagtcggccggtatgtgaacggattcgcgagctggtcaccgaggacggcacgcccgcgcacctcgacgccacctgtagcgcctggctcgcgcatgctcgcgggctgtatgcggacgttggtgtggatcgcgtgcagcgcccgatcgtcgcggtggacggcaagaccacgtggcacacctttgcggggacggcgatcaatagcgtgttggcgaggctggtcgagcactacggggggcctcgactctcggtgagcaacctgtcgctcaagacccgcggcggcgcggcgagcctgcgcgaggccgctctgcgtgcgtgcgaggcgctagccgaggatgcgctgccggggctcgagaagtgggccgagatcgatagcgagaagcgcacggcgatcttgtcggggtttcagcagtgcctcccgagggaggcggagcaggcgttcttgcgcgcagcactgctggatattgaaggcgcccaaagctgggccgaggagacgcgtaccgaggggatgagggagtga

SEQ ID NO: 3552 - DNA, 2181 bp, Microlunatus phosphovorus
atgacggacggtcgcgaagcagctgatccttttcaggtgttgcatccggtggtgcagcaccacatcgtcaacacccttggctggacgagcttgcggccattgcagtcccaggcgatcgagcccatcgtggcaggacaggacgccctgttgctggctccgaccgccggcgggaagaccgaggccgctttgttcccactcctcacccggatggcggctgatgactggcggggcacatctgtgctctacgtgtgcccgctgcgggccctcctcaacaaccttgagccgcgactgtccgcgtacgcgggctggctgggccgaacagcagccgttcgccacggcgacaccaagcagtcggtgcgccgccggttgacgatcgaacatcccgatgtgctgctgacaacgccggagtcgctggagtcgatgctcgtctcagcggtcaccgatcctcgatccttactgtcagatgtccgcgcagtcgtagtggacgagattcatgccttcgccggcgacgaccggggctggcacctcctcgcggtgcttgcccgcgtgagcgagatcgcgggccgccggttgcaacggatcggcctgtcggcgaccgttggcaacgctacagagctgttgtcttggttccaaggctcgacgtcagcggatcgcggagtaggccaggtgatcagtctggagatcggcaaccggtcgaacgagggcagcgtggtcgaaccgtcgatcgagatcgactatgtggcgtccctggtgaatgcggcgaaggtcatctttgcactgcacacgggggagaagcggctggtctttgccgagacacgagcgaatgtcgaggtgctggcgaaccagctgcgtcggctcggcaccgagacgtacgtgtcgcattcctccttgagttctgacgagcggcgtcgggcggagcaagcgttcgccgaggcccgggactgcgtcatcgtgtcgacctcaaccctggagctggggatcgatgtcggtgatcttgatcgggtgatccaggtcggcactccgcagaccgtcgcatccttcctgcaacggctcgggcgcaccgggcgccgacccggcagcagtcgcaacctgctgttcctggccgtgacagacgatgaactcgtgcagacgacggcgctggcgctgctctgggaggagggctttgtcgagccagtagtgccgcctccgttgccacggcatgtgctggcccagcaactcgtggcgctggcgctacagaagcgggctctcccacggggctcgtggtggcagccgttaggcggacttgcgctcgggtcagatgtcgatcgggagttgatcaccgattggatggtccagaccggtcacctcgatgtcgacggcccgatggtgttcgtcggccctgaagcggagaagcagttcggtcgccggcatttcctcgagttgctgtcggtcttcacgtcctcgccgcagttcacaatcgtgcacggccgaaccgagatcggtcaggttgaccccttcgtactcgtccgcaaggtgactggacctcgcgtgctcgcactggccgggcgggggtggctggtgaccgcgatcgactgggccaggcggcgcgcgcacgtcgagccggccgacgtgtctggcgccgctcgctggatcagcgtcgggcagccgcagacacacgagttcgtcgatgcccagcggcgagtgctgctcggtgctctgccgacccgaacacggctgtcgcgccgggcgattgagcacctgccggcggtgcacgcggagtacctgaaccgggttgatgcggacagcacgctggttgtcactgacgccggtcgcactcggtggtggacctgggccggtggccgagcgaacgcgatcctggttgctgcattggagtcggtcgacccaacgctggtcgatgacgactacgtgtacgacaaccgccaaatagggctgcgcagcagtgtcggtgctcatgacctgcgacggaccgtgcacgaggtgcaagctcgggtgagcgaccttgcgggtctccggcctttcgtcagcgaccgggcgctggaacagctgaagttctccgagctgttgccgccagatctggctcgcgacaccctgcagtcccggctggctgatcgcgagggcgcaatcagggttctggcgcgtccgatcgcgacctgggtgccaggtcctagaggcggcgcgtga

SEQ ID NO: 3553 - DNA, 2121 bp, Micromonospora aurantiaca
atgagggacagtgtccacttagacccggtactgctgcaccacgtggtcaacagcctcggttgggcggacttgcggccgctgcagcgagacgccctggcacctgtgacccgaggggacgacgcgctactgctcgccgctacggcgggcggcaagaccgaagcggcgatcttcccgctcctgacacgcatggcaggcgagcgttgggacggcacctcactgatctatctgtgcccgttgaaggcactgctcaacaacctgctaccccggctcgaacggtacgccggatggctcggccgctcggtcgcactctggcacggcgacgtgagcacaacggctcgccgacggacgctgtgggaacgcccagacatcctgctgaccactcccgaatcaatcgagtcgatgctggtcagcgcgaacgtggaccatcggatgttcctcgccggcgtacgagccgtcgtggtggacgaggtgcacgccttcgccggcgacgaccgcggctggcacctgctggcgctgctggagaggctgacccggctggccggacacccgctgcagcgggtcgggctctcggccaccgtggggaaccctgaccagttgctccggtggttgcagggtgccggcgcagacagccgacctggtgtcgtcgtcgcaccctcacgtcccaccgagggagccctatccgcgtctacgcagccacccggtcaggtcgagctcgactatgtaggctccctggccaacgcagccgtcgtcatcgccgcgctgcatcgaggagagaagcggctggtcttctgtgagtcccggcagacggtcgaggaactggcacagttgctccgcgaacgcggtgtcaccaccttcctctcccatgcttcgctctcactcgacgagcggcgccgggcagagcaggcgttcgccgaggccagagattgcgtcatcgtttccaccagcacgctcgagctcggtattgacgtgggggacctggatcgagtggtccaggtcgactcaccgtcaactgtcgcgtcctttctgcagaggctcggccgcagcggccgcagaccgggcagttcgcgcaactgcctctttctctgccgcagtgctatggagctgaccagggcagccgctctgctgtcattgtggggcgaaggctgggtggagcccgtcctcccaccgcccgagcctcgtcacatcgtcgcccagcaaatgctcgcgctctgtctgcaggagggccgcgtcggcagccgcctctgggcgcaggcatggaacgggctggccccgtttgaccacaccgcccagcccgttgtgcgtcacctgacggaggagggctacctggacagcgacggcgggctgatgttcatcggcacgcaggcggaacgccgattcggccgaagacatttcatggagctgacggcggtgttcaccggcccgccggagttcaccgtcctgcacgggcgccaggaaatcgggcggattgacccgagcctgctcaccgaggaggtacggggcgaccgccggttgctgctcggcggccggagttggcgggtcacctacgtcgactggcgcagacggcgttgtttcgtggaacccgcggacggcgggggccgagcacggtggacctcgcaggggtggctcgggtcgagctttccgctgacccgagcgatgcgggaggtcctgctcgggaacgacccgccggtgcggttgaccactagggcggcgagccggctcgcgacgatccgggaggagcgctcgtccctggtccacccgggaggtacctgcgtcgtgcgttcccgcggcgagcttcactggtggacctgggcgggtctgcggggcaacgctacgctggccgccacgctcggcgaggtgatcgacccctcgcagcgcttcgacgactgtgccatccggctccgccgggatgtgacaagggaccagtggcgagccgtggtgaccggagccggtgaacggttgtgccttcccgacatcgaccggcgtgctgtcgccggcctcaagttcggcgcagccctgcccgagcggcttgccgccgcgaccctggcggcacgcctcgccgacctcgacgcagcagcagccgtgctggcggagccggttcgcttcgcgaatctttggtgttaa

SEQ ID NO: 3554 - DNA, 2091 bp, Mycobacterium gilvum
atggacgccttcgaccggctacatcccggggtgcaataccacctggcgaacaccttgcggtggaacggattacggcccacccaggccgctgctgtggaaccggtcctggcaggttccgatgcggtggtgttggcacccaccgccggcggcaaaaccgaggccgcgatgttcccgctgctgtcccggatggccaccgaggactggcagggcgtatcggtgctgtacgtgtgtcccctgcgggcgctgctgaacaacctgcagccgcgcatcgacgggtactgccgctggctgggccgatcggccgcggtgtggcacggcgacgtcagccaggagcaacgccagaagatccttgtggaccgaccagatgtcctgctgaccaccccggaatcgctggaagcgatgctggtgtccaccaaagtcgatccgcgggtgctgttctccgggctgcaggccgtggtggtcgacgagatccacgcgttcgccggagacgaccgcggctggcatctgctggcggtgctggagcggctgtcgcgggtggcggggcgggaactgcagcggatcgggttgtctgccaccgtcggcaaccccaccgacctgctggcctggctgcagggcagcttccacacccgcaccagtgcggtcgtggcgcccgcggtggaaaccccagccgcacccgacatcaccgtcgactacgtgggctcactgaccaacgcggccaccgtgatcgcctccctgcacgcgggcgagaaacggttggtattcgtcgacagccgccgccaggccgaagaactcggcgccgcgctgcgcgacttggatatcgaaacctatatctcgcactcgtcgctgtcggccgccgagcggcgccgctccgaggcggcgttcgccgacgcccgcgacaccgtcatcgtcgccacctcgaccctggagctcggcatcgacgtcggcgacctggaccgcgtcatccagatcaactccacccgcacggtggcatcgttcctgcaacgactgggccgtaccgggcgccgccccagttcctcgcgcaactgtctgttcctctgcctggacgacgaggcggtgctgttggcctccgggatgctgcagcgctggtcgcagggttgggtggaaccggtcacccctcccccgcacccgcggcacatcgctgctcagcagttgatggccctgtgcctgcagcagcaccggatcggcgtcgcggaatggacacagtggtggggcgatctgccagtgttcgatgacactgcgccggagattctcgaatacctggtcgcggagggctatttcgcgaccgacgggccgttcctgcatatcgggccggaggccgagcggcggttcggtcggcggtacttctccgacctgaccgcggtattcaccgcgccgccggagttcatcgtgctcgccggccgtgtcgaggtcggcaccatcggcaccgatctgctgaccgagagcgtcgaggggcctcggctgttgctgctcggcgggcggtcgtggaaggtcacgcacatcgactgggaacggcggcgctgcttcgtcgaggccgtcgacggcggcggcaaggcgaagtggtcaggcgtgcccggcgggttgtcgcatgaggtgacccgcggaatgcgggaggtgctgctgggttcctcccctgcgggtgtgacgttcaccggtcgggcttgctcggtgctggccgaactccgggccggctccgccgacaccgtcgttgccgaccggtcgattgtcttcctgcccagcgattccgctgggcgatggtggacctgggccggcaccaaagccaaccggacgctgcaggcgtccttaccttccgtggtggatcctcggcagcgtattgatgagaagtcaatcaggctgctgcccggggtaactgtcgccgagttctctgcggcgctgtccgatgttcagtggcgcgatccggaggtggacgcgaatgcgatgcgggggctgaagttctccgcggcactgccgtccaagttggcgacgcagacgctcggggcgcgtttgggtgacaagcaacatgcgagtgcggtactgacagagaagcggtccatcacgaaatcaggagattga

SEQ ID NO: 3555 - DNA, 2133 bp, Nocardia cyriacigeorgica
atgaccgagaacccctgggatcggctcgaccccgtggttgtccaccacattgtcaacacactgggctggccgggccttcggccacttcaacaggccgcgatcacaccgctgatcgacggcgaggacgccgttctgctcgcgccgaccgcaggagggaagaccgaggccgcctgcttccccttgttgagtgccatggcacagaatcagtggaccggcacgtcgatcctctacctgtgcccgctgaaggccttgctgaacaacctggtcacgcgaatcgacgcgtacgcgcagtggctcggtagaagcgctgctctatggcacggcgatatctcgaactccaagcgtgaccggatccgccgcgagcaccccgatatcctgctgacgacgccggagtctttggaagccatgctgatcggcacaaagaccgaccacaacgcgtttctcagcagtatccgcgcggtcgtggtcgacgaggtgcatgcttttgccggcgatgaccgtgggtggcacctactggcggtactggaacgactgcagcggatctcaggccgcccgattcagcgagtcggcttgtcggccacggtcggaaacccggaccaccttctcacctggctacagggttcaggcgctggcatccggccgggccgagtggtcgccccggatgtccagctgccgacgacggtgaagacctccacacctccaccgggtgaggtcgaactcgactatgtcggatcgctcgacaatgccgcgaaagtgatcgctgccctacatcgcggcgagaagcggctggtcttctgcgactccaggcgacaagtcgaacatctaggcgccgctttacgagaacgcgacgttacggtatttctctcccattcctcactctcggtcgacgaacgcacccgcgctgaacaagcatttgccgaggcacgcgactgcgtcatcgtctccacatccaccctcgagctcgggatcgacgtcggcgacctcgaccgggtgatccagatcgatgcaccgacgacggtcgcgtcgttcctccagcgaatcgggcgcaccggtcgccgcgccggcagcgtccgcaactgtctgtttctcgcaaccaccaacgacgcgctcgtacaggccgccggcctgctgctcctgtggggtcgcgggtgggtcgagcccatcacggcaccgcccgaaccacgacatcttgtcgcacagcagctgatggccttaacgctgcagcatcaccatatcggcgaccggctatggccacaggaatggaacggcatcgcacctttcgacgcctccgctgccccgatacttcagcatcttctcgccgagggctacctcgacgatgacggcggactactgcatatgggcccggttgctgagaagcgattcggtcgccgacatttcctcgacctcacagcggccttcaccgcaccaccgcagttcactgtcctggccggccgcgacgagatcggccgaaccgatccatcggtactcaccgacgacaggccgggaccccggctgctgctgctcggtgggcgaagttggaaggtcacgtatatcgactggggccgtcggcgtgccttcgtggaaccggcggagggtggcggcgtagccaaatggtcgaacctgggcttgcgcggattgtcattcgaactcacccgcgcgatgcgcgagatatatctcggggcagatccgccggtggagttgacccggcgagctaaaacccagctgtccgacatccgggccaccgaagggacgggccacgctcacccgaccgcgactgtcatccatcgcgacggcgaacatgtccactggtggacctgggcggggttccgggccaatgccacgttggtagcgtctctttccggcattgtcgatccgacgcagcggccgaacgatttcagtatccgcctgcgaccggatctatcggtcgatatgtggcgtaacgcgatcctcgaccggatcacacgcctgccagcactcgaactgccgcaggtcgacgagcgcgcatgccgcggattgaagttctccgaggtgctgcccgaccatgcggcgagggcgacgatcgccgcacgtctggccgatcccgaatcggcacggcgggtactcggcgaggatacggtgttctacaccgtctga

SEQ ID NO: 3556 - DNA, 2028 bp, Polaromonas naphthalenivorans
gtgagcgagttcgacaagctgcacccggcgctgcagtaccacgtcgtcaattcgctgggctggagcagcctgcggcccacccagttgcaggcgatcgagccgattctctcgggcgtgcattgcctgctgctggcgcccacggccggcggcaagaccgaagcggccatcattccggtgctctcgcgcatgctgacccatgcctggcccggcgtgagcgtgatctatgtctgcccgatcaaggcactgctcaacaacctggagcagcggctctcgcattacgccaggctggtgggccggcgcgtggcggtttggcacggcgacgtttcgcagtcgaaaaaagggcatgcgttaaaggatgcccccgacatcctcctgaccacgcccgagtcgctcgaaggcatgctggtctccacgcgcattgaccgcaaagtctggtttggaaacttgcgcgtggtgattgccgatgagctgcatgcgtttgccgccgatgaccgcggctggcacatgcgggccgtgctgcaccgcctgcagcagtacgtgccccaggagatgcagcggctgggcctgtcggcgaccgtgagcaacccggccgaactgctcgattggtttgcgcccactggcatcaagcaggtcgtcggaagcgccagcgtgagcaccgatgccgatgtcaccgtggattttgtcggctctctggccaatgccgccaccgtcattgctcgtctgcatcggggcagcaagcgcctggtttttagcgactcgcgcagcagtgccgagcagctcaccagcatgctacgcgcgcaggaggtgcgcacctttttaagccatgcgtccctgagccactcggagcgaaagctggcggaaaccgcttttgccgaggaaaaggattgcgtgatcgtggcgacttccacgctggagctgggcatcgacgtcggggaccttgatcacgtgatccagatcgatgcgccagcgacggtgtcgtcttttttgcagcgcatgggccgcaccggacggcgggagggcgccaggcgcagctgcctgttcctgtgcaccaatgacgattcgctcatgctggccattggtatctgccggctgtggggtgaggcctgggtggaagccgcttacccgcccccggaaccctgggcgctggtggcccagcaggccatggtggctaccttggagcgcgcgcaatggccacggcgagaattgatcgcgctgctgtgcggagcgtttccggagtcaagcaggccaggcatcacggacgtgatcgaccatatggtggcctcaagctacctgatggacacgcacggcgtgctgcaaattggccccgcgactgaaaagcagttcgggcgggcgcattacaaggaccttctggcctcgttttccgggacgcagttgctgctggggcgttgcggcagcgccgaagtgggctacatcgaccccacgatgctggccggcgacaaaccggttcgcttgatcctgctggccggaaaaagctggcgcatcacggagatcgactggaagcggcaaacggtgtggctcgagcccgccaaggaaggcggcacggcgcgctggaacggcagcggacggaccctgagccgtgagatcgcccagggcatcctgcgcgcattgcgccagggtgcaggcgaacacaccgtgatttccaaacgcgcccggcttgaaatcgagcaggtcactcaagacctgcccgaaactggcaatgacggcgccctgtcagtcaccaggaatgaagcgggtgcggcccgtctgtggacttttgctggcacgcgcgcgaaccgcaccctcgccaggcagattcaatcgctggccgaaagcaggcgcattgatgcgatgggcattgacctgaaaacgcccgttgacctaagcgatctgagcgccgaactgttgtccacggcgcttgcgttttcgcccgaggaagtgaaggagcttgccaagccgatcaagttctcggagtgcctgcctgccacattgctgcttcagattattcgaaaaagacagtttggactttag

SEQ ID NO: 3557 - DNA, 2109 bp, Saccharomonospora viridis
gtgagtcaggccctcgagcgcctgcattccgcggtggtgcaccacctggtcaacacactgggctggcggtcattgcggcccctgcaacaacaggccgtcgcccctgtgttggacggacacgacgcgctgctgcttgcccccaccgcgggcggcaaaaccgaagccgcctgtttccccgtcctcacagcgatggagcaacagcgctggaccgggctgtccgtgttgtacgtctgcccgttgaaggcgttgctcaacaacctcctgccccgcctgcgggattacgccgcttggttggggcgccgggtggaactctggcacggcgacgtcccggcaacagctcggcgacacatcctccgtgacccaccggacatactgctgaccacgccagagtcggtagaagcgatgctggtcagcgccaatgtcgaacaccagcggctgttcggaaatctacgcgcgatcgtcgtggacgaggtgcacgcattcgccggcgacgaccgtggctggcacctactggccgtgctcgaacggctcaccgtgctcgcccagcgacccatccaacgcatcggcctttccgccacggtcggcaaccccgaacagctgttgcattggttgcagggctcaggacgggggcatcggcccgccaccgttgtcgcgcccggcgtgcacgcaccgagcgcgacaccacagggcgacatcgaactcgactacgtcggttctgtcgacaacgcggccacggtgatctcagcgttacaccgaggcgagaaacggctcgtgttctgcgattcgcgtcagctcgtcgaacagctcggcgccgcgttacgcatgcgcggagtcaccactttcctgtcgcatgcctcgctgtcggtggacgagcgccgtcgcgccgaggcggcctttgccgaagcccgtgactgcgtcatcgtgtccacatccacgttggaactgggcatcgacgtcggcgacctcgaccgtgtcattcagctcgactcgcccaccacggtggcgtcgttcctgcaacggctcggtcgcactggacggcgtgcgggcagcacacgcaactgtctgttcctcgctctcagtcaggagtcgttgctgtgggcggcagcgctattggaactgtggggtcgcggctatgtggaacccgtcaaagccccgttagaaccgagacacatcgtcgcccagcaagtgctggctctatgcctgcaggaacatgccgtgggcggccgattgtggactgaagcgtggaacggtctcgcaccgttcgaccgtagcgcggaacccattgtgcgccatctcgtcgaacagggttacttggaccgggacggcgaactgctctttatcggccccgaagccgaacgccgattcggccaccggaactttatggacatgacggccgtgttcaccgcgccaccacagttcaccgtgctggctggacgccaggagatcgggctcatcgatccgacactgttgacggagcgatcggaaggtcctcgagtattgctgctcggtggtcgcagttggaaagtgacgtgggtcgactggaaacgtcgacggtgcttcgtagaggaaaccaagcttaaaggaaaggcacgctggcacacacccggcgcaacaggtcgcagtgcggctctcgcccgtgcagcacgtgatgtgttgctcggtgccaccccaccggtgaaactcacacaacgtgccgtccaaacattgacgacactgcgtgagaagcgaattcccactgttgcttccgaggggctggtgatcactcgcgaggggagcacggaggcagacgtacgttggtggacctgggcgggccgcaaagccaacgccacactcgccgcttctttgccagaggtggtcgacggtcgtttcgacgatgtgtcagtgcgattgcgtcccgacctcaccccacaattgtggagaaccgccacaaccgatgctgcgcagaagctgtgtttgccggagatcgacgatcgtgcactcgccgggctgaaattcagtgtcgcccttccacctcaattggcggtcgacaccctggcctcacgcatggctgatctcgacacggcggccactgtcctgaatgagcccgttcggttcacaattcttggctaa

SEQ ID NO: 3558 - DNA, 2295 bp, Saccharopolyspora erythraea
gtgagtgatcaagaatttcagccgtcgtcggttgctcggggaaacgttcccgaaccgttcacgcggctgcatccggtgcttacacaccacatcgtcaacacgctcggttggcggtcgctacgcccattgcagcgggaggcgatcgacccggtgcttgacggttccgacgcgctgctgctcgcacccactgcgggcggcaagaccgaggccgcgtgctttccgctgctgtcagcgatggagacccacgcctggtcgggcgtgtcggtgctgtacgtgtgtccgctcaaggcgttgctgaacaacctcgaacaccgcctcgacacctacacctcctggctcgggcgccgggtcgggatctggcacggcgacgtcgcggccggggctagacagcgcctgctgcgcgacccacccgacgtactgctcacaaccccggaatccctcgaggcgatgctggtcagcaccaaggtcgaccacaggacgctgttcggcggtctgcgggcgatcgcggtcgatgaggtccattcgttcgccggagacgaccgaggttggcacctccttgctgtgttggagcggctgatgagggtggccggtcggccgatccagcgggtcgggctctcagcgacagtcgggaatccgcacgaactgttgtactggctgcagggatcgaggcgtggtgcgcggcccggggcggtggtggcaccgggtgttctgaacgggggccacgccacgcccccgggaacaacgtctccgactctcgaacaagagaagtcgtcgatctcgacgaacgcgaccggaaacaccggacccacgcgcatgatgtcctcagccgaggaagcagcagccacatcgaacgtcgttcagcgggtgcctccgcccggcgacatcgagcttgactacgtcggctcggtcgacaacgccgccaccgtcatcgccgccctgcatcgcggcgagaagcgcctggtgttctgcgactctcggcaactcgtcgaagaactcggcgcgtcgctgcggagcaggggcgtgacgacgttcctgtcccacgcatcgctgtccctggacgagcggcgtcgcgcggaggaggcgttcgccgacgccagggactgcgtgatcgtctcgacgtccacattggaactcggcatcgacgtcggcgacctagatcgggtcatccagatcaacgcgccgaccaccgtcgcctcgttcctgcaacgcctcggccgcagcggccgacgccccggcagcacccgcaactgcctgtttctggcgttgaggaaggacgcactgctgtggtcagctgcgctgctggagctgtgggggcgtgggtacgtggagcctgtcaccgcccccccggagccccggcacatcgtcgctcagcaactcctggcgctgtgtctgcagcacaacgcggtcggcgacgcgttgtggagcgaggaatggaacgggctcgcgccgttcgatcgcaccgctgagccggtcctgcgccatctgctgagagagggtttcgtcgagcgcgacggcccgatgctgttcatcggcccggaagccgaacgccggttcgggcgcaggcacttcatggacatgacggccgtgttcaccgccccgccccagttcacggtgctcgagggacgccgcgagatcgggcacaccgactcggcactgctgaccgagaaggtcgagggcccgagactactgctgctcggcggcagaagctggaaggtcaccagtatcgactggaagacccgccgctgctacgtcgagtccgccgacaagggcggccgagcgcgttggcagtccttcggcgcggggggagtcggtttcgcgcttgcgcaggccgcacgagacgtgctgcttggggcggtcccgccgatcgcgctgacgcagcgggcacaacgcgtgctggtcgaactacgtgagacgcgatccggccaggttagcgccgatgccacagtgatcacacgcgatggtaatgacgtccgatggtggacatgggctggcttccgcgcgaatgcgtcgctctccgcgacgttggaagacctaacggaccagtacacccgcttcgacgacgtgtcgatccgcctacgcggcgacctaacacgcgagatgtggcaggcgggagtcgccgaccccgaaacccgctcgcgtctaccggaaatcgaggaaagagcactgaacggcctcaagttcaacgaggcactcccgcaggaactggcaacgtcgacgctggcggcgcggctagcggacatcgacggggcgatcaaggcgctgaagcaatctgtgcggttcgttgcgcagggatga

SEQ ID NO: 3559 - DNA, 2112 bp, Saccharothrix espanaensis
atgtctgacgcgacggccgcagcgctcgccgcgctccacccggctgtccagcaccacgtcgtgaacaccctgcgctggcccggtctccgaccgttccaggcggcggcggtcgggccggtgctgtccggggtggactgcctcctgctggcccccaccgccgggggcaagaccgaggcggcgatgctgccgacgctgacccgcatggcgtcggaacggtggtccggcatctcggtgctctacgtctgcccgttgcgggctctgctcaacaacctggcaccacgactggccggctacaccgggtggctcgggcgcagtgccgaggtatggcacggcgacgtcggccaaggacaacggcgtcggatcctgcgggacctgcccgacgtcctgctcaccacgcccgagtcgctggaagccatgctggtgtcggtgaacgtcgacacccagcgcacctttcgcgatctccgggccgtcgtcgtggacgaggtgcacgccttcgcgggcgacgaccggggatggcacctgctggcgctgctggaacgactggcgcgggtcgccggccgggaactccagcgcatcgggttgtccgccacggtgggcaacccggacgaactgctgacctggctccagggaggcgctcgccaccggccgcgtgaggtggtcgcgccccaggccacctcctccgtcaccccggaggtcacgctcgaccacgtgggcacggtcgacaacgcggcgaaggtcatctccgcgttgcacaagggcgagaaacgactcgtcttcgtcgacagccgccgccgggccgaagagctcggcgcggccctgcgcacgcgcgacgtgacgacgttcctctcgcactcatcactgtccgcaggcgagaggcgtcggtcggaagaggcgttcgccgaggcgcgggactgcgtcatcgtcgctacctcgaccctcgaactcggcatcgacgtcggcgacctggaccgggtgatccagatcgactcgccgcgcaccgtggcctcgttcctgcaacggctgggtcggaccggacgacgtcccgacagcagccgcaactgcctgatcctgtgcctcggccaggaatccacgctgaccgccgcagggctcttggaccggtgggcggcaggttgggtggagccgatcaccgcgcccccctcgccgcggcacatcgtcgcccagcagctcatcgcggcggcgttgcaggaaaacacgatcgggctgcggacgtggcgcgagcggtgggcaggactgccggtcttcggggatgactcaccgcggatcttcgcccacctgctcgacgcgggcttcctcgacctcgacggcgatctggcgttcatcggtccggaggccgaacgaaggttcggtcggcggcacttctccgacatcacggcggtgttcaccgcgccgccggagttcctggtgctgtccggacgcgaggagatcggccaagtgggcgacgacgtcctgctggccgacgtggacggcccacgggtgctgttgctggccggccggacgtggctggtgacccacgtcgactggtcgcggcggcggtgccacgtgcagccgacagacctcccgggccgggcgcggtggggcagcggaggcggcggcatgtcctacgacatcacccagggcatgcgcaacgtcgtcctcggccacgacccgaccggggtgcacctcacgcggcgcgcggtgtccgcgttggccgagctgcgcgaacggcacagcacccacaccgccgccgacgccacagtggtcggctggtcgtcgaccggtgaggtgcactggtggacgtgggcgggcaccgccgccaaccggacgctgcacgcgtcgctccccgaattggtcgacccacggcaacggatcggcgaccacgcactgcggctccgcccggagctgaccgtcgacgagatgcaccgctccctgtcgatgtgcgaactccgcccgcccgaggtgaacccgagcgccgtctccgggctgaagttcgccgcggccctccccgaggacctcgccatcgcgaccgtcgcggaacgtctggtcgacctcgccggtgcacgagccgcactcgacgcgccccgacgccaccaccgcgactcgacgggaccatga

SEQ ID NO: 3560 - DNA, 2109 bp, Singulisphaera acidiphila
atgtgcgccttcgaccagctccacccggcgctccggcaccaggtcgtcaattccatgggttggcgatcgctgagaccggttcaggaactggcgatcgagggcgccctcgccggcgacaacttgctcatcctcgcaccgacggcggggggcaagaccgaggccgccttcttccccctaatttccgagacgctctcgcagtcctggactggcttgtcggttttatacatcagcccgatcaaggccttgctcaacaaccagaatgagcgtctcgagcgatactacgggctggttggccgacaggcggcgctctggcatggcgacgtctccgcgtcgatcaagaagcacacgctggccaacccacctgattgcctcctgacgacgcctgagtcgctggaagtaatgctgacatcaacttcgatcaaccacaaccggctgttcgctaacgtccaggccgtggttgtggacgaggtccacgccttcgctcgagacgaccggggctggcacttgctcgccctcttgcagcgaatcggccggctcgcgggccgcgaccaccaacgaatcgggctttcggccacagtgggcaacgaggacgacctactcacctggctttcggccggctctggtcgttccaggcgagtcatccggccgcccgccatacccgagccgccgcccgaggtgcaactcgactatgtcggcaacctcgacaatgctgccacggtcatcgcggctttgcatcgtggtgagaagcggctcgttttttgcgatagtcgatcgcgggtcgagcaactcgccgctgaactacgaatgcgacgagtcgagaccttcgtctcgcacagttcgctcggactcgacgagcgccagcaggccgaacgggcgttcgcccagggtcgcgactgcgtgatcgtggccaccagcacgttagagttggggatcgacgtcggtgacctcgatcgcgtggtccagatcgatgccccaggtgcagtctcgtcgtttttacagcggatgggccgcaccggtcgccggcctggcatggcgcgcaattgcctcttcctggcgacctctgacgagagcctccttcgcgcggccggtctgatcgatctttgggcctccggcttcgtcgatccggcgacagcaccgcccgagccgctgcatatcctggcgcagcagctcctggccttggcgctccaggagcgggggatcggccggggcgaatggctggactgggtcgggacggtccctgccttccgttcagtggggcgcgataccgtcgattcgatcgtcgcaggcatgatcgagaaggagatcctctgggacgaggcgggcgtgctctggctcgggcgcgagggccaggacacctatgggcggaagaatttcctccagctgatctcggtgttcacggctccccctctcttcaccgtcttacacggtcgacgcgagcttggatccgttgacgaatcgaccttcttgacccgccgcgaggacggactgccggtactcctgctagccgggcgggcctggcgtgtgacccacctggactggaagcggcgcagggcgtacgtcgagcctgccgaggatgttggccgctcgcgctggcggggcgaagggcagtttctctcaggcgagctctgcgaggcgattcgccggaacctggctggagacgagatctccccgcgatggtcggtgagaaccgtcagacgcatggaggctgttcgcaatgagttcccttggctgacccgggatgacgcgaccatgctcgtcacgtcggatggcgataccacctggtggacgttcggcggcggtcgtgccaacgccgccctcgcccacgaactggggcgacggaccggcgaccgggtcaagtttgacaattttgccgtccgattcccagcaaagttcgctgcgcaagacgccgagacccagctccggggcttagccgatgcagccccaggccagatcgtgcccccggccgatgagcaggctttggacggcctgaaattctcggaatgcctaccctccggactggcgagccgcgtcgtccaaacacgactctccgacatccgaggcgtggctgaggtgctggaacgacccatgcggatcgtccacgaatgctga

SEQ ID NO: 3561 - DNA, 2142 bp, Sorangium cellulosum
atgacgggcttcgacaggctcaccccggcgctccagtaccagatcgtcaatacgctggggtacgccaggctgcggccggtgcaggagctgacgatcggtcctgtgctcgacgggaagaactgcgtcgtcctcgccccgaccgccggcggcaagacggaggcggcgttctttccgttgctctcggcgatggacgccgccgactggcgtcctacgtcggtaatctacctgtccccgatccgggcgctgctgaacaaccaggaagagcgagtgacccggttcgcgacgacgcttggccggcgggtcgcgaagtggcatggcgacacggggcagggcgcgcgcaaggcgttcttgagcgattcgacggacatcttgctcacgacgccggagtcgctcgaggcgatgatgatgagcccacgggtcccggcgaagcgggtcttcgcgggcctgcgcgcggtgatcatcgatgaggtgcacgcgttcgccggcgatgatcggggtgcgcacctcgcggccttgctggagcgcctgtcccgcttttgcggcaacgacgtgcagcggatcgggctgtccgcgaccgtgggcaacccagagcagatcctggcctggctgcaggggcggtcgcggcgacccggaaccgtgatctcgccgccgagggaggcgagcgccccgcggctcgagctcgattcggtcgagacgatggagaacgcggcgtcgatcgtgcgcaggttccacgccgggagcaagcggctggtcttcgtggactcgcggcgtggggtcgaggagatcggcacccgcctgcgccgcgacggcgtcgacgtgtacatggttcacggctccctctctgcgccggagcgccgcgacgccgagcgtgccttcgccgagcgaaccgattgcgtgatcgtatcgacgagcgccctggagctcgggatcgacatcggcgatctcgaccacgtcatccagatcgacagcccttccacggtggcgagcttcctccagcgcctcggccgcacggggaggcgcgccggcgcccaggccaactgcacgttcctggcggtcaaacccgctgccgctttgcaggccgccgccctgatgcggctgcaccgccagggttacgtggaggatgtccgcgccgagcgtcgcgcggcgcatatcctggcgcatcagctcctcgcgctctgcatcgaacacggcggcatcggtcgcggcgactggttcgcctggctcgacggggcgacctccttcgcggatatcggccccgaggagcgcagcgccctcgtggaccacatgctcgaggaaggcatcctctccgaccaggaaggccgcctgtggctcggcccggagggcgagaagctgtatgggcgtcgcaatttcgccgagctctacgcggtcttctccaccccgcggctcatccgcgtgcagcacgacacgcacgacgtcggcaccgtcgacgcgtcgtttctagaggcccttgacagcgatgcccgtcgggccgccttctcgctcggcggccgcgcctggcaggtggtccatatcgcgtggggccgcggcctgtgccacgtgaagccggccgacgccgcgccgagcgcccgatggagcggcagcccgacctttctgggctaccggctctgccaggcgatgcgcgaggtgctcgtgcaggaggggtatgatccgggctggtcggcgcgcgcgcggctcttgatagacagcttgagggtcgagcacgcttttctccgcgaagcggacgagtgtaatggcccctcgccgatggtggacgacggcggggacaccgtggtctggtggaccttcgctggcgggagggcgaacctcttgctggcgcgcatgatcgaggcggagctcggggggaagtgcgtctcgaggaacacctcgatcacgtgcaaggaagaggcagggaagagccaggcggcgcttcggcaggtcgtgcgccagctcgcggcggaggggaggccgaacgacgcggacgcgcgccgctgggccgacgccgcggcagggagaggcagggtgtccaagttcgcgccgtgcctgacggaagaggcgctgacggcgtacctggtggagcggatgatggatgtggagggggcgagagaggcggtgaagggaggcgcggggtctcgggagatgtga

SEQ ID NO: 3562 - DNA, 2196 bp, Streptomyces coelicolor
atggcggatgccgacagctcgcccgagacggaaggggccgacgtactcgacaggctcgaccccgtcgtcctgcaccacatcgtcaacaccctcggctggtccgatcttcgcccgctccaacgagcggcgatcaccccgctcatggagggcgaggacgccgtactgctggcaccgacggcgggcggcaagactgaggcggcctgcttccccctgctgtcggccatggcagaacagaagtggaccggcacctcggtgctctacctctgcccgctcaaagcacttctcaacaacctcgtcagccgcgtcgacacgtacacccagtggctgggacgacgtgccgccctctggcacggcgacaccaaggagtcgcagcggcagcgcattcgaaccgaggcccccgatgtcctgctgaccacgcccgagtcgctcgaggcgatgctgatcggcgtcaagaccgaccacgcacgcctgctggggagcgtaagggccgtggttgtcgatgaagtgcacgcttttgccggcgacgaccggggctggcacctgttggccgtactggaacggctcgaacaagtcaccgggcggcccatccagcgcatcggtctgtccgcgaccgtcggcaatccggatcagttgctggactggctgcagggcgcgggcgtggagacccgcgcagggcgcgtcgtcgctccaggggtgacgctgccggcgttcgaggcggtgggcagcgatcggaagcccaccgccgaagaggttccccgtccggcgggcgaggtcgaactggactacgttgggtccctcgacaacgcggcgaaactcatcgcaaccctgcatcgcggcgaaaagcgtcttgtcttctgcgactcccgagcccaggtcgaacaactgggtgccgcactgcgcgcccgcgaggtgacggtcttcctgtcccacgcctccctctccgtcgacgaacgtacccgctccgagcaagccttcgccgaggcccgcgactgcgtcatcgtttccacctccactctggaactcggcatcgacgtcggcgacctggaccgcgtcatccaaatcgactcaccggccaccgtcgcctcgttcctgcaacgcatcggacgcaccggccgacgtgcgggtacggtgcgcaactgcctgttcctcaccacacgcaaggacacgctgttgcaggcggccgggctgttgctgctctggtcgcgcggctgggtcgaaccggtcaaaccacctccggagccacgtcatctggtggcccagcagctcctcgccgtcaccctgcagcagcacaagctgggcgaccagttgtgggaccggcagtggaacggcctggcccccttcgaccagtccgcagctcccatcctgcggcacctgaccgaagagggctttctggacagcgacggcggtctgctgttcgtcggtcccgaggctgagcgacgcttcggaaagcggcacttcatcgaactcaccgcttccttcaccgcaccaccgcagttcaccgtgctctccggccgaaccgaaatcggacggaccgacccgagtgtgctcaccgaagaacgacccggcccgcgccgattgctgctcggcggacgcagttggcaggtcacgtacatcgactggctgcgcaaacgcgtcttcgtcgaacccgccgacagcgggggtatcgccaagtggatgaacggaggcatcgccggactcacgtacgccctgacgcgcgccatgcgcgaggtcatgctcggcgaagaccctcccgtggtgctcacccggcgggcccaggcgcgactggccgagcagcgcgagagcgatgcacccgacaccgtgcacccggacggcacgctggtcacccgtgcaggcaacgacgtccgctggtggacctgggccggataccgcgccaacgccaccctcgcggccaccctgcagtcagtcaccgacccactgcagcgccccaccgactgctggctgcgcctgcgcgaggacctcgacccggccgactggcacgccgcccgaaagagcgtcggtgaaagccttgtcctgcccgacgtcgacccacgcgctgtacgtggtctcaagttctccgccgcgctccccgaacgccttgcgatcgcgacggtggccgcccgactggccgacttcgacagcgcatggttcgtactgtcggaggccgtgcgcttcgtcgtctccagcgatcgcgcctga

SEQ ID NO: 3563 - DNA, 2139 bp, Streptomyces griseus
atggggcagcaaccggtggccgaggatcctgtggaccgcctggatccggttgttctgcaccatgtggtgaacacgctgggctggccggacctgcgccctttgcagcgggcggcgatccgaccgctgatggacggtgaggacgcggtcctcctcgctcccacagcaggcgggaagacggaagcggcgtgtctgccgatcctgtcagccatgtcggagcagcgctggtccggcacgtccgtgttgtatctgtgtccgctcaaagcgcttctcaacaacctcgtgacgcgcatcgacggctacgcgcagtggctcggtcgccgggccgccctgtggcacggagacaccagggagtctcagcgacagcgcatccgcgccgaccggccggacatcctgctcactactccggaatcgctggaggccatgctcatcggcgtgaagaccgatcacgcgcaccttctgggaggtgtgcgagcggtcgtggtcgacgaggtccacgccttcgcgggtgatgaccgtggctggcatctgctcgcggtgctggaacgtctcgaacgagtcaccgggcgtccggtccagcggatcggtctgtcggcgaccgtcggcaaccctgagcagttgctgacctggctgcaggggtcgggcgcaggcaagcggccggctggcgtgatctcgcccggccctgccgcgatcggcacaacgccgaccggcgaggtggagctggactacgtgggttcactggagaacgcggccaagctcattgccgtactgcaccgcggtgagaagcggctcgtcttctgtgactcccgacggcaggtcgagcagttgggagccgccctgcgtgagcgggatgtgacggtattcctgtcgcatgcctcgctctcggcggacgaacgagcgcgatcggagcaagctttcgccgaggcccgggactgtgtgatcgtgtcgacatcgacgctggaactgggcatcgacgtgggcgacctcgaccgtgtgatccagatcgactcgcccagcagtgtcgcctcattcctccaacgcatcgggcggacagggagacgaccggggagtacgcgcaactgcctctttctcgccacccggaaggacacactcctccaggcggcagcactccttctcctgtggggaaagggatgggtggaggcggtgaccccgccgcccgagccccgccatctggtcgcccagcagttgctcgcggtcatcctccagcagcagcgggtaggtgaccgactgtggccggtccagtggaacgggctggcgcccttcgacgcctccgcgaagccgatcctgcgccacctggtggcacaaggcttcctcgacgaggacgacggcctcctctttatcggccctgaggcagaacggcgcttcggacgccgtcacttcatcgagctcacagcgtccttcacggcaccgccccagttcaccgtcctcgccggccgtaccgagatcggccagatggacccctcggtactgaccgaagatcggcccggtccacgtcgactcctgctcggtggccgcagctggcaggtgacgttcgtcgactggacccgcaaacgagcctttgtcgaaccgacagacggcggcgggatcgccaagtggagcagtggatccgtcctcggcctgtcgtaccacctcacccgtgccatgcgcaccgtactcctcggggagaaccctcccgtgtccatcacccgccgggccgaggtctgtctgaccggctggcgggaggacgaggctcccgaacttgtccacccggccatgtccctggtcacccgtcatggtgcggacgttcgctggtggacctgggccggctaccgcgcgaacgcgaccttgtcggcgacgctgccgtccgtcgccgatcccgtgcaacgccccacagactgctatgtacgactgcgtgaggacctgacccccgacatgtggcgcgaaagtcgggaggctgcgagcagcagcccggcgctcgttcttcccgacatcgatcgccgcgccgtacatggtctcaagttctccgcagccctgccccaacggctcgcagtggccaccgtcgcggcccggctcgccgacttcgagggagcacgctcggctcttgacgaaaccgttcgattccaccacggcttcgcgacctga

SEQ ID NO: 3564 - DNA, 2136 bp, Thermobifida fusca
gtgaccgcccccaccagcttcgacctgctccaccccaccctcgcctaccacgtcgccaacaccctcggctggcccacgctgcgccccctccagcgggaagccctcgcccccctcatcaacggcgacgacgcggtcctgctcgcccccaccgcgggcggcaaaaccgaagccgctgtgttccccctgctcaccgccatggccaaccagcagtgggaccgcgtctccgtgctctacgtgtgcccgctcaaagccctcctcaacaacctgctgccccgcctccagggctacaccggctggctcggccgcaccgccgccctctggcacggcgacgtcaccgccgcggcccggcagcgcatcctccgcaccccgcccgacgtgctgctcaccacccccgaatccatcgaagccatgctggtgagcaccaccgtcgaccaccgcgccctcctcggcaacgtccgcgccgtcatcgtcgacgaagtccacgcattcgcctccgacgaccgcggctggcacctgctcgccgtcctcgaacgcctcacccggctgtcccaacggcccctgcaacgcgtcggcctctccgccaccgtcggcaacccgcacgacctcctcacctggctgcaaggcagcaacgcgggcaaccgccccggccgcgtcatcgcccccggtgtgccccgggtcagcccagccgcagcgaaaaacgggccaccacccggcgaagtcgaactcgactacgtgggctcccccgagaacgccgccactgtcatcgccgccctccaccgcggcgaaaaacgcctcgtcttctgcgactcgcggcaactcgtcgaacgcatcggcgcggccctccgcgccaaaggcgtcaccgtgttcctctcccacgcctccctgtccgtcgacgaacgccgccgcgccgaacaagccttcgcggaagcccgcgactgcgtcatcgtcgccaccagcaccctcgaactcggcatcgacgtcggcgacctcgaccgggtcatccaaatcaacgcgcccgccaccgtcgcatccttcctgcaacgcatcggccgcaccgggcgccgccccgacaccacccgcaactgcctgttcctcgccctcaacgacatgggcttgctcggcgcggccgggctcctccacctgtggggacagcattgggtggaacccgtgcaccccacccccgaaccccggcacatcgtcgcccaacaactcctcgccctcagcctccaagaacccaaagtcggagaacggctgtggacggaatggtggaacgggctcgcacccttcactgaaggggagccgatcctcgcccacctgctccgcgaaggattcctcaccagcgacaacggcatgctcatcgtcggccccgaagcggaacgccgcttcgggcaccggcacttcgcggaactcaccagcgtgtttacggccccgcccgaattcaccgtgctgcacggccgcaccgaaatcggccgcaccaacccggcgctgctgtccgcagccgaacccggggaagggccgcggctgctcctgctcgccggccgcagctgggctgtgaccggagtcgactggaaacggcgccgctgctacgtggaacccgcagacagcggggaaggacgagcccgctgggactctgggactgtgctcggctggtcgttcgaactagcgcgggccgtgcgcgacgtgcttctcggcacggatccacccgtgaaactgacccgacgtgccgtcgacgctttaacgcacgcccgagaccggcacgccgaccacgtgcaccccgacggcaccgtcatcacccgcagcaacggggaactgcgctggtggacgtgggcgggcacgcgcgccaacctcaccctgcgcgccaccctcagcgggattgttgacccgggccagcaggtccgcgacacccacctgcggttgagcggggacgtggaccggacccggtggcgggccatccgcacggctgccgccgagcgcatcgtgctgcccgaagtcgacgacaaagccctgcacgggctgaaattcaccgcagcgctccctcgccacctcgccgaacgcacgctggccgcccggctcgccgacgttgcaggggcacggactgcgctcaccgaacccactcggttcgtcgtgggggagtag

SEQ ID NO: 3565 - DNA, 2100 bp, Hahella chejuensis
atgactggattcgaccggcttcaccctgccattcagcaccacatagtcaacagcctgggatggccgggcttgcgccccttacaagaagcaaccattgagcctgtcctcaatggagagcacgcaattttgttggcccccaccgcagggggaaaaacagaggcggcaagcttccctattttttcgcggatgcttacagaaaattggcagggcctcagtgttctgtacatttgtccaattaaagcgcttttaaacaatcttgaggaacgacttagttattacggtcacttgcttggacgccgcgtgggtgtttggcatggcgacatttctacctcagtgaaaaataagatactggctgaccctcctgatctgctattaaccactcccgaatctatcgaggtgatgttggtttccaaccggatggatcaccgacatctttttgagggattgcgtgcagttattatcgatgaagcacatgcatttgctggagacgaccgaggctggcatttgctagctgtgctggaacgtttgagttatttaactggccgcgagttgcagcggcttggtctttccgccactgtgggcaaccctgagacgctctgcgactggttggctggaagctgtccatctccacgcagtgtcattaaccctccagctccaaatactgttgttcccgaaatccaggtagattgggttggctccgttcggaatgctgcggtcgtcatctcgcgacttcatcgaggtgagaagcgactggtgtttgtagacagtcgctcacgtgtcgaagaattggcagtggaattgagaaatttaagtgtaacaacttatgtttcccatagttgtttaagcttggatgaacgcaggatggcagaggaagcattcgctcaaggcagcgattgtgtgattgtggcaacatcgacactggaactgggtattgacgttggtaacctcgaccgggttatccagattgatgcgccatttacggtatcttcatttcttcagagaattgggcgtacaggaagacgagctggtagctcaagaaactgtttgttcctggcaaccaaacaagatgcatttctcagagcgattgcgttgcttcggctttgggaagcaggttacgtcgaaccaatagagccgccaccattgcctttacatatttattgtcagcaggttatggcgttggtgctgcaagagaaaggtatcgccgaagcagacctttctaaatggattggtcgtatgcccggttttacacagttttctgtgtcagaccgttccagcttagtcagctatatgttagagcgttcaatacttcactccgatagcggcattattggtattggtgattccggtgaacgaatattcgggcaaaagaattttctcgagctattttccgttttcaccagtccgccgatggtgaaagtattcaacggtaaacaagaactaggtgaagttcaccagctgacgtttgctacaaaagaggatggtccagcctgcttaactcttggagggaaaagttgggtaactaaatatattgattgggccaggaagaaggcgtttgttgaaccgacagacatcaaagggcgatctcagtggttgagcatggggcaaccgctccaatttgaaatgtgccaatcgattcaacgcgtgttggcatctgatgacatcgacccgtggctctctaatcgcgcagcggcattacttgaaagcctaaagcaagagtttgattgggtagaaaatggcaagacgcttattacctacacgaaagataacgcaacttggtggacatttggcgggagactttttaattcaacggcctctcatttgttttcttcggaatccgatcaggtaaaaagtgataatttggctgtggagtttatcggagtcattgaccgagacaatcttatacaacgcattcgcagctttttagcagagtcattcgagcagttgccggccattttggatgaacgatttgttgaagagcttaagttttccgaatgcttatcccaagagtttgcggataaagaattgagttgtcgattcgatgttaaaaaagtatttgaagcgataaggaatatggacctaggtattattcagattggatag

SEQ ID NO: 3566 - DNA, 2121 bp, Planctomyces limnophilus
atggtaagcgttttttcaagactggctccgcgactccagcaggccatcgttgcccgacttggctggtccagcctacggcctgtccaggaactggcaggtgaagcgctactaagcggcagaaacgcagtgattctggccccgactgcgggggggaagaccgaggcgtcgatgtttccgacgctgtcgaatctggtcgatcaacagccggtcggagtcggagcaatctacgtcgctccgatcaaagcgttactgaacaaccaggaagaccgtctcgggctttataccgagatggtcggacttcgacgttttgtgtggcatggggataccacgaccagtgcccgcaaacagttcctggacgatccggcagaacttctgatgacgactccggaatcattggaggtgatgctggtttctcagcgcgtggatgagcgggctctcttcggtgacctgcggatgatcgtgatcgacgaagtgcacgcgatcgcgggcactgaccgtggcgcgcacctaatgagcgtgattgaacgcattcggcgagtttcccgccacgacattcagagagccggactcagtgcgacggttggcaacccagcagcgattcttgaatggctcaagggaacatcggaacgtgagggagtcgtcgttgatccgcccaagaggccctctcgaaggcagctgctgatcgtccatgaggccgaccagacgcagattgctgttgcggcggcgcaggttgcccgaggttgcaagagcctgttcttctgccagtcccgggccacgaccgaggctgtggcggaaacgatgcgacgatccggaacgaccgtcttcgtccatcacagcgctgtctccaaagaggaacggctcctggcagaacaggagtttcatcacggatccggtgcatgcattgtctgcacgtcaacgctggaactcggcattgacgttggtgacctcgataaggtcttgcaggccaacgcacctgagaccgtcgggtcgttccttcaacgaatggggagaactggccgtagggagggacaggcggccaacaccaccttcttttgcgagagcacggactcaatattgcaggccatcgccctgatcgaactggcgaaggctggttgggttgaagatgttccggtgaaccagcgttgctggccggtcctcattcatcagttgctggcgatgtcgctggctgaaaacggtattcctaccgacgtggcttggaaacacctttgtggcgtgcctgactttcagcggatcagccgaaaggagttcgatcggctgattgagtggatgatacaggatggctcattgcttctgatgagtggccgactgatcctgggaccccaggcggagcgacgatttggccgccgcaacttcatggagctatacgcagtcttttcgagtccccaatcgtacaacgtagaaacggtcaaccggcaggtcatcggaaccttgactcaggatttcgttgatgggctggttgatggcgtgagttgtttccttctgggcgggcgtgcgtgggcggtatttcaggttgtccataaagatcgactggtcgttgtcgagccagccccgcgaggacgacagccgacatggggtgggtacctaccccaatttctggggttccacctttgtcagaagatcctggagatagtcaccgccgacgacgaataccaatatcttatgccaccagccgctgatctggttactcaagaacgaaaccgaatggagtgcctggttgagccgattgttggtggaatcaacttcaataaggatgggaatgaggtcatttggcacacatttgccggaggcagggtcaattcgacgattcggtatgcgattggtgcgcttcagccgacatggaccatcacacctgacaacttctccgtgagatttagagactcggatataactgaaacagccttcaaatcagtgatccgagaactggcatccaccgacttctggaacgatgattctgtctggcaagaagtccgggctgcactgccgggttatcgcctcagcaagttccaaccgttaatgccggcgtgtatcgagcaagaggttctgttcgattatttgttggatcgacatcaaacggctgattgggtcaggaggattttatga

SEQ ID NO: 3567 - DNA, 2106 bp, Anaeromyxobacter dehalogenans
gtgagcgcgttctcacggttccccgcccggctgcagcaggcgatcgtctcgcgcctcgggtggacggcgctgcgtgcggtgcaggagctcgcgggcgaggcgatcctcgatgggaagaacgcggtcgtgctcgcgccgaccgcaggcggcaagacggaggcgtccatcttcccggcgctcgcgaacctcgtcgagaacgggtgtgaaggcgtcggcgtggtctacgtcgcgcccatcaaggcactcctcaacaaccaagaggaacggctcggcacgtacacggagatggtcggcctgcgccgcttcgtgtggcacggggacgtgccggaccgggacaagcgcgagttcgttcgggagcccgccgagctcctgatgacgacgcccgagtcgctcgaggtgatgctgctctcgccgcgcttcccgacgccgaaggtctttcccgaccttcgcatggtgatcgtcgacgaggtgcacgcgttcgctgggaccgagcgcggcgcacacctcatgagcgtcctcgagcggctcatcaagagcacgaagaatgacgtccagcggatcgggctgagcgcgactgtcggaaacccggaggaaatcctcggatggttgcaggggacgtcgcgccgggccggcgtggtcgtcgatccgccgaaggtgtccgcccggcgcgagttgcacgtttcactccacgagagcgtcatcgacatcgcccgggacgcggctcggcgtgctgcggggaacaagagcctgttcttctgccagagccgcgcgttgaccgagtccgtcgctgagaggatgcgtgggcacgggacggaggtgttcgttcatcacggctcggtgtcacgtgaggagcgccacgacgcggaggcgcaattcaaccacggtacgaacgcctgcatcgtctgcacgtcgaccctcgagctcgggatcgacgtaggagatctcgacctcgtgatgcaggcgaatgccccgagcaccgtttcgtcgttcctccagcgcatgggccggacgggccggcgcgccgggcagaccgcgaacacgagctttttctgcgaggacgaggacgcggcgctccaggcggtcgcgctcgtcgagctcgcgcgcgagggctgggtggagcgggtgccagccgcacgccggtgctggccggtgttcgcgcaccagatcttcgcgctaacgctgcagtacggagcggtgagcccggagcgctgctgggagcacctccacgtcgtgcgggacttcgcggacatcagccgcgacgagttcgagcgcgtgctcgaccacatgaagcgccacgagtacctcttcgagtccggcggcctcctctcgctgggccagaaggccgagcgggtctacgggaagcggaacttcctcgagctgtacgcggtgttctcgagcccggtgctgtaccaggtcgagactgccgctggccgggcgctcggctccctcgagcagaacttcgtggaccagctcgtcgaggagatgagcgcgttccttctcgctggtcgcgcgtggctcgtcgaacacgtgcaccacgaggaccgcgtcgtccgcgtccgagaggcgccgcgaggccagaagccgagctggggtggattcgcgccttccctgctcgggttcgagatctgccagcgcatgaagcgcgtcctgaccgactcgacgccggttccctacgcggacgctgccgcgatgcgcgcgatcgaggcccgccgcaaagacctcggggataccctgcggcggcccatcgcgatgcaaacggacgagggggtggtgcggtggtggacgttcgccgggggcaagattaaccagaccctcaaatacgggctcgagtggagtcacgactggtcggtgaagggcgataacttcgaactgcggatctcgggcgcgggggtatcggacggtgccgtccgcgaggccatccgcgaggtgtcttcggctgcgttctgggacaagccggagaccagatcggcgattcttggtcggcttccggcgtaccgcctgagcaagttccaggacgcgctgcccgacgtgttcgctgtagagctggtgggcaactacttgctagacgtgccgcgcgcgcaggcgttcgcgcagtcggtcctctga

SEQ ID NO: 3568 - DNA, 2778 bp, Haliangium ochraceum
gtgagcgtgttcgcgcgctttcccgcgcgcctgcagcacgccatcggcgcgcgcctgggctggaccgcgctgcggccggtgcaggaagaggccggcgccgccatcctcgccggcaacaacgccgtgatcctggcgcccaccgccgggggcaagaccgaggccgccatgttcccggtgctcgccgatctcgtggccgcgcccggcctggggccgtcggtgcgcgcgctgtacatcgcgcccatcaaggcgctgctcaacaaccaggccgagcgcctgggcctgtacacggagatggtcggcctggagcgcttcctgtggcacggcgatgtcggcgccagcgagcgccagcgcttcttgcgcgagcccgccgacctgctcatgaccacgcccgagtcgctcgaggtcatgctgatctcgcccaagatcgcggtgtccgaaatctttgccgacctgcgcgtggtgatcgtggacgagatccacgccctggccggcaccgaccgcggcgcgcacctgatgagcgtgatcgaacggctggcccagcacgccgggcgcgacgtgcagcgcgtgggcctgagcgcgactgtgggcaaccccgacgccatcctgagctggctgcgcggcacttcgcagcgcggcgacgtggtcgtggacccgcccaagccgccgacgcggcgcgagctgctggtgcacctcgacggcgccctgggcggcctggccgggcgcgcggccaagcgggcggcgggcaagaagagcctgttcttctgcgagagccgggcccagaccgagcagatcgccgagcgcctgggcgaccgcggcgtcgaggtcttcgtgcaccacagcgcggtgtcgttggaggagcgcgagcgcgccgaggagcgctttcagcgcggcggcgatgccgccatcgtgtgtacatcgacgctcgagctgggcatcgacgtcggcgatctcgaccaggtgttccagatcggcgcgcccagcaccgtgagctcgttcttgcagcgcatgggccgcaccggccggcgcgcgggcagcgtggccaacacgacgtttctgtgcgacgaccccgagagcgtgctgcaggccgtggcgctcatcgagctggcgcgcgtcggctgggtcgaatcgacgccggcgcagacccggtgctggccggcgtttgtgcatcagaccctggccatgtcgctgcagcagggcggcgtgcggcgcgacgagctgcgcgcgcacctgcggcgcgtgcccgacctcgccgggatttcggacgccgagttcgacgaggtcatcgcgtacatgatccggcgcggatttttgtacgacagcggcggcgtgctggtcatgggcagccgcggcgagcgcgcgttcgggcgccggaatttcctcgagctgtacgccgtcttcagcagcccgcagtactaccgcgtgcacacccagaacggccgcgagatcggctggctcgagcagcagtttgtcgacggcctggtcgagaacatgagcagctttctgctcggcggccgggcgtggctggtgcacgcgatccatcacggccagcgcgccgtgagcgtgtcgccggcgccgcgcggcaagaagccgagctggggcgggtttctgcccaaattcgtcggtttcgagctgtgccagcgcgttcgccggctgctggtcgaggacgagacgcccgcgtatctgtccgacgacgcgcgcgcggcgctcgagagctatcgcgaggagtttggcgagctattgcggcgcagcggccacgccatgcagtgggacgacggcagcgtgcgctggtggacctttgccggcgggcagatcaacagcacgctcaagtacgcgctggccgagaccacgagctggaagatcgtggccgacaactggcaggtgcgcgtcgagagcaagggcgccggcagcgtcgagctgcgcgcggtcgaggccgcgatcgtggcgctgagcgagcccggcttctggcgcgatgtcgaggtctggcagcgcatcgtggccaaggtgccgccgtatcgcctgagcaagttccagcccgcgctgccgccgcgtttcgagcaggagatgctgggccgctatttgctcgacatcgcgggcgcgcggcggtttttgctgggcgacgccgagcgccagatggtgggcgcgggcgacctgctgcgcgcggcgctggcgagtgttgggggcgaggacgggggcgaccgcggggcaggcggggccgagctgcattccgagccgccgcagcctgcgggcgcgcggccgagcaagccggtgcgctacgtggaccagcaggcggcgctggagcaggcgtgtgcggccttgctgggcgagccgcgcgtgggcctggacgtcgagaccacgctctttgatcgcgcgctgtgcctggttcagctcgccgcgcccgagtacaccgtggtcatcgacgcccgcgccgtggacgatctgggaccggtgtccgagctgttggcgtcgcgcgcggtggtcaagatcatccacaacgcgcagttcgagcgctcggtgttccgcaagctgggtatggatatcgagaatgtgttcgacacgctcaaggtgtcgcggcggctgcgcgggcgcaagcgcgagggcggccacggcctgggcgccgtgtgcgcgcgcgagctgggccgcgagctggacaagcacgagcagcgctcggactggacccagcgcccgctcacccagcgccaactcgactacgctgccctggacgccgaggtgctgctcgcgctgcacgagcgcttcacgcgcgagctgctggtcccctga

SEQ ID NO: 3569 - DNA, 2778 bp, Haliangium ochraceum
gtgagcgtgttcgcgcgctttcccgcgcgcctgcagcacgccatcggcgcgcgcctgggctggaccgcgctgcggccggtgcaggaagaggccggcgccgccatccttgatggcaagaacgccgtgatcctggcgcccaccgccgggggcaagaccgaggccgccatgttcccggtgctcgccgatctcgtggccgcgcccggcctggggccgtcggtgcgcgcgctgtacatcgcgcccatcaaggcgctgctcaacaaccaggccgagcgcctgggcctgtacacggagatggtcggcctggagcgcttcctgtggcacggcgatgtcggcgccagcgagcgccagcgcttcttgcgcgagcccgccgacctgctcatgaccacgcccgagtcgctcgaggtcatgctgatctcgcccaagatcgcggtgtccgaaatctttgccgacctgcgcgtggtgatcgtggacgagatccacgccctggccggcaccgaccgcggcgcgcacctgatgagcgtgatcgaacggctggcccagcacgccgggcgcgacgtgcagcgcgtgggcctgagcgcgactgtgggcaaccccgacgccatcctgagctggctgcgcggcacttcgcagcgcggcgacgtggtcgtggacccgcccaagccgccgacgcggcgcgagctgctggtgcacctcgacggcgccctgggcggcctggccgggcgcgcggccaagcgggcggcgggcaagaagagcctgttcttctgcgagagccgggcccagaccgagcagatcgccgagcgcctgggcgaccgcggcgtcgaggtcttcgtgcaccacagcgcggtgtcgttggaggagcgcgagcgcgccgaggagcgctttcagcgcggcggcgatgccgccatcgtgtgtacatcgacgctcgagctgggcatcgacgtcggcgatctcgaccaggtgttccagatcggcgcgcccagtacggtgagctcgttcttgcagcgcatggggcgcacgggacggcgcgcgggcagcgtggccaacacgacctttttgtgcgacgagcccgagagcgtgctgcaggccgtggcgctcatcgagctggcgcgcgtcggctgggtcgaatcgacgccggcgcagacccggtgctggccggcgtttgtgcatcagaccctggccatgtcgctgcagcagggcggcgtgcggcgcgacgagctgcgcgcgcacctgcggcgcgtgcccgacctcgccgggatttcggacgccgagttcgacgaggtcatcgcgtacatgatccggcgcgggctcttgtacgacagcggcggcgtgctggtcatgggcagccgcggcgagcgcgcgtttggccgccggaatttcctcgagctgtacgccgtcttcagcagcccgcagtactaccgcgtgcacacccagaacggccgcgagatcggctggctcgagcagcagtttgtcgacggcctggtcgagaacatgagcagctttctgctcggcggccgggcgtggctggtgcacgcgatccatcacggccagcgcgccgtgagcgtgtcgccggcgccgcgcggcaagaagccgagctggggcgggtttctgcccaaattcgtcggtttcgagctgtgccagcgcgttcgccggctgctggtcgaggacgagacgcccgcgtatctgtccgacgacgcgcgcgcggcgctcgagagctatcgcgaggagtttggcgagctattgcggcgcagcggccacgccatgcagtgggacgacggcagcgtgcgctggtggacctttgccggcgggcagatcaacagcacgctcaagtacgcgctggccgagaccacgagctggaagatcgtggccgacaactggcaggtgcgcgtcgagagcaagggcgccggcagcgtcgagctgcgcgcggtcgaggccgcgatcgtggcgctgagcgagcccggcttctggcgcgatgtcgaggtctggcagcgcatcgtggccaaggtgccgccgtatcgcctgagcaagttccagcccgcgctgccgccgcgtttcgagcaggagatgctgggccgctatttgctcgacatcgcgggcgcgcggcggtttttgctgggcgacgccgagcgccaggtggtgggcgtgggcgacctgctgcgcgcggcgctggcgagtgttgggggcgaggacgggggcgaccgcggggcaggcggggccgagctgcattccgagccgccgcagcctgcgggcgcgcggccgagcaagccggtgcgctacgtggaccagcaggcggcgctggagcaggcgtgtgcggccttgctgggcgagccgcgcgtgggcctggacgtcgagaccacgctctttgatcgcgcgctgtgcctggttcagctcgccgcgcccgagtacaccgtggtcatcgacgcccgcgccgtggacgatttgggaccggtgtccgagctgttggcgtcgcgcgcggtggtcaagatcatccacaacgcgcagttcgagcgctcggtgttccgcaagctgggcatggacatcgagaatgtcttcgacacgctcaaggtgtcgcggcggctgcgcgggcgcaagcgcgagggcggccacggcctgggcgccgtgtgcgcgcgcgagctgggccgcgagctggacaagcacgagcagcgctcggactggaccctgcgcccgctcacccagcgccagctcgactacgccgccctggacgccgaggtgctgctggtgctgcacgagcgcttcacgcgcgagctgctggtgccctga

SEQ ID NO: 3570 - DNA, 2112 bp, Saccharomonospora glauca
gtgagcgaggcgctggaccgcctgcatccggcggtggtgcaccacgtggtcaacaccctgggctggcggtcgctgcggcccctccaacggcaggcggtcgaccccgtcatggacgggcacgacgcgctgctgctcgcccccacggcgggcggaaagaccgaggccgcctgcttccccgtgctctccgcgatggagcgacacggctggaccgggctgtcggtgctgtacgtgtgtccgctcaaggcactgctgaacaacctgctgccccggctgcgcgactacgccgcctggctgggccgccgggtcgaactgtggcacggcgacgtcacggccgccgcgcggcgacgcatcctggccgacccgccggacgtgctgctgaccacgccggaatcggtggaagccatgctggtcagcgcgaacgtcgaccacaagcgactgttcggcgacctgcgggtgatcgtcgtggacgaggtgcacgcgttcgcgagcgacgaccggggctggcatctgctggccgtgctcgaacggctcaccgtgctcgcgcagcggcccatccagcgcatcggcctgtcggccacggtcggcaacccggaacacctgctggcctggctgcagggggcaggaaagggctcccgccctgcgaccgttgtcgcccccggggtcgcggcgaccccgaacagggcacaggacggggacatcgaactggactacgtcgggtccgtcgacaacgccgccaccgtgatctccacattgcaccgaggcgagaaacggctcgtgttctgcgactcgcgccgccttgtcgaacagctcggtgcggcactgcgcatgcgtggtgtcaccacgttcctgtcccacgcctcgctgtcggtcgacgagcgacgccgtgccgaggcggccttcgccgaggcccgtgactgcgtcatcgtctccacgtccacgttggagctcggcatcgacgtcggcgatctcgaccgggtcatccagctcgacgcgcccaccaccgtggcgtcgttcctgcaacggctcggccgcaccgggcggcgtccgggcagcgtgcgcaactgcctgttcctcgcactctcccagcgggcgctgttgtgggcggcggcgctgctggaactgtggggccgtggctacgtggaacccgtcgaagccccgccggaaccgcgacacatcgtcgcccagcaggtgctggcactgtgcctgcaggagcacaccgtgggcagccggttgtggactggggcgtggaacgggctcgcgccgtttcacagcggtgcggaacccatggtgcggcacctgatcgagcaaggctatctcgaccgggacggcgagctgctgttcatcggtccggaagccgaacgccggttcggacgccggaacttcatggacatgacggccgtgttcaccgcaccaccgcagttcaccgtgctggccggacgccaggagatcggacagaccgatccggcgctgctgacagaacgggtggaaggcccccgcgtactgctactcggcggccggagttggaaagtgacatggatcgactggaagcgtcgacggtgcttcgtggaggagaccgacctgcgtggcaaggcgcgctggcactcacccggcacggagggccgaggccacgctctcgcgcgcgcggcccgcgatgtgctgctaggcgccaccccacgggtgaagctgacacaacgcgcgacgcggacactggcggcactgcgggaggaatggggcccgaccgtcgccctcgacgggctggtggtgacccggaccggaggcgcggaggcggatgtgcgctggtggacctgggcggggcgcaaggccaacgccacgctcgcggcctccctgggagcggtggtcgacgggcggttcgacgacctgtcgatccggctgcgtgacgatctcaccccccggatgtggcgggcggccaccgcgggtgtcccggaccggttgtgtctcccggaggtcgacgagcgggccctcgccgggctgaagttcagcgccgcgcttccgccccggctggccacggcgaccctggccgcgcgcctggccgacttcgacgcggcggcacaggtgctcgccgagcccgtgcggttcaccgtcctcggctga

SEQ ID NO: 3571 - DNA, 2112 bp, Rhodococcus triatomae
gtgacggcgggttttgacctgctcgatccagttctccagcatcacatcgtcaactcactcggttggcccgggctgcggccgctgcaggacgagtccgtcgcacccatcacgaccgggtcggacgcgatcctgttggcgccgaccgccggcgggaagaccgaggccgcgatgttcccgctgctgacccgcatgcagcagcagcggtggcacggcatctccgtgctctacctgtgcccactcaaggcactgctgaacaacctgcaaccacgcgtcgacgagtacgcagcgtggatgggccgcggagccatgacgtggcacggcgacgtcagccagtccgtccgcgaccgcatcaaacgcgaccggcccgacgtcctgctcaccacacccgaatcgctcgagtcgatgctggtgtcggagagcgtcgacgccgcgacagtgctctgcggtgtgcaggccgtggtcgtcgacgaggtccacgcgttcgccggcgacgaccgcggctggcacctgctcgccgtcctcgcccgcctcgaatcgcttctcggtcgccggctgcagcggatcgggatgtccgccaccgtcggcaatcccgacgagctgctcggctggctgcagggcggccgcacctcccccggccgcgtgatcgccccggcggtgaccgggggcgcggtggtccccgagatcaccgtcgactcggtcggcagcgtcgagaacgccgccaaggtcatcgccgcgctgcacgccggggagaagcgactggtctttgtcgactctcgtcggctcgccgaggagctcgggaccatgctccgcggtcgcggtatcactacgttcgtatcgcattcgtcgctgtcggcagcggaacggcgcgaatcggagcaggcattcgccgaggcccgcgactgcgtcatcgtcgccacttctacgctggagctgggcatcgacgtcggcgacctcgaccgcgtcatccagatcaacgcgccccgcacggtgtcgtcgttcctgcagcgcctcggccgcaccggtcgacgtcccggcaccacccgcaactgcttgttcctcggtatcaccgacgaggcggtgctcagcaccctcgggatgctgcagtgctggtccaccggctgggtcgagccggtcgtcgcgacacccgagccgcgccacatcgccgcgcagcagatcctcgcgtccgcactgcagacccggcgggtgccgctcaccggctggcaggagacgtggggtccgctgccgatcttcggaccggatagtcaggagatattcgactacctcctggaagagggtttcctcgaacatgattcggggtccgcgttcatcggacccgaggcggagaagcacttcgggcgccgccacttcatggatctgctcgcggtgttcactgcggccccggagttcatggtgttcgccggtcggcaggagatcggctccgtcgagacgagcgtgctcaccgacgacattgaaggaccgcgggtcctgctgctcggcggccggtcgtggaaggtcacgcacatcgactggaaacgtcgtcaggtgttcgtcgagaacaccgacctccaaggacgcgcgaagtggatgtcgctccccgacggagcgtccttcgagatcacgcggggcgtgcgtgaggtcctgctgggagcggaaccggccggcgtgaccctcacgcgccgggccgtcgcgacactcgacgacattcgacttcaacgcgccaaccacgtcaccgacggtgcgttcctcatcgcacgcgatggacgagaagactggcgctggtggacgtgggcgggagcgaaggcgaaccggactctcgctgcctgggcatcggaccttgtccctcctcgtcagcgcatcggaccggaatccatccgcctgcacagtgatctgtcggtcgacgacattcggaacggactggccgccctccggagcgacggccgagaccgcccgatgcccgccatcgacaagaacgcactcaagggactgaagttctcggcagcgcttccggaagcgctggcctgccgctcgctggccgcgcggaccgtcagcgttccagcggccgagacggtgctcggtgaacgggctcggatcgtcagcacttcgtcgtcctag

SEQ ID NO: 3572 - DNA, 2112 bp, Saccharomonospora cyanea
gtgagtcaggcactggaccgcctgcatccggcggtggtgcaccacgtggtcaacaccctgggctggcggtcgctgcggcccctccaacggcaggccgtcgaccccgtcatggacgggcacgacgcgctgctgctcgcccccacggcgggcggaaagaccgaggccgcctgctttcccgtgctctccgcgatggagcgacacggctggaccgggctgtcggtgctgtacgtgtgtccgctcaaggcgctgctgaacaacctgctgccccggctgcgcgactacgccgcctggctgggccgccgggtcgaactgtggcacggcgacgtcacggccgccgcgcggcggcgcatcctggccgacccgccggacgtgctgctgaccacgccggaatcggtggaagccatgctggtcagcgcgaacgtcgaccacaagcgacagttcggcgacctgcgggcgatcgtcgtggacgaggtgcacgcgttcgcgggcgacgaccggggctggcatctgctggccgtgctcgaacggctcaccgtgctcgtgcagcggcccatccagcgcatcggcctgtcggccacggtcggcaacccagaacacctgctggcctggttgcagggggcgggaaaggactcccggcctgcgaccgtcgtcgcccccggagtcgcggcgaccccgaacagggcacaggacggggacatcgaactggactacgtcgggtccgtcgacaacgccgccaccgtgatctccacattgcaccgaggcgagaaacggctcgtgttctgcgactcgcgccgcctcgtcgaacagctcggtgcggcactgcgcatgcgtggtgtcaccacgttcctgtcccacgcctcgctgtcggtcgacgagcgacgccgtgccgaggcggccttcgccgaggcccgtgactgcgtcatcgtctccacgtccacgttggaactcggcatcgacgtcggcgatctcgaccgggtcatccagctcgacgcgcccaccaccgtagcgtcgttcctgcaacggctcggccgcaccgggcggcgtccgggcagcgtgcgcaactgcctgttcctcgcactctcccagcgggcgctgttgtgggcggcggcgctgctggaactgtggggccgtggctacgtggaacccgtcgaagccccgccggaaccgcgacacatcgtcgcccagcaagtgctggcactgtgtctgcaggagcacaccgtgggcagccggttgtggactggggcgtggaacgggctcgcgccgttcgacagcggtgcggaacccatggtgcggcacctgatcgagcaaggctatctcgaccgggacggcgagctgttgttcatcggtccggaagccgaacgccggttcggacgccggaacttcatggacatgacggccgtgttcaccgcaccaccgcagttcaccgtgctggccggacgccaggagatcgggcagaccgatccggcgctgctgacagaacgggtggaaggcccccgcgtactgctactcggcggccggagttggaaagtgacgtggatcgactggaagcgtcgacggtgcttcgtggaggagaccgacctgcgtggcaaggcgcgctggcactcacccggcacggagggtcgaggccacgctctcgcgcgcgcggcccgcgatgtgctgctaggcgccacaccgccggtgaagctgacacaacgtgcgacgcggacactggcggcactgcgggaggaatggggcccgaccgtcgccctcgacgggctggtggtgacccggaccggaggcgcggaggcggatgtgcgctggtggacctgggcggggcgcaaggccaacgccacgctcgcggcctccctgggagcggtgatcgacgggcggttcgacgacctgtcgatccggctgcgtgacgatctcactccccggatgtggcgggcggccaccgcgggtgtcccggaccggctgtgtctcccggaggtcgacgagcgggctctcgccgggctgaagttcagcgccgcgcttccgccccggttggccacggcgaccctggccgcgcgcctggccgacctcgacgcggcggcacaggtgctcgccgagcccgtgcggttcaccgtcctcggctga

SEQ ID NO: 3573 - DNA, 2121 bp, Gordonia polyisoprenivorans
atgagcggatttgagtccctcgacccggcgatccagcatcacatcgtcaatacccttggctggcctggtcttcggccgctgcaggaggaatccattcccgccatcgtcggaggtggggacgcgctgttgctcgctccgacggccggcggcaagaccgaggcagcggtgttcccggtacttacgcggatgcaggagcaccggtgggccgggacgtcggtgctgtatgtgtgcccgttgaaggcgctgctgaacaatctgggcccacgtctcgccgattacgccgcgtgggtgggacgtagtgcgtcggtgtggcacggtgacgtgtcgcaggcagcccgtcgcgggatcacccgggaccgacccgatatcctgctcaccacacctgaatccctcgaatcgatgctggtttcagaaagcgttgatgcacaacagttcttgggtgacgtccgaaccgtgatcgtcgacgaggtgcacgccttcgccggagacgaccgagggtggcacctcctcgcggtgcttgcccggctggagtctttgatcagcgatgcgagtgggccgaatgccccccgccggcggctgcagcggatcgggatgtcggctaccgtcggtaaccctgacgaactgctgcgatggctccgcggaggggcggcagacggtgggcgagtggtggcaccggaggcgtcggccgcggtgggtgctgagatcaccgtcgatgccgtcggcagcgccgagaacgctgccacggtcatcgcgggactacatcgtggcgagaaacggctcgtgtttgtcgattcacgtcggttggccgaggaactcgggacggcactgcgaagccgcggcatcaccacgttcatctcgcattcgtcattatcggcgcagcagcgccgcgaatccgaagcggcctttgccgaggcccgcgattgcgtcatcgtcgcgacgtcaacgctggaactcgggatcgacgtcggtgatctcgaccgggtcatccagatcaactcaccgcggacggtctcatcgttcctacagcgactcggccggaccggtcgacgacccggcaccacccgcaactgtctgttcttggccctcgacgatgcttcactcgcgcagacgctgggaatgctgcactgctgggcgaccggctgggtggagcccgtggtggccactcccgagcctcgccacatcgctgctcagcagatcctcgcggcggccttgcagacccgacggcttccgctcgtcgggtggcagcatcagtgggccgatctaccgctgttcggtgaggacggcgacgagatcttcgaccacctgctcagcacggggttcctcgaccacgatgccggcagcgccttcatcggactggaagccgaaagacacttcgggcggcgtcatttcctggagctcctcgcggtgttcaccgcggctcccgagttccgggtcttcgagggccgcaacgagatcgggatggtggaggtcggggttctgacccagcggacggagggccctcgtgtactgctgttgggtggtcgatcgtggaaggtgacccatatcgactggaagcgacggcaggtgtacgtggagggcaccgatatccacggcactgcacgctggcaatcgataccggacggattgtcgttcgagatcactcgcggcgtgcgcagcgtgctgctgggagagacaccctcgggagtgacgttgtcacgccgtgccgtcgaggcgctcgatggttaccgtgcgcagcgctcggcgcacgttcacccggccaacctggtcattgagcgagatgtgcgcggcgactggcggtggtggacgtgggccggaaccaaagccaaccgcactctcgccgcctggactcgagagctggtgcccgggcgtcagaggatcagcggagagtcgatccggttgcactcggacctgcgagtcgacgacatcgcgcgcgtattggcttcggtgcggggcagctcgcaccgtcctctgccggatgtcgatcgcgccgcgatcagcgggctgaagttctcggcggcgctcccggaaggcctggcgcgccggactctcgctgcacgggtggtcgacgtcaaaggcgcggaatcggttctgacgagacgtgtgtcattcgcgaaatgctga

SEQ ID NO: 3574 - DNA, 2097 bp, Amycolatopsis azurea
gtgagttccggagccgaccggctgcttcccgcgctggtgcaccacatcgtcaacacgctgggctggccggggctgcgcccgctccaggccgaagcgatcgacccgcttcttgacgggtccgatgcgatcctgttggcgccaacagcaggcggtaagaccgaagctgcgatgtttcccctgctcagttccatggaagaacagtcatggacgggcctgtcggtgttgtatatctgtccgcttcgggccctcctgaataaccttcaacccagactggcgatttatgcgggctggctcggtcgcactgccgacctatggcacggagacgtcagctccggcgcccgcaaacggatactccaggaaccgccggatatcctgctgaccacgccggagtcgctcgaggcgatgctggtgtcggcaaacattgattcccggcgcttgttctcgagccttcgagcggtcgtagtggacgaggtccatgctttcgccggcgacgaccgcggctggcacttgctcgcggtcctcgaacgactctctcggatcgcaggccgcccgcttcagcgaattggcttgtcagccacagtaggcaacccggacgaactgctgaggtggcttcagggctcgcaacactccagaccacgatcggtagttgcgcccagcggtggcacgacgaccacgccggacatcaccgtcgatcatgtcggttcaattgacaacgcggccaccgtcatcgcaacactgcaccgaggcgagaagcgactggtgtttgtcgacagccgccgacgcgctgaagaactcggagcagcactacgcgcccgcgaaatcaccacgttcctgtcgcactcatcgctctccgcagacgaacgccgcagatcagagcaggcctttgcagaagctcgcgactgcgtgatcgttgcgacttccactctggaattgggaatcgatgtcggagatctcgatcgtgtgatccagatcgacgctccccggacggtggcttcgtttctccagcgtctgggccggacaggacgtcgtgcagggggcaccagaaactgcctctttctgtgtctcgaagaatcagccgtactcagcacagccggtctgctcgaacggtggggagcaggctgggtggaaccgatcgtggccccgccacaccctcgacacatcgccgcgcagcagatgctcgccctcgccctgcaagagaacaaaattgggacgcacacctggcgagagtggtggggcgacctgccgttgttcgatgagcaccaaaccgagatctttgatcatctactggccgaaggctacctcgagcgggacggcccgatggcgttcatcgggctcgaggcggagaagaagttcggccgacggcatttcatggaccttctcgccgtgttcagcgcgccaccggagttcacagtcctgaccggccgagaagagatcggccgagtgggggacgatgttctgctggccgacaaccacgacggaccacgtgtcctgcttctcgctggacgtggctggaaggtcgggcacattgactggaagcggaggcgctgtttcgtcgagccgagcgacctccccggccgcgccaagtggggcgggagcgaaggtgggctgtctttcgcccttacccgcagccagcgatcggtcctgctgggcaccaatcccgcaggggtccggttcacccgcagagcagcatcggtactcgccgagctccgcgagaagcactccggagacgttgccgacaacgcgactgtgttccggcgttcgtctggcgagctcagatggtggacttgggctggtatcgcagccaaccggacgttgcaagccagcttcccacgagtcgtggatcctcggcagcggactaccgatcaatccttgcgcttgcaaccagatctgtcgaataacgaattgctgcgcacgctgtcagcaagcgcggcgctttcccctccacacgtcaataagtccgccctccatggactcaagttctcttccactctcccaagcgagctagcctctgaaaccatttccgaacgccttgcggatcagagacacgcacagttcgtcttattcgagaaacgactattttcccaagcagagaactag

SEQ ID NO: 3575 - DNA, 2103 bp, Marinobacter sp.
atgagtgagttcgacaggcttcacccggcgattcaacatcatattgttaacagtcttggctggcccggcctgcgccccctccaagaagccaccatccaaccgatcctcaatggtgagcacgctattctgttagcgccaaccgcaggtgggaaaactgaagcggctatttttcctgttttttcgcgaatgctgagtgaaaactggcaaggtttgtctgtgctctacatctgcccaatcaaagcactgctgaacaacctggaacagcgtctgagcaattacgggcacctgctgggccgaacagtcgatgtatggcacggtgatatcagcgcttctcgcaaagcgaagattgtatcgtcgccgccggatattctgctgacaacgcctgagtccctcgaggtgatgttggtttcccacaaagtggatcatcagcatttttttgctaatgtgcgtaccgtgattgtggacgaagttcatgcctttgccggcgatgatcgcggctggcatttgctggcggtgctggagcggatcagtattttggcagggcgtgagctgcagcggcttgggctttcggcaacggttggtaacccagaccttctttgtgattggctggctagtagttgcgaggcccgccgcagtgtgattaacccaccggctgaaaacaccctagaggcagacgtgcagctggactgggtgggttcgttgcgcaatgcagccgttgttatttcgcgtttgcacagcggtgaaaagcgtctcgtgtttgtggatagccgctcgaaagtggaagagctggcgattgagttacgcattttgggcgtttctacttacatctcacacagttccttgagccttgaggagcgacgctcggcagaggaggcgttctcgcagggtaataattgtgtcattgtcgctacgtctactcttgaactgggtattgatgtgggcgacctggaccgggtaattcaagtcgacgccccctacgcggttgcgtcgtttatgcaacgaatcggccgtactggccgccgcgcgggttcatctcgcaattgcctgttccttgccactcgtgaagatgctttcttgcgcgccgctgcactgctaaacctttggcgcagcggctatgttgagcccattttgcccccagccagacccatgcacatttatgctcagcaaacgatggcactggcgcttcaacagcaagcaattattgcggcagatgcagacaggtggcttgccaagatgccggggttcgccgccatctcgcctgaagaccgtgcggccgcgattaactatatgcttgatacaggcattttacattcagaccagggccttattggtattgggaaaacgggcgagcgagcgtttggccacaaacactttatggagctgttttccgtgttcacgacaccgccgatggttaaggtgttctggggcaagcaggagttgggtgaagtagaccaaatgaccttcgcagtccgcaatgaagggcctgccttgctaacgcttgcaggccgcagttggcaaactgtttatgttgactggccaagaaaaaaggcttttgtggagccgtcccaggcacggggtaagtcgcagtggttcagtgatggccagccgatgagctacgagctgtcccgaagtatcgctgacgtgctggtgggtgaagatattccagcgggcttttcctcacgcgctcaggaattattggagacattacgagacagctacggttacctggaacttggcaaaacaacgttgctcttcgatgaagatggaaatgcaacatggtggaactttgccggtagattgctgaacacggctatgaaaaacccgctggcggacaaagctcgcaaggttgaagcagataacctgtgtttagctttcagccatgtgtatgaacctgaattattaatagcggctattcgccgtgttctgtcgaagaacgttgagcctttggctattacgcttgaggagagtttcatacaagaattgaagttctctgagtgcctgtcgcaaaaagaaatgaatcgtgagttgaacgaacgctatgccgtcgataaagaatttacccggtttcgtcggttgccgctgtcagtattgagggtgatttga

SEQ ID NO: 3576 - DNA, 2118 bp, Rhodopirellula sp.
gtgagcgtcttttccaagttcgcccctcgattacaagaggccatcgtctcacgccttggattcacgagcctacgacctgttcaagaactggctggtgaggcgatccttgcaggtaagaacgccgtcgtgcttgctcccacggcaggcggtaagacggaggcctcgatctttccaacgctttcggggcttgtcagcgatccggtcgacggcgttggcgcaatctatatcgctccgatcaaggcgctgctgaacaaccagtcccatcggttggaccagtacaccgaaatggtcggattgcggcgatttgtatggcacggtgatacaccaaccaacgaacgcaacaagttcaagaaggagccggccgagttgctgatgacgacgcccgagtcgttggaggtgatgttggtttcgcaaagcgttgatgaagcgactctgtttcgcgaactccggtacgtaatcatcgacgaggtccacgcgattgcgggaagcgatcggggcgctcacctgatgagcgtgatggagcgaatcgcaaagtattccaagcacgatctgcaacggatcgggcttagtgcgacggtcggaaaccccgatgcgatccttacttggttgaagggcagttcacagcgagaaggcgtcgtcgtggatccgcccaagaagccatcaagacgccagttgcaagtattccaccgtgcagggttggcttcgatcgcaaacgaagcttctcggaaggctcgtggttccaaaagtctgttcttttgccaatcgcgtgcgacgtccgaggcggtcgccgaacaattgcgacgcgaagggactgaggtcttcgttcaccacagtgccgtttctaaggaagaacgtcaattcgcggaggaacagttccacagtggaagtgatgcctgcatcgtttgtacctcaacgcttgaactcgggatcgacgtcggagacttggactacgttctgcaatccgaggctcccgataccgtcagttccttcatgcaacggatgggacgaacaggccgacgaggcgacacaccggccaacacaacgttctattgcgaaacaagcgaaggcgttctacaagcgatcgcgatcattgagctggcgaagactggctgggtcgaaagcatcgaagtcaacgatcgttgctggccagtgctaatccatcagttgctcgccatgtcgctctcaacgggcggactgcgccccgaacaagcatgggaacacctgtcccgtttgccagacttctgcggcattgcacgcgacgaattcgatcgactgatcgcctggatgattcaagacggttcgatggtgctctctagtggcctactttctcttggtccaacggcagaacgacgtttcggccgtcgcaacttcatggaactttttgcggtcttctcaacaccaaagacctacgccgtgatgacgattgccggccagccggttggttcgcttactcaagattacgtcgatcgactggtcgaggacgtcagcagcttcctgctcggcggccgagcatgggcagtccaccaaatcaaccacgacgatcgccgaatcttcgtcattccgacctcaatgggtcgccagccatcttggggcggcttcttgccgcaattcctcggctacgatctttgccaacaggtccttcaagtcctcacctcaaccgaagactatccgtatttggaaaccgaatcacgcgaagtcctgcacgaagaacgtcgcaatctaggcggcttcctcacaccagagcgcggcggcatcgacggcgacacccacgaactccgctggtggaccttcgcgggcggccggatcaattcaaccctccgttacgccctagcattcttagaaccaacctggacgttcacccccgacaactacgccatcaagattcgaggcgacagcccaacctccgcatggctaggcgaagccatcgctcaaatctctgcagcagacttctgggccaacgaagccgtccacgcatccatcaccgccgcgattcccaattaccgtctaactaagtttcaaccgctgatgccggattggattgagcgggaaacactgcaacggcacttgctaagtgtccctgacgccaaggaatgggtgcgaatcaatcgtggattttga

SEQ ID NO: 3577 - DNA, 2142 bp, Pseudanabaena biceps
atgcgttccacttttgccagatttccgccccgcttacaacaggcgattgccgatcgcctcggttggtcatccttgcgtccagtccaagaacttgcaggtcaagcaatccttgatggtaaaaatgcgatcgtgcttgctcccaccgcaggggggaaaactgaagccgccatatttcctctattagccaatctaatcgagcatgaatcacagggcgtaggcatactctatattgcgccgatcaaagccctgctcaataatcaatgcaatcgctttgctacctataccgaaatggttggtttgcgtagttttgtatggcatggcgatattaaaggcaaagataagcaagcctttctcaaagaacctgccgaagttctactcaccactcccgaatctctcgaagtgatgctgctatcagccaaagtccctcatgtgagactatttggcgatctccgtgctgtaattattgatgaaatccatgccctcgcaggtagtgatcgcgggacacatttactttcagttctagagcggctgattaccgccgcaaatcaagatttacctactaatcaaaagtgcgatgtgcagcgagttggactgagcgccactgtgggcaatccagagcaaattctcaactggatgcaaggctcatcacagcgccaaagaatcgtgattgatccgccaaaaattcctgctaagcgtgaaattgcaatcctacagcgtaatgagatcggcgcgatcgcccgtgaagctagtcgcaaagcacaaggtaataaaagcctattcttttgtcaaagtcgagcgcttgcggaagatgtcgcggaacgaatgcgcgatcgcggcacagatgtatttgtgcatcatagttctgtctcccgcattgaacgcgaaatcgccgaagagaattttcaaaagggaatgaatgcttgcattctctgtacgagtaccctcgaattaggaattgatattggcgatcttgatcttgttctccaagccaatgctcctagtactgtgtcatcatttttacaaagattaggacgcacaggcagacgcgcaggtaaggcagcaaataccaccttttattgtgaaaatattgagacagttttacaagcgatcgctattgttgaattagcacgatcgggctgggtggagtctgtaaagtgtcataaccgcacatggacagttttagtccatcaattactagcgctcaccttgcaatttggagcgattagtcccgaacttgcttgggagcaattatctctaattcctgattttcagggcatcgcggagacagaatatcaaatcttgattcagcatggcattagggaaggttatttttttcagtcgggcggcttactatccatcggtgaaagagccgagaagatatttgggcgcaaaaactgtatggaactctatgccgtattcagtagccccgttctctataaagtcaagaccgcagcaggttataccgttggttctctagaacaagactttgccgataaattagttccaagtatgagttctttcctcttaggtggcaaggcttggctagttgaagcgatcgatcacaaggaacgctcaattcgcgtagttctctctccaaaaggtaaaaagccaaactggaatagtttttcgccgcaaatcctcagctatgaactctgtcaaaaaatttacgagatcctcactaccgacatcgactatccctacatcgacgctcaatctcgttatgcaatcacagaaaaacgtgaagatctgggtgtactactcagtcagcaatctttcacggcgatcgatgatggcgatcgcgttacatggtggacatttgcagggggacaaattaattacacgatcaaatatctccttgccgatctccgccctgaatggaaagtaattgctgataattttaaaattgggatcgaaggttctgatgtgagtgttcagttattgcgatcggctttagatagattgcgatcgtctttcgattggcaaagcgaagcacatcgttccaatatccttgctcaacttcctctctatcgctttagtaagtttcaacctctactccccgaagcttatgctcttgagactattgaacgttatctacttaattgggaaagtgctagcagtttcttaaagcgttttaccaattag

SEQ ID NO: 3578 - DNA, 2199 bp, Streptomyces turgidiscabies
atggcggacgcgggagtcccggccgggaaagacccgggtgacgaggacgtcgacgtcctggacctactcgaccccgtcgtcctgcatcacatcgtcaacacccttggatggcccgatctgcgaccgctgcagcgagcggcgatcacgccgctcatgcaggggcaggacgccgtactgctggctccgacggcggggggcaagaccgaggcggcctgcttccctctgctgtcggcgatgaccgagcagaagtggaccggcacgtccgtgctgtacctgtgtccgctcaaggcacttctcaacaacctggtcgtccgtgtcaactcctatgcccagtggctggggcgacgcgctgccctctggcacggtgacaccaaggaatcgcaacggcagcgcattcgggccgaggctccggacatcctgctgaccacgcccgagtcgctcgaagcgatgctgatcggcgtcaagaccgaccacgcccgcctgttgggaagcgtccgggccgtcgtcatcgacgaagtgcacgcgttcgcaggggatgaccggggatggcacctgctcgccgtgctcgaacggttggagcgggtcaccggacggcccatccagcgagtcgggctctcggcgaccgtcggcaatccggccgagttgctgcactggctgcaaggcgcgggcgtcggcacccgcaccggtcaggtggtcgcccccggagtgcacctgccggccaccgacggcagcggacacggcggcaaagcgagtcccgagccgtccaacagaccttccggcgaagtggaactcgactacgtcgggtccctcgacaatgcggccaaactcatcgcggcgctgcacagaggggagaagcggctcgtcttctgcgactcgcgccgccaggtcgaggagttgggcgcggcgcttcgcgcgcgcgaggtgactgtcttcctgtcccacgcctccctctccgtcgacgaacgcacccgctccgagcaggcgttcgccgaggcacgcgactgcgtcatcgtctccacgtcaaccctcgaactcggcatcgacgtcggtgacctcgaccgcgtcatccagatcgacgcaccgaccaccgtcgcctcgttcctgcaacgcatcggacgcaccgggcggcggtccggcacgatgcggaactgtctgttcctgaccacccgcaaagagacgctgctccaggcggcgggcctgttgctgatttggtcgcggggctgggtggaaccggtcgtcccgccgccagagccgcgccacctggtggcccagcaactgcttgccgtcaccctccaacagcacaagctcggcgaccggttgtgggaccggcagtggaacggcctcgcccccttcgacaagtccgctgcccccatcctgcgcttcctcaccgaggaaggcttcctcgacagcgacggcggaatgctgttcgtcggtcccgaggcggaacgacgcttcggtaaaaggcacttcatcgagctcaccgcctccttcaccgcacctccgcagttcaccgttctgtccggacgcacggagatcggccgcaccgacccgagcgtgctcacggaggaacgccccggccccaggcggttgctgctcggcggacgcagttggcaggtcacgtacatcgactggctgcgcaaacgcgtcttcgtcgagccggccgacggcggcggaatcgccaagtggatgaacggcggcgtcaccggactgtcgtacgccctgacgcgtgccatgcgcgaggtactgctgggcacggccccgccggtctccctcacccggcgtgcggaggcatgcctggccgaacagcgcgaaaccgacgcacctgacaccgtccaccggggcggcacgctgatcacgcgcgtcggctccgacgtccgttggtggacctgggccggttaccgcgccaacgccaccctggcggccaccctccagtcggtcacggaccccctgcaacggcccaccgacagctgggtgcgcctgcgcgagaacctcaccccggccgcctggcgtgtggcccgtgagaacgtcggcgagaacctcgtcctacccgacgtggaccgccgggccgtacgcgggctgaagttctccgtcgctctcccggaacgcctcgccgtggccacggtggcggcccgcttggccgacttcgagagcgcccggttggtgctcggtgagtcggcgcgctttcagtgggacggctga

SEQ ID NO: 3579 - DNA, 2103 bp, Gemmata obscuriglobus
gtgacccctttcgaccacctccacccggccctacggcaccacgtcgttaacagcctcggctggacggaacttcgtccgttccaggaggcggtgatcgaaccggcgttggccggtgagcacctcctcatcctggcccccactgccggcgggaagaccgaggcggcggcgttcccggtcctgtcccggatgctgaccgaggactggcggggactcggcgttctgtacgtctgccccatcaaggccctgctgaacaacctcgacgcccggctgtcccggtactgcaccctgctgggccggcggtccgccctctggcacggggacgtcccgaccgggcagaagaaggcgatcctccgcgacccgcccgacctcctgctgacgacgccggagtccctggaggtgatgctcgtctccggctcggtggacgagcgcgccctgttcgcggcgttgcgggcggtcgtggtcgatgaggtccacgccttcgccggggacgaccgggggtggcacctgctgtccgtcctcgcccgcctccggcggctgtgcgggcgggagttccagcggctgggcctgtccgcgacggtggggaacccggacgggttgttggcgtggctgaccggcgggtgtgacgggccgcggcgggtctgccacccgccgggcggcacggccgcggcggaagcggacgtgaagctcgaccacgtcgggtcgctccgcaacgccgcgacggtcatctcccggctgcaccggggggagaaacggctggtgtttgtggacagccggtcgcgggccgagcaactggggcgggagctgcgggccctggaggtgacggcgttcgtcacccacagctcgctgagtgcggacgagcgtcgccgggcggaggaggcgttcgccggccgggacgattgcgtcatcgtggcgacgagcgtgctggagcttggggtcgacgtgggcgacctccaccgggtcatccagatcgacgccccgacgacggtttcgagcttcctccagcggatgggtcgcaccgggcggcgaccgggcgcgtcgcggaactgcctgttcctggccacggacgacgactcgctgttgcgggccgccgggctgatcgggctgtgggccggcgggtacgtcgagccggtcaccccgccgccggaaccgtaccacgttctggcccagcaggtgatggccctctgccttcaagagcgggggatcggccggcgtgactgggcggcgtgggtcgacggggtgccgggctttgcggctatgccggacgcgcggccccacgaggtcatcgactggatgctgtcccaggggctcctgtgggaggacggcgggctgctgtggctgggccgccggggcgaggaggagttcgggcataagaacttcatggacctcttctcggtgttcacctccccgccgctgttcgcggtgcgctacggccgccaggacttggggttcgtggacgaggccagctttaccgcccggcgtgaggggccgcgggtcttgctgctcggcgggcgggcgtggcgcgtcacgcacctcgactggccccggcgggtggcccacgtcgagccgtccgaggaggccgggcggtcacggtggcggggcaccgggccgttcgtcggcttccgactcgcccagtcaattcgctccgtgctggcgggggaagaccagtctccgctgtggtcgcgacgggcccaggacaaggtcgcagagttgcgcgaggaggcgtcctgggtgagtgccgacgggccaacgctgctgggcctcgcgggcggggcggtggagtggtggaccttcgcggggacgcgggccaacgccaccctggcgggcgcactaagcggaaggtgcgggggacggatcgaccacgatggcctccgcatggtgttcgaaggggccggggggctgaccgccgtcgagcaggcggtgcgtgagttgcccccggtagaagacctgagccccgcggtcgaggaggaagccctcgacggcctcaagttttcggcctgcctcccaaaggatctcgccctcgccgccctcgcggcacggctccgcgacaccgcggctgcccgggcggtactggcccagcggatgcgggtggtcgttggtggctga

SEQ ID NO: 3580 - DNA, 2106 bp, Rhodococcus ruber
atgaccgacagcgcattcaccctcctccatcccggcgtgcagtaccacctcgtcaacacgctgcgttgggacggccttcgccccactcaagccgtcgccgtcgaaccgatcctcgcgggcgaggacgccctcgtcctcgccccgaccgcgggaggcaagaccgaggcggcggctttccctctgctctcggcgatggccgagcacgattggcagggcacgtcggtgctctacgtgtgcccgctgcgggcactgctcaacaacctccaaccacgcatgcacacttacgcccagtggcttggccgcaccgccgccgtgtggcacggggacgtcggccagtccgcgcgacagcagatcctgcgggaccgccccgacatcctgctcaccacaccggaatcgctcgaggcgatgctggtgtccaccaaagtcgacccgcgcgtgctgttcgcagggctacgagccgtcgtcgtcgacgaggttcacgcgttcgccggcgacgaccggggctggcacctcctcgccgtgctggaacggctcgcgcgcatcgccggccgtcccctgcagcgcatcgggctgtcggcgacggtcggcaatcccgacgagctactgcaatggttgcagggtgggactccgggccggcctcgtcgcgtagtcaacccagcagttcccgctgcggccacgccacctgagatcaccgtcgactacgtcggctcgatcgacaacgccgccaaagtcatcgctgccctgcaccagggcgagaagcgcttggtgttcgtcgactcgcgacgccgcgccgaagaactcggtgcggccctgcgcgaacggggagtgaccaccttcctgtcgcactcgtcgctctcggctgccgagcggcgccggtccgaaacggcattcgccgaggcacgggatacggtgatcgtcgcgacctccaccctcgaactcggtatcgacgtcggcgacctcgaccgcgtcatccagatcggttcgccacgcaccgtcgcatcgttccttcagcgtctcggccgcaccggacgccgcccaggcaccacgcgcaactgtctgttcctcggcgtcgacgacgaacaggtactgctcaccctgggcatgctcgaatgctggtcgcgcggatgggtggagccgattgtcgcacccccgtccccgcggcacatcgcggcgcaacagatgctggcgctgtgcctgcaggaacaccgactcggagagaggagctggcgggactggtggggttctctgccgatcttcgacgagcacgccgacgagatcatggcgttcctccgcgcgcagggcttcttcgagcgcgacgggagcctcctgcacatcggacccgaggccgagcgccgattcggacggcgatacttctcggacctgacggccgtcttcagcgcccctcccgagttcaccgtgctggccggacgcaacgaggtcggcaccgtgggcaccgatctgctggtcgaagaggtcgacggcccccgcgtgctgttgctcggtggtcgctcgtggagggtgactcatatcgattggcaacggcgccggtgtttcgtcgaacccgtggacggcggcgggaaggccaagtggtccggcacaggcggtggggtgtcctacgacatcacacagggcatgcgcgcagtgctgctcggcaccgtacctgcaggagtgacactgacccgacgcgcggaaacggtgcttgccgaactacggcagggctacgccgacagcgttgatccggatgcctccgtgctcacgatgccgactgagggctcgggtcggtggtggacctgggcaggaaccgcggccaaccgcactttgcaggcgtcgcttccgacgctggtcgatccccgtcagcgggtcgacgagaagtccttgcgtctccttccgaacatcaccccggcaaacgtgagtgtggctctggccgatcctcgttggaccttcccacacgtcgcgcagagcgccgtggccggactgaagttctcctccgcactaccaccgggactcgccgaggaaaccctggcagtgcggctcgcggacgaaccgcatgcccgagcagtcattgcgacgtgtcgccggatccatcggaccgaccacgacgactaa

SEQ ID NO: 3581 - DNA, 2079 bp, Mycobacterium xenopi
atggacgcgttcgagcgactgcatcccgggctgcaataccatctggcaaacacgttgcggtggaccggtcttcgtcccacccaggcgcaagccgtcgcaccgatcctcgacggccgcgacaccctcgtcctcgcgcccaccgccggcggaaagaccgaagccgcggtgttcccgctgctgtcgaggatggccaccgaggactggcaagggttatcggtgctgtacgtgtgtccgcttcgggcactgctgaacaacctgcaaccccgcatcgacggctacgcccggtggctcggccggtcggcggccgtctggcacggtgacgtcggtcagagccaacggcggcggatcctcgccgagcgtcccgatgttttgctgaccacgccggagtcgatcgaatccatgctggtgtccaccaaagtcgacccgcgcgtgctgttctcgggcttgcgggcggtggtggtcgacgagatccacgcgttcgccggcgacgaccggggctggcacctgctcgcggtgctggagcgggtgtcgcggctggccggccgcgagctgcagcgggtggggttgtcggcgaccgtcggaaacccgtcggaactgctggcctggctgcagggcagcttcgtctcacgggcgtcgtcggtggtggcacccgccgacgggtccattgccgaacccgagatcacggtggattacgttgcgtcgctgggtaatgccgccaaggtgatcgcgtcgctgcacgccggggagaagcgactggtgttcgtcgacagcagacgccaggccgaggaactcggtgttgcgttgcgggatttcggtgtttcgacgttcgtttcccactcgtcgctgtcggcgtccgagcggcgccgctccgaagcggcgttcgccgaggcccgcgacaccgtcatcgtcgccacctcgaccctcgaactcggcgtcgacgtgggcgacctcgaccgtgtcatccagatcggctccacccggacggtcgcgtcgttcctgcaacgactgggccgcaccggccgtcgcgcagacaccgtgcgcaactgcctgtttctgtgcatcgacgacgacagtctcctgctggccgcggggatgctgcagcggtggtcgcacggctgggtcgagccgatcaccccgccgcctgcgccgcggcacatcgcggcgcagcagttgatggcgttgtgcctgcaggagcaccgcatcggtataagggagtgggcgtcgtggtggggagatctgcccgtgttcgacgccagctcggagattgtggattaccttgtcgccgaaggcttcttcgagcccgacgggccgttcctgcacatcggccccgaggccgagcggaagttcggccgtcgctacttctccgacctgaccgcggtgttcaccgcgccgccggagttcctggtgctcgctggacgggtcgaagttgggaccatcggcacggagttgctcaccgacgaggtcgacgggccgcgagtgctgcttcttggcggccggtcgtggcgggtcacccatgtcgactgggaccgcaggagatgcttcgtcgaacccgaggacgggggcgggcgggccaagtggtcggggtccgggggcggtctgtcgtacgacatcgcccgcggtatgcggtcggtgctgctgggggcgcagccgatgggagtggtgttcaccagccgagcgtcgttgaagctcgcggaaatccgagaagcaaacggcgacaacgtgtctgcagatgctttgatcgtacgactgcccgccgactcggcggggcggtggtggacgtgggcgggcactgcggccaaccggacgctgcagatgtcgttgccgacggtcgtcgatccccggcagcggatcgacgagaagtcgctgcggctgctgcccggcatcacggacgccgagttctcggccgcgctcgatggcgtcgagtggcgggagccagctgtcgacgcgaatgcgcttcggggactgaagttttcgtcggccctgccgccggagttggctcgggtcacgctggccgcgcggatcggcgaccaaaaaagggcggccgaggttctcggcgatgcccggatcgtcgtccgatag

SEQ ID NO: 3582 - DNA, 2217 bp, Micromonospora sp.
ctggaacccccgggagcactacgcgctgacgctgcgctccgacgagctgacggaggtcgagcggaacgccgcctcggccgacgacgtcgacctgaccctgtgaacgccgaggcggcgctcgacccggtgctgctgcaccacgtcgtcaacagcctcgggtggccgcagctgcgcgccctgcagcgggacgcgatcgggccgctgctcgacggcaccgacgcgctgctgctcgccccgacggcgggcgggaagaccgaggcggccgtgttccccctgctgtcgcggatggcgcgggagggctggaccggcacctcggtgctctacctgtgcccgctgcgggccctgctcaacaacctgcacccccgcatcgagcggtacgccgggtggctggggcgtacggccgccctgtggcacggcgacgtccacgccggcgcccggcgggccgtgctctggcagcgccccgacatcctgctcaccacgcccgagtccctcgaggcgatgctggtcagcgtcaacgtggaccatcggggcttcttcggcgggctgcgggcggtggtggtcgacgaggtccacgccttcgccggggacgaccgcggctggcacctgctcgcggtgctggagcggttgacccgggtggccggacggccgctgcaacgggtggggctctccgcgaccgtcggcaacccggcggacctgctgacctggctgcggggatcggcgacgggcagccgccccgggcgggtcgtcgcccccgacgtgcccgccgctgccgccgctaccggtccgccgcccggtgacgtggaactcgactacgtcgggtcgctgttcaacgccgcgaaggtgatcgccgccctgcacgcgggggagaagcggctggtcttctgcgagtcccgacagaccgtcgaggaactcggccaactgctgcgggaacggggggtgaccacgttcctgtcgcacgcctcgctctccgccgacgagcgacgccgctccgagcaggcgttcgccgaggccagggactgcgtcatcgtctccaccagcaccctggagctgggcatcgacgtcggcgacctggaccgggtggtgcagatcgacgcgcctgccacggtggcatcgttcctgcagcggctcggccgcaccggccgccgtccgggcagcacccgcaactgcctgttcctctgccgtacggggcaggagctggtccgggcggcggcgctgctgtcgctgtggggacgcggctgggtggagccggtcgtcccaccgcccgaaccccgacacatcgtcgcccagcaggtgctcgcgctctgcctgcaggaacaccgggtcggtgaccgcctctgggcgcaggcgtggaacggcctgcggcccttcgggccgggtgccgagccgatcgtccgccacctcgtcgaccacggctacctcgacagcgacggcgggctgctgttcatcgggccggaggcggaacggcggttcggtcggcggcacttcatggacatgaccgccgtgttcaccgggccgcccgagttcaccgtgctgcacggccgtcaggagctgggccgggtcgacccgagcctgctcaccgaggaggtacgaggcgaccggcggctgctgctcggcgggcgcagctggcgggtcacgtacgtcgactggcgtcggcggcgttgcttcgtcaaaccggtcgacgacggcggccgggcgcggtggacgtccctgggctgggtgggctggagccacccgctgacccgggcgatgcggggcgtcctgttgggtgacgacccacccgtacggctgacgggcagggcgacggaccggctggcggccgagcgggcggaccgctcggccgtggtgcacccgggcggcagcctcgtcctccgggccgagcacggcgacctgacctggtggacgtgggccgggctgcgggcgaacgcgaccctggccgcgacgctcagcgaggtcgtcgacccgatgcagcggtacgacgactacatgatccggctccgcgcggacctggagcggtcgcagtggcgctcgctggtggccgacgcggaacagcggatctgtctgcccgaggtcaacacacgggccctcgccgggctgaagttcggcgtcgcgctgccggaacgcctggcccgcgcgaccctcgccgcgcgccttgccgaccttcccggggcggcggcggtcctggcggaaccggtccgcttcgtcgcggctcgggcgtga

SEQ ID NO: 3583 - DNA, 2109 bp, Saccharomonospora xinjiangensis
gtgagctcggcgctggaccgcctgcatcccgcggtggtgcaccacctggtcaacaccctgggctggcggtcactgcgccccctgcaacagcaggccgtcgcgcccgtgctcgaaggccacgacgcgctgctgctcgcccccaccgcgggcggcaaaaccgaggccgcgtgctttcccgtgctctccgcgatggaacagcacggctggaccgggctctcggtgctgtatgtgtgcccgctgaaggcgctgctcaacaacctgcacccgcgcctgagcagctacgccgcctggctgggccgcagggccgcactctggcacggcgacgtgacggcggcagcgcggcgacgcatcctcgccgacccgcccgacatcctgctgaccacgcccgagtcggtggaagccatgctcgtgagcacgaaggtcgatcatcggcggctgttcggcgggctgcgcacgatcgtcgtggacgaggtccacgccttcgccggtgacgaccggggctggcacctgctggccgtcctcgaacggctcaccgcgctcgcggggcggcccatccagcgcatcggcctctcggccacggtcggcaacccgggcgaattgctgtcctggctgcaaggctccgggcggggtgctcggccagccacggtggtcgcgcccgcagtggaggccgcgagcacgacaccgcagggcgacatcgaactggactacgtcggctccgtggacaacgcggccacggtgatctcggcactgcaccggggtgagaaacggctcgtgttctgcgactcccgcaggctcgtcgagcagctcggggccgcgctgcgggcacgcggggtcaccacgttcctctcgcacgcctcgctgtcggtggacgaacgccgccgcgccgaggcggccttcgccgaggcccgcgactgcgtcatcgtcgccacgtccacattggaactcggcatcgacgtcggcgacctcgaccgggtcatccagctcgacgcgcccaccaccgtggcgtcgtttttgcaacgactcggccgcacagggcggcgcgccggcagcgtgcgcaactgcctgttcctcgcgctgcgcacggactcgctgctgtgggcggcggcgctgctcacgctgtggggtcgcggctacgtcgaacccgtcgaggcgccgcccgagccgaggcacatcatcgcccagcaggtgctggcactgtgcttgcaagaacacaccgtgggtagccggttgtgggcgaaggcgtggaacgggctcacgccgttcgactccggcgcggaacccatcgtgcgatacctgatcgaacacggctacctggaccgtgacggcgaactgctgttcatcggccccgaggccgaacgccggttcgggcggcgcaacttcctggacatgacggccgtgttcaccgcgccgccacagttcaccgtgctcgccgggcgcgaggagatcgggcagaccgaccctgcgctgctcaccgagcaggtcgagggcccgcgcgtgctgctgctcggcggccggagctggaaggtgacctggatcgactggaagcgtcgccgctgcttcgtcgaggagaccgacctgcgtggcaaagcacgctggcagtcgtccggcgcgggcggaaggagcgcggcgctcgcgcgggccgcgcgggacgtgctgctcggggccgacccgcccgtgcggctgacgcggcgggcgagccggggactggacgaactacgcgaccaacgcggctccaccgtccatcccggtggcctggtggtgacacgtggcggtgcttccggcacggacgtgcgctggtggacgtgggctgggcacaaggccaacgcgaccctcgccgcttcacttggcgacgcggtcgagggccggttcgacgacgtgtcgctgcggctgccggacgcggtcaccccggcgctgttgcgggcggtcagggacggcgccgccggccggttgtgtctgcccgaggtggacgagcgggcgctcgccggactgaagttcagcgccgccctcccgccgccgctcgccgaggcgaccctggccgcgcgtctggccgatctcggcacagccgcgcgagtgctggccgaaccggtgcgcttcacgaccgtcggctga

SEQ ID NO: 3584 - DNA, 2136 bp, Bradyrhizobium sp.
atgtctcccggtcctgatgccatcgaccggttgagcccagcagttcgctaccagatcgccaacggactgggctggagcggtttgcgtccagtgcaagcgctctcgacccacgcgatcctcgacggtgcgaactgcgtggtgctcgcacccaccgcaggcggcaagaccgaggcggcatttcttccgctcttatcgaagatggacgtcgaggattggcacggcgtgtcggtgctctacgtcgcccccatccgcgccctgctcaacaatcaggaggcgcggctctcgaagctcacgggcctcatcggcaggcgcgccggcaagtggcatggcgatgtgaaagaacccacgcgcaagcggctggtcaacgacccacctgacgtcctagccatcacgccggagtcgctagaggcgatgctgctgtcaactcgcacgcccgcgcgccgcttcctggcgcatgtgcgcgccgtcgttatagatgaggtgcacgccttcgcaggagacgatcgcggcgcgcatctcgtatcgctcctcgagcgcatctctcgcatcgcagaaaccgatatccagcgcatcggtctctcggcaaccgtcggggaccccgatgtcatcgtgcgctggctgggcggcagcagcatgcgcccccagcgcgtcgtcgatccgagcggcgcgcgcaaggtccccgacctgtacctcgacttcgtcggtacgctcgataacgccgcgctcctcattgagcggctttacccgggaacacggcggctggtgttcgtcgatagccgcagacgcgtagaagaactcggccaccggctctcacagcgtggcgttgacgtttatctctctcactcttcgctagcgctctcggagcgaaacgccgccgagaaggcgttcgaggaaggcaccaactgcgtcatcgtcgccacgagcgcacttgagctaggcatcgacgtcggcgatctcgaccatgtcatccagatcgacgcgccgagcagtgtctcgtcgttcctccagcgcatgggccgcacgggtcggcgcccggacttgaatccgaactgcacgttcctcgcgaccgacgacgacgcgctcctgcgtgccgccgccatcatcgatctctttaggatgggatacgtcgaacccgcggcgccctcgacgtggactccccacgttctcgcgcatcaggccatcgcgctcgcaatgcaggagcaaggctcggcgtcgcatggctggtggaactggctcgacgggtgtgaggcttaccgcgacgtttcagtagtggaacgcgagggcatcgtgcggcacatgatcgagaacaacattcttgtcgaggccgatgcgcggctcatgcttggcgcacggggcgagcggctctatggcgcgcggaacttcctcgagctctatgcagtgttctcgacgccccgggtactccgtgtgatgcacggccattcggaggtcggcgttgtcgacgcctcgttcctccaggacaaggagcagagaggccccaatttcgtccttgccggccgcgcttggcgtatcagcggcgtggactggaagggcgggacgtgtgccgtcgagcccgcggaggcaggcagttacccccggtggtttggcttgcccgtgagcctcaaccgctcactctgccaagcaatgcgccgcattctcacgaccgtggagatcgacccgtcatggtccaagcgggccatcgcgcagctccaattgcagcgagagtcctacgccttccttgacgagagttccgtgcccatcgaggaagactccgacggtcgttgccgctggtggaccttcgggggcggggccggcaaccgcgttctcgcgggactcctcgaacttaagctgggcgagcgcgtctcgtccggcaacaccttcataacgttctcgaatggcgctgccgcgagcgtcgtagcgatccgccaagccatcgatctgctcgcagcgcgccccctaacttgggaagacgcctcgcgcctcgtcgactctaaccagcggtcccgcatctcgaaatttcaaccttgcctcccggcggcgattgagcacggcctgatcgcccgggagaccatgaatatcgacgacgcgaacgcgaccgtcgcacagtggaagcgaggcaggaaaagcccagagggatga

SEQ ID NO: 3585 - DNA, 2112 bp, Planctomyces maris
gtgacattgagcagttttgaccttctccatccagctttgcagcatcacattgttaacagtcttggctggcgggaactgcgtccgtttcaggaagcagtcataccgcagatcctggcaggcaaacatctgatagtcctcgcgcccacagcaggaggaaaaacggaagccgccttttttccggttgtctcccggatgctcacggaagaatggaacggcctgagcgtgctttatatctgtcccattaaggcgctgctcaataatcttgacgtccgtctggaaggctactgtcgcctgctgggaagacgctctgcgttatggcacggcgatgtgaagccttcagcacgtaaaaagatcctgcgcgaaccgcccgactgtctgttgacaactcctgaatcactggaggtgatgctggattccccgaatgttgatgcacagcggctgtttggtaatcttcaggttgtcatcattgatgaaattcatgccttcgccggagatgatcgaggttggcatctgctctctgtcctggaacggatttcacgaattgcaggtcgggaactacagcgcctgggactttccgcaaccgtaggcaatcctgaaacactggttgactggctggcaggttcctgcaaggggccgcgcgacgtgtttttgccgcttgcttccggttcagatgctgcagatgtccaactggattatgtcggctcactctccaatgcagctgtcgtcatttcccgcctgcaccgtggtgagaagcgactggtgtttgtcgacagtcgtgcccgggccgaacaactggccgccgaactccggcgtctggaaattacgacttttgtgacgcacagctccctcagccaggaacagcggaaacaggccgaagaggctttcgcttcccgagatgactgcgcgatcgtcgccaccagtgtccttgaactgggcattgatgtaggaaacctggatcgagtaattcagatcgactctcctcctactgtctccagtttcctgcaaagaatggggcgcaccgggcgtcgcgcagggacactgcgtaactgtctgtttctggcaactaaggaagaaatgctgattcaagcggcggctttgatcgatctctggtccacaggttatgttgaaccggtacagccaccatctctgccttaccatattctagctcaacaattgatggctttgatcctgcaggagagtggcattggtcaaagagactggttttcctggctgagtggcgtttcaggatttcagtcaatatcccccagtcaggttgatcaactggtatcatcgatgttggaacgcggtatcctgtgggaagattctggtattttaggaatgggacagtcaggggaagaaacatacggtcgacgtaatttcatggaactgttttccgtgttcctttccccccctcttttttcggtattgtacggaagacaggaactgggttatgtcgatgaaatgacctttctcagcaaacaggaagggccacgaattttactgttaggtgggcgggcatggcaggtcaatcacatcgactggcaaagacgaaaagcctacgtggaaccaactgaatcaaagggaagaacacgctggcaaggctcaggacagggactgaactttcaaatggcacagtccatgaaacagattctgtctacagatttaaatcgtgattacctgtcacaacgggccactcaatacctcacagatattcgtgaagaatacgcctggctggacccagcttcttcgattgccatacaaactgggggccaggaagtcgagtggtggacttatgcaggttctcaggtcaatgcaactctggcgcggcagctctctcaacagactcgacatgatgtccagtttgacagtttcacactgacatttcaccagacactgaaactgcaggacatcgaagtcgcgatcaaagcggtctgtcaacgagatcctaatgaaatgtatccatctattgaagagcaagcgatcgacggactgaagttttcagaatgcctcccgcgggagctagcaatcgaaatgttggagcacagactgcaagacagtgaatccacccagaaactcttccagcaaccagtcaggtttgtgattcagcagtaa

SEQ ID NO: 3586 - DNA, 2223 bp, Streptomyces gancidicus
atggcggacgccgacagatcggccgggaccgaaccggccggggcggaaccggccgggggaggggccgatgtactcgaccggctcgatccagtcgtcctgcaccacatcgtcaacaccctcggctggcccgatctgcgccctctccagcgggcggcgattgccccgctcatggacggcgaggacgccgtcctgctggccccgacggccggcggcaagaccgaggcggcctgcttcccgctgctgtccgcgatggccggacagcggtggaccggcacctcggtgctctacctgtgccccctcaaggcgctcctcaacaacctggtcggccgcgtcgacacctacgcccaatggctgggacggcgcgcggctctctggcacggcgacaccaaggagtcgcagcgacagcgcatccgcgccgaggcgccggacatcctgctgaccacgcccgagtcgctcgaggcgatgctgatcggcgtcaagaccgaccacgcccggctgctgggcggcgtacgggccgtcgtcgtcgacgaggtgcacgccttcgcggacgacgaccggggctggcacctgctcgccgtgctcgaacggctggagcgggtcaccggtcggcccatccagcgcgtcggactctcggctaccgtcggcaatcccgagcacctgctgcactggctgcaaggggccgcagccgtgagccgcaccggacaggtcgtcgcaccaggcgtccaactgcccgccagtggtgcggccggacaccaggaggaggccaccgaagctccgtccacccggccggcgggcgaggtggagctcgactacgtgggctccctcgagaacgccgccaagctcatcgcggctctgcaccgcggagagaaacgcctcgtcttctgcgactcgcgccgtcaggtcgaggaactgggcgccgcgctccgcgcccgcgaggtgaccgtcttcctctcccacgcctccctctcctttgacgaacgcacccgttccgagcaggccttcgccgaagcacgcgactgcgtgatcgtctccacctccaccctcgaactgggcatcgacgtcggcgacctggaccgcgtcattcagatcgactcaccagcctccgtcgcctcctttctgcagcggatcggccgtaccggccggcgctccggcgccgtacgcaactgcctgttcctcaccacccgcagagacacactgcttcaagcagccgggctgctgctgctgtggtcgcgcggctgggtcgaaccggtcctcccgccgcccgagccgcgtcacctcgtggcccaacagctcctcgccgtcaccctgcaacagcacaaggtcggcgaccagttgtggtcgcagcagtggaacggccttgctcccttcgaccgctccgccgccccgatcctgcgcttcctcaccgaggagggctacctcgacagcgacggcggcatgctgttcgtcggtcccgaagcggaacgccgcttcggcaaacgtcacttcatcgagctcaccgcctccttcaccgcaccaccgcagttcaccgtcctgtccgggcgcaccgagatcggccgcaccgacccgagcgtgctcaccgaagagcggccaggtccgcggcgcctgctcctcggcggacgcagctggcaggtgacctacatcgactggctgcgcaaacgcgtcttcgtcgaacccgccgacgggggcggcgtcgccaagtggatgaacggcggcatcgcgggcctctcgtacgccctcacccgtgccatgcgcgaggttctgctgggggcggacccgcccgtcaccctcacgcggcgtgccgaggcatgccttgcggagcagcgcgagagcgacgcccccgagaccgtgcaccccggcggcactctgatcacccgggtcggcagtgacgtccgctggtggacctgggccggctaccgcgccaacgccaccctcggagccacgctctcctcggtcgccgaccctttgcaacggcccaccgactgctggctgcgtctgcgcgaggatctcacccgggccgactggcgcgcggcccgcgagggcgtcggcgagaccctggtcctgcctgacgtggaccccagagccgtacgtggtctgaagttctcggccgcgctccctgaacgcctcgccgtcgccaccgtcgcggcacgcctagcggacttcgagggcgcccggaaggtgctgtccgaatctgtgcggctgcagacgttagacgactccgcctga

SEQ ID NO: 3587 - DNA, 2094 bp, Gordonia amicalis
atggccggattcgatatcctcgatccggtcctgcaacaccatgtcgtgaactctctcggctggccgggtttgcgaccgttgcaggatgaggccgccgaaccgatcgtgggtggctcggatgcgatcctgctcgcgccgaccgctggcggcaagaccgaggcagcgatgttcccactgctcactcgaatgcaaacggagcactggaccggcatctcagtgctgtacatatgcccgctgaaggcactactcaacaatctgcaaccacgactggcggaatacgcagcatggcttggacgtggcgccatgacgtggcacggcgacgtcgcccaatcggtacgcggacgaataaagcgtgaccggccggacatcctcttgaccacgcccgaatcacttgaatcgatgctcgtatccgagaatgtcgatgctgctcaacttctcggtggcgttcaagcagtggtcgtagacgaagtccatgcattcgccggcgacgaccgcggttggcatcttcttgcagtacttgcacggctcgagtctttgctgggccgcaagctccagcgggtcggcatgtcggctacggttggcaatccagacgaactcctggggtggttgcagggtcgagccgagcgacctggtctcgtggtatcccccgtcgttggcggcggtgcggtcgttcccgacatcaccgtcgattccgtcggcagcacagagaacgcggcgaagatcatcgcatcactgcatctcggggagaagcgactggtattcgtcgattctcgacgactggccgaggaactcgggtctcagctgcgacagcgaggggttacaacattcatctcccactcttctctgtccgcagccgagcgccgcgagtctgaggaagctttcgccggagcacgagactgcgtcatcgtcgctacgtcaacgctcgagctcggcatcgatgtcggcgacctcgaccgcgtgatccagatcaacgcaccgcgcacagtgtcgtcctttctgcagcgtctcggacgcaccggccgacgcgcaggtacgactgggaattgtctcttcctctgtctgagcgatgcctcgacacttgaagcgctaggaatgctccactgttggtcccacgggtgggtggagcctgtgactgccacacctgaaccccgacatattgctgcccagcagatcctcgcggccgcactgcaaacacgacgagttccgctcaccgactggcaagccatctggggaaccctccccctcttcggcgaggactctcagcagatcatgagctacctgcttgacgaaggtttccttgagcacgacgctggcagtgcctttattggcgcggaggccgaaaaacatttcggtagaaggcatttcatggacctactcgcggtcttcaccgcagcacccgagttcaccgtgtacgcaggacgcaacgagatcggcgctgtcgagacgagtgttctcaccgatgacgtcgaaggccctcgcgtgttgcttctggccggcaggtcgtggaaagtcactcacatcgattggaagcgccgacacgtgtatgtcgaggctacgaccctcggcggtcgagcgaagtggatgtccgtgcctgacggggcttccttcgaaatcgcccgcggcatccgggaagtcctgctcgggtcgaaccccgccggcgttactttgacccggcgggctgtcgccaccttggacgacctacgaacaagcaggtcgcaccaagtagcgcatggcgcgtttgttatcgaacgagacgaccgcggcgactggcgttggtggacgtgggcaggagcaaaggccaaccggactcttgccgcgtgggctccgaaactcgtacccgcgcgacaacgaatcggcgcagaggtccttcgtttgcactcggacctgtcggtggacgagatcaaagaagaactatctaccatccgagccggaaacactcgtgcgtttccctcgatcgactcccgtgcgctgcgtgggctcaagttctccgctgcactgccggagtcactcgcacgcaggacgctcgcagcccgcatggcggatcagatgggtgcagagactgtactgagtgaacgtgtttcctatcatctgtag

SEQ ID NO: 3588 - DNA, 2061 bp, Phaeospirillum molischianum
gtgaccccgttcgagcgcctccatccctcactccaataccacatcgtcaatacgctgggctggccgggcttgcgtccgtcgcaagccgaggcgatcgagcctgtcgtaaccggaaagaatgccctcctgcttgctcccacagcaggcggcaagaccgaggctgcatcgtttccgatcctgtcgcggatgctgacggagaattggcgaggggtctccgtcctatatgtctgcccgatccgtgcgctgctcaataacctggagccaaggttggcgcagtacgccggcctagtcgggcggcgggcggcgctttggcatggcgacgtcggccaagggcaaaagcggaaggtcttgcgcgagctgcccgatttgttgctgatcaccccggaatccatcgaggggatgctcgtctctcgccgtgtcgaacacgaggcattattcgcgggcctacaggcggtggtggtcgatgaactgcacgcctttgccggcgatgatcgcggttggcatctattggcaatcatcgcccggttggaacggcttgttggtcgaccattacagcgtgtcgggctgtctgctaccgtcggcaatcctgaggaattggccgagtggctcacggttggtcggccagtggtggtcgcaggtcggtcgaccgtatcgacggacgccgacgtcacgctggaccatgtcgggtcgctagacaacgcggcgctgctcctgtcccgccttcatcgtggcgagaagcgactggtattctgcgacagccgcgggaaggtcgaacaattggcggccggactccaagccggcggggtaagaaccttcgtctcccactcgtctctgggagccgatgctcgccggcaggcggaggaagcctttgcccgcgagcgcgattgcgtcatcgttgccaccagtacgttggaactgggcctcgacgtcggtgatctggatcgggtcgttcagatcgatgctccctccacggtatcgtcgttcctgcagcgaatggggcggaccgggcggcggccgggcagccgccgcaactgcctgtttttgacgacctcggaaaaggcattcctgcatgcggcaggacttgtgagattgtggagcgaaggctatgtcgagccggtcaaaccgccggccactcccttgcatctccatgcccaacaaattatggcgatgatcctacaggatggcggcttgccggagagtgaagtccagccccgtcttgccggtgcattcggtgccgttgacgagggtgacacccgggccatcctgggccacatgctggtgacgggcgtgttggcgagcgatggcggggtcctggggatcggtcccacgggagaaaagttgttcggccgcaggaatttcctggaattgttggccgccttcactgccccgtccatggtcacggtcatgcacggtcgccaggaactggggcaagtcgatccggtctccctgacggcgagggcggaccagccatccgtccttctcctcgccgggcgtcactggcaggtcgcctccatcgactggcgtcgccgcattgcctgggcagaaccggcagcaggagccggcaaaagccgatggttgggcagttcccgggctttgcatttcgacctctgtcgcgcgatccagcgctgtctggcggaagggcaggtgccatgcacgttgtcgaagcgagggaccacacgactggccacgttggtcgaggagttttccttcctagacggacgggcgcaagccatcctcgcggaggaaggcagcatccactggtggaccttcgcgggtgggcgcgccaatgcggcacttgctttggcaatcgcgaatgatcaatgccgcgtgcgccgttcagacgattttggccttgatctcgatggccatccaccaagtctggatgcagcagacctgaccaacgcattagaaaatgctgatggcgtagatctcggccatgagatttctgggctcaagttctccgcctgcctgcctctcattttggcgcgtgacgtagttcttcgacgtcgatttgatctcgatggtgcgatgcaggtcgttgtgtcgaaaatttcgttttga

SEQ ID NO: 3589 - DNA, 2085 bp, Nitrococcus mobilis
gtgaagggtggcggcgctgagcgtgtctccgccttcgagcgcctgcacccggcggtgcagtatcacatcgtcaactcgctgggctggccggcactccggccgctgcaggagcgcagcattgccccggtattggacggccaccatgcgctgttgatcgcgccaaccgccggcggaaaaaccgaagcggccatgctgccggtgttgtcgcgcatgttaagcgaggagtggcgcggcctgtcagtcctgtatatctgcccgatcaaggcactgctcaacaatctcgaggcgcggttatcccgcctggcgcgtctgctgggccgcacggtgcaactgtggcacggggatatcggccagggcgagaagaatcgcgcacagcgtgagcctccggacatcctgctgaccacgcccgaatcgctggaaggcatcctgatcggtgggcggcgcgatcatcttcgccttctgggcggtgtgcgttgcgtggtaatcgatgagctccacgccttcgccggcgacgaccgcggttggcatctgttggccttgctggagcgcattcatgcattgcgcggccatgagccgcagcgtattggcctgtccgccaccgtcggtgaacctcacgcactgctgaactggctggccgcgcattgtgccggggaacgcagccttgtgcgagttcaggtaccgccgaccgaggtggatttgtgcgtggattacgcgggttcgttgcgaaacgccgcgatcctgatcagccgtctgcatcgcggcgagaagcggctggtattttgcgacagccgcagccgagtcgaggagctatcgattgcattacgcgcgctcggcgtggacgtgttcgtctcccatgccgcgctgtccgttgacacccgccgccaggccgaacaggcctttgccgagcggcaaaactgtgtaatcgttgccaccagcacactggagcttggactggatgtgggcgatctcgatcgcgtcatccaaatcgatgcacctgggtcggtggcgtccttcctgcaacgattgggacgtaccggtcgtcgcgccgacagccgcaggaacctactgttcatcgccacccgcgacgctggtctgctggaatcgctggcgattgcgcagctgttcgagtctggcttcgtagagccggttgtcggcccgcccatgccttgtcatttggtggtgcaacaactgttcgccatgctgttccagcattcgctggagctggaagagcgtgtgtttaccaccacgctacgccgtatccccgggtttgccggattgatcgatgcgcattgggacgaactgcgcgagcatctgcttgcccgtggctttctgatccgcaacgggctgctgcttgccctcggccccaaggctgagcgcgcgtttctcgggcgcggcttggcggatctgtgtgtttcctttgactcgccgcaattattcacggcgtttcacggtaacaagttactcggtcatgtcgatcctcttagtctgtcctggcggcgcgatgggcctacggtactggcgctgggcgggcgctcatggcgcgtcgtttccacagattggacgcgtgatcgcgtgtatgtggaagcggccgatgagaagggtaccagtcgttggctcggtgaatcgcgcggtgtttctagggttatcgccgagcaggtaagacgtattcttgcagcaccgccggcggattcgacgctgctcactaagcgctcatccagccgcatcgccgagttgtgtgctgcccaggaagacacgctatccctgaccccccttcggctccaggagggcggcttcgaatggtggacctacgcagggttggccgccaatattttgttggccgcgcgcatcgccgccgctggcggcagttgcggcgccgtcggctcctatagctttcggttcaaaataagcgatgcggcggtgacggcgcacggcggctgggacgccatacgcaagctcacccccaggctggagcctctggaccggcagcgcatcaagttcgctgagttgctcccccatgatcttttggctgagatgagcttgcggcgaatcaatgctaaatcccgaccgcgcggcggcctttcatga

SEQ ID NO: 3590 - DNA, 2133 bp, Frankia sp.
gtggtgacgcaccacatcgtgaacacgctgcagtggccggggctgcgcccgttgcaggaggcggctgtcgcgccgctgctcgccggatcggacgcgctgctgctcgcgccgaccgccggcgggaagaccgaggccgccaccttcccgatcctgtcgcggatggccgcggagaactggcagggcacatccgtcctgtacctgtgcccgctcaaggcgctgctgaacaacctcaccccacggctggagacctacaccggctggctcggccgccgggccgccgtctggcacggggatgtggccgagagccggcgcgggcggatccgccgcgaacggcccgacgtcctgctcaccacacccgagtcgctggaggcgatgctcgtcagcgtccgcaccgaccatcacgggttcttcgccggtgtgcgggccgtgatcgtcgacgaggtgcacgccttcgcgggcgacgaccgtggctggcacctgctcgccgtcctggagcgactgcgccggctcatcgccgcagagctgcaggtcatcgggctgtcggcgacggtcgggaacccggccgagctgctgcgctggctgcagggatcgggcgccggccgccgcaccgcccaggtcgtcgcaccggacgtccccctccagcggacccacgaaccgacaccaccgacgtcccacagcgcggtgccggcgacaccgccgccgggtgagatcgagctggactacgtgggctcggtgacgaacgccgcgaaggtgctggccgccctgcaccgcggcgagaaacggctggtgttctgcgactcgaggaagaccgtcgaggagctcggccaggcgctgcgggcgctcggcgtggacacgttcctctcgcacgcctccctgtccgcggccgagcggcgccgctccgaggaggccttcgcgcaggcccgcgactgcgtcatcgtggccaccagcacgctggagctgggcatcgacgtcggcgacctggaccgggtgatccagatcaacgccccggcgaccgtcgcgtccttcctgcagcgcctcggccgcaccggccggcggccgggcaccgtgcgcaactgcctgttcctcaccctgtacgagagcgcgctcgtgcaggccgccgggctgctggcgctgtggggccgcggctgggtcgaaccggtcgtcgccccgcccgagccacggcacatcgtcgcccagcaactgctcgcctactgtctgcaggagaaccggatcggcgaccggacctgggtcgacgagtggaacggcctcgcgccgttcgaccgctcggcggaaccgatcgtgcgccacctcgtccgcgccggctacctggactccgacggcggcatgctgttcgtcgggcccgaggccgagcgccgcttcggccaccggcacttctccgagctgaccgccgtgttcaccgccgcgccgcagttcaccgtcgtgcacggccgcgacgagatcggccgcaccgacccggtcctgctcaccgacccggtcgaggggccgcggctgctgctgctcgccggccgcagctggcgggtcacccacatcgactggaaacgtcgccgctgcttcgtcgaacccgccgacggcggtggccgggcccgctggctcaccgccgccgacggcgggatgtccttcgcactgaccagagcgatgcgggacgtcctgctcggcgaggacccgccggttcccctcacccgccgggcgacggaacggctcgccgccatccgggagaaccacctcgacgtcgtccatccgggcggcacggtgatcgcccggacggaggatcacaccgacgtccgctggtggacctgggccggtgaacgcgccaaccgcaccctcgccgcgagcctcggcgaccttgccgacccgctgcagtccccgacggccgcctacctgcgcctgcgcaccgatctgaccccggccttctggaagaccgcgaccgcggacctggccgcccgcctgtgcctgccgcacgtcaccgaggacgccctcgcgggcctgaagttcaacaccgcgctgcccccacggctggccgaggtcaccctcgccacccgcctcgccgacctgcccgccgcggcggcggtcgtgcgcgagcccgtccgcttcacccaccgaatccccgcgtag

SEQ ID NO: 3591 - DNA, 2112 bp, Pseudomonas stutzeri
atgagtgagttcgacaagttccaccctgccttgcagcaccacatcgtcaactctctaggttggaacggtttgcggcctttgcaagaagctaccattcagcccgttttggatggcgagcacgcgattctgctggctccaacggctggcggaaaaaccgaagcggcaagctttccggtgttttcacgcatgctcagtgagagctgggaaggcctttctgttctctacatctgcccgatcaaggcgctgctcaataaccttgagcagcgtttgagttattatggacacctcctggggcgcagcgtcgccctatggcatggcgatatcagtgctgcgcgtaagtccaagattgtggcatcgccaccggacattctgctgacaacacctgagtcgctcgaggtcatgctggtctccaacaaggttgatcatcagcagctttttgccaacgtgcggacagtgattattgatgaggtgcatgcctttgcgggtgatgaccgtggctggcacttgctctctgtccttgagcgaatcagtgttctagcaggccgagagatccagcgcttagggctctcagcaaccgtaggtaatcctgacacgctctgcgattggcttgccggtagctgtaatgcccgaagaagcgtgatcaaccctcctgcagagaacaatgtgattcctgacgtccaagtcgattgggtcgggtcgctgaaaaacgcagcagttgtcatttcaagattgcacaaaggcgagaagcgcctcgtcttcgtggatagtcgatccaaggttgaggagctcgctgttgagttacggtgccttggtgttgccacctacatctcccacagttccttaagcctggaggaacggagagctgctgaagaagccttctcccagggtaatgactgcgtcatcgtttctacttcgacgttggagttgggtattgatgtgggcgaccttgatcgagtgatccagatcgatgccccgtacacggttgcttctttcctgcaacgcattggccgaactggccgacgcgcgggtagctctcgaaactgtctgtttctggctaccaaggaagatgcgtttcttcgtgctttggcgttgttacagctatggcggcaagggtatgtcgaacctatcgaaccgcccgcgaggccagtgcacatctatgcccagcaaacgatggcattggcgcttcagcaaaaaggcatcatcgcagccgacgttgatcagtgggttgggcgcatgcctggttttgctggagtcacgcccgatgatcgggctggtgttattagctacatgcttggggccggcatattgcactctgatgaggggctcatcgggattggcaaggccggagagagggcgtttggtgagaagaacttcatggagctcttttcggtgttcacgacgccccccatggtcaaggttttttcgggtaagcaggagctgggtgaggttcatcaactgaccttcgctgtccgtgataacggcccagcgctgcttactcttggtggacgcagttggcaaacgacctatatcgactggccgcggaaaaaggcttttgtcgagccatccgaggtgcgtggtaagtcgcaatgggtcagtgatgcgcaacctttgagatatgaactgtgtcgtgcgattgctgatgtgttgatttcagatctcgtgccagagggcctttcatccagggctcaaggactacttgccgatcttcgtgatcagtacgggtggatggaatcgggtaaaagcactctgctccttgatgccgatggtaatgcgatttggtggaactttgctggcaagctgctgaattcagccatgaaggatctgctggctgatgaggcagataagctcatcgcggacaatgagtgcatgacttttcggcacgtctattcagccgaggcgttggtacgtgctattcgagagattcttgcaggagacgcgcataatttagcggtgctgctagatgaatcctttgtacaagagctgaaatttgctgagtgtttaagccagaaggaaattgatcgtgagctgggggagcggtactccgttgatagtgatttcaagcagttcagccgagtttcgctcgccgttctatgggtgaaggatgaagcctga

SEQ ID NO: 3592 - DNA, 2115 bp, Dietzia cinnamea
atggactaccgcgccccgcagggcttccccgcgctgcacccgctcctgcagcaccacgtggtcaactccctcggctggcccggcctgcggccgctgcaggaggagtccgtccggccgctcatcgacggcgaggacgccctactgctcgcgccgaccgccggcggtaagaccgaggccgccgtcttccccgtcctcacccgcatggcccacgaggactgggccagcctgaccgtcctgtacgtgaccccgctcaaggcactgctcaacaacctcgccgtgcgtctggtcgactacaccgcgtggatgggccgccgcgtcgaggtgtggcacggggacgtcggcgagagtgcccgcagagccatccgcgccgacccaccggacatcctgctcaccacacccgaatccatcgaggcgatgctcgcctccaccaagaccgaccaccgcacgctgttcgcgaacctgcgcaccgtggtgatcgacgaggtccacgcctttgccggcgacgaccgcggctggcacctctccgccgtgctctcgcgcctcgagcacctggtcgggcggccgctgcagcggatcgggatgagcgcgaccgtcggcaaccccgaggaactgctgcagtggttgcagggcggtgccgacgggagggccgggcgagtgatcgcgccgggcgtcgccgtgggcgaggcggtccggcctgtcgccggtgacgcggagatcgtggtggacgccgtcgacactctcgactccgccgctgtgttgctgtccaagctgtaccgggggcagaaacggctcgtctttgtggacagccggcggcaggccgaggagctcgcgtccatgctccggggcttcgacgtggacgtgtacctctcgcactcgtcgctctccgcccaggagcggaggcggtccgagttggcctttgccgaagcgcgcgactgcgtgatcgtggccacctcgaccctcgagctggggatcgacattggggatctggaccggatgatccagatcggtgccccgaccaccgtgtcgagcttcctccagcggctcggccggaccggacgccgcgcaggtaccgtccgcaactgcctgttcatcgccaccgaaccccgacatctgctccggacgttggggctcctgcatgcctggggcacaggatatgttgagccagtcgtgcctccgccggtcccgctgcacctggtggcgcagcagatcatggccgcgatgctgcaggagggcgcgctgccgcggtatggctggcaggaccggtgggcggccaccccgctcatgcatgtggacaccctggagcgtcccgccgagctgatcgtcgacttcctcgtggagcgcgggtacctcaacgtcgacggcggcgccatgttcctcgggcccgatgctgagcgggtgtttggccgccgacatttcatggacctgctcactaccttcgcgatgccgcgagagttcaccgttctcgccggccggcaggaggttgggaccgtggagtggcgggctctcactggcggcgacgggccgatccacttgctccttgccgggcggtcctggaaggttacggacatcaactggcccaggcaccgggtgcaggtggagcccgccgcgggcggcggcagagcacggtacgggttcgggggcgccgacatcggtcggcaggtcgcgcagggcatgcgcgctgtgctgctgggcgagctccctgagcagattcggctcaccgcgcgggcgcgcgccgcactcgccgacgatgaggaccggttgcgtcacacggtgagcccgcacggcccagtgtggacgaccactgacaatgtccggaagtggtggacctacgagggcagtgccgccaaccgtcggtaccaggcggcactcgggccagcattgggtgaggagctggcgccgcagggcggaatcgtccagcccgacgcgattaccctgcacgagggcatgcccaccgggccggcggctgagcggctcgagttctgggagtccctaccggagagtgagcggccgcttcctgcggttcctccgacgttggtcgacaagctcaagttttcggaagcgttgcctgtcgagtgggcaattgaggtcatcgcgcggcggatgggctacgcttag

SEQ ID NO: 3593 - protein, 720 aa, Desulfitobacterium hafniense
MSGNPFYRLAPFIQEYIYKHQWTELRAVQVEACRVIFESESHLLLAAGTASGKTEAAFLPVITLLHESPPLSISALYIGPLKALINDQFARLSDLLEEAHLPVWHWHGDVSPSHKNKMLKNPQGILQITPESLESMLINRSTDILRLFADLRFIVIDEVHAFMGTDRGSQILCQLERLTRMIGHQPRRIGLSATLGDYAIAEKWLSSGTEKRTITPKVQVGQQKVRLAVEHFYLDEEKKMSLYDQYIFDQSKNRKCLIFTNNREQAEYTVATLRQLAEGKRMPDVYHVHHGSISAPLREAAEKAMKESPEPCVTAATITLELGIDLGYLERIIQLETPFSVSSFVQRLGRSGRRGTPSEMWLVCKEDEEVNDLLPNQLPWSLLQAIAIIQLYLEERWIEPVSPKHYPFSLLYHQTMSTLAAMGELVPAALAQRVLTLSPFKNISSEDFRRLLLYLIEIDHIEQTEERGLLVGLTGEQVVRNFRFYSVFPDNEEFTVRDESKEIGSILSPPPKGERFALAGRTWEVMEIELKRRTVYARPVKGKVRTTWNGGGGSIHSRILQRMKQVLEEDIIYSYLQPGAVKRLCEARNLARAAGILKTNILPLGGNSYCLFPWLGTVAYRTLERCLRYRGADLYEIRNVGGLSPYFLTFSTKSGTTIEVDSLLKEVIAGTADTEQLMQEDEAPQLEKYDEFIPPSLLRKGFRYDYLDLNELRLAFDIKN

SEQ ID NO: 3594 - protein, 855 aa, Desulfitobacterium hafniense
MNIKEMLQNFGGKITYHYIDSSRSGKYMKTPEILDTRLRLYTKFKYPQGLYSHQVMCIISLLNGHHTALCTSTASGKSLGFCYPAMQEILNNSNARALFVYPIKALANDQIAKLKSLATDLALKPDIVRKFDGDVKATDRVEALEKSRILVVTPDVLHTTLLRLNDEPLYSRFFENLSLVILDECHTYSGVFGSNMAYVLSRLRQVCQKKGSNPRFMMSSATVGNPQEHLRQLTGIEDITIIDERFNGSPQFEREFFMVQPTRYLEGYTLDLMGELIQQNTRFLVFGQSRQQIERLVESFRLKYPKYRSKVEPYRAGFTPTERQQIENSFRKGELVGLVATSALELGVDLPNLSVCIILGLPSTKSSFWQQSGRIGRSNEGVVIVLRTDSAFDNYFFNNPEKLYNKPFEPLVINQNNEPLMIGHYACARAESGDFENPFLDHRIFGSKFSGLSQRINEFDYTDEILYTKDPHFEINIRSLNDPTYQIVIGRDSQDPPIGTITYSQLMREAYPQAIFLQRGKRYRVTKISFTNKKVYVDARCPMYSSTRPKGEVRIKERFNGRILQKHWGSGVTIRNTTLGILEKVSGYQIITGKEKEDVEYAQPLMRYFVTQGVIIHLKDISSLSHSAVVGLTTALHNIYPVFYPCAKEDIASYAWAKAGEAGVFLYDNNAGGLGLTAAAFDRFEELIKQAYENVVNCEYCLSHPQDNGCINCVVANRWYTTNVKSDRQAVLRLFEEIIDVLRRILPRSNQNGSENLPAKSQLIKEGHFGRTMISDGALVFTGKNQEGVILSSQHFQSVGEEERLYELNVQGRIVKFMGRSLTLVQGNLEYWCTNCGQEGIERSEVVCPLCGSQL

SEQ ID NO: 3595 - protein, 878 aa, Desulfitobacterium hafniense
MEKVFETHQLLEDLGLEVIHTESKEPRAARICQAENLTPIIQETIKEILPLGLYRHQAKSIDSACAGENIVICTGTASGKTFAFAIPALQTLLKDPKARAIFFYPTKALSGDQKSKLEELSSRFGLEDGVYSFDGDTPFNRRKEAIKKGRILLCTPDVLHATMLRLSNEKDYQEFFAHLTHVILDECHIYSGAFGSNMAYLMRRLRQVCRRLGNEPQFLAASATSKDPKGHLEKLVGVPFQVLGEEEDGSPSGGRNFYIAISPNMPEEQAVIQLIARLIEDQKRFIVFSHTRKITEQVFMDLINLFPEVEGKVMPYRSGFEHGDRQRIEQALRKGDLFGVISTSALELGVDLSEMEYCILLGIPSTAMSFWQRDGRVGRSPQSQGQVIIIPSTNSVDDYYRHHSEKLLTRELEDLVIHLDNWQLILFHFACARAESGNHEHPNLDPEIFGQDFAQLADKIEELDITDEILIAPEPHLVMGIRGIDDKTYEILSSGGEKRLGTISYSQILREAYPQAVYRHMGEAYRVEWLNTKHCTIRVKKEERNLATSPIGYIAVKERINNGTTFRRIRWGNALEMLHTTMTVTTVTSGYRERRDGDWINQEKYPSPLQRRVISEGVWLKFGSEFGMIKKNALNALAHAFSNIYSIWFPCDAAEVATHCVVNAKDKSSRLYIFDTTSGGLGITSGFFDHFLELLDPVRERLEYCDHCDSDPELFDKGCPSCIQIPRWFEDNEHLSKSLALELLSQIRTVLESNTPNLTVSEAYRGRQEGGLAAVSSLNIVDGEVAVEDLKRGIVILYPGAIIALPSGQQGKILGWRIDHGQVVYETELSNGKTIGLRNTGNNIALIQGEEAILCLDCGYETIDRSDVICPACGAVLR

SEQ ID NO: 3596 - protein, 711 aa, Candidatus Accumulibacter
MSEEQAAFDRLHPAVQHHIVNSLGWNGLRPTQQAAVAPILDGQHCILLAPTAGGKTEAAIFPVLSRMLSEDWRGLSVLYVCPIRALLNNLEPRLSCYFGLVGRRVGVWHGDISDSIKKRAIKDPPDLLLTTPESLEGMLISANDDKRNLLLGVGLIIVDELHAFCGDDRGWHVRCLIQRVQRLAGRRIQVLGLTATVGNPKFLIDWMLPGQPTTVIGAGHSGIDADLTIDFVGSLENAATVIFKLHAGEKRLVFCDSRAKTEELSAVLRGFGVRTFVSHSSLSADERRQAEKAFAEEPNCVIVATSTLELGIDVGDLDRVIQIDAPGSVASFLQRMGRTGRRKGEMRNCLFLATDDEGLMIASAIVRLWREDFVEPINPPVAPWHLVAQQGIALILQSRGLERASLESQLTDIFFDLDSNKISQIISTMLSRSILWEDEGIGGLIGLGEVGEDEFGRRHFEAIVSTFNSPLLLTVLHGQRELGFVDPMSIRTNDESAPTLILAGRYWRVVTSDWRSRVVYVEPSENRGKASWLGSSRALRLELCQKIKALLIDRKVPAVLSNRAKNRLDNLSSSFAFLEVGKTTAEKTVGANQPEWRWWTFAGGAANFLLAEMMTLSGNKSIGHDNFSIRLTFPPNVAEGMALPVELTQQGEKRIRQIGKDLKFSRCLEDADVAAVIKPRLLDRGGAASITAQAIVASNEYFAPHQSRDAP

SEQ ID NO: 3597 - protein, 917 aa, Corallococcus coralloides
MAGLERLHPHLQHAIIHDLGWRSLRPVQELTIDAILDGCNAVVLAPTAGGKTEASIFPVLSRILTEDLKPVCALYVCPIRALLNNQEERLSSYARMVGLEVFKWHGDVSDSKKKKFRETPAHILMTTPESLEVMMISERTDAKSLFSGLSAVIIDEVHAFAADDRGAHLASLLERLVAMTGRDIQRIGLSATVGNPHVIGEWLQGSSKRPFRLVDPPKAKAQRDLRLDLCVDISEAAKAIGQVARGKKSLVFVESRSKAEKVAHALAGTGVEVFIHHSSVSRADRTLAEEQFAKGQNTAIVCTSTMELGIDVGDLDQVIQVDAPASVASFLQRLGRTGRRANTRANCTFFCLSSESLLQSVALLRLAEAGWVEDVTPAAHAMHVLAHQVMALILQEGGISRHTLMPWVEAAYPFSSVRPERVQELVDTMLEREILYEADGLLSLGQRGEKLYGRKNFFELYAVFTAPPVMRVQHGKEDVGYIQALFVSMHDASAGPLCFRLSGRAWEVGQIDYGKGVLHVRPADYGRVPSWLGLPGVLSNALCQGMLDVLLHEKQEGAWLSKAAAAELAVVRDSYDGLLEEGTAPLEDHPDGVQWHTFAGGAVNRLLAAGLEQKSGKKWVAGNLSLRCKDIAFSAADDAIRSLADLNWERVAAGAAREMARGMLSKFQPCLPEEAEDRLLSERLLDQAGTLRFLANVRVNGSRVAARPTGMRLADVEVTGPLPLELTLRGLPGVAAAPKNDVQWVDTLAALRAVSEELRAAEVVGLDVETALDFGTLYLLQIATRTRTFLIDPLAVGDLQPIVDVLSGPTPLKVIHNARFERRVLAALGIALDGVFDTLAASRRARGTDALGGHSLAMVCERELGIVLDKSSQTSNWSRRPLEADQLSYAALDAEILLALYDRFKDAGVAPGAGGGN

SEQ ID NO: 3598 - protein, 742 aa, Corynebacterium variabile
MTGFDHLYPTLQHHIVSTLGWPGLRPLQDASVKPLLTGQDALLLAPTAGGKTEAASFPVLTRMANENWRGVSVLYICPLKALLNNLEERLRTYAGWIGRTVGVWHADVTTSARRRMQTSTRPDILLTTPESLESMMVSTGVNDRDFLGNVQTVIIDEVHAFAGDDRGWHLSAVLARLEHTVGRHIQRIGMSATVSNPEDLLEWLQGGARSAATRTGSVIAPGVVLPSAGISPAAGPDAPEIRVDRLESFDQVATLLSKLYVGEKRLVFVDSRKNVEILGGLLEDLGVKVFLSHSSLSASERARSEAAFAEETDCVIVATSTLELGIDIGNLDRVIQVGAPRTVSSFLQRLGRTGRRAGTSRNCLFIALPGASSVARDDQDEMLLQILGLLSAWAAGFVEPVIPPPLPLHIAAQQFLAAALSRGAFSTTDWRDIWAGTSLMDEAVLECEAAEVLDHLISSGMLETDGEMALIGEAAEKAFGRRHFMELLSAFTSTPLFTVLDGRTEIGMVEDRLVASLDDSDGERVLALAGQNWKILSIDFKRKVIHTEPSSKHGVARWGSSGPSFGYNVAQGMRRVVLGEDPAGVQLTGRASEALEGIRAWWSPTVSATSDAVYVPVGRYRPEQAEWWAWCGTGRNQQVKAALGASASHGDVLPGELGFTTDSIADDAQLAPLDQAARYDRLRVFPEATPAQVRARVAWYDSLLADERPLPYVSPKAVHGLKFSAALPEDKAREILARRLLL

SEQ ID NO: 3599 - protein, 753 aa, Frankia sp.
MISRTSGASGASGAPGASGASGASGFAALDPAVQYHVVNSLRWPALRPLQEAAIRPVLDGHDVLLLAPTAGGKTEAVALPLLSRMAGEKWRGLSVLYVCPLRALLNNLEPRLAAMCEWLGRRAAVWHGDVADSVRGRLAVDPPDLLLTTPESIEAMLVSARVDHRWLFAGLRTVVVDEVHAFAGDDRGWHLLGVLARLRGLANRAVQRIGLSATVGNPDVLLDWLADGSARPRAVVRPSDVTATTDVTATTDATATTDATATTDATATTEVGIDYVGSLRNAALVVARLHQGMKRLVFCDSRSQVEELTVALRDLGVRTYVSHSSLSRDDRRQAEAAFATSTNCVIVATSTLELGIDVGDLDRVIQIGAPATVISFLQRLGRTGRRPGTRRNTLFLATSQNSLWLAAAITLLWQRGYVEPVVPPVLPRHIVAQQILGLALQEGRLVDRDVWQWLGGLARTPGAVDVLAHLARSGFVVHTDGLVSIGPRAEKEYGRRYFLDLTSTFAGESMVQVWWGRSLLGQLPPIALAARPEHGPRVVLLGGRAWKVNHVDWRRRRVQVEPSRYPGRSRWNGGARVMSYPLAQAHLDVLAGQTAGIEISRRAADALDKLRAQHSFVSVSVSDEPGERTYLTRDPEKRPIWWTFAGFAANSALASGLGELVDADAPVGDLRLRLRPHVNSAALRTMLDVRRDDLVDALPAIDVEAADGLKFSAAIPLELAIETLAARLTDPSAVHATLKAIIREETAPPPGGW

SEQ ID NO: 3600 - protein, 784 aa, Frankia sp.
MTEPVPLASAGGTESADLLHPVVLHHIVNTLQWPGLRPLQEAAVEPLLAGADALLLAPTAGGKTEAAAFPVLSRMASENWQGTSVLYLCPLKALLNNLAPRLESYTGWLGRRAAVWHGDVTESRRNRIRRERPDVLLTTPESLEAMLVSVRTDHRGFFVGVRTIVVDEVHAFAGDDRGWHLLAVLERLRRIVAAERTAINDLCVPRNGVVACEQPAQPAGSGHGAGLAEERPAGAAPPELQVIGLSATVGNPEELLRWLQGSRVGRRPARVIAPDLPTAQAVPLPTAPPVASPPDLATSGAATRAAPPAGDIELDYVGSVSNAAKVLAALHQGEKRLVFCDSKKIVEELGQALRSLGVTTFLSHASLSVDERRRSEEAFAQARNCVIVSTSTLELGIDVGDLDRVIQINAPGTVASFLQRLGRTGRRPGTLRNCLFLALSESALVHAAGLLLLWGRGWVEPVVPPPEPRHIVAQQLLAYCLQEGRIGDQTWVDEWNGLAPFDRSAEPIVRHLVRMGHLDSDGGMLFVGPEAERRFGHRHFSELTAVFTAAPEFTVLSGRDEIGRTDPVLLTDEVEGPRMLLLAGRSWRVTYIDWKRRRCFVEPAERGGRARWLTSGDVAMSFDMTRAMREVLLGADPPVPLTRRAQERLATIRDSHLDVVHPGGTVIVRTDDLTDIRWWTWAGERANRTLTASLGDLADSLQTPTAAYLRLRTDLTPEMWKTATADLESRLCLPHVTDEALAGLKFNTALPPRLAEATLATRLADLPSASTVLRQPVRFTFLQA

SEQ ID NO: 3601 - protein, 711 aa, Haliangium ochraceum
MSESAFHRLHPSLRYLIREALRFSSLRPVQEATIAPVLDERDIVVLAPTAGGKTEAAFFPVLSRVLSERWQPVPVLYVSPLRALLNNQEGRITRMAEAVGLATGTWHGDVSAAKKRALLAAPPHILSITPESLEVLLITAPERAEALLSRVRVAIVDEVHALAADPRGAHLLSVLERLQQRAGGGHIQRIGLSATVGNPEELAAWLQGSGAQAPPLVVAPSGERKEPLFRFCASQGDGDAALRIDELGAGRKRLVFVEGRRQAEALAGAVSARGTRAWVHHSSVGRAQREEAERAFEEARDAVLVATSSMELGIDIGDLDQVYQRDAPTTVSSLAQRLGRSGRRPGTTPQMTFLLKQPEDLLVALAVTSLFERGWVEPVHPSSRLWTVLVHQMFANLLETGGLTRAQLVARLRSVPAFAGIGDNEQHGLIVHLVEEGWLDEHDGVLLLGVRGEREFGRRNFFRLYAVFDTSETFAVRHGQEQVGTLDRWFVLQLSARRPVFRLAGRAWKVIEFDLRRSALRVVPAEAGTAPQWTGRASILSRPVCERIRELVTEDGTPAHLDATCSAWLAHARGLYADVGVDRVQRPIVAVDGKTTWHTFAGTAINSVLARLVEHYGGPRLSVSNLSLKTRGGAASLREAALRACEALAEDALPGLEKWAEIDSEKRTAILSGFQQCLPREAEQAFLRAALLDIEGAQSWAEETRTEGMRE

SEQ ID NO: 3602 - protein, 726 aa, Microlunatus phosphovorus
MTDGREAADPFQVLHPVVQHHIVNTLGWTSLRPLQSQAIEPIVAGQDALLLAPTAGGKTEAALFPLLTRMAADDWRGTSVLYVCPLRALLNNLEPRLSAYAGWLGRTAAVRHGDTKQSVRRRLTIEHPDVLLTTPESLESMLVSAVTDPRSLLSDVRAVVVDEIHAFAGDDRGWHLLAVLARVSEIAGRRLQRIGLSATVGNATELLSWFQGSTSADRGVGQVISLEIGNRSNEGSVVEPSIEIDYVASLVNAAKVIFALHTGEKRLVFAETRANVEVLANQLRRLGTETYVSHSSLSSDERRRAEQAFAEARDCVIVSTSTLELGIDVGDLDRVIQVGTPQTVASFLQRLGRTGRRPGSSRNLLFLAVTDDELVQTTALALLWEEGFVEPVVPPPLPRHVLAQQLVALALQKRALPRGSWWQPLGGLALGSDVDRELITDWMVQTGHLDVDGPMVFVGPEAEKQFGRRHFLELLSVFTSSPQFTIVHGRTEIGQVDPFVLVRKVTGPRVLALAGRGWLVTAIDWARRRAHVEPADVSGAARWISVGQPQTHEFVDAQRRVLLGALPTRTRLSRRAIEHLPAVHAEYLNRVDADSTLVVTDAGRTRWWTWAGGRANAILVAALESVDPTLVDDDYVYDNRQIGLRSSVGAHDLRRTVHEVQARVSDLAGLRPFVSDRALEQLKFSELLPPDLARDTLQSRLADREGAIRVLARPIATWVPGPRGGA

SEQ ID NO: 3603 - protein, 706 aa, Micromonospora aurantiaca
MRDSVHLDPVLLHHVVNSLGWADLRPLQRDALAPVTRGDDALLLAATAGGKTEAAIFPLLTRMAGERWDGTSLIYLCPLKALLNNLLPRLERYAGWLGRSVALWHGDVSTTARRRTLWERPDILLTTPESIESMLVSANVDHRMFLAGVRAVVVDEVHAFAGDDRGWHLLALLERLTRLAGHPLQRVGLSATVGNPDQLLRWLQGAGADSRPGVVVAPSRPTEGALSASTQPPGQVELDYVGSLANAAVVIAALHRGEKRLVFCESRQTVEELAQLLRERGVTTFLSHASLSLDERRRAEQAFAEARDCVIVSTSTLELGIDVGDLDRVVQVDSPSTVASFLQRLGRSGRRPGSSRNCLFLCRSAMELTRAAALLSLWGEGWVEPVLPPPEPRHIVAQQMLALCLQEGRVGSRLWAQAWNGLAPFDHTAQPVVRHLTEEGYLDSDGGLMFIGTQAERRFGRRHFMELTAVFTGPPEFTVLHGRQEIGRIDPSLLTEEVRGDRRLLLGGRSWRVTYVDWRRRRCFVEPADGGGRARWTSQGWLGSSFPLTRAMREVLLGNDPPVRLTTRAASRLATIREERSSLVHPGGTCVVRSRGELHWWTWAGLRGNATLAATLGEVIDPSQRFDDCAIRLRRDVTRDQWRAVVTGAGERLCLPDIDRRAVAGLKFGAALPERLAAATLAARLADLDAAAAVLAEPVRFANLWC

SEQ ID NO: 3604 - protein, 696 aa, Mycobacterium gilvum
MDAFDRLHPGVQYHLANTLRWNGLRPTQAAAVEPVLAGSDAVVLAPTAGGKTEAAMFPLLSRMATEDWQGVSVLYVCPLRALLNNLQPRIDGYCRWLGRSAAVWHGDVSQEQRQKILVDRPDVLLTTPESLEAMLVSTKVDPRVLFSGLQAVVVDEIHAFAGDDRGWHLLAVLERLSRVAGRELQRIGLSATVGNPTDLLAWLQGSFHTRTSAVVAPAVETPAAPDITVDYVGSLTNAATVIASLHAGEKRLVFVDSRRQAEELGAALRDLDIETYISHSSLSAAERRRSEAAFADARDTVIVATSTLELGIDVGDLDRVIQINSTRTVASFLQRLGRTGRRPSSSRNCLFLCLDDEAVLLASGMLQRWSQGWVEPVTPPPHPRHIAAQQLMALCLQQHRIGVAEWTQWWGDLPVFDDTAPEILEYLVAEGYFATDGPFLHIGPEAERRFGRRYFSDLTAVFTAPPEFIVLAGRVEVGTIGTDLLTESVEGPRLLLLGGRSWKVTHIDWERRRCFVEAVDGGGKAKWSGVPGGLSHEVTRGMREVLLGSSPAGVTFTGRACSVLAELRAGSADTVVADRSIVFLPSDSAGRWWTWAGTKANRTLQASLPSVVDPRQRIDEKSIRLLPGVTVAEFSAALSDVQWRDPEVDANAMRGLKFSAALPSKLATQTLGARLGDKQHASAVLTEKRSITKSGD

SEQ ID NO: 3605 - protein, 710 aa, Nocardia cyriacigeorgica
MTENPWDRLDPVVVHHIVNTLGWPGLRPLQQAAITPLIDGEDAVLLAPTAGGKTEAACFPLLSAMAQNQWTGTSILYLCPLKALLNNLVTRIDAYAQWLGRSAALWHGDISNSKRDRIRREHPDILLTTPESLEAMLIGTKTDHNAFLSSIRAVVVDEVHAFAGDDRGWHLLAVLERLQRISGRPIQRVGLSATVGNPDHLLTWLQGSGAGIRPGRVVAPDVQLPTTVKTSTPPPGEVELDYVGSLDNAAKVIAALHRGEKRLVFCDSRRQVEHLGAALRERDVTVFLSHSSLSVDERTRAEQAFAEARDCVIVSTSTLELGIDVGDLDRVIQIDAPTTVASFLQRIGRTGRRAGSVRNCLFLATTNDALVQAAGLLLLWGRGWVEPITAPPEPRHLVAQQLMALTLQHHHIGDRLWPQEWNGIAPFDASAAPILQHLLAEGYLDDDGGLLHMGPVAEKRFGRRHFLDLTAAFTAPPQFTVLAGRDEIGRTDPSVLTDDRPGPRLLLLGGRSWKVTYIDWGRRRAFVEPAEGGGVAKWSNLGLRGLSFELTRAMREIYLGADPPVELTRRAKTQLSDIRATEGTGHAHPTATVIHRDGEHVHWWTWAGFRANATLVASLSGIVDPTQRPNDFSIRLRPDLSVDMWRNAILDRITRLPALELPQVDERACRGLKFSEVLPDHAARATIAARLADPESARRVLGEDTVFYTV

SEQ ID NO: 3606 - protein, 675 aa, Polaromonas naphthalenivorans
MSEFDKLHPALQYHVVNSLGWSSLRPTQLQAIEPILSGVHCLLLAPTAGGKTEAAIIPVLSRMLTHAWPGVSVIYVCPIKALLNNLEQRLSHYARLVGRRVAVWHGDVSQSKKGHALKDAPDILLTTPESLEGMLVSTRIDRKVWFGNLRVVIADELHAFAADDRGWHMRAVLHRLQQYVPQEMQRLGLSATVSNPAELLDWFAPTGIKQVVGSASVSTDADVTVDFVGSLANAATVIARLHRGSKRLVFSDSRSSAEQLTSMLRAQEVRTFLSHASLSHSERKLAETAFAEEKDCVIVATSTLELGIDVGDLDHVIQIDAPATVSSFLQRMGRTGRREGARRSCLFLCTNDDSLMLAIGICRLWGEAWVEAAYPPPEPWALVAQQAMVATLERAQWPRRELIALLCGAFPESSRPGITDVIDHMVASSYLMDTHGVLQIGPATEKQFGRAHYKDLLASFSGTQLLLGRCGSAEVGYIDPTMLAGDKPVRLILLAGKSWRITEIDWKRQTVWLEPAKEGGTARWNGSGRTLSREIAQGILRALRQGAGEHTVISKRARLEIEQVTQDLPETGNDGALSVTRNEAGAARLWTFAGTRANRTLARQIQSLAESRRIDAMGIDLKTPVDLSDLSAELLSTALAFSPEEVKELAKPIKFSECLPATLLLQIIRKRQFGL

SEQ ID NO: 3607 - protein, 702 aa, Saccharomonospora viridis
MSQALERLHSAVVHHLVNTLGWRSLRPLQQQAVAPVLDGHDALLLAPTAGGKTEAACFPVLTAMEQQRWTGLSVLYVCPLKALLNNLLPRLRDYAAWLGRRVELWHGDVPATARRHILRDPPDILLTTPESVEAMLVSANVEHQRLFGNLRAIVVDEVHAFAGDDRGWHLLAVLERLTVLAQRPIQRIGLSATVGNPEQLLHWLQGSGRGHRPATVVAPGVHAPSATPQGDIELDYVGSVDNAATVISALHRGEKRLVFCDSRQLVEQLGAALRMRGVTTFLSHASLSVDERRRAEAAFAEARDCVIVSTSTLELGIDVGDLDRVIQLDSPTTVASFLQRLGRTGRRAGSTRNCLFLALSQESLLWAAALLELWGRGYVEPVKAPLEPRHIVAQQVLALCLQEHAVGGRLWTEAWNGLAPFDRSAEPIVRHLVEQGYLDRDGELLFIGPEAERRFGHRNFMDMTAVFTAPPQFTVLAGRQEIGLIDPTLLTERSEGPRVLLLGGRSWKVTWVDWKRRRCFVEETKLKGKARWHTPGATGRSAALARAARDVLLGATPPVKLTQRAVQTLTTLREKRIPTVASEGLVITREGSTEADVRWWTWAGRKANATLAASLPEVVDGRFDDVSVRLRPDLTPQLWRTATTDAAQKLCLPEIDDRALAGLKFSVALPPQLAVDTLASRMADLDTAATVLNEPVRFTILG

SEQ ID NO: 3608 - protein, 764 aa, Saccharopolyspora erythraea
MSDQEFQPSSVARGNVPEPFTRLHPVLTHHIVNTLGWRSLRPLQREAIDPVLDGSDALLLAPTAGGKTEAACFPLLSAMETHAWSGVSVLYVCPLKALLNNLEHRLDTYTSWLGRRVGIWHGDVAAGARQRLLRDPPDVLLTTPESLEAMLVSTKVDHRTLFGGLRAIAVDEVHSFAGDDRGWHLLAVLERLMRVAGRPIQRVGLSATVGNPHELLYWLQGSRRGARPGAVVAPGVLNGGHATPPGTTSPTLEQEKSSISTNATGNTGPTRMMSSAEEAAATSNVVQRVPPPGDIELDYVGSVDNAATVIAALHRGEKRLVFCDSRQLVEELGASLRSRGVTTFLSHASLSLDERRRAEEAFADARDCVIVSTSTLELGIDVGDLDRVIQINAPTTVASFLQRLGRSGRRPGSTRNCLFLALRKDALLWSAALLELWGRGYVEPVTAPPEPRHIVAQQLLALCLQHNAVGDALWSEEWNGLAPFDRTAEPVLRHLLREGFVERDGPMLFIGPEAERRFGRRHFMDMTAVFTAPPQFTVLEGRREIGHTDSALLTEKVEGPRLLLLGGRSWKVTSIDWKTRRCYVESADKGGRARWQSFGAGGVGFALAQAARDVLLGAVPPIALTQRAQRVLVELRETRSGQVSADATVITRDGNDVRWWTWAGFRANASLSATLEDLTDQYTRFDDVSIRLRGDLTREMWQAGVADPETRSRLPEIEERALNGLKFNEALPQELATSTLAARLADIDGAIKALKQSVRFVAQG

SEQ ID NO: 3609 - protein, 703 aa, Saccharothrix espanaensis
MSDATAAALAALHPAVQHHVVNTLRWPGLRPFQAAAVGPVLSGVDCLLLAPTAGGKTEAAMLPTLTRMASERWSGISVLYVCPLRALLNNLAPRLAGYTGWLGRSAEVWHGDVGQGQRRRILRDLPDVLLTTPESLEAMLVSVNVDTQRTFRDLRAVVVDEVHAFAGDDRGWHLLALLERLARVAGRELQRIGLSATVGNPDELLTWLQGGARHRPREVVAPQATSSVTPEVTLDHVGTVDNAAKVISALHKGEKRLVFVDSRRRAEELGAALRTRDVTTFLSHSSLSAGERRRSEEAFAEARDCVIVATSTLELGIDVGDLDRVIQIDSPRTVASFLQRLGRTGRRPDSSRNCLILCLGQESTLTAAGLLDRWAAGWVEPITAPPSPRHIVAQQLIAAALQENTIGLRTWRERWAGLPVFGDDSPRIFAHLLDAGFLDLDGDLAFIGPEAERRFGRRHFSDITAVFTAPPEFLVLSGREEIGQVGDDVLLADVDGPRVLLLAGRTWLVTHVDWSRRRCHVQPTDLPGRARWGSGGGGMSYDITQGMRNVVLGHDPTGVHLTRRAVSALAELRERHSTHTAADATVVGWSSTGEVHWWTWAGTAANRTLHASLPELVDPRQRIGDHALRLRPELTVDEMHRSLSMCELRPPEVNPSAVSGLKFAAALPEDLAIATVAERLVDLAGARAALDAPRRHHRDSTGP

SEQ ID NO: 3610 - protein, 702 aa, Singulisphaera acidiphila
MCAFDQLHPALRHQVVNSMGWRSLRPVQELAIEGALAGDNLLILAPTAGGKTEAAFFPLISETLSQSWTGLSVLYISPIKALLNNQNERLERYYGLVGRQAALWHGDVSASIKKHTLANPPDCLLTTPESLEVMLTSTSINHNRLFANVQAVVVDEVHAFARDDRGWHLLALLQRIGRLAGRDHQRIGLSATVGNEDDLLTWLSAGSGRSRRVIRPPAIPEPPPEVQLDYVGNLDNAATVIAALHRGEKRLVFCDSRSRVEQLAAELRMRRVETFVSHSSLGLDERQQAERAFAQGRDCVIVATSTLELGIDVGDLDRVVQIDAPGAVSSFLQRMGRTGRRPGMARNCLFLATSDESLLRAAGLIDLWASGFVDPATAPPEPLHILAQQLLALALQERGIGRGEWLDWVGTVPAFRSVGRDTVDSIVAGMIEKEILWDEAGVLWLGREGQDTYGRKNFLQLISVFTAPPLFTVLHGRRELGSVDESTFLTRREDGLPVLLLAGRAWRVTHLDWKRRRAYVEPAEDVGRSRWRGEGQFLSGELCEAIRRNLAGDEISPRWSVRTVRRMEAVRNEFPWLTRDDATMLVTSDGDTTWWTFGGGRANAALAHELGRRTGDRVKFDNFAVRFPAKFAAQDAETQLRGLADAAPGQIVPPADEQALDGLKFSECLPSGLASRVVQTRLSDIRGVAEVLERPMRIVHEC

SEQ ID NO: 3611 - protein, 713 aa, Sorangium cellulosum
MTGFDRLTPALQYQIVNTLGYARLRPVQELTIGPVLDGKNCVVLAPTAGGKTEAAFFPLLSAMDAADWRPTSVIYLSPIRALLNNQEERVTRFATTLGRRVAKWHGDTGQGARKAFLSDSTDILLTTPESLEAMMMSPRVPAKRVFAGLRAVIIDEVHAFAGDDRGAHLAALLERLSRFCGNDVQRIGLSATVGNPEQILAWLQGRSRRPGTVISPPREASAPRLELDSVETMENAASIVRRFHAGSKRLVFVDSRRGVEEIGTRLRRDGVDVYMVHGSLSAPERRDAERAFAERTDCVIVSTSALELGIDIGDLDHVIQIDSPSTVASFLQRLGRTGRRAGAQANCTFLAVKPAAALQAAALMRLHRQGYVEDVRAERRAAHILAHQLLALCIEHGGIGRGDWFAWLDGATSFADIGPEERSALVDHMLEEGILSDQEGRLWLGPEGEKLYGRRNFAELYAVFSTPRLIRVQHDTHDVGTVDASFLEALDSDARRAAFSLGGRAWQVVHIAWGRGLCHVKPADAAPSARWSGSPTFLGYRLCQAMREVLVQEGYDPGWSARARLLIDSLRVEHAFLREADECNGPSPMVDDGGDTVVWWTFAGGRANLLLARMIEAELGGKCVSRNTSITCKEEAGKSQAALRQVVRQLAAEGRPNDADARRWADAAAGRGRVSKFAPCLTEEALTAYLVERMMDVEGAREAVKGGAGSREM

SEQ ID NO: 3612 - protein, 731 aa, Streptomyces coelicolor
MADADSSPETEGADVLDRLDPVVLHHIVNTLGWSDLRPLQRAAITPLMEGEDAVLLAPTAGGKTEAACFPLLSAMAEQKWTGTSVLYLCPLKALLNNLVSRVDTYTQWLGRRAALWHGDTKESQRQRIRTEAPDVLLTTPESLEAMLIGVKTDHARLLGSVRAVVVDEVHAFAGDDRGWHLLAVLERLEQVTGRPIQRIGLSATVGNPDQLLDWLQGAGVETRAGRVVAPGVTLPAFEAVGSDRKPTAEEVPRPAGEVELDYVGSLDNAAKLIATLHRGEKRLVFCDSRAQVEQLGAALRAREVTVFLSHASLSVDERTRSEQAFAEARDCVIVSTSTLELGIDVGDLDRVIQIDSPATVASFLQRIGRTGRRAGTVRNCLFLTTRKDTLLQAAGLLLLWSRGWVEPVKPPPEPRHLVAQQLLAVTLQQHKLGDQLWDRQWNGLAPFDQSAAPILRHLTEEGFLDSDGGLLFVGPEAERRFGKRHFIELTASFTAPPQFTVLSGRTEIGRTDPSVLTEERPGPRRLLLGGRSWQVTYIDWLRKRVFVEPADSGGIAKWMNGGIAGLTYALTRAMREVMLGEDPPVVLTRRAQARLAEQRESDAPDTVHPDGTLVTRAGNDVRWWTWAGYRANATLAATLQSVTDPLQRPTDCWLRLREDLDPADWHAARKSVGESLVLPDVDPRAVRGLKFSAALPERLAIATVAARLADFDSAWFVLSEAVRFVVSSDRA

SEQ ID NO: 3613 - protein, 712 aa, Streptomyces griseus
MGQQPVAEDPVDRLDPVVLHHVVNTLGWPDLRPLQRAAIRPLMDGEDAVLLAPTAGGKTEAACLPILSAMSEQRWSGTSVLYLCPLKALLNNLVTRIDGYAQWLGRRAALWHGDTRESQRQRIRADRPDILLTTPESLEAMLIGVKTDHAHLLGGVRAVVVDEVHAFAGDDRGWHLLAVLERLERVTGRPVQRIGLSATVGNPEQLLTWLQGSGAGKRPAGVISPGPAAIGTTPTGEVELDYVGSLENAAKLIAVLHRGEKRLVFCDSRRQVEQLGAALRERDVTVFLSHASLSADERARSEQAFAEARDCVIVSTSTLELGIDVGDLDRVIQIDSPSSVASFLQRIGRTGRRPGSTRNCLFLATRKDTLLQAAALLLLWGKGWVEAVTPPPEPRHLVAQQLLAVILQQQRVGDRLWPVQWNGLAPFDASAKPILRHLVAQGFLDEDDGLLFIGPEAERRFGRRHFIELTASFTAPPQFTVLAGRTEIGQMDPSVLTEDRPGPRRLLLGGRSWQVTFVDWTRKRAFVEPTDGGGIAKWSSGSVLGLSYHLTRAMRTVLLGENPPVSITRRAEVCLTGWREDEAPELVHPAMSLVTRHGADVRWWTWAGYRANATLSATLPSVADPVQRPTDCYVRLREDLTPDMWRESREAASSSPALVLPDIDRRAVHGLKFSAALPQRLAVATVAARLADFEGARSALDETVRFHHGFAT

SEQ ID NO: 3614 - protein, 711 aa, Thermobifida fusca
MTAPTSFDLLHPTLAYHVANTLGWPTLRPLQREALAPLINGDDAVLLAPTAGGKTEAAVFPLLTAMANQQWDRVSVLYVCPLKALLNNLLPRLQGYTGWLGRTAALWHGDVTAAARQRILRTPPDVLLTTPESIEAMLVSTTVDHRALLGNVRAVIVDEVHAFASDDRGWHLLAVLERLTRLSQRPLQRVGLSATVGNPHDLLTWLQGSNAGNRPGRVIAPGVPRVSPAAAKNGPPPGEVELDYVGSPENAATVIAALHRGEKRLVFCDSRQLVERIGAALRAKGVTVFLSHASLSVDERRRAEQAFAEARDCVIVATSTLELGIDVGDLDRVIQINAPATVASFLQRIGRTGRRPDTTRNCLFLALNDMGLLGAAGLLHLWGQHWVEPVHPTPEPRHIVAQQLLALSLQEPKVGERLWTEWWNGLAPFTEGEPILAHLLREGFLTSDNGMLIVGPEAERRFGHRHFAELTSVFTAPPEFTVLHGRTEIGRTNPALLSAAEPGEGPRLLLLAGRSWAVTGVDWKRRRCYVEPADSGEGRARWDSGTVLGWSFELARAVRDVLLGTDPPVKLTRRAVDALTHARDRHADHVHPDGTVITRSNGELRWWTWAGTRANLTLRATLSGIVDPGQQVRDTHLRLSGDVDRTRWRAIRTAAAERIVLPEVDDKALHGLKFTAALPRHLAERTLAARLADVAGARTALTEPTRFVVGE

SEQ ID NO: 3615 - protein, 699 aa, Hahella chejuensis
MTGFDRLHPAIQHHIVNSLGWPGLRPLQEATIEPVLNGEHAILLAPTAGGKTEAASFPIFSRMLTENWQGLSVLYICPIKALLNNLEERLSYYGHLLGRRVGVWHGDISTSVKNKILADPPDLLLTTPESIEVMLVSNRMDHRHLFEGLRAVIIDEAHAFAGDDRGWHLLAVLERLSYLTGRELQRLGLSATVGNPETLCDWLAGSCPSPRSVINPPAPNTVVPEIQVDWVGSVRNAAVVISRLHRGEKRLVFVDSRSRVEELAVELRNLSVTTYVSHSCLSLDERRMAEEAFAQGSDCVIVATSTLELGIDVGNLDRVIQIDAPFTVSSFLQRIGRTGRRAGSSRNCLFLATKQDAFLRAIALLRLWEAGYVEPIEPPPLPLHIYCQQVMALVLQEKGIAEADLSKWIGRMPGFTQFSVSDRSSLVSYMLERSILHSDSGIIGIGDSGERIFGQKNFLELFSVFTSPPMVKVFNGKQELGEVHQLTFATKEDGPACLTLGGKSWVTKYIDWARKKAFVEPTDIKGRSQWLSMGQPLQFEMCQSIQRVLASDDIDPWLSNRAAALLESLKQEFDWVENGKTLITYTKDNATWWTFGGRLFNSTASHLFSSESDQVKSDNLAVEFIGVIDRDNLIQRIRSFLAESFEQLPAILDERFVEELKFSECLSQEFADKELSCRFDVKKVFEAIRNMDLGIIQIG

SEQ ID NO: 3616 - protein, 703 aa, Saccharomonospora glauca
MSEALDRLHPAVVHHVVNTLGWRSLRPLQRQAVDPVMDGHDALLLAPTAGGKTEAACFPVLSAMERHGWTGLSVLYVCPLKALLNNLLPRLRDYAAWLGRRVELWHGDVTAAARRRILADPPDVLLTTPESVEAMLVSANVDHKRLFGDLRVIVVDEVHAFASDDRGWHLLAVLERLTVLAQRPIQRIGLSATVGNPEHLLAWLQGAGKGSRPATVVAPGVAATPNRAQDGDIELDYVGSVDNAATVISTLHRGEKRLVFCDSRRLVEQLGAALRMRGVTTFLSHASLSVDERRRAEAAFAEARDCVIVSTSTLELGIDVGDLDRVIQLDAPTTVASFLQRLGRTGRRPGSVRNCLFLALSQRALLWAAALLELWGRGYVEPVEAPPEPRHIVAQQVLALCLQEHTVGSRLWTGAWNGLAPFHSGAEPMVRHLIEQGYLDRDGELLFIGPEAERRFGRRNFMDMTAVFTAPPQFTVLAGRQEIGQTDPALLTERVEGPRVLLLGGRSWKVTWIDWKRRRCFVEETDLRGKARWHSPGTEGRGHALARAARDVLLGATPRVKLTQRATRTLAALREEWGPTVALDGLVVTRTGGAEADVRWWTWAGRKANATLAASLGAVVDGRFDDLSIRLRDDLTPRMWRAATAGVPDRLCLPEVDERALAGLKFSAALPPRLATATLAARLADFDAAAQVLAEPVRFTVLG

SEQ ID NO: 3617 - protein, 703 aa, Rhodococcus triatomae
MTAGFDLLDPVLQHHIVNSLGWPGLRPLQDESVAPITTGSDAILLAPTAGGKTEAAMFPLLTRMQQQRWHGISVLYLCPLKALLNNLQPRVDEYAAWMGRGAMTWHGDVSQSVRDRIKRDRPDVLLTTPESLESMLVSESVDAATVLCGVQAVVVDEVHAFAGDDRGWHLLAVLARLESLLGRRLQRIGMSATVGNPDELLGWLQGGRTSPGRVIAPAVTGGAVVPEITVDSVGSVENAAKVIAALHAGEKRLVFVDSRRLAEELGTMLRGRGITTFVSHSSLSAAERRESEQAFAEARDCVIVATSTLELGIDVGDLDRVIQINAPRTVSSFLQRLGRTGRRPGTTRNCLFLGITDEAVLSTLGMLQCWSTGWVEPVVATPEPRHIAAQQILASALQTRRVPLTGWQETWGPLPIFGPDSQEIFDYLLEEGFLEHDSGSAFIGPEAEKHFGRRHFMDLLAVFTAAPEFMVFAGRQEIGSVETSVLTDDIEGPRVLLLGGRSWKVTHIDWKRRQVFVENTDLQGRAKWMSLPDGASFEITRGVREVLLGAEPAGVTLTRRAVATLDDIRLQRANHVTDGAFLIARDGREDWRWWTWAGAKANRTLAAWASDLVPPRQRIGPESIRLHSDLSVDDIRNGLAALRSDGRDRPMPAIDKNALKGLKFSAALPEALACRSLAARTVSVPAAETVLGERARIVSTSSS

SEQ ID NO: 3618 - protein, 703 aa, Saccharomonospora cyanea
MSQALDRLHPAVVHHVVNTLGWRSLRPLQRQAVDPVMDGHDALLLAPTAGGKTEAACFPVLSAMERHGWTGLSVLYVCPLKALLNNLLPRLRDYAAWLGRRVELWHGDVTAAARRRILADPPDVLLTTPESVEAMLVSANVDHKRQFGDLRAIVVDEVHAFAGDDRGWHLLAVLERLTVLVQRPIQRIGLSATVGNPEHLLAWLQGAGKDSRPATVVAPGVAATPNRAQDGDIELDYVGSVDNAATVISTLHRGEKRLVFCDSRRLVEQLGAALRMRGVTTFLSHASLSVDERRRAEAAFAEARDCVIVSTSTLELGIDVGDLDRVIQLDAPTTVASFLQRLGRTGRRPGSVRNCLFLALSQRALLWAAALLELWGRGYVEPVEAPPEPRHIVAQQVLALCLQEHTVGSRLWTGAWNGLAPFDSGAEPMVRHLIEQGYLDRDGELLFIGPEAERRFGRRNFMDMTAVFTAPPQFTVLAGRQEIGQTDPALLTERVEGPRVLLLGGRSWKVTWIDWKRRRCFVEETDLRGKARWHSPGTEGRGHALARAARDVLLGATPPVKLTQRATRTLAALREEWGPTVALDGLVVTRTGGAEADVRWWTWAGRKANATLAASLGAVIDGRFDDLSIRLRDDLTPRMWRAATAGVPDRLCLPEVDERALAGLKFSAALPPRLATATLAARLADLDAAAQVLAEPVRFTVLG

SEQ ID NO: 3619 - protein, 706 aa, Gordonia polyisoprenivorans
MSGFESLDPAIQHHIVNTLGWPGLRPLQEESIPAIVGGGDALLLAPTAGGKTEAAVFPVLTRMQEHRWAGTSVLYVCPLKALLNNLGPRLADYAAWVGRSASVWHGDVSQAARRGITRDRPDILLTTPESLESMLVSESVDAQQFLGDVRTVIVDEVHAFAGDDRGWHLLAVLARLESLISDASGPNAPRRRLQRIGMSATVGNPDELLRWLRGGAADGGRVVAPEASAAVGAEITVDAVGSAENAATVIAGLHRGEKRLVFVDSRRLAEELGTALRSRGITTFISHSSLSAQQRRESEAAFAEARDCVIVATSTLELGIDVGDLDRVIQINSPRTVSSFLQRLGRTGRRPGTTRNCLFLALDDASLAQTLGMLHCWATGWVEPVVATPEPRHIAAQQILAAALQTRRLPLVGWQHQWADLPLFGEDGDEIFDHLLSTGFLDHDAGSAFIGLEAERHFGRRHFLELLAVFTAAPEFRVFEGRNEIGMVEVGVLTQRTEGPRVLLLGGRSWKVTHIDWKRRQVYVEGTDIHGTARWQSIPDGLSFEITRGVRSVLLGETPSGVTLSRRAVEALDGYRAQRSAHVHPANLVIERDVRGDWRWWTWAGTKANRTLAAWTRELVPGRQRISGESIRLHSDLRVDDIARVLASVRGSSHRPLPDVDRAAISGLKFSAALPEGLARRTLAARVVDVKGAESVLTRRVSFAKC

SEQ ID NO: 3620 - protein, 698 aa, Amycolatopsis azurea
MSSGADRLLPALVHHIVNTLGWPGLRPLQAEAIDPLLDGSDAILLAPTAGGKTEAAMFPLLSSMEEQSWTGLSVLYICPLRALLNNLQPRLAIYAGWLGRTADLWHGDVSSGARKRILQEPPDILLTTPESLEAMLVSANIDSRRLFSSLRAVVVDEVHAFAGDDRGWHLLAVLERLSRIAGRPLQRIGLSATVGNPDELLRWLQGSQHSRPRSVVAPSGGTTTTPDITVDHVGSIDNAATVIATLHRGEKRLVFVDSRRRAEELGAALRAREITTFLSHSSLSADERRRSEQAFAEARDCVIVATSTLELGIDVGDLDRVIQIDAPRTVASFLQRLGRTGRRAGGTRNCLFLCLEESAVLSTAGLLERWGAGWVEPIVAPPHPRHIAAQQMLALALQENKIGTHTWREWWGDLPLFDEHQTEIFDHLLAEGYLERDGPMAFIGLEAEKKFGRRHFMDLLAVFSAPPEFTVLTGREEIGRVGDDVLLADNHDGPRVLLLAGRGWKVGHIDWKRRRCFVEPSDLPGRAKWGGSEGGLSFALTRSQRSVLLGTNPAGVRFTRRAASVLAELREKHSGDVADNATVFRRSSGELRWWTWAGIAANRTLQASFPRVVDPRQRTTDQSLRLQPDLSNNELLRTLSASAALSPPHVNKSALHGLKFSSTLPSELASETISERLADQRHAQFVLFEKRLFSQAEN

SEQ ID NO: 3621 - protein, 700 aa, Marinobacter sp.
MSEFDRLHPAIQHHIVNSLGWPGLRPLQEATIQPILNGEHAILLAPTAGGKTEAAIFPVFSRMLSENWQGLSVLYICPIKALLNNLEQRLSNYGHLLGRTVDVWHGDISASRKAKIVSSPPDILLTTPESLEVMLVSHKVDHQHFFANVRTVIVDEVHAFAGDDRGWHLLAVLERISILAGRELQRLGLSATVGNPDLLCDWLASSCEARRSVINPPAENTLEADVQLDWVGSLRNAAVVISRLHSGEKRLVFVDSRSKVEELAIELRILGVSTYISHSSLSLEERRSAEEAFSQGNNCVIVATSTLELGIDVGDLDRVIQVDAPYAVASFMQRIGRTGRRAGSSRNCLFLATREDAFLRAAALLNLWRSGYVEPILPPARPMHIYAQQTMALALQQQAIIAADADRWLAKMPGFAAISPEDRAAAINYMLDTGILHSDQGLIGIGKTGERAFGHKHFMELFSVFTTPPMVKVFWGKQELGEVDQMTFAVRNEGPALLTLAGRSWQTVYVDWPRKKAFVEPSQARGKSQWFSDGQPMSYELSRSIADVLVGEDIPAGFSSRAQELLETLRDSYGYLELGKTTLLFDEDGNATWWNFAGRLLNTAMKNPLADKARKVEADNLCLAFSHVYEPELLIAAIRRVLSKNVEPLAITLEESFIQELKFSECLSQKEMNRELNERYAVDKEFTRFRRLPLSVLRVI

SEQ ID NO: 3622 - protein, 706 aa, Planctomyces limnophilus
MVSVFSRLAPRLQQAIVARLGWSSLRPVQELAGEALLSGRNAVILAPTAGGKTEASMFPTLSNLVDQQPVGVGAIYVAPIKALLNNQEDRLGLYTEMVGLRRFVWHGDTTTSARKQFLDDPAELLMTTPESLEVMLVSQRVDERALFGDLRMIVIDEVHAIAGTDRGAHLMSVIERIRRVSRHDIQRAGLSATVGNPAAILEWLKGTSEREGVVVDPPKRPSRRQLLIVHEADQTQIAVAAAQVARGCKSLFFCQSRATTEAVAETMRRSGTTVFVHHSAVSKEERLLAEQEFHHGSGACIVCTSTLELGIDVGDLDKVLQANAPETVGSFLQRMGRTGRREGQAANTTFFCESTDSILQAIALIELAKAGWVEDVPVNQRCWPVLIHQLLAMSLAENGIPTDVAWKHLCGVPDFQRISRKEFDRLIEWMIQDGSLLLMSGRLILGPQAERRFGRRNFMELYAVFSSPQSYNVETVNRQVIGTLTQDFVDGLVDGVSCFLLGGRAWAVFQVVHKDRLVVVEPAPRGRQPTWGGYLPQFLGFHLCQKILEIVTADDEYQYLMPPAADLVTQERNRMECLVEPIVGGINFNKDGNEVIWHTFAGGRVNSTIRYAIGALQPTWTITPDNFSVRFRDSDITETAFKSVIRELASTDFWNDDSVWQEVRAALPGYRLSKFQPLMPACIEQEVLFDYLLDRHQTADWVRRIL

SEQ ID NO: 3623 - protein, 701 aa, Anaeromyxobacter dehalogenans
MSAFSRFPARLQQAIVSRLGWTALRAVQELAGEAILDGKNAVVLAPTAGGKTEASIFPALANLVENGCEGVGVVYVAPIKALLNNQEERLGTYTEMVGLRRFVWHGDVPDRDKREFVREPAELLMTTPESLEVMLLSPRFPTPKVFPDLRMVIVDEVHAFAGTERGAHLMSVLERLIKSTKNDVQRIGLSATVGNPEEILGWLQGTSRRAGVVVDPPKVSARRELHVSLHESVIDIARDAARRAAGNKSLFFCQSRALTESVAERMRGHGTEVFVHHGSVSREERHDAEAQFNHGTNACIVCTSTLELGIDVGDLDLVMQANAPSTVSSFLQRMGRTGRRAGQTANTSFFCEDEDAALQAVALVELAREGWVERVPAARRCWPVFAHQIFALTLQYGAVSPERCWEHLHVVRDFADISRDEFERVLDHMKRHEYLFESGGLLSLGQKAERVYGKRNFLELYAVFSSPVLYQVETAAGRALGSLEQNFVDQLVEEMSAFLLAGRAWLVEHVHHEDRVVRVREAPRGQKPSWGGFAPSLLGFEICQRMKRVLTDSTPVPYADAAAMRAIEARRKDLGDTLRRPIAMQTDEGVVRWWTFAGGKINQTLKYGLEWSHDWSVKGDNFELRISGAGVSDGAVREAIREVSSAAFWDKPETRSAILGRLPAYRLSKFQDALPDVFAVELVGNYLLDVPRAQAFAQSVL

SEQ ID NO: 3624 - protein, 925 aa, Haliangium ochraceum
MSVFARFPARLQHAIGARLGWTALRPVQEEAGAAILAGNNAVILAPTAGGKTEAAMFPVLADLVAAPGLGPSVRALYIAPIKALLNNQAERLGLYTEMVGLERFLWHGDVGASERQRFLREPADLLMTTPESLEVMLISPKIAVSEIFADLRVVIVDEIHALAGTDRGAHLMSVIERLAQHAGRDVQRVGLSATVGNPDAILSWLRGTSQRGDVVVDPPKPPTRRELLVHLDGALGGLAGRAAKRAAGKKSLFFCESRAQTEQIAERLGDRGVEVFVHHSAVSLEERERAEERFQRGGDAAIVCTSTLELGIDVGDLDQVFQIGAPSTVSSFLQRMGRTGRRAGSVANTTFLCDDPESVLQAVALIELARVGWVESTPAQTRCWPAFVHQTLAMSLQQGGVRRDELRAHLRRVPDLAGISDAEFDEVIAYMIRRGFLYDSGGVLVMGSRGERAFGRRNFLELYAVFSSPQYYRVHTQNGREIGWLEQQFVDGLVENMSSFLLGGRAWLVHAIHHGQRAVSVSPAPRGKKPSWGGFLPKFVGFELCQRVRRLLVEDETPAYLSDDARAALESYREEFGELLRRSGHAMQWDDGSVRWWTFAGGQINSTLKYALAETTSWKIVADNWQVRVESKGAGSVELRAVEAAIVALSEPGFWRDVEVWQRIVAKVPPYRLSKFQPALPPRFEQEMLGRYLLDIAGARRFLLGDAERQMVGAGDLLRAALASVGGEDGGDRGAGGAELHSEPPQPAGARPSKPVRYVDQQAALEQACAALLGEPRVGLDVETTLFDRALCLVQLAAPEYTVVIDARAVDDLGPVSELLASRAVVKIIHNAQFERSVFRKLGMDIENVFDTLKVSRRLRGRKREGGHGLGAVCARELGRELDKHEQRSDWTQRPLTQRQLDYAALDAEVLLALHERFTRELLVP

SEQ ID NO: 3625 - protein, 925 aa, Haliangium ochraceum
MSVFARFPARLQHAIGARLGWTALRPVQEEAGAAILDGKNAVILAPTAGGKTEAAMFPVLADLVAAPGLGPSVRALYIAPIKALLNNQAERLGLYTEMVGLERFLWHGDVGASERQRFLREPADLLMTTPESLEVMLISPKIAVSEIFADLRVVIVDEIHALAGTDRGAHLMSVIERLAQHAGRDVQRVGLSATVGNPDAILSWLRGTSQRGDVVVDPPKPPTRRELLVHLDGALGGLAGRAAKRAAGKKSLFFCESRAQTEQIAERLGDRGVEVFVHHSAVSLEERERAEERFQRGGDAAIVCTSTLELGIDVGDLDQVFQIGAPSTVSSFLQRMGRTGRRAGSVANTTFLCDEPESVLQAVALIELARVGWVESTPAQTRCWPAFVHQTLAMSLQQGGVRRDELRAHLRRVPDLAGISDAEFDEVIAYMIRRGLLYDSGGVLVMGSRGERAFGRRNFLELYAVFSSPQYYRVHTQNGREIGWLEQQFVDGLVENMSSFLLGGRAWLVHAIHHGQRAVSVSPAPRGKKPSWGGFLPKFVGFELCQRVRRLLVEDETPAYLSDDARAALESYREEFGELLRRSGHAMQWDDGSVRWWTFAGGQINSTLKYALAETTSWKIVADNWQVRVESKGAGSVELRAVEAAIVALSEPGFWRDVEVWQRIVAKVPPYRLSKFQPALPPRFEQEMLGRYLLDIAGARRFLLGDAERQVVGVGDLLRAALASVGGEDGGDRGAGGAELHSEPPQPAGARPSKPVRYVDQQAALEQACAALLGEPRVGLDVETTLFDRALCLVQLAAPEYTVVIDARAVDDLGPVSELLASRAVVKIIHNAQFERSVFRKLGMDIENVFDTLKVSRRLRGRKREGGHGLGAVCARELGRELDKHEQRSDWTLRPLTQRQLDYAALDAEVLLVLHERFTRELLVP

SEQ ID NO: 3626 - protein, 705 aa, Rhodopirellula sp.
MSVFSKFAPRLQEAIVSRLGFTSLRPVQELAGEAILAGKNAVVLAPTAGGKTEASIFPTLSGLVSDPVDGVGAIYIAPIKALLNNQSHRLDQYTEMVGLRRFVWHGDTPTNERNKFKKEPAELLMTTPESLEVMLVSQSVDEATLFRELRYVIIDEVHAIAGSDRGAHLMSVMERIAKYSKHDLQRIGLSATVGNPDAILTWLKGSSQREGVVVDPPKKPSRRQLQVFHRAGLASIANEASRKARGSKSLFFCQSRATSEAVAEQLRREGTEVFVHHSAVSKEERQFAEEQFHSGSDACIVCTSTLELGIDVGDLDYVLQSEAPDTVSSFMQRMGRTGRRGDTPANTTFYCETSEGVLQAIAIIELAKTGWVESIEVNDRCWPVLIHQLLAMSLSTGGLRPEQAWEHLSRLPDFCGIARDEFDRLIAWMIQDGSMVLSSGLLSLGPTAERRFGRRNFMELFAVFSTPKTYAVMTIAGQPVGSLTQDYVDRLVEDVSSFLLGGRAWAVHQINHDDRRIFVIPTSMGRQPSWGGFLPQFLGYDLCQQVLQVLTSTEDYPYLETESREVLHEERRNLGGFLTPERGGIDGDTHELRWWTFAGGRINSTLRYALAFLEPTWTFTPDNYAIKIRGDSPTSAWLGEAIAQISAADFWANEAVHASITAAIPNYRLTKFQPLMPDWIERETLQRHLLSVPDAKEWVRINRGF

SEQ ID NO: 3627 - protein, 713 aa, Pseudanabaena biceps
MRSTFARFPPRLQQAIADRLGWSSLRPVQELAGQAILDGKNAIVLAPTAGGKTEAAIFPLLANLIEHESQGVGILYIAPIKALLNNQCNRFATYTEMVGLRSFVWHGDIKGKDKQAFLKEPAEVLLTTPESLEVMLLSAKVPHVRLFGDLRAVIIDEIHALAGSDRGTHLLSVLERLITAANQDLPTNQKCDVQRVGLSATVGNPEQILNWMQGSSQRQRIVIDPPKIPAKREIAILQRNEIGAIAREASRKAQGNKSLFFCQSRALAEDVAERMRDRGTDVFVHHSSVSRIEREIAEENFQKGMNACILCTSTLELGIDIGDLDLVLQANAPSTVSSFLQRLGRTGRRAGKAANTTFYCENIETVLQAIAIVELARSGWVESVKCHNRTWTVLVHQLLALTLQFGAISPELAWEQLSLIPDFQGIAETEYQILIQHGIREGYFFQSGGLLSIGERAEKIFGRKNCMELYAVFSSPVLYKVKTAAGYTVGSLEQDFADKLVPSMSSFLLGGKAWLVEAIDHKERSIRVVLSPKGKKPNWNSFSPQILSYELCQKIYEILTTDIDYPYIDAQSRYAITEKREDLGVLLSQQSFTAIDDGDRVTWWTFAGGQINYTIKYLLADLRPEWKVIADNFKIGIEGSDVSVQLLRSALDRLRSSFDWQSEAHRSNILAQLPLYRFSKFQPLLPEAYALETIERYLLNWESASSFLKRFTN

SEQ ID NO: 3628 - protein, 732 aa, Streptomyces turgidiscabies
MADAGVPAGKDPGDEDVDVLDLLDPVVLHHIVNTLGWPDLRPLQRAAITPLMQGQDAVLLAPTAGGKTEAACFPLLSAMTEQKWTGTSVLYLCPLKALLNNLVVRVNSYAQWLGRRAALWHGDTKESQRQRIRAEAPDILLTTPESLEAMLIGVKTDHARLLGSVRAVVIDEVHAFAGDDRGWHLLAVLERLERVTGRPIQRVGLSATVGNPAELLHWLQGAGVGTRTGQVVAPGVHLPATDGSGHGGKASPEPSNRPSGEVELDYVGSLDNAAKLIAALHRGEKRLVFCDSRRQVEELGAALRAREVTVFLSHASLSVDERTRSEQAFAEARDCVIVSTSTLELGIDVGDLDRVIQIDAPTTVASFLQRIGRTGRRSGTMRNCLFLTTRKETLLQAAGLLLIWSRGWVEPVVPPPEPRHLVAQQLLAVTLQQHKLGDRLWDRQWNGLAPFDKSAAPILRFLTEEGFLDSDGGMLFVGPEAERRFGKRHFIELTASFTAPPQFTVLSGRTEIGRTDPSVLTEERPGPRRLLLGGRSWQVTYIDWLRKRVFVEPADGGGIAKWMNGGVTGLSYALTRAMREVLLGTAPPVSLTRRAEACLAEQRETDAPDTVHRGGTLITRVGSDVRWWTWAGYRANATLAATLQSVTDPLQRPTDSWVRLRENLTPAAWRVARENVGENLVLPDVDRRAVRGLKFSVALPERLAVATVAARLADFESARLVLGESARFQWDG

SEQ ID NO: 3629 - protein, 700 aa, Gemmata obscuriglobus
MTPFDHLHPALRHHVVNSLGWTELRPFQEAVIEPALAGEHLLILAPTAGGKTEAAAFPVLSRMLTEDWRGLGVLYVCPIKALLNNLDARLSRYCTLLGRRSALWHGDVPTGQKKAILRDPPDLLLTTPESLEVMLVSGSVDERALFAALRAVVVDEVHAFAGDDRGWHLLSVLARLRRLCGREFQRLGLSATVGNPDGLLAWLTGGCDGPRRVCHPPGGTAAAEADVKLDHVGSLRNAATVISRLHRGEKRLVFVDSRSRAEQLGRELRALEVTAFVTHSSLSADERRRAEEAFAGRDDCVIVATSVLELGVDVGDLHRVIQIDAPTTVSSFLQRMGRTGRRPGASRNCLFLATDDDSLLRAAGLIGLWAGGYVEPVTPPPEPYHVLAQQVMALCLQERGIGRRDWAAWVDGVPGFAAMPDARPHEVIDWMLSQGLLWEDGGLLWLGRRGEEEFGHKNFMDLFSVFTSPPLFAVRYGRQDLGFVDEASFTARREGPRVLLLGGRAWRVTHLDWPRRVAHVEPSEEAGRSRWRGTGPFVGFRLAQSIRSVLAGEDQSPLWSRRAQDKVAELREEASWVSADGPTLLGLAGGAVEWWTFAGTRANATLAGALSGRCGGRIDHDGLRMVFEGAGGLTAVEQAVRELPPVEDLSPAVEEEALDGLKFSACLPKDLALAALAARLRDTAAARAVLAQRMRVVVGG

SEQ ID NO: 3630 - protein, 701 aa, Rhodococcus ruber
MTDSAFTLLHPGVQYHLVNTLRWDGLRPTQAVAVEPILAGEDALVLAPTAGGKTEAAAFPLLSAMAEHDWQGTSVLYVCPLRALLNNLQPRMHTYAQWLGRTAAVWHGDVGQSARQQILRDRPDILLTTPESLEAMLVSTKVDPRVLFAGLRAVVVDEVHAFAGDDRGWHLLAVLERLARIAGRPLQRIGLSATVGNPDELLQWLQGGTPGRPRRVVNPAVPAAATPPEITVDYVGSIDNAAKVIAALHQGEKRLVFVDSRRRAEELGAALRERGVTTFLSHSSLSAAERRRSETAFAEARDTVIVATSTLELGIDVGDLDRVIQIGSPRTVASFLQRLGRTGRRPGTTRNCLFLGVDDEQVLLTLGMLECWSRGWVEPIVAPPSPRHIAAQQMLALCLQEHRLGERSWRDWWGSLPIFDEHADEIMAFLRAQGFFERDGSLLHIGPEAERRFGRRYFSDLTAVFSAPPEFTVLAGRNEVGTVGTDLLVEEVDGPRVLLLGGRSWRVTHIDWQRRRCFVEPVDGGGKAKWSGTGGGVSYDITQGMRAVLLGTVPAGVTLTRRAETVLAELRQGYADSVDPDASVLTMPTEGSGRWWTWAGTAANRTLQASLPTLVDPRQRVDEKSLRLLPNITPANVSVALADPRWTFPHVAQSAVAGLKFSSALPPGLAEETLAVRLADEPHARAVIATCRRIHRTDHDD

SEQ ID NO: 3631 - protein, 692 aa, Mycobacterium xenopi
MDAFERLHPGLQYHLANTLRWTGLRPTQAQAVAPILDGRDTLVLAPTAGGKTEAAVFPLLSRMATEDWQGLSVLYVCPLRALLNNLQPRIDGYARWLGRSAAVWHGDVGQSQRRRILAERPDVLLTTPESIESMLVSTKVDPRVLFSGLRAVVVDEIHAFAGDDRGWHLLAVLERVSRLAGRELQRVGLSATVGNPSELLAWLQGSFVSRASSVVAPADGSIAEPEITVDYVASLGNAAKVIASLHAGEKRLVFVDSRRQAEELGVALRDFGVSTFVSHSSLSASERRRSEAAFAEARDTVIVATSTLELGVDVGDLDRVIQIGSTRTVASFLQRLGRTGRRADTVRNCLFLCIDDDSLLLAAGMLQRWSHGWVEPITPPPAPRHIAAQQLMALCLQEHRIGIREWASWWGDLPVFDASSEIVDYLVAEGFFEPDGPFLHIGPEAERKFGRRYFSDLTAVFTAPPEFLVLAGRVEVGTIGTELLTDEVDGPRVLLLGGRSWRVTHVDWDRRRCFVEPEDGGGRAKWSGSGGGLSYDIARGMRSVLLGAQPMGVVFTSRASLKLAEIREANGDNVSADALIVRLPADSAGRWWTWAGTAANRTLQMSLPTVVDPRQRIDEKSLRLLPGITDAEFSAALDGVEWREPAVDANALRGLKFSSALPPELARVTLAARIGDQKRAAEVLGDARIVVR

SEQ ID NO: 3632 - protein, 738 aa, Micromonospora sp.
MEPPGALRADAALRRADGGRAERRLGRRRRPDPVNAEAALDPVLLHHVVNSLGWPQLRALQRDAIGPLLDGTDALLLAPTAGGKTEAAVFPLLSRMAREGWTGTSVLYLCPLRALLNNLHPRIERYAGWLGRTAALWHGDVHAGARRAVLWQRPDILLTTPESLEAMLVSVNVDHRGFFGGLRAVVVDEVHAFAGDDRGWHLLAVLERLTRVAGRPLQRVGLSATVGNPADLLTWLRGSATGSRPGRVVAPDVPAAAAATGPPPGDVELDYVGSLFNAAKVIAALHAGEKRLVFCESRQTVEELGQLLRERGVTTFLSHASLSADERRRSEQAFAEARDCVIVSTSTLELGIDVGDLDRVVQIDAPATVASFLQRLGRTGRRPGSTRNCLFLCRTGQELVRAAALLSLWGRGWVEPVVPPPEPRHIVAQQVLALCLQEHRVGDRLWAQAWNGLRPFGPGAEPIVRHLVDHGYLDSDGGLLFIGPEAERRFGRRHFMDMTAVFTGPPEFTVLHGRQELGRVDPSLLTEEVRGDRRLLLGGRSWRVTYVDWRRRRCFVKPVDDGGRARWTSLGWVGWSHPLTRAMRGVLLGDDPPVRLTGRATDRLAAERADRSAVVHPGGSLVLRAEHGDLTWWTWAGLRANATLAATLSEVVDPMQRYDDYMIRLRADLERSQWRSLVADAEQRICLPEVNTRALAGLKFGVALPERLARATLAARLADLPGAAAVLAEPVRFVAARA

SEQ ID NO: 3633 - protein, 702 aa, Saccharomonospora xinjiangensis
MSSALDRLHPAVVHHLVNTLGWRSLRPLQQQAVAPVLEGHDALLLAPTAGGKTEAACFPVLSAMEQHGWTGLSVLYVCPLKALLNNLHPRLSSYAAWLGRRAALWHGDVTAAARRRILADPPDILLTTPESVEAMLVSTKVDHRRLFGGLRTIVVDEVHAFAGDDRGWHLLAVLERLTALAGRPIQRIGLSATVGNPGELLSWLQGSGRGARPATVVAPAVEAASTTPQGDIELDYVGSVDNAATVISALHRGEKRLVFCDSRRLVEQLGAALRARGVTTFLSHASLSVDERRRAEAAFAEARDCVIVATSTLELGIDVGDLDRVIQLDAPTTVASFLQRLGRTGRRAGSVRNCLFLALRTDSLLWAAALLTLWGRGYVEPVEAPPEPRHIIAQQVLALCLQEHTVGSRLWAKAWNGLTPFDSGAEPIVRYLIEHGYLDRDGELLFIGPEAERRFGRRNFLDMTAVFTAPPQFTVLAGREEIGQTDPALLTEQVEGPRVLLLGGRSWKVTWIDWKRRRCFVEETDLRGKARWQSSGAGGRSAALARAARDVLLGADPPVRLTRRASRGLDELRDQRGSTVHPGGLVVTRGGASGTDVRWWTWAGHKANATLAASLGDAVEGRFDDVSLRLPDAVTPALLRAVRDGAAGRLCLPEVDERALAGLKFSAALPPPLAEATLAARLADLGTAARVLAEPVRFTTVG

SEQ ID NO: 3634 - protein, 711 aa, Bradyrhizobium sp.
MSPGPDAIDRLSPAVRYQIANGLGWSGLRPVQALSTHAILDGANCVVLAPTAGGKTEAAFLPLLSKMDVEDWHGVSVLYVAPIRALLNNQEARLSKLTGLIGRRAGKWHGDVKEPTRKRLVNDPPDVLAITPESLEAMLLSTRTPARRFLAHVRAVVIDEVHAFAGDDRGAHLVSLLERISRIAETDIQRIGLSATVGDPDVIVRWLGGSSMRPQRVVDPSGARKVPDLYLDFVGTLDNAALLIERLYPGTRRLVFVDSRRRVEELGHRLSQRGVDVYLSHSSLALSERNAAEKAFEEGTNCVIVATSALELGIDVGDLDHVIQIDAPSSVSSFLQRMGRTGRRPDLNPNCTFLATDDDALLRAAAIIDLFRMGYVEPAAPSTWTPHVLAHQAIALAMQEQGSASHGWWNWLDGCEAYRDVSVVEREGIVRHMIENNILVEADARLMLGARGERLYGARNFLELYAVFSTPRVLRVMHGHSEVGVVDASFLQDKEQRGPNFVLAGRAWRISGVDWKGGTCAVEPAEAGSYPRWFGLPVSLNRSLCQAMRRILTTVEIDPSWSKRAIAQLQLQRESYAFLDESSVPIEEDSDGRCRWWTFGGGAGNRVLAGLLELKLGERVSSGNTFITFSNGAAASVVAIRQAIDLLAARPLTWEDASRLVDSNQRSRISKFQPCLPAAIEHGLIARETMNIDDANATVAQWKRGRKSPEG

SEQ ID NO: 3635 - protein, 703 aa, Planctomyces maris
MTLSSFDLLHPALQHHIVNSLGWRELRPFQEAVIPQILAGKHLIVLAPTAGGKTEAAFFPVVSRMLTEEWNGLSVLYICPIKALLNNLDVRLEGYCRLLGRRSALWHGDVKPSARKKILREPPDCLLTTPESLEVMLDSPNVDAQRLFGNLQVVIIDEIHAFAGDDRGWHLLSVLERISRIAGRELQRLGLSATVGNPETLVDWLAGSCKGPRDVFLPLASGSDAADVQLDYVGSLSNAAVVISRLHRGEKRLVFVDSRARAEQLAAELRRLEITTFVTHSSLSQEQRKQAEEAFASRDDCAIVATSVLELGIDVGNLDRVIQIDSPPTVSSFLQRMGRTGRRAGTLRNCLFLATKEEMLIQAAALIDLWSTGYVEPVQPPSLPYHILAQQLMALILQESGIGQRDWFSWLSGVSGFQSISPSQVDQLVSSMLERGILWEDSGILGMGQSGEETYGRRNFMELFSVFLSPPLFSVLYGRQELGYVDEMTFLSKQEGPRILLLGGRAWQVNHIDWQRRKAYVEPTESKGRTRWQGSGQGLNFQMAQSMKQILSTDLNRDYLSQRATQYLTDIREEYAWLDPASSIAIQTGGQEVEWWTYAGSQVNATLARQLSQQTRHDVQFDSFTLTFHQTLKLQDIEVAIKAVCQRDPNEMYPSIEEQAIDGLKFSECLPRELAIEMLEHRLQDSESTQKLFQQPVRFVIQQ

SEQ ID NO: 3636 - protein, 740 aa, Streptomyces gancidicus
MADADRSAGTEPAGAEPAGGGADVLDRLDPVVLHHIVNTLGWPDLRPLQRAAIAPLMDGEDAVLLAPTAGGKTEAACFPLLSAMAGQRWTGTSVLYLCPLKALLNNLVGRVDTYAQWLGRRAALWHGDTKESQRQRIRAEAPDILLTTPESLEAMLIGVKTDHARLLGGVRAVVVDEVHAFADDDRGWHLLAVLERLERVTGRPIQRVGLSATVGNPEHLLHWLQGAAAVSRTGQVVAPGVQLPASGAAGHQEEATEAPSTRPAGEVELDYVGSLENAAKLIAALHRGEKRLVFCDSRRQVEELGAALRAREVTVFLSHASLSFDERTRSEQAFAEARDCVIVSTSTLELGIDVGDLDRVIQIDSPASVASFLQRIGRTGRRSGAVRNCLFLTTRRDTLLQAAGLLLLWSRGWVEPVLPPPEPRHLVAQQLLAVTLQQHKVGDQLWSQQWNGLAPFDRSAAPILRFLTEEGYLDSDGGMLFVGPEAERRFGKRHFIELTASFTAPPQFTVLSGRTEIGRTDPSVLTEERPGPRRLLLGGRSWQVTYIDWLRKRVFVEPADGGGVAKWMNGGIAGLSYALTRAMREVLLGADPPVTLTRRAEACLAEQRESDAPETVHPGGTLITRVGSDVRWWTWAGYRANATLGATLSSVADPLQRPTDCWLRLREDLTRADWRAAREGVGETLVLPDVDPRAVRGLKFSAALPERLAVATVAARLADFEGARKVLSESVRLQTLDDSA

SEQ ID NO: 3637 - protein, 697 aa, Gordonia amicalis
MAGFDILDPVLQHHVVNSLGWPGLRPLQDEAAEPIVGGSDAILLAPTAGGKTEAAMFPLLTRMQTEHWTGISVLYICPLKALLNNLQPRLAEYAAWLGRGAMTWHGDVAQSVRGRIKRDRPDILLTTPESLESMLVSENVDAAQLLGGVQAVVVDEVHAFAGDDRGWHLLAVLARLESLLGRKLQRVGMSATVGNPDELLGWLQGRAERPGLVVSPVVGGGAVVPDITVDSVGSTENAAKIIASLHLGEKRLVFVDSRRLAEELGSQLRQRGVTTFISHSSLSAAERRESEEAFAGARDCVIVATSTLELGIDVGDLDRVIQINAPRTVSSFLQRLGRTGRRAGTTGNCLFLCLSDASTLEALGMLHCWSHGWVEPVTATPEPRHIAAQQILAAALQTRRVPLTDWQAIWGTLPLFGEDSQQIMSYLLDEGFLEHDAGSAFIGAEAEKHFGRRHFMDLLAVFTAAPEFTVYAGRNEIGAVETSVLTDDVEGPRVLLLAGRSWKVTHIDWKRRHVYVEATTLGGRAKWMSVPDGASFEIARGIREVLLGSNPAGVTLTRRAVATLDDLRTSRSHQVAHGAFVIERDDRGDWRWWTWAGAKANRTLAAWAPKLVPARQRIGAEVLRLHSDLSVDEIKEELSTIRAGNTRAFPSIDSRALRGLKFSAALPESLARRTLAARMADQMGAETVLSERVSYHL

SEQ ID NO: 3638 - protein, 686 aa, Phaeospirillum molischianum
MTPFERLHPSLQYHIVNTLGWPGLRPSQAEAIEPVVTGKNALLLAPTAGGKTEAASFPILSRMLTENWRGVSVLYVCPIRALLNNLEPRLAQYAGLVGRRAALWHGDVGQGQKRKVLRELPDLLLITPESIEGMLVSRRVEHEALFAGLQAVVVDELHAFAGDDRGWHLLAIIARLERLVGRPLQRVGLSATVGNPEELAEWLTVGRPVVVAGRSTVSTDADVTLDHVGSLDNAALLLSRLHRGEKRLVFCDSRGKVEQLAAGLQAGGVRTFVSHSSLGADARRQAEEAFARERDCVIVATSTLELGLDVGDLDRVVQIDAPSTVSSFLQRMGRTGRRPGSRRNCLFLTTSEKAFLHAAGLVRLWSEGYVEPVKPPATPLHLHAQQIMAMILQDGGLPESEVQPRLAGAFGAVDEGDTRAILGHMLVTGVLASDGGVLGIGPTGEKLFGRRNFLELLAAFTAPSMVTVMHGRQELGQVDPVSLTARADQPSVLLLAGRHWQVASIDWRRRIAWAEPAAGAGKSRWLGSSRALHFDLCRAIQRCLAEGQVPCTLSKRGTTRLATLVEEFSFLDGRAQAILAEEGSIHWWTFAGGRANAALALAIANDQCRVRRSDDFGLDLDGHPPSLDAADLTNALENADGVDLGHEISGLKFSACLPLILARDVVLRRRFDLDGAMQVVVSKISF

SEQ ID NO: 3639 - protein, 694 aa, Nitrococcus mobilis
MKGGGAERVSAFERLHPAVQYHIVNSLGWPALRPLQERSIAPVLDGHHALLIAPTAGGKTEAAMLPVLSRMLSEEWRGLSVLYICPIKALLNNLEARLSRLARLLGRTVQLWHGDIGQGEKNRAQREPPDILLTTPESLEGILIGGRRDHLRLLGGVRCVVIDELHAFAGDDRGWHLLALLERIHALRGHEPQRIGLSATVGEPHALLNWLAAHCAGERSLVRVQVPPTEVDLCVDYAGSLRNAAILISRLHRGEKRLVFCDSRSRVEELSIALRALGVDVFVSHAALSVDTRRQAEQAFAERQNCVIVATSTLELGLDVGDLDRVIQIDAPGSVASFLQRLGRTGRRADSRRNLLFIATRDAGLLESLAIAQLFESGFVEPVVGPPMPCHLVVQQLFAMLFQHSLELEERVFTTTLRRIPGFAGLIDAHWDELREHLLARGFLIRNGLLLALGPKAERAFLGRGLADLCVSFDSPQLFTAFHGNKLLGHVDPLSLSWRRDGPTVLALGGRSWRVVSTDWTRDRVYVEAADEKGTSRWLGESRGVSRVIAEQVRRILAAPPADSTLLTKRSSSRIAELCAAQEDTLSLTPLRLQEGGFEWWTYAGLAANILLAARIAAAGGSCGAVGSYSFRFKISDAAVTAHGGWDAIRKLTPRLEPLDRQRIKFAELLPHDLLAEMSLRRINAKSRPRGGLS

SEQ ID NO: 3640 - protein, 710 aa, Frankia sp.
MVTHHIVNTLQWPGLRPLQEAAVAPLLAGSDALLLAPTAGGKTEAATFPILSRMAAENWQGTSVLYLCPLKALLNNLTPRLETYTGWLGRRAAVWHGDVAESRRGRIRRERPDVLLTTPESLEAMLVSVRTDHHGFFAGVRAVIVDEVHAFAGDDRGWHLLAVLERLRRLIAAELQVIGLSATVGNPAELLRWLQGSGAGRRTAQVVAPDVPLQRTHEPTPPTSHSAVPATPPPGEIELDYVGSVTNAAKVLAALHRGEKRLVFCDSRKTVEELGQALRALGVDTFLSHASLSAAERRRSEEAFAQARDCVIVATSTLELGIDVGDLDRVIQINAPATVASFLQRLGRTGRRPGTVRNCLFLTLYESALVQAAGLLALWGRGWVEPVVAPPEPRHIVAQQLLAYCLQENRIGDRTWVDEWNGLAPFDRSAEPIVRHLVRAGYLDSDGGMLFVGPEAERRFGHRHFSELTAVFTAAPQFTVVHGRDEIGRTDPVLLTDPVEGPRLLLLAGRSWRVTHIDWKRRRCFVEPADGGGRARWLTAADGGMSFALTRAMRDVLLGEDPPVPLTRRATERLAAIRENHLDVVHPGGTVIARTEDHTDVRWWTWAGERANRTLAASLGDLADPLQSPTAAYLRLRTDLTPAFWKTATADLAARLCLPHVTEDALAGLKFNTALPPRLAEVTLATRLADLPAAAAVVREPVRFTHRIPA

SEQ ID NO: 3641 - protein, 703 aa, Pseudomonas stutzeri
MSEFDKFHPALQHHIVNSLGWNGLRPLQEATIQPVLDGEHAILLAPTAGGKTEAASFPVFSRMLSESWEGLSVLYICPIKALLNNLEQRLSYYGHLLGRSVALWHGDISAARKSKIVASPPDILLTTPESLEVMLVSNKVDHQQLFANVRTVIIDEVHAFAGDDRGWHLLSVLERISVLAGREIQRLGLSATVGNPDTLCDWLAGSCNARRSVINPPAENNVIPDVQVDWVGSLKNAAVVISRLHKGEKRLVFVDSRSKVEELAVELRCLGVATYISHSSLSLEERRAAEEAFSQGNDCVIVSTSTLELGIDVGDLDRVIQIDAPYTVASFLQRIGRTGRRAGSSRNCLFLATKEDAFLRALALLQLWRQGYVEPIEPPARPVHIYAQQTMALALQQKGIIAADVDQWVGRMPGFAGVTPDDRAGVISYMLGAGILHSDEGLIGIGKAGERAFGEKNFMELFSVFTTPPMVKVFSGKQELGEVHQLTFAVRDNGPALLTLGGRSWQTTYIDWPRKKAFVEPSEVRGKSQWVSDAQPLRYELCRAIADVLISDLVPEGLSSRAQGLLADLRDQYGWMESGKSTLLLDADGNAIWWNFAGKLLNSAMKDLLADEADKLIADNECMTFRHVYSAEALVRAIREILAGDAHNLAVLLDESFVQELKFAECLSQKEIDRELGERYSVDSDFKQFSRVSLAVLWVKDEA

SEQ ID NO: 3642 - protein, 704 aa, Dietzia cinnamea
MDYRAPQGFPALHPLLQHHVVNSLGWPGLRPLQEESVRPLIDGEDALLLAPTAGGKTEAAVFPVLTRMAHEDWASLTVLYVTPLKALLNNLAVRLVDYTAWMGRRVEVWHGDVGESARRAIRADPPDILLTTPESIEAMLASTKTDHRTLFANLRTVVIDEVHAFAGDDRGWHLSAVLSRLEHLVGRPLQRIGMSATVGNPEELLQWLQGGADGRAGRVIAPGVAVGEAVRPVAGDAEIVVDAVDTLDSAAVLLSKLYRGQKRLVFVDSRRQAEELASMLRGFDVDVYLSHSSLSAQERRRSELAFAEARDCVIVATSTLELGIDIGDLDRMIQIGAPTTVSSFLQRLGRTGRRAGTVRNCLFIATEPRHLLRTLGLLHAWGTGYVEPVVPPPVPLHLVAQQIMAAMLQEGALPRYGWQDRWAATPLMHVDTLERPAELIVDFLVERGYLNVDGGAMFLGPDAERVFGRRHFMDLLTTFAMPREFTVLAGRQEVGTVEWRALTGGDGPIHLLLAGRSWKVTDINWPRHRVQVEPAAGGGRARYGFGGADIGRQVAQGMRAVLLGELPEQIRLTARARAALADDEDRLRHTVSPHGPVWTTTDNVRKWWTYEGSAANRRYQAALGPALGEELAPQGGIVQPDAITLHEGMPTGPAAERLEFWESLPESERPLPAVPPTLVDKLKFSEALPVEWAIEVIARRMGYA

SEQ ID NO: 3643 - DNA, 1449 bp, Thermomicrobium roseum
atgacgagcgtcgccagagtcgtctcgggaagcgagtcgctcgccgacaaggtggaacgggtctttcgcggcctggtgatcgacaagcgccgcttgccggcaagccaactccagaagcgaggtgtgccagcctacgtcggtgaatggctcctcgacaccctcgttccgggacgcggagaactgacggaggaggaggctcggaaggttcgggagtgggcagaaaaatatgtcccgggaccgaacgaccaacagatcatcaagcatcggcttttgcagggcgaggtcatcaaggtgttgacacctgttcaggtcgaggtgagcttagcgagggcgacgcggagcgccaagctacggttgttggggatcgaggatgctgctatctccgacgagttgccgacacgctaccccgatctgctccggcaaggcatgtggggcgtcgtcgagttgctcagtacgggggacggagtggcaattcaatccttccgcccgatgcaggcatcgctggatctcggtctctacaaggaggcgaggcaagagttcacgctggacgagtggctccggctgatgctcacctcaatggggtacgcaccggaagccttcacggcggaagaacaactatggctcatcgcgaggctccttccgctcgtgcaaaagaatctgcacctcgtagaacttgcccccaaggcaacggggaaaagctacttctatgagaatatcagccccagggttcgcttggtgagcggcggaaacattactccagcagtcctctttgtgaacaacgcgactggtcagtggggtttgctcgcccggtacgcagtcgtcgtgctcgacgaagtccagacactgaagttcgaaaagcccgaggaaatcatcggtggattgaagggtttcctcgctaacggtcggttgacccgcggaggtttgcacgaggcatcgagtgactgcagtttcgtcatgctggcgaacgtccctttggacgaaaagcaggaaccgatcatccagcagaactcactggtcgactatctaccagagttcatgcgagaaaccgccttcctcgatcggatcaagggtttgctccccggatggaagatccggaagctgagtaaggaggccttcgccaactccgtcggtttgaaggcggatttcttcggggatgccctactcacactgcgagaggacctcgagatcgaccagtactgcgctcgtcgtatccgcctccgcggtaatcgaccatacgcgcgcaacgagattgcagtgcaagcactcgcaagcgggatgatgaagatcctgtttccgcacggtcgcgtaagcgactgggatttcagacattattgcgtcgaaccagcagtccaactccggcagggtatctgggacctgctgtaccaactcgacggcgagtaccgacagtgggaccgactgatcgaggccgagatagtgccaatgtcatga

SEQ ID NO: 3644 - DNA, 2085 bp, Salmonella enterica
atgcaaacccatcatgacttacccgttccagctgtatccgaaggggaactcgtcgcagaaggttacgatctggacgccttgctgaatcagcattttcgtggtcgggtagtacgtaaggacctgactaaacagctcaaagaaggggcaaatgtcccggtctatgtgctggagtatctgctcggtatgtactgcgcttccgacgatgaccagatcgtcgagcaagggttgcagaacgttaagcgtattctggctgataactacgtccgccctgatgaagcagagaaggtgaaatcgctcattcgtgagcgaggatcctacaagatcattgataaagtatcggtaaagctcaatcagaagaaagacgtttacgaagcccagctctccaacctcggcattaaagatgcactggttccgccgcagatggtcaaggacaacgagaagctgttgaccggcggcatctggtgcatgatcaccgtgaactacttctttgaggaaggacaaaaaacgtcgcccttctctctgatgacgcttaaacctatccagatgcccaatatggacatggaagaggtatttaccgcacgtacgcacttcaaccgcgaccagtggattgatgtcctgctacgttccgtgggtatggaacccgctaacattgagcagcgaaccaagtggcacctgatcacccgcatgatccctttcgtggaaaacaactataacgtctgcgaactgggtccacgcggcaccggtaaaagccacgtctataaagaatgttcgccaaactcactgttagtttccggcgggcaaaccacggtagccaacctgttttacaacatggccagccgccagattggcctggttggcatgtgggatgtcgtcgcgtttgatgaagtggcggggatcactttcaaagacaaagacggcgtgcaaatcatgaaggattacatggcgtctggctcgttttcccgcggaagagattcgattgaaggcaaagcatcgatggtgttcgtcggcaacattaaccaaagcgttgagacgctagtcaaaaccagccatctgttagcccccttccctgccgcgatgatcgatacggcgtttttcgaccgcttccatgcctatatccccggctgggaaattccgaaaatgcgcccggaattctttaccaatcgctacggccttatcacagattatctcgccgaatacatgcgggaaatgcgtaagcgcagcttctccgacgcgattgataagttctataagctgggtaataacctcaaccagcgcgacgttatcgcggtaaggcgcacggtttctggtctactgaaacttcttcaccccaatggttcttacagcaaagaagatgtccgtgtttgcctgacctacgccatggaagctcgccgtcgcgtcaaagaacagcttaaaaagctgggcggtctggagttcttcgatgtaaatttcagctacattgataacgagacgctggaagaattcttcgtcagcgtgccggaacagggtggcagcgaattaattcctgctggcatgcccaaacctggtgtagtgcatttggttacgcaagcggaaagtggcatgacgggtctgtatcgcttcgaaactcagatgaccgcaggcaatggtaagcatagcgtttctggtctgggatcaagcacctcggctaaggaagccatccgggttggatttgactatttcaaaggcaacctcagccgcgttagcgcaacagcgaaattttctgaacatgagtaccacctgcacgtagtcgaattgcacaatactggaccaagtaccgcgaccagtcttgccgcgctgatcgcgctgtgttccgttttactggcgaaacccgttcaggaacaaatggtcgtgttaggtagcatgacgctcggtggtgtgatcaacccggttcaggatctggcggctagcttacaacttgctttcgatagtggcgcgaaaaaggtccttttgccgatgtcttccgcggtagatattccgactgtgccagccgagttgtttaccaaattccaggtcagtttttactctgaacctgtagatgcggtttataaggcgttgggagtaaactaa

SEQ ID NO: 3645 - DNA, 2067 bp, Clostridium sticklandii
atgatggatactatgttgatggataatgaaagcccaaatgcattattaaatagaaagctaagaaagtattttgatgggaagatagtgagaaaagacctgacaaaatctatcaaggaaggagcaaatgtgcctgtatatgtgctggagtttttattagggcagtattgcagctctgatgaccctgagataatagaagatggagtaaagacagttaagaaaatcctatcagagaatttcgtaagaccagatgaagctcaaaaagtcctatctatactcagagagcgtggtagttacactgtgatagatagaatcactgcaaagctaaatataaagcaggatagatatgagactgagttttcgaatctaggggtaagagaaatcttgctagatcctatgtatgtttctaagtatgatagactcctatgtggtggaatctggtgcatagttcagctagagtatgagtatctagaagaagataagagagctcatcctatccgcatcagaaagctaactcctatccagatgcctcatatagagctagatgagattaagtcagctagaaaggaatttacgaaggaagaatggctagatgtccttatcaggtctactggtatggagcctagtaagttcaatactaggcaaaaatggctactgcttgctcgtatgattcctcttatagaaaacaactttaatctgtgcgagctagggcctagaagtacaggaaaatctcatatatataaagaaatatcaccgaacagtatcctagtatcaggtggtcaaactactgttgccaaccttttttataatatggcaaacaaatctgtagggctagttggtatgtgggactgcgtggcgtttgatgaagtagctgggattacttttaaagacaaagacggaatccaaattatgaaagactatatggcttcagggtcatttgctagaggaaaagaagaaaaagcagctagtgcttccatggtatttgtgggcaatgtcaaccaaagcgtagatgtactgttaaagacctcgcatttgtttgagccatttccagaagctatggcatatgatactgcatttctagataggatgcattgctatgtgccggggtgggagattccaaagtacagacctgatttctttacaaacgactatgcatttattacagattatctgtcagaatttatgagagaaatgagaaaagagcaattttctgatgcttgtgatagatactttaagttcggacataatctaaatcaaagagatgtgatagctgtaagaaagatggtatcaggatttactaaattgctgtatccagatggagagtattctaaggaagatatggctgagatactagatatctcactagagctaagaagaagagtaaaagagcaactcaaaaaaataggtggcatggagttttatgatgtcaacttttcatatattgataatgatacctttgaggagcattatgtaggagtatcagagcaaggaggaggaaaactcatccctgagggcatcataaatccagggcatatctataccatatctagaggaaaaacaggaatggtaggggtatatagactagaaactcaagctctacctggaaatggaaaaatagaaagaacaggactaggctcagatagagatgcaaaagaagcgacaaatactgcatttaattatctcaaagcccatggacattctatcagtaactccataagtacaactactaaagactacatcatcaactatcaagacctaaatggtgttggcatgacaaagtaccttacacttcctacagtgatagctatagcttctgctgctctaaacaaacctacacttagtagcctagcagtactgggagatatcagtatcagtggaagtatattcaaggtagaagaactagcaaacaccttgcaagtctgcctagatagtggagcaaaaaaaatcctcctacctattacctcagcagtggatatggcaacagtcccaccagagctgatgggagcatttagcattatattttataatacacctcaagaggcagtttttaaggctctaggggtagagtga

SEQ ID NO: 3646 - DNA, 2043 bp, Acidiphilium multivorum
atgagcaatggtacactgccggcccgcgacgcactcgacaacaaagcgaaccagctgttcgccggaaaagttgtccggaaggatctcgttcgcaaggtcaaggtaggggccaatgtgcccgtcttcgtgctggaatttctacttggaaaatattgcgcctcgtccgatgaggtcgcaattcagatggggctgcaggtcgtcaacgacacgctcgcaaacaactatattcgaccagacgagtctgcgaaggcgcagagcaaggtcaaagagagtggaaaatattctttcatcgacaaggtcaaagtgcggctggtcgattccgactactgggcagaaggtgtaaattttaataacaaattccttcatatacctagccaatacgtgcgtgattatgagcgcctgcttatgggtggcgtgtgggcgcaagtcgacatgcggttcgaaaccgacgaggagtcgaagggcaaaaatccgttttggatcgacaagctagtccccattcaaatcgcgacgttcgacctcgacgaataccgcaatgtcagaaaacagtttaccaccgacgagtggttagatctgatcgtacggagcatggggtacgagcctggggagatgtctaggcggctcaagctgctcttcttggttcgactcatccctttgacggagcggaactacaaccttgttgagcttggccctcgcgggaccggcaagagctacgtggtccaggaggtttcgccgtatacagcgcttctgacgggagggacgacagtcgccaatctgttcggccatatgtcggggcgtcaaaaaggcatggtccagatctgggatgtcgtgggcttcgacgaggtcgcagacctccagaagatgcctaaggaagtcatcacgacgatgaagacgtactgcgagtctggcaccttccaacgtgggcaggaggccgttgcaggggatgccagcatagctatgttcggcaacaccaatcagccgatcgacgtcatggtccagacgggccatctcttcgcgccgatgcccgacactattcgtgacgacatggcattcatcgaccggctgcacttttatctccctggctgggagattccgcagatgcggaacgagctgttcacggaccactacggctttgttgtggactatctcgctgaggcgctgcgcgacatgcgcaagcacaacttcactgagattatcgaccggttcttttcgatgggcgcgcatctgaacgcgcgcgatcgtaaagcggtcaggaagaccgcgtctggattggtgaaaattttatttcctcatggcgacgtgacacaggaggagctcgcagaaattcttgagcttgctcttgaaggacggagacgcgtgaaggaacagctcaagaagatgggttcctttgaatattaccaaacgtcgttcagctacacgctccaggacaccggcgaagagcgctttgttggtgtccccgagcagggcggacgcgatttgatttccgccgatcctctgtctcctggaagtgtctatacggccggcgtgacatccgacggaaccgtcggcctttatcggttggaggtatccgtttctagcggcactgcaaagctacggttggctggtggcatttctggtgcaatgaaggaatcggtgcaacgagcctttagctatgtccaggcgaagaaggtcgagcttgggattacccgggatcttgagacttctgacctccacgtcgaggtgatcgatttattgggaaatcgcgttgaggccgagatcggcgtcgcgttcttcgtggcggcctattcggcacttcgcaaagtgccagtcagtcccgcgctgctcgttcttggcgacatgagcgtgcaagggaatatcaagccgttgcgatccctgaccgagccccttcaggtcgcgaaagacaatggggcgaagcgctcactcattccgatagagaacaaacgcaactttctcgatgtgagcgctgacattatggagcacgtcgacccaatcttctatggggatccgaagacggcagctatgaaggtgctgggcaacgtataa

SEQ ID NO: 3647 - DNA, 2109 bp, Acidithiobacillus ferrivorans
atgagcgccctcgacgacaaaatcaaccagcacttcgcgggcctggtagtacgcaaagatctggtgaagaccgtgaaaggcaatgccacggtgccctcctatgtgctggaatacctgctcggccagtattgcgccaccaatgacgaggccactatccagaccggtatcgagaccgtgaaggaaatcctccgcaagcactatgtgcatcgcaacgaggcgggattggtgcgctccaccatcaaggagaaaggccgacacaaggtgatcgaccgtatcagcgtgtcgctcaatgacaaggacgatgtttacgaagcggaattcgccaatctgggtatcaaaaaagtgctcatcaacgctggtactgtcaaggcgcatcagaagctgttggtgagtagcgtctggtgtatcgccgacctggagtatgagtattccgaggaaaaatcgggctcgccgtgggtgttagcctccctaaagcccattcagatctcccgtttcgacttggatggctacctggcagcgcgcaagcagtttagtacggacgaatggatcgacctgctgatccaaagcctcggcttcaacccgcaaatgttcggaaagcgcaataaactgctgcaactcatccgcctgattcccttctgcgagcgcaattacaacctgattgagttggggccgaaagggacgggtaaatcgcatgtctattcggagttttcgccgcacggcattctgatttccggcggtgaagtgaccgtgcccaagctcttcgtccataacggcaccggcaaactcggcttggtgggttactgggatgtagtagcctttgatgagttcgccggcaaacagaagcgggtagacaaggcgctggtggacatcatgaagaattacatggccaacaagtccttctcgcgcggcgtagaaacgctgggcgcagaggccagcatggtcttcgtgggcaacaccgaccataccgtaccgtacatgctgaaacattccgacctcttcgacccactaccggaaaagtttcatgactccgcattcctggaccgcattcactactatattcccggctgggaagtggacgtgatccggggcgaaatgtattccgacggctacggctttgtagtcgattatctgggagaaattctgcggacactgcgcggcgatgatttttccgaccgctataagaagcggttcagcctatccaatgagatctccagccgcgatcgcgatggcatcaacaagaccttctccggccttatgaagatcatttttcccaacgacgacgccagtgatgcggagattgaggaagtattacgctacgcgattgaaggccgcaagcgggtcaaagatcagttgctgcgtatggaccacacctatcccgaggttcgttttgcctaccagagcagcgatggccaggaagtattggtgcacacgctggaagaagaggagtaccccagtcagtaccatcgtcagttagcggcggatatttccttgcaggagttgccctttgacgtaatgggcgttgcaccggttgcacatgccgcaccggccatggagatgcttgcatcacccatgaacgcagcggccggcagtgatttggttttgaaagaacagcacctcgtcttccacgaaaaccagcggggagtgagcttcgacaagctctttggtccctatctggcgaccagtaagcgtattgtcgtcaccgatccctatctccgagccttccatcagttacgcaatctgatggaactcatggagaccatcagcaaacagaaaagccccgatgacgaggtggctgttcacgtggtaacggttgaagacgagtttaacggcgatcgtcagacagaaagcctgcaaaaaatagccgacgcgtgcgccgaggtgggcattcagttcacctgggtctacgacaccacgaacaccctacacgaccgtgacatcagcaccgacctcggctggaaaatcgtcctcagccgtggactggacgtgtttcagcgctttgagctcaatgatgccttcagcttcgccaaccggctgcaacagcatcgaccctgtaaggccttcaatgtaacctatgtacacgatatcaggcaggaacacagcatcggttag

SEQ ID NO: 3648 - DNA, 2040 bp, Acinetobacter baumannii
atggaatctgctaacgataaagaactggatcagctgctgaatgaacactttgctgggcgggtggtacgtaaggatctgactaaactgatcaaagaaggggccaatgtccctgtctatgtgctcgagtacctattggggatttactgtgcctcggatgaccctgagatcattgaacaggggctgcgtaacgtaaagaccgttctggcagagaattatgtccgcccggatgaagcggagaaagtaaaatccctggttcgtgaacgtggcagttataaggtcattgaccgagttaccgtgaagctgaatgagcgtaaggacaaatacgaagcctctttcagtaatctaggtattaaagatgctgagatttcggcaggcatcgtcaaagagtatgaaaaattactcgttggtggtatctgggtgattgcaacactcagttattattttgatgaaggacagtcaaattctccatttggtgtgagcctactcaagccgattcaaatgccgaatatgaatatggatgaactcttcagtggaagagcagcattaagcactgatcagtggcgcgagagtttaatccgttcgatcggcatggaaccggcttcgctaaaagaggacgtgcaatggcagctattagcacgtatggttccgttcgttgaaaataactataacgtttgtgaactgggaccacgcggtaccgggaaaagccatatttacaaagaatgttcaccgaatagtattttagtctccggtgggcaaacgactgtcgccaacctattctataacatgagtagccgccgtattggtctggttggcttatgggatgtggtagcctttgatgaagtcgccggtatttcctttaaggacaaagatggcgtacagatcatgaaagattacatggcctcagggtcttttgcccgtggccgcgaacagatggaagcctctgcttcaatggtttttgtgggtaatatcaaccaaagcgtggaatccctggtcaaaaccagccatctattggcacctttccctgaagccatgatcgattcggcattcttcgatcgttttcatgcttatatccccggctgggaaattccgaagatgcgcccggagttcttcaccaaccgttatggattgatcgttgattatctagctgagttcttccgggaaatgcgtaagcgtagctttgcagatgccattgagaagtacttcaaactcggcaacaacctgaatcaacgtgatgtgatcgccgttcgcaagacggtttccggattgatgaagttgctctacccacacggtcagtttaataaagaagatgtacgccagtgtctggaatatgccctgcaggtacgtcgtcgggtcaaagaacagctgaaaaaaattggtggcatggaattctatgatgtgcatttcagctacatcgataatgacacgcttgaagagcactttgtttcagtcaaagagcagggtggaggtggactgattcccgaaggtccagccaagccaggtttcttatataccatcgggctcagtaataaaggcatgccagggttataccgcttagaacttcaagtcaccaaaggttcaggaaagctggcgacatcaggcttatggaattcaagcagtgccaaggagcaggtcaaggtcgcatttgactacttcaaggccaatgcatctcgaatctcgggtggcagtaaggtgatggaacatgacttccacttacatgtggttgaattacagaacaccggaccactcagtcatcttgctctgccaagtttagtagctttcgcttctggcctgttaggacgatcggtacaaagtcagatggtggtactgggtgatataagcttgggtggttctgtgacaccggtggaaagtattgccgaatgtctgcaagttgcttttgatgcgggtgccaagaaggttgctttgccaatgagtagtgcggcagatatcccaacgattcctgtagaactgtttaccaagttccagaccagcttttatgcagatccggtggatgcggtatttaaagctctgggtgtgggttga

SEQ ID NO: 3649 - DNA, 2055 bp, Anaeromyxobacter dehalogenans
atgaccatgaccctggatcatctcgaccagcgggcggccgaagtcttcgacggctacctcgttcggaaggatctcgttcgtaagtacgcgcgccagtatccggtgccgacctacgtggtcgagttccttctcggccgctactgcgcgagtacggacgagaaggagatcgccgagggactccagatcgtcgagaagcagctccgcgatcgcaccgtccgcaccggcgaggaagagttgttcaaggcccgagcgaaggagggcggtaccgtcaagctcatcgacatcgtcaaggcgcgtctcgatgcgaagaacgatcggttcgtcgccgagttgcccagtctggcgcttcgcgacgttctcatcgacgaccagttcgtgcgtgagaacgagcgaatgctcaccgacggcttctacgccgaggtgacgctggcctacgacggagtcgctgcccaggagcagggagggcgccccttctccatcgagtcgatgcgcccgattcagatgtcgaagtctgacgtgctcgaggtgatggggaaggcgcgccgcgcgttcacgacacaggagtgggtcgatttcctcatccgctcgattggtctcgaaccttcctcgttgaccgagcgtgcgaagcgtgtggccatcctacgcatggtcccgttcgtcgagcgcaactacaacctcgtggaacttgggccgcgcggcacgggcaagagccacctgttccagcagatctcgccttacgcgcacctcatctccggcggcaaggcgacggtcgccaagatgttcgtgaacaacgcgactggccagcgcggtctggtctgccagtatgacgtcgtgtgcttcgacgaggtgtccggcgtctccttcgatcagaaggacggcgtcaacatcatgaagggctacatggcctccggccagttcagccgcggcaaggacaacatccgcgccgaaggcggcatcgtgatggtcggcaacttcgacgttgatgtcgagcagcagcagcgcgtggcgcacctgctgagcccgctccctcccgagatgcgcaacgacacggcgttcatggaccgcttgcacgccttcgtaccgggctgggacttccccaagctcaacccgaacgaccacttcaccgatcacttcggccttgtgagcgacttcctgagtgaatgctggagcaagctgcgctcgggcaaccgcgtctcggtgatgcagggacgcgttcacctcggtggcgcgctgtcgggtcgtgacatcgaggcggtgaacaagacggtgagcggcctgacgaagctgctcttcccggatcctgaggcgaccgttcccgacgaggatctcgagtggatcgcgcgcatcgcgctcgagtcacgccgccgcgtcaaggagcagcagaagcgctgcttcaagagcgagttccgcaacacgcacttcagctacatgctcggctccgaaggtgtggagcagttcgtctcgacacccgaactccacagcgacgaggccatcgagagcgacccgcttccgcctggccaggtgtgggctgtgagcccatcgagcccggacgcgggcccgggcctgtatcgcgtcgaggtcacctgtggcccgggcgcgggcgtgaaggtgttgaaccagccgacgccgcccacgttccgagagagtgtgaaggtcggcgagcagaacctctacacacgtgcgaaggagctcgtcggcgaccgaaaccctcgagagcacgagttctcgatccagatgcgcgccctggataccgacaagactggcgcgggccttggcattccggtgctcgtcgcattgtgcggagcacttcttggccgcaacacgcgcgggggaacggtcgtcgttggcgcgctgaacctcggcgggtcgattgagatgatcccgaacgccgtccgcgtcgccgagctggcggttgataagcaggcgcagacgctcctcatgcccgtggccgcccgccgccagctcaacgacctgcccgacgagctgtggaccaagctcaacatcgagttctacaaggacgcgtccgacgcggtcttcaagtcgctggtcgagtga

SEQ ID NO: 3650 - DNA, 2082 bp, Aromatoleum aromaticum
gtgtgccgctgcgagtcgacctcgcctttacgaatgacttttgaaacacacatgaccgaacccgtggatacggcccgactcgatgggctcctcaacgcgcacttcgccggcaaagtggtccgcaaggacctgaccaagctgatcaaggagggcgccaacgtcccggtgtatgtgctcgagtacctgctcgggatgtactgcgcatcggacgacgaggcgacgatccagaacgggatgacgatggtcaagcgcatcctggccgagaactacgtgcggccggacgaggccgagaagatcaagtcgaagatccgcgagagcggaagctacaaggtcatcgacaaggtgactgtgaagctcaacgagaagcgcgacgtctacgaggcgctgctttcgaaccttggggtaaagaacgccgaggtttcggaaactttcgtgcgccagtttgaaaaactgctcgtgggcgggatctggtgcatcgtcacactgaactatcgctttgaggagaaccagcgcggctcgcctttcacggtgaccgatctcaagccgatccagatgcccaacatggacatggctagcctgttcgaggggcggcgggcttttaccgaggatgaatggatcgatgcgctgatccgctcgaccggcatggagccgggctgcttcaaggatcgggtgaagtggcacctcctcgcgcggatgattccgctggtcgagaacaactacaacttctgcgagctgggtccgcgcggcacgggcaagagccacatctacaaggagatcagcccgaacagcatcctggtgtcgggcgggcagacgactgtcgccaatctcttctacaacatgagcgcacgcaaggtggggctgattggcctgtgggatacggtcgccttcgatgaggtggctggcatccacttcaaggaccacgacggcgtgcagatcatgaaggattacatggcgtccgggtccttcagccggggcagggaggcgatcaacgccaatgcctcgatggtctttgtgggcaacatcaaccagagcgtcgaatccctggtgaagaccagccatctgctcgccccgtttcccgaggccatgatcgactcggccttcttcgaccgcttccatgcctatgtgccgggctgggagatcccgaagatgcgcccggaattctttaccaaccaatacggcctgatcgtcgactacctggccgagtacctgcgcgaaatgcgcaagcgcaacttcgccgacgcgatcgacaagtggttcaagctgggcaacaacctcaatcagcgagatacgatagcagtgcggcggacggtgtcaggcttgctcaaactgctttacccgaatggcgagtacgacaaggaggccgtgcgtcgctgcctcgaatatgcgctggaagtacgccgcagggtgaaggagcagttgaagaagatcggcgggatggagttttacgatgtgcatttcagctacatcgacctggaagacagccaggagcgcttcgtcaccgtgcccgagcagtcaggcggtgcgcttattcccgaggggcggctcaatcccggtacgctgcatacgatcagcctgggagagtctgaaatgccgggtacctacagggtggaagtccaggccattgctggtaacggcaaggcatcggtctccggtgtggcaccgcgcgaagccgtgaaggtggccttcgattatttcaaggccaatgcaagccggatcagcgcttccatcaaaccgggtgagcacgacttccacctgcatctgctggagctgcagcacaccggaacgccgaaggcattcaccctcgcaggactgatcgctttgtgttctgccgcgctcgccaaatcgattcagcctcaaatggtggtgctgggcgatatgagtcttggtggtaccgtggtccaggtccgcaatctggccgagagccttcaggtggcctttgatgcgggtgccaagcgaatactgttgccgatgtcgagcgtgatcgacattccgacggttcccggtgagctctttgcaaagttccagacaagtttttactcggacccggtggatgctgcattcaaggcgttgggcgtcgagtag

SEQ ID NO: 3651 - DNA, 2142 bp, Arthrobacter sp.
atgacggaagctgaagttgagttcgaggacccggcaggggatttccctgaccccgatcctggcctgcaagcccccgagaagtcggcgctcgaccagaagatcaacgacctcttcgcaggcgtcgtcgtacgcaaggacctcgtcaaagccgtcaagggcaacgcgatcgtcccctcctttgtcctggagtacctgctcggccagtacgcggcatccgacaatgaggccaccatccagaccggcatcgagacggtgcgcaagatcctcgccgaccactacgtccaccgcaatgaggccgaactggtcaagtcccggatcaaggagaagggacaccttcgaatcatcgacaaggtgggcgtcactctcaacgaaaaggatgacgtctaccaagccgagttcgccaacctcagcatcaagggcgtgctggtcagctcctcgacaatcaaacagcacgaaaagcttctggtcggcggtgtctggtgcatctgcgagatcgagtactcccacaccgatgaccaccgtgccgtgccctggattctgagctcgatcaagcccatccagctctcgaacttcgacttcgacaactacgtcagcacccgcaagaagttcaccaccgacgaatggatcgacttgctgatccagtcgatcggcttcaacccggaactcttcgggcgcagagcgaaactgattcaactcgcccggttaatcccgttcgtcgagcgcaactacaacctcgtcgaacttgggccgaagggcaccggcaagtcacacatcttctcggagttctcgccccacggcatgctcatctcgggcggcgaggtcaccgtgccgaagctgttcgtgaacaacgccaacgggaagatcggcctcgtcgggtactgggatgtcgttgccttcgacgagttcgcaggcaaaaagaagcgcactgacaaggcgctcgtggacatcatgaagaactacatggcaaacaagtccttctcccgcggcgtcgagacgcttggcgcagaggcgtccatggtgttcgtcggcaacacctcgcacacggtgccctatatgctcaagcactccgacttgttcgacgagcttcccgagagctaccacgattcggctttcctggaccgactccaccactacatccctggctgggaggtcgacatcatccgtggggagatgttctctaccggatacggattcgtcgtcgactacatcgccgaagtcctcaagtccatgcgctccttggacttctctgatcgctacgagtcgaccttcacgcttgatccgagcatctcgacccgcgatcgagatgggatctacaagaccttctccggcctcatgaaagtcatgtacccgcacggtgcggcaacgagcgaagagatcgaggaggtccttcgattcgccatcgaggggcggaagcgtgttaaggaccagatcctccgcatcgattccacgatgaacaaggtgaacttcggatacgtcgacaagtccggcgagtggcacgcggtcacgactctcgaagaggacgagtacccggagtattaccaccgagagggcagtgagggtgctgaggtcggcgaaccgaaggcgggtggtgccgtagctactgccgggggtgctcagtcgccttcggcggaaacagtcgtagacaaaccgctgttcgagggccaccgggagttccaggagaaccagcggggagtctcgttcgacaccctcctcgtcccgtacctgcgtggagctacgcaaatcaccataactgacccatacatccggcacttcacccaggcccgcaacctcatggaactcatcgagtgcatcgcggccaccaaggacgcggccgacgaggtaagtgtcaatctcatcacgtcggagaacagcgagggaggggacaagctccgaaagcagttcgagcttttgctgaaggtcaagcagggagcggctgtcggcggtatcaacgtcgacgtcatcttcgacggcagcattcatgatcgatctatcgtcaccgacaccggatggaggatccttctcggccgcgggctagacatcttccagtacgtcactggcgacgcctttgacctcgccacccgcctccaggcgttccgtcaggtgagggcgttcggagtgacctatatccgcgagagtgagtga

SEQ ID NO: 3652 - DNA, 2052 bp, Azospirillum lipoferum
atgatgaacgtggaaatggacagcctggaccggcttggcgctgctgccttcgacggcttcctcgtgcgcaaggacttggtccgccggtacgcccggcagtacccggtgccgacctacgtcgtcgaattccttctcggccgctactgcgccagcgtggatgaggaggagatcgccgaaggtctggagatcgttgaaaagcagctccgcgaccggacggtccgcaccgggacggaggagctgttcaaggcccaggcgcgcgaccgcggctcggtcaagatcatcgatatcgtcaaagcgcgcctggatacgaagaacgactgctatatcgccgaactgcccagcctgacgctgcgtgacgtgcgcatcgatgacagcgtcgtgcgcgagaacgaacgcatgttgaccgacggcttctatgccgaggtcactctgtcgtatgatgccatcatcgcgcaggagaagggcggcaggcccttcggcatcgaggcgctgcgcccgattcagctctccaaatccgatgcgttggaggtacttgcccgcggccgcgccaaattctccacccgtgaatggctggattttttgatccgctccgtcggccttgagccatcctccctcacggatcgggcaaagcaggtcatgctgctgcgcatggcccccttcgtggaatcgaactataacctcgtggagctgggtccacgtggtaccggcaagagccacctgttccaacaaatctcgccctacgctcacctgatctccggcggcaaggccacggtcgccaagatgttcgtcaacaactcgtcgggcgagcgcggcttggtgtgccgctatgatgtggtctgcttcgacgaggttgccggcgtgtccttcgaccagaaggacggcgtcaacatcatgaagggttacatggcctccggccagttcagccgggggaaggagaacatccgggccgaaggggccatcgtgatggtcggtaatctggatgtcgacctggagcagcagcagaagatcggacacctgctcggtccgctgccgccggaaatgcgcaacgacaccgccttcatggaccgcctccacgcctatgtgcccggttgggacttcccgaagctcagcccgaccgagcacctgaccgaccacttcggccttgttagcgactttatcagcgagtgctggagccggctgcgcagcgtcaatcggactcaggcgctcgagcgcgtccacttcggcggcgccctaagcggccgcgacatcgaggcggtgcgcaagacattcaacggtgttgccaagctgctcttcccggacccggacacgccgatcccggatgaagatctggagtggatcgtccgactggcgctggaggcccgccggcgggtcaaggagcagcagaagcgcgtgttcaagagcgagttccggaacacgcacttcagctataccctgggagccgatggggtggagcagttcgtctcgacgcccgagctccacagcgacgaagccatcgagagcgatcccctgcccccgggtcaggtctgggcggtgggcgcctcggcggagacggcgccgggcctgtatcggcttgaggtgacctgcggacctggaagtggcgtgaagatcctgaatcagccgacaccgccggcactccgggagagcgtcaaagtcggcgaacagaatctctacgcccgctcgcgcgaaatggtcggcgatcgcaatccgcgtgaggaggagttctccatccagatgcgggctatggacagcgataagactggggccggtctgggccttcccgttctggtcgcgctttgcggttcgctgctgggtcggaacagccgaggaggaacgatcgtggtcggctcgctgaatctcggcgggtcggtcgaactcattcccaacgcggtgcgcatcgctgaattggctgtggaccgtcaggcacagacgctcctgatgccggtcagcgcccgcaagcagctcaacgaccttcccgatgagctgtggaccaggatcagtattgaattttataaagacgccgcggacgcggtcttcaaggcgctagaagattga

SEQ ID NO: 3653 - DNA, 2169 bp, Bifidobacterium animalis
atgaccgataccatgcaacatgaactgagcccgttggacaggaagatcaccgacgtgttcccgcagcacaccgtgcgcaaggatctcgtcggggaaatcaagggcaatgcggtcgtgcccacctatgtgctcgagttcctgctcagccagttcgccacgacaaccgatgcgctcagcatcgaatcgggtgtgcgacgtgtgcaggagatcctcgcccagcattatgtgcaccgtgatgaggcgatgctgatccagtcgaagatccgcgagaaggggcattaccgggtcatcgacaaggtgcaggtgacgctcaacgagaagctcgaccggtacgaggcgagcttctcgcacctcaacatccggcaggtagtcgtcgatccgaacatcgtgcagaagaacgagaagctgctcgtgaccggcatctggtgcatctgccgtatcggctacgcgtacacgggcgagaaggacgaggtgccgtggcggctggaaagcctcaagccggtgcagatggcgaccgacgacgtgcataacttcatcgaggggcgcaaggcgttctcgacggaggaatggatcgatctgatgctgcagtcgatcggcttcaaccctgagctgttcagcgaccgagcgaagctgctgctgctcatacgcatggtgccgttcgtcgaacgcaacttcaacgtcgtcgagctcggccccaaaggcaccggcaagtcgcatatctattcggagttctcgccgcacggcatgctcatctcgggcggcgagatatcggtggcgaagctgtttgtcaacaatgccaccggacgggtgggactcgtcgggttctgggacacgatcgcgttcgatgagttcgccggcagaaacaagaaggccggcaaggaactcgtcgacatcatgaagaactacatggcgaacaagacattctctcgcggcgtcgaacagatccccggcgaggcgagcctcgtgttcgtcggcaacaccgaccatgacgtccccacgatgctgcggacgtcggacctgttcgaggcgctgccatcgcaataccacgatccggcgttcctcgaccgcatccacgtctacatccccggctgggagttcgagcagatccgttctgagatgttcaccgacggctatggcttcgtcgtcgactatctggccgaggtgctgcacaacctgcgcgaccttgactacagcgaccgcttcaacccgtacttcgaactctcgtcgtcgctgtccacgcgagacaaggacggcatccgcaagaccttctccggactgatgaaactcatctacccgtccggcgcggcgtcggccgaacagatcgagccgctgctgcgattggcaatcgagggacgcaaacgcgtcaaggaccagctgtgccgcatcgacacgacgatgacgccggtcgacttcgcctatacgaaggttggatccgaaacgccgatcaccgtcaggaccttcgaggagatcgactacccgaaactgtatcggcgccagcacaccgatgacgcatccgacgaggacgacggcacgatccccgaaggcgcgttgccggacaaggacgctgcgctgaccgaagacgcgccggaacagcctttgaccgcgaaacccacaccttcccccatcgaacgcatgcaggcactcgcaaaacccggtgtgaaggagctggaggagaacgaacgcggtttctcctacgacaagctgttcggcccatatgtcgccggcgcacagcagctcgaactgatcgatccgtacatccgcctctcctaccagatgaggaatctggcggagttcatggagatggtgcgcagaaactctaatccgcgtcaacgcgtccacgtacatctgatcacgaagaaagacgaggaggagcacaaggcgaaacggcaacaggaaatgctcgaagagctcaagcacaactacgcgccgatgggcgtcgacctgaccttcgagttcaatgacacgatccacgatcgtcgtctgtgcactgacaccggctggaagatcacgatgggacgcggactcgacatcttccagcaaggcaacgacggcgactggctcaacccgcagaaccgcatccaaaagatgcgccgcatcaaatcctgcacgttcacctacctcagggatgatgacatattgaccgatcaggagaagcagagcagaaactga

SEQ ID NO: 3654 - DNA, 2073 bp, Bordetella parapertussis
atgaacgaacttgaccagaaaatcaacacacacttcccgggactcgttgtccgcaaggatcttgtcaagacggtcaagggcaacgccatcgttccctcctacgtgctggagtacctgctgggacagtactgcgccaccagcgatgagccgaccatccagaccggtatcgagacggtcaaagagattcttgccaagcattatgttcaccggaatgaagccgggttagtccgctcgaacatcaaggaaaaggggcgctacaaggtcatcgacaaaatcagtgtcgatctgaacgacaagaaggatgtctatgaggcgcagttctccaacctgggtatcaaagaggtccttgttgattccggaacggtgaaaaagcaccccaagctcttggtcggcggagtgtggtgcattgctgatctggaatatgagtttaccgaagacaaggccgtcagcccctgggtcttgtccactctcaagccgatccagctctcccatttcgatttcgacggctatgtcgaggcccgcaagcaattcaccaccgacgagtggatcgacctgctggtgcaaagcatcggcttcaacccggatatgttcggcaagcgcagcaagctgacccaactggtccgcctgatcccgttttgcgaacgtaactacaacctgatcgaacttggccccaagggaaccggcaaatcgcacatctactcggagttttcccctcacggcatcctgatctccggcggcgaggttacggttcccaagctgttcgtgaacaactcttccggaaagatcggcctggtcggctactgggattgtgtcgccttcgacgagtttgccggaaagcaaaagcgcgtggacaaggccctcgtcgacatcatgaagaactatatggccaacaagtccttctcgcggggcgtcgagacgctgggcgcagaggcctccatggtgttcgtgggcaacacccagcacaccgtgccctacatgctcaagcactcggacctgttttgcgagttgcccgacaagttctacgactccgcgtttctggaccgcatccatttctacatccccggctgggaggtcgacatcatcaggggcgagatgttctccagcggttacggattcgtggtggactacctggccgagatccttcgctcgctgcgcaaccacgattactcggaccgctataaggagcacttctccctctcctccgatatctcgacgcgggaccgcgatggcatcaacaagacattctccggcttgatgaagattctttttccgcatgggggggcgaccgaggaagaggtcgaggaactgctgcggttcgcgattgaaggccgcaagcgcgtcaaagaccaactgatgcgcatcgactccacctacggcaacgtccgctttacctatctgggcacggatggccaggccaagccagtcaccacgctcgaagaggaggaataccccagctactaccacaagaccatcgccgagggtgaagacggggaaatcatagaagctgcgcaaccgggctcgccccaaggtccatccgaaccactggcaccggccgagtccgtcctcgaggagaagcacctcacattccaggagaaccagaagggcctctccttcgatacgctgctcggtccctatctcaagggcgcgactacgatcacagtcaccgatccgtacatccgcctgttttaccagatgcgcaacttcatggaatttttggagaccgtggtcaagcacaaggctccggatgaggaagtgtccgtgcatctggtgacgacggaaggcgagttcaaaggcgaacagcagaaggaaaacttcgagaagatgaaggagtccgccagctcggtgggcgtgaacttcacctgggagttcgacagcacgggaactatccatgcccgtcacatcgtgaccgaccacggctggaaagtctctctggatcgcggcctcgatattttccagcgatacgagttgaacgatgcctttacctttgcaaatcggttgcagcaataccgcccatgcaaggcgtttgaggtgacgttcattagacacaagccgaatggagctgcgggggaataa

SEQ ID NO: 3655 - DNA, 2046 bp, Burkholderia sp.
atgcaactcgacgacttggacaaaaaagctacgacggcattcgagggctatgtcgtccgcaaggacctggtgcgcacgttcagtcgccagtttcctgtgccgacctatgttgtcgagttcttgctggggcgctattgcgcaacaaccgatgaagccgagattcaggaggggcttgacatcgtgcagcggcagttggcttcgcgtacggtcaaagcgggtgaagaggaactgtttaaagctcgcgcgcgcgagtccggctccgtgaaaattatcgacatcatcactgcccgcctggattcgaagaccgactcgtacgttgctagtttgcccagcctgcgtctgaacgacgtccgcttgacgcccgagatggtgaaggacaatgagcgcatgttgaccggcggcttctacgccgaagtcacgctaggctacgacgcgtcaattgctcaggaaaaaggcggccgacccttcggtgtggacgcactgcgcgcaattcaactctcgaagcgcgaagtactggacgtgctggccaagggacgcgagagcttttcgaccgccgagtggcgcgacctgctgcttcgcagcgtgggctttgagccggagaccttgcccgagcgcgccaaggatgcgctgctgctgcgcatggtgcctttcgtcgagcgcaactacaacctggttgagttgggaccgcgtggcaccggcaagtctcacctgtttcagcaagtctcgccgtacgcgcatcttatctccggtggcaaggctacggtggcgcggatgttcgtcaacaacgccagcggccagcgcggtctggtctgtcagtacgacgtggtttgcttcgacgaggtgtctggcgtttccttcgaccagaaggacggcgtgaacatcatgaagggctacatggagagcggtgagttctcgcgcggcaaggagagcatccgtgccgacggctccatcgtgctagtgggtaacttcgatgtcgacgtcgagcaccagcagcgtataggccatctgtttggcccgctgccccctgagatgcgcgacgacacggccttcatggaccgcattcactgcttcctgccgggctgggacgtgcccaagctaaacccgagcttgtttaccgagcacttcggcttggtgagcgacttcctgtccgagtgcttcacccagttgcgcaaccagagccgtgtctcaacactacaaagccgcgtctattggggcggctccttatctggccgcgacctgaatggcgtcaacaagactgtcagcggtctgctcaagctgctctacccgaacgctgaaacgccggtaagtgatgaagacctggagtgggcggtgcggctggccctggaggtgcggcgccgcgtgaaggagcagcagaagcgcatcggcgcggccgagttccgcaacacgcatttcagctacaccatgggcgcggaaggtgtcgaaaagtttgtgagcacgcccgaacttcaaagtcagggcggtattggcgatgagccgctggagtgcgggcagatttggacgctgagccccggcggccaggacgagcacccggggctgttccgtcttgaggtcaccgagggaccgggtagcggcgtgagagtgcttaacaacccggtgcactctgcttttaaggaatcgattcgatgtgccgagcagaatctttatgcaagggcgcagcagctggtgggagaccgcgacccgcggtcgcacgagttttctgttcagctacgaggtttcgatgccgcaaaggccggtgcgaagaccggggtggcatcggtcattgcactagctggcgcgttgctgaggaagtcggttcgaggaggtttgattgtcgtcggggaagtgactctcggcggcacaattgagccgattcataacgcagtcacgttggcggaaatcgcggtcgaaaagggcgctcagtccttattgctgccggtgtcttgtcgtcggcagctcttcgagctgtctgacgatatggcgacaaagcttgatatcgagttttatcaggacgtgcgagacgctctgttgaaggcattggcggaatag

SEQ ID NO: 3656 - DNA, 2070 bp, Burkholderia gladioli
atggcagaacccacttcaccacccctggcggagaacgcgaccgtggacacggccggcgatcgctcgctcgacaacctgctgaacgagaagttcgccggtcgagtggtgcgcaaggacctcacgaagttgattaaggagggcgccaacgttcccgtctacgtgctcgaatacctgctggggatgtattgcgcctcggacgatccggagacgattcgcgcaggtctcgacagcgtcaagcgcatcttggcggaaaactacgtgcgtccggacgaggccgagaaggtcaaaagcaagatccgggagctcgggtcgttcaaggtgatcgacaaagtcaccgtcaagctcaacgagagccgcgacgcctatgaggcgctgctctccaacctcggcatcaaaaacgccgaggtgcccgatcactacgtccggcaatacgagaagctgctcgtcggcggcatctggtgcatcgtgacgctgcgctactacttcgaggaaaaccagaagtcgtcgcccttcgcggtggcggatttgaagccgatccagatgccgagcctcgacatgaacgagctgttttcggcgcgcaaaagcttcacggaagagcagtggatcgacgcgatgctccgctcgacggggatggagccgacatgcttcaaggagcgcgtcaagtggcacttgctcgcgcgcatgatccccctggtcgagaacaactacaacctctgcgagttggggcctcggggaacgggcaagagccacatctacaaggaaatcagccccaactccatcttggtctccggcgggcagacgacggtggccaatttgttctacaacatgagcgcccgcaaagtcgggttggtcggcttgtgggacgtcgtggcgttcgacgaggttgccggcatcaacttcaaagaccaagacggcgtgcagatcatgaaggactacatggcctcgggctcgttcagccgcggccgcgactcggtcaacgcgagcgcgtcgatggtcttcgtgggcaacatcaaccagagcgtcgaatcgttggtgaagacgagccatttgctcgcgccgtttcccgacgcgatgatcgactccgccttcttcgatcgctttcacgcctacgtgcccggttgggaaatccccaagatgcggccggagtttttcaccaaccaatatggcctgatcgtcgattacctcgcggagtgggtgcgcgagatgcgcaagcgcagcttcgccgacgcgatcgacaagtggttcaagctcggcaacaacctcaatcagcgcgacaccattgccgtgcgtcgcacggtctcggggttgctcaaactgatttgccccaatggcgagtatgaaaaggagacggtccgccgctgcctcgaatacgccttggagacgcgacgacgcgtcaaagagcagctcaaaaagattggcgggatggagttctacgacgtccatttctcctacatcgacctcgaggacatgcaagagcggttcgtctcggtgcccgagcagaccggcggcggcatcattccggagggccgcctgcaaccgggcgtgctgcacaccatcgcgatggccgaggcggaaatgccgggcgtctaccgcatggaggttcaagcgctcagcggcagcggcaaactctccgtctccggctcgctctcgcgcgagcacgttcgcgtggccttcgactatttcaaggccaacgcgagccgggtgagcgcgtcgattcgtccgacggaacgggactttcacctgcacctggtcgagctgcaaaacaccggcgcgcccgatgcggtgacgctcgcgagcttcatcgcgtttgcgtcggcggcgctggccaagcccttgcagcctcagttggcggtgatgggcgacatgacgttgggcggcacgatcgcccaggcgcggaatctcgcggaaagcttgcaaatcgcgttcgacgccggcgctaagcgaatcttgctgccgatgtccagcgtcacggacattcccaccgtccccggcgagctcttcgccaagtttcagacgagcttctactccgatcccgtcgacgccgtgttcaaggcgttgggcgtcgagtga

SEQ ID NO: 3657 - DNA, 2070 bp, Burkholderia vietnamiensis
atggcagacccaacctcacagcccctggcggaaaaggcgaccgtggacacggttggcgatcgctcgctcgacaccctgctgaacgcgagcttcgcgggacgagtggtgcgcaaggacctcacgaagctgatcaaagagggcgccaacgtcccggtctacgtgctcgaatacctgttgggcatgtattgcgcctctgacgatccggagacgattcgcgccgggctcgacagcgtcaaacgcatcttggccgaaaactacgtgcggcccgacgaggcggagaaggttaagagcaagatccgggaactcggatcgttcaaggtgatcgacaaggtcaccgtgaagctcaatgagagccgagatgcctatgaggcgctgctctcgaatctcggaatcaagaacgcggaggtgccagatcactacgtgcgccaatacgagaagctgctcgtcggcggcatctggtgcatcgtgacgctgcgctactacttcgaggaaaaccagaagtcgtcgcctttcgccgtggcggacttgaagccgattcagatgccgagcctcgacatggaggagctgttttcggccaggaagagcttcacggaagagcaatggatcgacgcattgctgcgctcgacggggatggagcccacgtgcttcaaggaccgggtcaaatggcacctgcttgcccgcatgatcccgctggtggaaaacaactacaacctgtgtgagctcgggccgcgcggcacggggaagagtcacatctataaggaaatcagtccgaactcgatcctcgtgtccggtgggcagacgactgtggcgaatttgttctacaacatgagcgcccgcaaggtcggcttggtcggcttgtgggacgtcgtggcgttcgacgaggtcgccggcatcagcttcaaagaccacgatggcgttcagatcatgaaggactacatggcctcgggctcgttcagccgaggccgggagtcggtgaacgccagcgcctcgatggtctttgtgggcaacatcaatcagagcgtcgaatcgctagtgaagacgagccatcttctggcgccgtttcccgacgcgatgatcgactccgccttcttcgaccgttttcacgcctacgtgcccggctgggaaatccccaagatgaggccggagttcttcacgaaccaatacggcttgatcgtcgactacttggcggagtgggtgcgcgaaatgcgcaagcgcagcttcgcggacgcaatcgacaaatggttcaagcttggcaacaaccttaatcagcgagacacgatcgctgttcgccgcacagtttcgggcttgctcaaactgatttgtccgaacggcgagtatgaaaaggagacggtccgccgatgcctcgaatacgcgttggaagtgcgtcgacgcgtcaaagagcagctcaagaaaattggcgggatggagttctacgacgtccacttctcctatatcgacctcgaggacatgcaggagcggttcgtcgcggtgcccgagcagaccggcggcgggatcattccggaggggcgcctgcaacccggcgtgttgcacacgatagcgatggccgaggccgaaatgcctggcgtctaccgcatggaggttcaggctctcggcggcagcggcaagctgtccgtctccggctcgctttcgcgcgagcacgttcgcgtggcgttcgattacttcaaagcgaacgcaagccgggtgagcgcctcgatccacccgaccgagcgcgacttccacctgcacctggtcgaacttcaaaacgcaggggctcctgacgctgtgacgctggcgagcttcatcgcgttttgctcggcggcgttgagcaaacccttgcagtcgcagttggcggtgatgggcgacatgacgctcggcggcacgatcgcccaagcgcgaaatctcgccgagagcctgcaagtggcgtttgacgctggcgcgaagcgaatcttgttgccgatgtccagcgtcacggacatcccaacggtccccggagagctcttcgccaagtttcagacgagcttctactccgatccggtcgatgcggtgtttaaggcgttgggcgtcgagtga

SEQ ID NO: 3658 - DNA, 1608 bp, Calditerrivibrio nitroreducens
atggacaaacttgacaaaaaaataagtgagctatttccaggcaaaattgtttctaaagaattgggtcaaaagcttaagacaggttataatgccccaaactttgtaatagaatatcttgtgggtatgtactgtgctacaaatgacgaagaacaaataaaagatggaatggaaactgttaaagatatcttaacgaagcattatgtaagagcagatgaaatagaaaaggttaaatatctaatgagagaggaaggatcttataaagtaattgataaagcagaagtttatttagaagaaaaagaagataaatattttatgagacttaaaacaatgcagcttgataaaatacaggtaaaggttgatttgattgaaaaaaatccacggttactaacaacaggtgtatgggggataataacactacaatatttaaggcttgaggaattaataaatgaaaaagtaaatttatttatgccacttgaaaatcaggaatgtatgagttggctttctaatgataatattaaaattattagcgctattcaggatgaagtagtaaataacaaaaaaattaaatacagaccaaaaaatttagaagatccctatttattagaagattttagacctatacaagtaccaaaagtggatttggaagaaatatttgaaaatagaaaagaatttagtttggaagaatggatagattttataatgagaagttgtggtcttgaaccgagctattttaatgaaagacaaaaatttcttttcttgtatagacttataccttttgtggaaaataactacaatttaatcgaacttggaccaaggggtacaggcaagtcttttgtttataaagaaatttcacctaatgcaatccttatttctggaggtaagacaaccgtagctcagctttttgaatgggctggtgttataatgaggcagaatactttaggtttggtaaatttatgggatgtggttggctttgatgaaatttcatataatgtttttaaaaacaaggaaagtatacaaatattaaaagattatatggagtctggttcttattcaagaggtaagaataccagatttgcagatgcttctatggtatttgtcgggaatatagatgaggctatagagaatataattaaagacaagaataaaaatttatttcaatggatagctcaagaaatgcaggatgcagcgtttttagaaaggattcactgctttatacctggatgggagtttcctaaaatgaggccagaatttattacaaaaaaatctggatttattgttgattacttcgctgaatttatgagaagtatgagaaaatataattatacagataaatatgaaaaatattttaagcttaaaaatgcttctcagagagatagtgtggcaatcaaaaggacttttagtgggttagcaaagttactatttcctgaaaatgaaatgacaaaagaggatataaaaaaattattaaagtatgcctgcgaatgtagaaaaagagtgaagtataatttacgtagaatgttgccacatgagtatacaacggattttataggattcactgacatagagacaggagaagaatttgaaatattcgctgaagaagaaattagataa

SEQ ID NO: 3659 - DNA, 2031 bp, Carboxydothermus hydrogenoformans
atggatgaattaagtgcaaaattgaatcagcattttgctggcagagtggtaagaaaagacctgacgaaaaagatcaaggaaggcgctaatgtgcctgtatatgtccttgaatacctcctgggaatgtattgtgccaccgaggatgaggacagcatacgtgaaggagttgaaagggtcaaaagcatacttgcagagaactttgttaggcccgatgaggcggagaaggttaagtcaaaaatccgagagcatggcaggtataccattatcgacagggtaacggtgaaactcaatgaaaagaaagacgtatatgaagccgaattttctaatcttgggattaagggagttgttatgccttcctcgtatgtgaagaattatgagaggcttttagctggtggtatttggtgcatcatcaagatggattattattttgatgaagaacaaaagggttcaagtcctttttgcataaactctcttactcctatacagttgccgaacttagaacttgaagaaataatggtcggcagaaggcactttacaaaggatgaatggattgatgttcttataaggtcgatcggtttagagccgacaaaattgtccaacaacgttaaatggcatatgttagagagaatggttccccttgtagaaaataattacaacctttgcgaacttgggccaaggggaacgggaaaatctcatatttataaagagatatctccaaacagcattttggtttcgggtgggcagacaacggtagctaatttattttacaatatggcttcaagacagataggccttgtaggactttgggattgcgtagcttttgatgaggtggcgggtatttcctttaaagataaagacgcgatacaaataatgaaagactatatggcctcagggtcatttgctcgaggaaaagaggaaaaagccgcaacagcttcaatggtgtttataggcaatataaaccagagtgttgatgcactactaaaaacttctcatttgtttgaaccattccctgaagcaatagctaatgatactgctttttttgatagaatacattattatttgcctggatgggagattccaaaattcaggccagaattcttcacagatgagtatggattcattacagattatttggcagaatttcttcgcgagatgaggaagcgttctttttccgatgcgtttgacaggtattttaagcttgggaacaaccttaatcagagggatgttattgcggtaagaaaaactgtgtcgggacttgtaaagcttatttaccccaatggagaattcgacaaagatgatattgaagaaatattaaggtatgcacttattggcagaagaagagtaaaagaacagcttaagaaaattggcgggatggagttttacgatgtccacttctcatatattgacaatgaaactatgaatgagcagtttgtttctgttcctgaacaagggggtgacaagattattcccgaggggctggggaagccaggtcatgtctatactgttgcacgtggcagaacaggtatgattggggtatataagattgaaacacaggttgtaagtggaagcggaaaatttgaaaagacaggtcttggttcagacagagaggctaaagaggcgattgaaacggctttcagatttttcagggcaaacagcaagaaaataagcggaagtataagtactactacaaaggattaccttatgcatgtggaagatattaatggggtagggcttacatccgaactttcgcttgctgcatttgttgctttgtgttcaggtgcattggacaggccctgccagagtcagatggttattttaggctcaatgagtattggtggtaccataaataaagtcgaagaactggccaatgtgctgcaggtatgtttcgacgcaggagcaaaaaaagtcttaatgccaatgtcttcggctactgacatcgctactgttccgccagaactgtttgccaagtttcagatatctttttaccagtcgcccgaagatgcggtattcaaggctttgggagtggaatag

SEQ ID NO: 3660 - DNA, 2070 bp, Chlorobium phaeobacteroides
atgaacgaacttgaccagaaaatcaacacacacttcccgggactcgttgtccgcaaggatctcgtcaagacggtcaagggcaacgccatcgttccctcctacgtattggaatacttgctggggcagtattgcgccaccagcgatgagccgaccatccagaccggtatcgagacggtcaaggagatcctgcgcaaacattacgtgcatcgcaacgaggcgggtctggttcgctcgaacatcaaggagaaagggcgttacaaggtcatcgacaagattggcgtggccttgaacgacaaggccgacgtctacgaagcggagttttccaacctcggcatcaagaaagtgctggtcgactcgggtacggtcaagacccaccccaagttgctggtcagcggcgtgtggtgcattgccgacatcgaatatgaattcaccgaggacaagaacgccagcccctggatcttgtcgaccctcaagcccattcaactttctcagtttgattttgacagctaccttgaagcccgcaaacagctcaccaccgatgaatggatcgatttactgatacagagcatcggtttcaaccccgagatgttcggcaagcgcagcaaattgacccagttgatccgcctgattccgttttgcgagcgcaactacaacttgatcgaacttggcccgaagggaaccggcaaatctcacatctactcggagttctcgcctcacggcatcctgatctccggcggcgagatcacagttcccaagctcttcgtgaacaactcttccggaaagatcggcctggtcggttactgggactgtgttgccttcgacgagtttgccggaaagcaaaaacgcgtcgacaaggccctggtcgacatcatgaagaactacatggccaacaagtccttctcgcggggcgtcgagacgctgggcgcggaggcgtccatggttttcgtgggcaacactcagcacaccgtgccctacatgctcaaacactcggatcttttttgcgagctgcccgaaaagttctacgactccgcatttcttgaccgtatccatttctatatcccgggctgggaggtcgacatcatccggggcgagatgttttccaacggctacggcttcgtggtggactacctggccgagatccttcgctcgctgcgcaatcacgattactcggaccgctacaaggagcacttctccctctcctcggatatctcgacgcgggaccgcgatggaatcaacaagacattctccggcctgatgaagatcctctttccgcatgacggggcgaccaaggaagagattgaggaactgctgcggttcgcgattgagggccgcaagcgcgttaaagaccaactgatgcgcattgattccacctacggcaacgtccgctttacctatcaagacagtgatggccaggccaagcctgtcaccacgctcgaagaagaggaataccccggctactatcacaagaccatcgcggagggcgaagacggggaaatcttagaagctgcgcaaccgggctcaccccaaggtccatccgaaccactggcaccggccgagcccgccctcaaagaaaagcacctcacattccaggagaaccagaagggcctctccttcgatacgctgctcggcccttatctcaagggcgcaactgcgatcacggccactgatccgtacctccgcctgttttaccagatgcgcaacttcatggaattcctggagacggtggtcaagcacaaggctccggatgaggaagtatccgtgcatctggtgacgacggaagacgagttcaaaggcgaacagcaaaaggaaaacttcgagaagatgaaggagtccgccagtgcggtgggcgtgaacttcacctgggagttcgacggcaccggcacgatccacgcccgccatatcgtgaccgaccacggctggaaaatctccctggatcgcggtctcgatatcttccaacactacgagatgaacgatgcctttaccttcgccaatcgactgcagcagtaccgcccatgcaaggcgttcgaggtgacgttcattaaacacaagcgggaagctgagggggaataa

SEQ ID NO: 3661 - DNA, 2031 bp, Clostridium clariflavum
gtggatgaattaagcaggaaactgaatcaatattttgccggcagggttgtaagaaaggatttaacaaaaaagataaaagaaggtgcaaatgtacccgtatttgttcttgaatatcttttgggtatgtattgtgccactgatgatgaagatgggattaatgagggcgttgaaacagtaaaaagaattttggctgaaaattttgtgcgccctgatgaagcagagaaggtaaaatccaagattagggagataggaaaatataccgttattgataaggttagtgtaaaacttaatgaaaagaaggacatctatgaagccgaattttcaaatttgggaataaagggagtagccatatcacctacatatgtaaaacaatatgaaaaactcctttgtgggggaatatggtgcattataaaaatggattattactatgatgaagaggctagagggacaagcccttttaatattagcaatttgacccccatacaaatgcctaatcttgatatggaagagataataaacggcagaaaatatttcacaaaagatgaatggatagacattctcttaaggtccataggaatggaacctacaagattcgaaaataatgtgaagtggcatcttctggctaggatgatacctttagtggagaataactacaatctctgcgaactggggccaaggggtacgggcaaatcccatgtttataaggagatttctccaaacagcattttggtatcaggtggtcagacgacggttgcaaacctattttacaatatggcttcaaggcagattggccttgttggactttgggattgtgtggcttttgacgaggtagcaggaatttcatttaaagataaagatggaattcaaataatgaaagattacatggcttcgggctcctttgccagggggaaggaagagaagaatgcttctgcttctatggtatttgttggcaatattaatcagagcgtggatgtattgttaaaaacatcccacctctttgaaccgtttcctgaggcaatggccaatgatacagcattctttgacaggatgcattattacatacctgggtgggagatacccaaaatgcgaccggagttttttacagatgaatacggttttattactgattacgtatcagagttcatgagggaaatgagaaaacggtccttctctgatacactggataagttctttaaactgggcaacaacttaaaccaaagagatgttattgcagtaagaaaaacagtttcaggacttgtaaaactcatataccctaacggtgagtttgcaagggacgatatagaagaaatactgcgttatgcactggtaggaagaaggcgtgttaaagagcagttaaagaaaatagggggtatggagttttatgatgttcatttctcatacatagataatgaaacaatgagcgaggaatttgtttcagttcctgagcagggcggtggcaaaataatacctgaaggcatgggtaaaccaggtcatctttataccattgccagagggaaatcaggtatgataggggcttataagattgaaacccaggttatatcaggtaccggtaaatttgaaaggacaggtcttggttccgatagagaggcaaaagaaagtatagagacagccttcaggtacttcagagcaaacagcaaaaatataagcggaagtataagtgttaccacaaaggattatttgatgcatgtacaggatatacatggagtagggatgacttctgaacttgcattggcagcctttgtagcactatgttcaggggcattgggtaagcctccacagagccagttggttgttctgggttcactcagcataggcggtacaataataaaggttgaggaattagcaaatgtgctgcaggtatgttttgattcaggtgccaagagggtgcttcttccaatggcatctgcagtggatattcctactgttccgcctgaattgtttgcaaagtttcagatttcattctaccagagtccagaagatgcggtatttaaggcacttggggtggagtag

SEQ ID NO: 3662 - DNA, 2031 bp, Clostridium clariflavum
atggatgaattaagcaaaaagctgaatcaatattttgcaggcagggttgtaagaaaagatcttacaaaaaaaataaaagagggggccaatgtgccggtatatgtcctggaatatcttttgggtatgtattgtgccactgatgatgaagaaggaatccgggaaggtgttgaaacggtaaagagaattttagccgataattttgtgcgccccgatgaagcagagaaagttaaatctaagataagggaaataggaaaatataccgttattgacaaggttggtgtaaagctcaatgaaaagaaggacgtatatgaggcagagttttcaaatttgggtattaaaggggtagctatatcccctacttatgtaaagcaatatgaaaagctcctctgtggtggcatatggtgtattataaaaatggattattactacgacgaagaagctaaagggacaagccctttcaatataagcaatttgacacctatacagatgcccaaccttgatatggaagagatttttaacggaagaaaaaattttactaaggatgaatggatagatgtgcttttgcggtcaataggaatggaacctaccaggttggaaaacccggtaaagtggcatctattagccaggatgataccgcttgtggagaacaattacaacctgtgtgaattaggacccagaggcaccggtaaatcccatgtgtataaggaaatttccccgaacagcattctggtatcaggaggacagacaactgtagccaatttgttttacaatatggcttcaaggcaaataggtcttgtcgggctttgggactgtgtagcttttgacgaggttgcagggattacgttcaaggataaagacggaattcagataatgaaggactacatggcttcaggttccttcgctcgaggaaaggaagaaaaaaatgcctctgcctccatggtgtttgtaggtaacattaaccaaagtgttgatgtactgcttaaaacatcccatctttttgagcccttccctgaagctatggcaaatgacagtgcgttttttgacagaatgcattactatgttcccggttgggagataccgaaaatgcgtccagagttttttacggacgaatacggctttattactgattatatatctgagtttatgagggagatgagaaagcgttctttctccgatgccttggataaatatttcctactgggtaacaaccttaaccaaagggacgttattgcggtgagaaaaactgtctcagggcttgtaaaactcatatatcccaacggtgaatttacaaaggatgatattgaagagatactgcgttatgctttgataggaagaagacgtgtgaaggaacagctaaaaaagattggcggtatggagttttatgatgtccatttttcctatattgataatgaaacaatggcagaagaatttgtttcggttcccgaacagggtggtggcaaaataatccctgaaggtatgggaaaacccggacatctgtatacagttgcccgagggaaatccggcataataggaacttataagattgaaacccaggtaatatcgggcaacggtaaatttgaaaaaacaggccttggttctgacagggaagcaaaagaaagtatagaaactgctttcagatactttagagctaatagtaaaaatataagcggaagtataagtattaccacgaaggactatttaatgcatgtacaggatataaacggggtaggaatgacttcagaacttgcactggcagcttttgtggctttatgttcaggagcgctgggcaagccgccacagagtcagttggttgtattaggttcacttagcataggcggtaccattaccaaagttgaggaattggcaaatgtactgcaggtgtgttttgattcgggtgccaaaaaagtgttgattccaatgagttctgcagtagatattccgacggttcctcctgaactatttgcaaagtttcaaatttcattctatcagagtccggaggatgcggtatttaaggccttgggcgtagagtaa

SEQ ID NO: 3663 - DNA, 2031 bp, Clostridium ljungdahlii
atggatgaattaagtaaaaaacttaatacctactttcaaggtagagttgttagaaaagatttaactaaaaaaataaaagaaggagcaaatgtcccagtttatgtattagaatatttgcttggaatgtactgtgctacatatgatgaagatagcataaatgatggtgtagagagagttaaaaaaatacttgcagataactttgtaaggccagatgaagcagaaaaaataaagtcaaaaataaaagagctaggtagatatactgtaattgataaagtaagcgtaaagctaaacgaaaagaaggatgtttacgaagcagaattttctaaccttggtttaaaaggtgtagtaatatcatcacattatgttagagaatttgaaaaactattatcaggtggaatttggaatatagttaaaatatcttacttttatgatgaaactgctagagatgtaagcccattcaatattgatagtctaacgccgattcaaatgcctaatttggatattgatgaaataatggaaggcagaaagaattttactaaagaagagtggatagacattttaataagaagtataggtatggagcctacacaattagactatagtgtaaaatggcacatgctagagcgaatagttccacttgttgaaaataattataatttatgtgaacttgggccgcgaggaacaggtaaatctcatatttacaaggaaatatctccaaattcaatattgatttctggaggacaaactacagttgccaatcttttttataacatggcttcaagaaaaattggacttgttggaatgtgggatgctgttgcttttgatgaagttgcaggaattacatttaaagataatgatggaatacagataatgaaagattatatggcttcaggatcttttgctagaggaagagaggaaaagaatgcatctgcttcaatgatttttgtaggtaatataaatcaaagtgtagaagtgcttttaaaaacatctcatctatttgaaccatttccagaggctatggcaaatgattctgctttctttgatagaatgcattattatttaccaggctgggaagttcccaagatgcgtccggaatttttaacggatgagtatggatatataactgattatttatcagaatggtgtagagaaatgagaaagcattcatttactgatgcttttgataagtattttaaattaggaaataatctaaatcaaagagatgtaatagcagtaagaaaaacagtttctggcttgactaaacttatatatccaaatggagaatataataaggacgatattgctgaaatattaagatatgctcttgtaggtagacgccgagtaaaggaacagttaaaaaagattggtggaatggagttttatgatgttaatttttcttatatagataatgaaacaatggaagaggaatttgtatctgttccggaacaggggggcggcaagattattccagaaggtataggtaaggcaggacatctatatacaattggaagaggaagatctggaatgattggagcatataagatagaaacgaaagttgtaaatggttcaggaaagtttgaaaaaactggacttggctcagatagagaggcaaaggaagccattgaaacagcttttagattttttaaagcaaattctaagaatattagtggcacaataagtactggaacaaaagattatttgatgcatgttcaggatattcatggagttggtcttacaagtgaactggctttaacagcatttattgccctgtgttctgctgcaatgaatagaccggcacaaagtcagatagttgttttaggatctatgagtataggtggaactataagtaaggtggaagaactagcaaatgtgctgcaggtatgctttgattctggtgcaaagaaaatattgattccgatgtcatcagcagtggatattggaattgtgccgccagagttatttgctaaatttcaaatatcattttatcagactccagaggatgcagtgtttaaggcattaggagtggaataa

SEQ ID NO: 3664 - DNA, 2067 bp, Clostridium saccharolyticum
gtggaagaatttaaattcgaagaagtggacaatccaaatgctgcccttaacaaaaaactaagacagttttttgatggcaagattgtccgaaaggacttaacaaagtccataaaagaaggggcaaatgtccctgtatatgtattagagtttttactcgggcagtattgcagctcagatgatccagagatcatcgaagaaggggtcaagacggtaaagaggatactctctgagaactttgtaaggccggatgaggctcagaaagtattgtctattctgcgtgaacggggtagctatacagtaatagatcgaattactgctaagctcaacatcaaagaagatcgatatgaggctgagttttcaaatcttggagttcgagaaatccttcttgctccgagctatgtatcagaatatgatcgactcttgtgcggtggaatctggtgtatcgttcagcttgaatatgagtatttggaagaagatagacgagctaatcctatcagggttcgaaaactgacacctatccaaatgccgcacatcgagcttgatgaaataaagcaagcaagaagggaattcacaaaagaagagtggctgaatgttcttattcgttcaacaggtatggaatcggataagttctctactcgtgagaagtggttgttgcttgctcgtatgattccactcgtggaaaacaatttcaatctatgcgaattgggtcctagaagcaccggtaagtcccatatttataaagagatatcaccaaatagtattctcgtatcgggggggcaaaccacggtcgcaaacctgttctataacatgtccaataaaacagtagggcttgtaggtatgtgggactgcgttgcatttgatgaagttgccggaatcacatttaaagataaagacggcgtacagatcatgaaggactatatggcatctggttcttttgcacgaggcaaagaggaaaaggctgccagtgcttcaatggtctttgtgggtaatataaatcaaagtgtggatgtattacttaaaacgtctcacttatttgagccgtttccagaagttatggcatacgatacagcatttttggatcgtatgcattgctatgtgccgggatgggagataccaaagtatagaccggattttttcaccaacgagtatgcattcataaccgattatttatcagaatttatgaaggaaatgcgaaaagaacagtatggcgatgcctgcgataaattctataaattcggctctaatttaaatcagcgtgatgttatcgctgtcagaaaaatgatttctggctttaccaagctcctgtatccaaatggagaattcactaaagaggatatggcagaaataattactgtttcgcttgaacttcgtcgccgtgtcaaagagcaactcaagaaaattggcggtatggaattctatgatgtaaatttctcttatgttgataatgaaacatttgaagaacactacgtcccggtacctgaacaaggtggaggtaagcttattccagaaggaatgactaaccctggccatgtttatactgtatcaagaggtaaatcaggcatggtcggtgtctaccgcctagagacacaagtgttgcctggaaatggcaagtttgaacgtacaggacttggatcagatcgtgatgccaaagaagctaccaatacggcattcaactacttgaaagccaatggcaggcatattagcaattcagtcagcactacgaccaaggactatatgattaattatcaggacttaaatgggattggtataacaaagactttaacactcccaaccttgatagcaatatgttcggcagctcttcaaaaaccaactctttcaagtcttgccgtacttggagaaataagtatcagtggcactattcaaaaggtcgaagagcttgcaaacactttgcaggtatgccttgatagtggtgctaaaaaggtattgattccaatcacttcagctgttgatatggcaactgtacctccagaactcatgggagcattcagtattatattctacaatacgccgcaggaagcggtctttaaggctttaggagtggagtaa

SEQ ID NO: 3665 - DNA, 2121 bp, Clostridium saccharolyticum
atggaaatgatggatatggcggcagacgatacccgtgaagaactgcgccggaagctgcgtagcaactttgacggtcggatcgtccgcaaagacctgacaaagaaaataaaagaaggagcaaatgttccagtctatgtgctggagttcctgctgggtcagtattgtagttcagacgatgagacaatcattgagcagggcgttcagaatgtgaaacgcattctggcagacaattttgtccgcccggatgaggctcagaaaattctctcccagctgcgcaagaacgggagtcataccattattgatatggtgacagtacatctggacatcaaaaaggattgcttttttgcagagttctctaaccttggtctcaccaatgtgccgattacggatgattatccggaaaaatatgaccggttgctttgcggcggtatctggtgcatcgtgcagctggaatatgagtctgagggagacagcagctttggaatcacggatatagatggacagccgatttcctctaaacagaaaaagcagaaggacatctctcccatcagcatccataagctgactccgattcagatgccccatatcgacattgaagaagttcgagagggacgcaaggcattcacacaggaagagtggatggatggtatgctgcgttcctgcggatatgagccggaacagctgaacaatcgggaaaagtggctgctgcttgcgcgtatgttaccgctggtggagaacaacttcaatctctgtgagttggggccgcgcagcacaggcaagtcccatatctataaagaaatcagcccgaacagtatcctggtatccggtggtcagacgaccgttgcaaatctgttttacaatatggggcgcaaaaccgtaggtttggtaggcttatgggactgtgttgcctttgatgaggttgccggaatcaagtttaaggacaaagacggcattcagattatgaaggactatatggcttccggctcctttgcccgtggcaaagaggaaaaggcagcgtcggcatctatggtctttgtaggaaacatcaatcagagcgtggatgtgttgctcaagacttcttctctgtttgatccgttcccgccggagatgggaacggacaccgcttttcttgaccgtctgcattgctacattccaggctgggagattccgaagttccgtccggagcattttaccaacgactacggatttatcacggattatctggcagagtttatccgagaactgcggaaagaacagtatggtgatgcgttggataagtatttccgccttggaaagaacctgaaccagcgcgatacgattgctgtccgcaagattgtaggcggctatgtgaaattgctttatcccgatggagagttcacgaaggaacagattgaagaaattcttgtatttgcgctggaaatgcgccgtcgtgtcaaggaacagctgaaaaagctgggtggaatggagttctatgatgtgaactttagctacatcgaccttgatacctttgaagaaaaatttgtttccgtgccagagcagggcggtggaaagctcatccccgatggcatctgcaatcctggacaggtatataccgtaagtcagggcaaatccggcatgatcggcgtattccgccttgaaagccagatgctgcccggtaacggaaaatttgaacgcactggtcttggcagcgaccgtgactgcaaggaatccacgaatacggcgttcaatttcctgaaagcaaacggaaatcgaatcagtggtagcatcagcaccacgatgcgggattacatcatcaactatcaggatttacagggcattggcatgaccggaaagctggcattgcctacattgattgcactatgcagcatcgctcttggacggcctacggtcagtacacttgccgtgctgggagaaatcagtattagcggcacgattctgaaagtggacgagcttgccaatagtttgcaggtgtgcctcgatagcggagcaaagaaagtgctgcttccgattaccagtgcagcagaccttggcaccgtgccgccggagctggtgggcagttttaatctgattttctacagcagtgcggaagatgcggtgtttaaggcgttgggggtagagtaa

SEQ ID NO: 3666 - DNA, 2061 bp, Clostridium sp.
atgacggaatttatggagagcgaagataaaagatctgtcataaggaataagcttcgccagcactttgacgggaagattgtccgcaaagatctaaccaagaagataaaagaaggagcaaatgttcctgtttacgtgctggaattccttttgggacagtattgctcatcggatgatccggaggtcattgagcagggagtagagaacgtaaaacgcatcctggccgataactttgtgcgaccggatgaagcccagaagattttgtcgatgcttcgccagagaggcagtcataccgtaattgatatgattacagtgaatctggatatcaagcatgactgctatgtggctgagttttccaatctgggcctgaaggcagttccaatcgatgaggaatatccgacaaaattcgacagacttctctgcggaggaatctggtgtattgtgcagctggattatgagtttatcgaggaagaatgtaatggcacaccaattcatatccggaagctgacaccgattcagatgcctcacgtagatatcgatgaactgaaagaaggacgtaaagccttctcgaaagaggaatggatcgatgttcttctccgttccatcggtatggaaccggatgagctgaattatcgagagaaatggctgcttctgacaagaatgctgccgctcattgagaataacttcaatctgtgtgaacttggtccaagaagcaccggcaaatcacacctatataaagagatttccccgaacagcattcttgtgtccggcggacagaccacagtcgcgaatctgttttacaacatgggaagaaaaacggtcggactggtcggcctttgggattgtgtagccttcgatgaagttgccggtattcgctttaaggacaaggacggcatacagatcatgaaggattatatggcttccggatcctttgcccgcggcaaggaagaaaaggcagcctctgcttctatggtctttgtcggcaacattaatcagagcgtggacgtgcttctgaagacttctagcctttttgatccattcccgccggaaatgggaacagatacagcgtttcttgatcgtatgcattgttatatccccggctgggagattccgaagttccgtccggagcacttcaccgatgattatggtttcatcactgattatctggctgaattcgtaagggagttgcgaaaagagcagtatggcgatgccttagacaagtatttccgcctggggaaaaacctgaaccagcgtgatacgatcgctgtccgcaagatggccggcggttttgtaaagctgctttatccggacggtgtgttcacaaaagaagatattgaagaaatcctgacgatttcgctggagatgcgtcgccgtgtcaaggaacagctgaagaagttgggcggcatggaattttatgacgtgaatttctcttacatagacaatgaatctttcgaagagaaatatgtaagcgtaccagaacagggcggcggaaagttgattccagaaggtatgtgtaatcccgggcaggtttataccgtgtcgcagggcaagtccggcatgattggtgtgttccgtctggaatcccagatgctcccgggcaacggcaaattcgagaggaccggcctgggatccgaccgggagtgccgtgaagcttccaatacagccttcagtttcttgaaagccaacggaaaccggatcagcggagccatcagtacgacaacaaaggactacatcgtaaactatcaggatcttcaggggatcggcatgaccggtaaactggcacttccgactttgattgcgttgtgttctattgctctgtcaaagcctacagtcagcagccttgctgtgctcggcgagattagcataagtggaacgatgatcaaggttgatgagctggccaattcgctgcaggtatgcctggatagcggggcaaaaaaggtcttgctgccgattacgtctgcaggagatctcggcactgtcccggcagatctcgtgggtagtttcaatttgattttctatagcagcgctgaggatgcggtgtataaggcgctgggtgtggagtaa

SEQ ID NO: 3667 - DNA, 2109 bp, Cupriavidus necator
atgaacctgccagatgcactcgaccagaagctgacatcagcctttgatggcaaagtggttcgcaaggacctgctccaccgcatcaagaagggcaccaacgtgccgaccttcgttctggagtttctcctggcacgcttttgcgccagcgacgaccaagcagagatggacgcgggcatggaagcggtgttggcaacactgcaggacaattacgtccggcccgatgaggccaatgccgcgcaatccaaggttgctaccaaaggcaagcaccgcttcatcgacaaggtgcacgtccgctatgtcgaaaaagaaaaacgccactgggcgtcgctggagaatttcaattcgcagcgcattgcaatcggtgagaagttttaccgggacaacgaccgactgctggaggggggcatttgggccgaggtgactctgtcgcacaacgacatcgaggaagacgactacgctttctacatcgaggacctacgaccgatccagctttctcgttttgatttcgagcgttatgctgagggccgcgccactttcacccgtgatgaatggctcgacgtgatcatgcggtcggtgggcctcgagccatccaaactctcacatagggtgaagatgcacttcatcgcgcgtcttgcagccttggtagagccaaactacaactatattgaactcgggccgcgcggcaccggcaagtcgtacttcttcagtgagttctcgccctacgcaacactgatttccggcggacaggctaccaaagcgaccttgttttacaacaatgcccgacgcaaggtggggttggtcggctattgggataccgtcgccttcgatgaggttggcggaatcaaggtgcgtgatccggataccatccagatcatgaaagacttcatggcaaacggccgcttttcgcgtggggcagaggtcattgccgatgcaagccttagtttcgtcggcaatatcgacttgtcggtgcaacaggtggtgaactccaccgaatacgatctcttccagcccctgccccccgagctggatctcgctgtgatggaccgcttcgccgctttcattccgggctgggagatgcccaagaacagcagcgagttcctgacgagccgctacggattcatcacggactacctggccgaggccttccactaccagttcaaacacaccaaccggtacgaagaagtgagcaagcgaatccggcttggcaagtcgatcgagggccgcgacgagaaggggatcaagaagacggtctgtgcatttttgaaaatcctgcatccgaccggcgctccgactgaccaagagttcgaagagtacgttgcctatgccgcggagtgccggcgacgcgtgaaggaacagatgaacaagcgcaaaccagacgatgagtttgcactgatcaatctgtcttacttcaaggcggcaggggaggaggttgtggtcttctgtccggagtcgaaggatgctgcagcgacacagcagccggctcgccgccgattgaatcaatcagtggagcaactgggttcggttgtggaagagaaggcaggcgctgaacacgcaccggccgttgaggcggagccttcagcggaccccacggcgcttgcgccggtttctgcgggggaggcacatacgccgacaacggtcgagctaaaggaacagcacttcagcatcctatatggcgacaccggctacagttatgagtcgatcctggggccgtatttgcagggagcgaaggtcgtagtcatcgaagacccatacatccgcctccagcatcagatccagaactttgtgcgcttctgcgaaactgtcctgaagtccaacacggtgaagaagatcaatctaatcaccgggtacgacgacaagacccagctcgcggaaatcgccgaaaagatggaagagcttaagcagagccttttggaactggacgttgaacttgaagtcaagctcaaccccaatatgcacgatcgcgagattcgcctcgataacggatggatcatcaagatcggtcggggcttggacttctatcagaagcctggcagctggttcgaggtgggcgcgactgatctgagcttacgcaagtgccttgaaaccaaggtagatatttttcgcgcgtaa

SEQ ID NO: 3668 - DNA, 2013 bp, Cyanothece sp.
atgagtaatcttgagcaaaaaataaatcaatattttgaggggttagttgtcagaaaagaccttgttaaagaagttagaggcaacgccattgttccttcctatgttttagaatatttactaggacagtattgtgctacccatgatgaagcctcaattcaaacagggattgaaacggttaaagagattttgcggaggcattatgtccatcgcaacgaagcaggattaattcgctccaatataaaagaaaaaggacgttacaaaattattgacaaaattagcgtcactttaaatgataaagcagatgtctatgaagcaagttttgccaatttaggaattaaaaaagttttagtagattcaactacagtcaaagctcaccccaagcttcttgttagtggagtgtggtctattgctgatattgaatatgaatttgaagaagataagaaggcctgtccttggcttttaaattctctaaaacccattcaattatctcactttaactttgatagttatttagaagctcgtcagcaatttagtaccgatgaatggatggatttattaattcaaagcatcggatttaatcctaattttttaggacgaagaagtaagctaactcaactcattcggttaattcctttttgtgagcgtaattataatttaatcgaattgggaccgaaaggaacaggaaaatctcatatctattccgaattttcccctcatggaattttaatatcaggaggagaagtgactgttcctaaattatttgttaataacgccactggaaaaataggtctagttggctattgggatgtagttgcttttgatgaatttgctggcaaacaaaagcgagtagataaagctcttgtcgatattatgaaaaattacatggccaacaaatctttttctcgtggaattgaaacattaggcgcagaatcttctttagtatttgtaggaaatactcaacataccgtaccttatatgcttaaacacagcgatttatttgcagatttaccgcaaaaattttatgattctgcttttcttgatcgtattcacttttatattcctggttgggaaatggatattatccgaggcgaaatgttttcctctggttatggttttgttgtagattatctggctgaaattcttagatatctacgtaattatgattattcagaccgttatcaaccttatttttctctgacttctgacatatcggccagagatcgtgagggaattaataagactttttcaggtttaatgaaactgctttttccgtctggggaagcaacctcagaagaaatagaagatattctaaaattagcgattgaaggccgaaaaagagtaaaagatcagttaattcgtatggataatacttatccgcctgtttgctttgcctatctaaatcaatcaggaaactcccatagtgttcctactcttgaagaacaagaatacccacaatactatagcaaaactactccaacggatatagagacaatcacttcccctctagagtgcaacagttctgagaacctcaaagaacaaacgataactattcaagacaaccaaaaaggaatcacctttgactatttatttggtccctatcttcaaaatgtgaatcaactcactgtcatagaacctcatcttaaaaactcacctcaattagacaatttttttgagttgttagaaaccgttatcaagtttaagtcaacagatgaggaaatgttagtccatctcattactactgaagatgagtttcaagttgaatttcaacaagagactttcaataatctggctcaatcttgtttgtcagttggcattcatctaagttgggaatttgactcgactaaaacccaagaaggctgtcaaattatcacggctaatggctggcagatcagtcttagtcagggtctagacatatttcaacaacgtgataagaacaatgctttttcttttgccaatcgacttcaactattaagattctgtaagaattgtcaagtaaactataaacgcacataa

SEQ ID NO: 3669 - DNA, 2031 bp, Dehalococcoides sp.
atgcaacaggatgacttagataaaaaagtaacgagcatattcgccggaaaagtagttaggaaagatctcctccaccaaatcaagggcggcgagaacgtaccatcgtacgtgcttgaatatcttcttgggaagtattgtgcctcagataacgatgaggaaatacgcattggagtggacgcggtcaaagaaactttaacaacgaactacttccgccatgacgaggcgaataaggcacaatcaatggtcgaacagaagggcaagcatcggttcattgaccggatcgaagtacgctttctaccaagtgaaaataagtattgggcgtcaatggaccacttcggatatgccaggattcacattcctgaagagttctaccgccgctacgaacggcttctcgaggggggcatttgggctattgtagacgttgaattcagactatctgaggagggaaagaaagacagtccctttcatgtcgtcgacctcaagcccattcagctcgctcgttttgacttggatgagtacttggatggaagacgcgacttgagtagagatgagtggattgaccttctccttcgtagtatcggcttagaaccagtaaggatggataggcggttgaaaatcctgcttatcacccgattaatcccgtttgtcgagaagaattacaattttatcgagctgggaccgcggggaactggtaagtcttatgcgttcagcgagatgtccccgtattgcatgttgctctctggcggcaaggctagcactgcaaaccttttttacaacaatgcacgccggcaagttgggcttgtaggtcattgggatgtcgttgccttcgatgaagtcggagggatgaagatcacagacccagatgcaatccaaattatgaaagactatatggctaacggccggttcagccgtggggttacacaagtgctggcagacgcatctttggtattcatcggaaacttgaacaatcctgtagaaagcctagttcaaaattcggccacagatcttttccagccattgccaaaggagtttgatctcgccgtccttgatcgtattcatttttaccttccaggttgggaagtgcccaagaactcgaaggatatgttaacggttcactatggattcgtaaccgactatctggctgaggctttccgtgcgctacgaaagcaaaaccgtttcgatgaaacagaacgtgtcttccgattcggttcgcatgtcgaaggccgagacgctacggctgccaagaaaaccgtgagcggtttgctcaaaatcctacatcccggcggggaatggacaaaagaggaacttacagaatatctagagttggcaatggaagggcgtagacgtgtgaaggagcagcttaagaaacgcgggtcatttgagttctataaaacaagtttctcatacattaatcttgaaaacgatgcagaacgatccgtgggtgtacctgagcaaggcggagctggagtgatctcgccggatcctttgccagcagggacagtctacactgcctcggtggactccgaagctaaggtcggattatttcggattgaaatcacgttgacggcgggcacgggcaagctcaggactccgaccggactcgaaaagtcgctcaaagaatcattgaatcgagccttcagttacctgcagaacgtcaaagataagctcggactcacacagatgctggcacaaaaggacatctatgctgaagccgtggatctctctggaggacgaatcgattgtccttgcggcgtagcgtttttctccgccattatttcggccgtccgcggccgccaagtgcaggctggaacggtcgttgttggtgacctgactattcaaggcaatatcaaaggacctgcctctatcacagaaccgttgcaattatgtctggaagctggagccgctcgcgtgttggttcctgtttcaaacaaggcacagttcgctggattaccggaagatgtgattgaacgcttggacgtcgtgttctatggggacatagatcgagcggtgttgaagacgctggagacatga

SEQ ID NO: 3670 - DNA, 2121 bp, Dehalogenimonas lykanthroporepellens
atgacaaacgatgcgttggacataaagttacttgatgcgtttggcggaaaggtcgtgcgcaaggaccttctgcatcgcatcaagaaaggcacgaacgtccccacgtttgtgctcgagtttctattagcgcgttattgcgccagtgacgatgcagccgaaatacaggaaggactggaggctgtcattgccaccttgcaagataactacgtccgtgccgatgaggcaaatgctgcccagtcaaaggtggcgaccaaaggaaaacaccgatttttcgataaagtccatgtgcggtatgtagagaaggagaagcgccactgggccgctctggaaaacttcaattcccagcggattgccatttcggaaaagttttaccgcgacaacaatcgtctacttgaaggtggtatctgggctgaggtgactctcggctataacgagatcgaagatgacgactacgctttttacattgaagatttaagacccattcagctgagccggttcgattttgaaggatatgccgagggacggaagccgttcagccgcgacgagtggttggacatcgtcctgcgatccgttggtctggagggcagcaggctctctcaccggctcaagctgcacttcgtggccaggttggcccctctggttgagccaaacttcaatttcgtcgaactgggaccgcgaggcacaggcaagtcctatttcttcagcgagttttccccatactccaccttgatcagtggcggacaggccaccaaggcgacgctcttttacaacaatgctcgaagccgcatcgggcttgtcggattctgggacacggttgctttcgatgaggttgggggcattaaaatcaaagacccggacaccatccagatcatgaaggattacctcgcaaatggacggttttcgcggggagtcgaggtcatcgcagatgccagcatggcctttgtcggcaacatcgactactccatcgagcaagtagtgaactctaccgaacacgacttgttcatgccgttgcccaaggagttcgatcttgctgtgatggaccgctttgcctgttatctgcccggctgggagatgccgaaaaacagcagcgattatttgacttcaaactatgggttcatcacggactacctggccgaagctttccattatcagttttctcataccaatcgctatgaggaggtcaccaaacggattcaactcggcaaatcggtcgaagggcgcgacgaaaagggcataaagaagactgtttgtgccttgctgaaaattctccatcctgatggtccgccgagcgacgccgagttcgaggaatacgtggcttatgcggtggaatgccgccgccgggtcaaggaacagatgaataagcggaagcccgatgacgaattcgccaatatcaatatgtcttaccggacagctgatggtcgcgaggtcgtcgtgttttgcccagaatcccgcaacgcaccggcgactcagcatccattgcgcagaacactggcaaacgaacccggtagtgatgtcgaacccgtcatttcaaaagagagtgttacggcgtcaattccagactcgccaccaccggctgagaatccggttgacctgccagcaaccatcgcgccggaacaagagcaatctcctgtcgatctagggccaagcgagcggcatttcacaattctgtatggcgacacagggcacagctatgaatccataatcgcgccatacgtcaagaatgcccgggagatcgttgtcgaggacccgtatataaggctgactcaccagatccagaattttgttcgcttctgtgaggccgtcttgaaacattcctcggtaaaacggatcaagttgatcacaagctatgacgacagcacaaacatgatggaaataaacgaccggcttggtgaattaaagcagagcctgttggagatggatgttgttctcgatatcgacctgaacccgaacatgcatgaccgcgagattcgtatcgataacggctggatcatcaagatcggtcgaggactcgatttctatcaaaaacctgccagttggttcagcatcggggcaaacgaccttaatttaaggccatgccttgaaacaaaggtggatattttccagaagaaaaacacggagtga

SEQ ID NO: 3671 - DNA, 2076 bp, Desulfitobacterium hafniense
atggatttagaagaggctagctatacatcggaaacagatgatgcgaatgaggttatctatcgtaaactgcgcgagcatttcgacggcaagattgtccgtaaagatttgaccaaggcgatcaaagaaggcgcgaatgttcctgtctatgttttggagtttttacttggtcagtattgcagttccgatgatccgaagatcatcgaggacggcgtgagcaacgtcaagcgaatcctctcggagaactttgtgcgccctgacgaagcccagaaggtactgtccggattacgcgagcgtggcagttatacggtcatcgaccgcataaccgtgagcctaaacataaaactcgatcgttacgaagccgacttttcaaacctgggcgtccgcaatatccccatatcgtcgggctatgtatcgaagtacgaccgcctgctctgcggcggcatttggtgcattgtcgggcttgaatatgagtatgtggaggaagacaagaagtccaccccgatccgaatcgtgaaacttacacctatccagatgccccacatcgatatggacgaaataaaaaacggtcgtcgcgcctttaccaaggacgagtggattactatcctgctccgttccacgggtatggaggcagaccggttcagcgatagggagaagtggctgcaactcacccgtatgcttccgctcattgaaaacaactttaacctttgcgaattgggaccacgtagcacgggaaagtcgcacctttacaaggagatctctccgaacagcatactcgtgtccggcgggcagaccacggttgccaatctcttctataatatgtcgagcaagcaggtgggccttgtgggcttgtgggattgcgtggcttttgacgaggtcgcgggcatcacgttcaaggacaaagacggcgttcagatcatgaaggattatatggcttccggatccttcgccagaggcaaggaggaaaaggcggcttccgcttcaatggcttttgtgggcaacatcaatcagagcgtggacgtgctgttgaagacatcgcaccttttcgatccgtttcccgaagtgatggcgtatgatacggcctttcttgaccgtatgcactgctatatccctggctgggagataccgaaataccgccccgaatcatttacaaacgactacggctttatcacggactacctcgccgagtttatgcgagagatgaggaaagagccgttcggcgacgtgtgcgacaaatacttccgttttggcagcaacttgaatcagcgtgatgttatcgctgtccgcaagatcgtgtcgggcttcgccaagctgctctatcctaacggtgagtttaacaaggagaacattgaggaaatcctgaccttcgccctcgaaatgcgacgccgcgttaaagaacagttgaagaaaattggcggtatggagttttacgacgtgaacttctcttatatcgacaatgagtcctttgaagaacgctatgtttcagtgccggaacaaggcggcggtaagataatccccgaagggctgacgaatcctggtaatgtgtataccatctcgcaaggcaaaagtggaatgataggcgtttaccgccttgaaacgcagatgctccctggtaatggcaagttcgagcgcacggggttaggcaccgatcgtgatgcaagagaagccacaaatactgcgtttaacttcctgaaagccagtgcttcacatataagtggctctatcagtacgaccacaaaggactacatcatcaactaccaagacctcaacggtattggaatgacgaagttcctgactctgccgaccgttattgccctcgcatcttgcgctctcggcaagccgacactttcgaaccttgcggtgcttggcgaaataagcataagcggtacgatactaaaggttgaggaactggcgagtgttctgcaagtttgtctcgatagcggagcgaaaaaagtgctgataccgataacatccgccgctgaacttggtacggttccggcagatttgataggagcgttcagcctgattttttactcaacaccacaagaagccgtgttcaaagctttgggtgtggaataa

SEQ ID NO: 3672 - DNA, 2052 bp, Desulfobacula toluolica
atgacagcgcttgatgacaagataaatgaacatttttcaggactcgttgttcgaaaagatctggttaaaacagtcaaaggcaacgccattgttccttcctatgttcttgaatatctgctggggcagtattgtgccacggcagatgaagaaagcatcaaaacagggattgatactgttaaagatgtcttaagaaagcactatgttcatcggaatgaatcaggattgatcaagtctgttatcagggagaaaggccgtcataagattattgataaagtcagtgttgcccttaatgatgcaaaagatgtatatgaagcatcttttgccaatctggggatcaaaaaagttttagttgattcagatacggtaaaaaaacatcccaaacttcttgtcagcggggtctggaccattgtggatatggagtatgaacatttcgaggacaagtcaacctcaccctggatcatcaacaaactcaaacccatccagctttcgcattttaattatgataattatattgccgcaagaaaacagttcaacacggatgaatggatagaccttttggtccaaagtatcggttttaaccctgaaaagctgggcaaaagaagtaaacttctgcaattggtccgtctgataccattttgtgaacgaaattataacctgattgagcttggcccaaaagggacaggcaaatcgcatgtcttttccgacttttctccccatggtatcctgatatcaggcggagagatcaccgtacccaagttgtttgtaaacaataattccggtaaaatcggccttgtaggatattgggatatagttgcatttgatgagtttgcaggtaagaaaaaaagagtgaacaaagcacttgtggatatcatgaaaaattacatggccaacaaatccttttcccggggggtggagaccatcggtgcagaagcatccatggtatttgttggaaacacccggcatactttgccgtatatgctcaagcacacggatctctttgatgaattgccggaacagtattatgattcagcgttcctggatagaatccacttttaccttcccggctgggaagtggacattatccgtggagagatgttttccaatggatatggatttgtagtggactatcttgctgaaatcttaaggtcactcagaaaccatgattactcagacctgtatgctcaacactttaacctggtaagcgatatttcaaccagggataaggacggtataaataaaaccttttccggcatgatgaaaattttatttcctcacaaagaggcaactgaaaaagagataaaagaggtgctgcagtttgcaattgaaggcagaaaaagggtgaaagaccaactgatgaaaattgattccacctatgctgctgtaagatttgcatacacctgcaatgatggtggaaaaaccatccatgtgaagagccttgaagaggaagagtatcctcagtattttggttcgtttcaagacaaagaatctgaaactgaaattgatccgcaacaacttgagcagcccaatgttcaagacgctgccaaggaaaaattatccgaactcaaagaaagacaggtcattgtgcaagaaaatcaacgtggcgtaacatatgacaagctctttgatcagtatctccagggtgccagaaaaataacagtgacagattcatatatccgtattttttatcagatcagaaacttcatggagtttcttgaaaccatagccaagatcaaacctaaagacgatgaagtgaaagtccacctgataacggcggaagatgaattcaaaggcccgcagcaggtggaaaatttcatgaagatccaggagaattgcgccatagccggagttagattttcgtgggaatttgatgaaaaccagatcctccatgcgcggcatattgttaccgaccatggctggaaaatcctattagaccggggccttgatatttttcagcactatgaaatgaatgattcgttctccctgagcaaccggcttcagcaatatagatcctgcaaggcttttgagatcacctatttgagagttgacagctga

SEQ ID NO: 3673 - DNA, 2046 bp, Desulfomicrobium baculatum
atgaatttggacgcaattgatcgcaaagcggcctcgacgtttgaaggttatctggttcgcaaggacctggttcgaaccttcagcagacagtttcctgttccaacctatgtcgtagaatttttgctcggcaggtattgcgccagtatcgatcaggatgagatcgatgaaggtctgggcattgtccaacggcaactcctggatcgcaccgtcaaggctggcgaggaagaacttttcaaatctcgcgccagggagaagggacaggtcaaaatcatcgaccttgtatccgcccgtcttgatgccaaatccgattcctacctggcgaccctgcctagcttaaggctcacagacgcacgcattgaggccgccgttgtcagcaaacacgagcgcatgctgaccggaggcttttacgctgagatcacacttggctacgacccgataattgcccaagaaaaaactggacgccctttcggaattgacggtttgcgggagatccaactttcgaatcgagatgtcctggagaaacttggcgaagcaagagcacagttctccaccaaggagtggaagacattacttctgcgctcaattggcatcgaggattccgcgctgtcggaacgacagcaaaatgccctctttttgcgtatggttccttttgttgagcgtaacttcaatatggtcgaacttggtcctcgtggaaccggcaaaagtcatctattccagcaggtttctccttatgcccacttgatatccggtggaaaggctactgtagccagaatgttcgtgcatatgggcaccggacaaaaagggcttgtttgccaatacgatgtcgtctgctttgatgaaatttccgggatatctttcgaccagaaagacggcgtaaacatcatgaagggctacatggagtccggtgaattcagccgtggaaaggagagtatcagggcggacggaagtgttgtcatggtaggcaacttcgatgttgacgtggaacaccagcaacgggtcggccatctttttggcccaatgccagccgaaatgagggatgacactgccttcatggaccgattgcacgcattcctaccaggctgggatgtacccaaaatcagcaaggagctgctaaccaatcatttcggattggtcagcgatttcctttcagagtgttggacccaactccgaaatcagagccgtgtctcacagcttcaaaacagagttttctatggtggcgcactgtcaggtcgggacaccaatgccgtgaacaaaaccgtgagcgggctgcttaaacttcttcatcctgacggcacacaacagattccagaggaagacattgaatgggcggtcagaatcgccatggaatctcgaagacgcgtaaaggaacagcaaaaaagaatcggtgccgccgaattccgaaatacccatttcagttatgtgatggggacggacggtgtggagaaattcgtttcaacaccggaacttcaaagcgacaacagcatcggaacagatcctcttgagcctggtcaagtctgggccatcagcccgggtggtaatggcgaaaatcctggactctaccgaatcgaagttaacgaaggaccaggctctgggctgaaggttctcaacaaacctattccaccggcattccgggaaagcatcggatgcgccgagcaaaatctctactcacgggcaagccaactggtcggagacaaagacccaaggcaccacgaattcacagctcaacttagggcctttgatgcctcaaaatcaggagccaagatcggagttgcggctctggtggcgttatgcactgccctgctcaaaaaaagcgtgcggggcgggcttatactggtaggcgaaattaatcttggcggttcaattgaatcaattcataatccagtaaatattgccgaaatagcagtggaaaaaggagcgacgtctcttttaattccagtttcatgtcgaaagcaattattcgatttatcagatgatatggcgacaaaagtcgatattcagttctattctgacgctaaagatgcgttattgaaagcaattattgaataa

SEQ ID NO: 3674 - DNA, 2061 bp, Desulfosporosinus meridiei
gtgagcgaattagaaatgggaattaaaaacgtttcagaactgttggaaaagctgaaaacacatttttccgggaagattgtccgtaaagatctgaccaagaaaatcaaagaaggggccaacgttccggtttatgttttggaatacttgctggggatgtattgctcttcgatggatcaagaggaaatcgacgctggggttcagaacgtaaagcagatactggccgagaattatgtgcgcccagatgaagcccaaaagattatttccaagcttcgagaaagaggcagctatacggttattgataaagtatcagtgaaactgaattataagaacgatatttatgaatctgagttttccaatctcggcataaaaaatgtcccgcttgccgagaagtacgtatctgattttgaacgactgctctgcggcggtatatggtgtatcgtacagatggaatatttctatgatgaggccgataaaaaccgctgtccgtttatcatccgcaagctaaccccgatccagatgcccagtttggatattgatgaagttaagtctgccagagcgaatttctcagatgaggaatggatcgacctggtgctaagaagcaccgggatggaaccgtcccagtttgataagcgagttaaatggctgcacctagcccgtttgatccccttgattgagaacaactacaacttctgcgaattggggccgagaggaaccggtaagtcccatatttataaggagatcagcccgaatagcattctcgtttccggcggtcagacaacagtggctaacctgttttacaacatgggcagcaagacggttggactcgtgggcttatgggattgcgtagccttcgatgaggttgccgggatcaagttcaaggatcaagacggagtacagatcatgaaggattatatggcttctggttctttttcgcgcggaaaggaagaaaagaacgcctatgcttcgatggtgttcgtcggaaatatcaatcaaagtgtggatgttcttttaaaaacgtcccacctctttgatccatttccagaggcgatgtctaatgactcggccttcttggatcgattacactgttatttacctggctgggagattcccaaatatcggccggaatatttcaccgacgactacggctttattacggactatttctcggaaattatgcgagagttgagaaaaatatcctatgccgatgcctatgataaatacttcaagctggggaacaacctgaaccagcgggatgtcattgctgtgaaaaaaacagtatctgggctggttaagttgatccacccagatggccagtttacgaaagaaaatgtcgaagaaattctgcgctttgcgctggaaatgcgtcgtcgtgtcaaggaacaactgaagaagatcggaggcatggagttctatgacgtaaacttctcttatattgaccatgaaacattcaatgaggactatgtttctgttcctgagcaaggcgggggcaaattgattccagaaggtatgggaaaacctggtcatatttatacggtttctcgtggcaaatccggtatgatcggcgtttacaaactggaaatgcagatgactgccggtaatggtaagtttgagagaactggtattggatcggatcgggaagcgaaggaggctgtcgatacagcctatcgttatctcaaagccaatggtaaaaatatcagtggttccattagcacgacgactaaagattatctcatgcacgttcaggatttgaatggtatcggcatgaccaagcgtttgaccttgccaactgttgtggctatatgctcaatagctttgcataagccggctttgagtagtgcggtcatacttggagatcttagtattggcggcacaattataaaagttgaagagttggccaacactttgcaggtttgtttggacagtggagccaaaaaggttctgattcctattacctctgctgtcgatcttggaaccgtgccttcggaactgattggctgctttaatatcatcttctaccagagtgccgaggacgcagtgtttaaagcattgggagtagattag

SEQ ID NO: 3675 - DNA, 2034 bp, Desulfovibrio magneticus
atggataacgaagctcccagccttgactccctgctcaacgaacattttcaaggcaaggtcgttcgaaaggacctcaccaagctcctcaaagaaggagcgaatgttcctgtttatgtgctggagtatctccttggcatgtactgcgcctcggacgacgaggatattattcaggaaggcatcaagagcgtcaaagatatccttgcacaaaactatgtacggcctgacgaggctgagaaagttaaatccattatccgcgagcgtggcagcttcaaggttattgataaagttacagttaagctcaacgaaaaaagggattgctacgaggcacttctttccaacttgggaacaaagggtgttgaaatttccagcaataccgtcaaggaattcgagaagcttctcgtcggcggcatctggtgcatcatttcgctcaactatttttatgaggaaggccaaaaaggctccccattttccatatccgaccttaagcccattcaaatgccgaatatggatatggaaaccatttacgaagggcgaaagcacttcacagaagatcagtggctagacgtactgcttagatctacgggcattgagccgaccacgtttgaagaacgagccaagtggcacctgctttcacgtttgattcctcttgtagagaacaactacaatatatgtgagcttggcccccgtggcacaggcaaaagccatgtttacaaagagatcagcccgaacagcattctggtttctggtggccagacgaccgtggcgaatctcttttataacatggggaaccacaaagttggcctagttggtgtttgggatgttgtggcgttcgatgaggtggccggtataaccttcaaggacaaagatggcgttcagatcatgaaggactacatggcgtctgggtccttctcccgagggcgagacgctatcagcgcaaacgcttcaatggtttttgttggaaatataaaccagagcgtcgataccctagtaaagaccagccacctgtttgcacctttccctgaaacaatgatcgacacggcattttttgatagaatgcattgctatacgccgggctgggaaattcccaagatgcggcccgaattttttacgaatcagtatggccttatcgtggactatttggcggaatatttccgtgagatgcgcaaaacaacttttgccgacgccatcgacaagtattttcacctgggcaacaacctgaaccagcgggacaccattgcggttcgaaaaacggtctcgggccttctcaagcttctttatccgcacggtgattataccaaagaagccgttgaaaaatgccttcggtatgcattggaatgtcgccgccgtgtcaaggaacaattgaaaaaacttggcggcatggaattttacgatgtccattttagctatatcgacaatgaaactcgggatgaaaaatttgtcggcatccctgaacagggtggaagttcgctgatcccagaagggccgccaaatccagggaccttgcatacggttggctgcgggtcgggacatcttggactgtaccgaattgagcttcaggtgactgccggcaatggcaagctgtccatctctggggttggatcgagcaaccaagccaaggaaccaataaaggtcgcctttgactacttcaaggcgaacgccagccgggtcagtgggtcttcaaagccgggggatcgcgattaccacctgcacattgttgagctgcacaacacaggccctaacgacgccatgaccctgcccagtttcatcgccctgtgctcagggttattgggcaagccggtgcaaggaagcttggtggtgcttggtgacatgagccttggcggcagcatcatccgggccggcgacttggccgcaagtctccaggtcgcgttcgatgctggagcaaagcgaatcttaatacccatgagcagcgtgggcgacatccaaaccgttccgggcgaactttttgccaagttccagacaagcttttattcagatcctgttgatgcagtctttaaagcccttggggtggaatga

SEQ ID NO: 3676 - DNA, 2070 bp, Desulfovibrio vulgaris
atgaacgaacttgaccagaaaatcaacacacacttcccgggactcgttgtccgcaaggatctcgtcaagacggtcaagggcaacgccatcgttccctcctacgtgctggaatacctgctaggacagtattgcgccaccagcgatgagccgaccatccagaccggcatcgagacggtcaaggagatccttgccaagcattatgttcaccggaacgaagccggattggtccgctcgaacatcaaggaaaaggggcgctacaaggtcatcgacaagatcagtgtagatctgaacgacaagaaggatgtttatcaggcgcagttctccaacttagggctaaaagaggttcttgttgattccggaacggtaaaaaagcaccccaagcttctggtcggcggcgtgtggtgcatcgctgatctggaatatgagtttaccgaagacaaaagcgccagcccctggatattgtcgaccctcaagccgatccagctctcccatttcgatttcgacggctatgttgaggcccgcaaacaattcaccaccgacgagtggatcgacctgctggtgcaaagcatcggcttcaacccggagatgttcggcaagcgcagcaagctgacccaactggtccgtctgatcccgttttgcgagcgcaactacaacctgatcgagcttggccccaaggggaccggcaaatcgcacatctactcggagttctcgcctcacggcatcctgatctccggcggcgaggttacggttcccaagctgttcgtaaacaactcttccggaaagatcggcctggtcggctactgggattgcgttgccttcgacgagtttgccggaaagcaaaagcgcgtggacaaggccctcgtcgacatcatgaagaactacatggccaacaagtccttctcgcggggcgtcgagacgctgggcgcggaggcgtccatggttttcgtgggcaacacccagcacaccgtgccctacatgctcaagcactctgacctgttctgcgagttgcccgacaaattctacgactccgcgtttttggaccgcatccatttctacatccccggctgggaggtggacatcatccggggcgagatgttctccaacggttatggtttcgtggtggactacctggccgagatccttcgctcactgcgcaatcacgattactcggaccgctacaaggaccacttctccctctcctccgatatttcgacgcgggaccgcgatggcatcaacaagacgttctccggtctgatgaagatcctctttccgcatggtggagcaacaaaggaagaggtcgaggaactgctaaggttcgcgattgaaggccgcaagcgcgtcaaagaccaattgatgcgcatcgactccacctacggcaacgtccgctttacctatcaagacactgatggtcgggccaagcctgtcaccacgctcgaagaagaggaataccccggctactaccacaagaccatcgccgagggcgaagacggggaaatcttggaagctgcgcaaccggactcgccccaaggtccatccgaacccctagctccggccgagcccgtcctcaaggaaaagcacctcacattccaggagaaccagaagggcctctccttcgatacgctgctcggcccttatctcaagggcgcgaccacgatcaccgtcaccgatccatacatccgcctgttctaccaggtgcgcaacttcatggaatttttggagaccgtggtcaaacacaaggccccggatgaggaagtgtccgtgcatctggtgaccacggaagacgagttcaaaggcgaacagcagaaggacaacttcgagaagatgaaggaagccgcctgcagcgtaggagtgaacttcacctgggagttcgacggcaccgggacgatccatgcccgccatatcgtcaccgaccacggctggaaaatctccctggatcgtggcctagacatctttcagcactatgagatgaacgatgcctttaccttcgccaatcgcttgcagcaatgccgaccatgcaaggcgttcgaggtgacgttcatcaaaaccggagaatctgacaatgaccattga

SEQ ID NO: 3677 - DNA, 2070 bp, Desulfovibrio vulgaris; identical to SEQ ID NO: 3676

SEQ ID NO: 3678 - DNA, 2055 bp, Desulfurivibrio alkaliphilus
atggacaccctgactcttgaccagattgatcgcaaagctgccgccgcgctggatggctacctggtccgcaaggacctggtccggaccttcagccgccagtttccggtcccgacctacgtggttgaatttctgctgggccgttactgcgccagcatcgagcaggaggagatcgaagagggtctggagatcgtccaacgccaactaagcgaccggacggtgcgggccggggaagaggagctgttcaagtcccgggcccgggaacagggggaggtcaagattatcgacctgatcaccgctcggctggacgccaagaccgactcctacctggccacgctgcccagcctgcgcctgaccgatgcccgcattgacgccgagctggtaagtcgccatgaaagaatgttgaccggcgggttttatgccgagatcacccttgattatgatccgataatcgcccaggaaaaaaacggtcggccgttcggggttgccggcctgcgcgaaattcagctttcccagcgcaatgtgctggaccagttggctgccgcccgggcaaatttttccaccaccgagtggaaagaattcctgctccgctccatcggaatcgagccggccgggttgacgccgcgccaggtggacgcctttttgctgcgcatggtgccttttgtggagcgtaactacaacctggtggaactggggcctcgggggaccggcaagagccatctctttcagcaggtttccccttacgcccacctgatttccggcggcaaggccaccgtggcccggatgttcgttcatatgggcaccggccaacggggcctggtctgccagtatgatgtggtctgcttcgatgaggtttccgggatctccttcgaccagaaggacggggtcaacatcatgaagggctacatggagtccggggagttcagccggggcaaggaaagtatccgggccgacggcagtattgtcctggtcggcaacttcggggtcgatgtggagcaccagcagcggctcggccatctccttggccccctgccgcccgaaatgcgggatgataccgccttcatggatcggatccacgccttcctgccgggctgggacgtgcccaagatcagcaaggagctgctgaccggtcatttcggcctggtcagcgactttctttccgaatgctggagccggctgcgcagtcagagccggctgggcagcctgcaaaatcggctttatttgggcggggcactttcggggcgggacaccaacgcggtgcacaagaccatcagcggcctgctcaagttgctctatcccggtcaggatgccgtgattcccgacgaggacctagaatgggcggcgcggatcgccctggaagcccggcgccgggtcaaggagcaacagaaacggattggagcggccgagtttcgcaatacccacttcagctatgttatgggggccgatggggtggaaaaatttgtctccaccccggagctgcagagcgaaaacagcatcggtggcgatcctttggagccggggcaggtctgggccatcagccccggcggggacgaggaacatcccggtctataccggatcgaggtcaatgaaggggcgggcaacggggtaaaaattctcaacaagccggtcccgccggccttccgcgaatcgatgggctacgccgagcagaacctctacgcccgggcgatacagctggtgggggataaagacccgcgccaccatgagtttaccgtccagttgcgggcctttgatgcctcgaagtccggggccaagctgggggttgccgccctgatcgccctgagtaccgccctgctgcgcaaaagtgtccgggggggcctgattgtggtgggcgaaatcaatctgggcggctccatcgagccggttcacaacccggtggccatggctgagatcgcggttgaaaagggcgcgaccgtgctgctgatgcccgtgacctgccgccgccagttgttcgatctttccgacgacatggccaccaaaatcgacattcagttctacgccgacgcccgcgacgccctgctcaaagcgatggtggattag

SEQ ID NO: 3679 - DNA, 2232 bp, Enterobacter cloacae
atgccacatgatgagataaatcctactgaaggtgagtttgtaggaaaggaaaccgcacaagaaccagcggtgaatgtcacacatatcacgaacaatgtagtaatccagcagatggacgtttacacggagaagcttgcccagccgagcggaactactgttgatgaggcttctatgctcagcattgacgatgagttatctcagcatgccagcatggatcttgatgcccgtctgaatcgttactttaagggtaaagttgtccgtaaggatttgaccaaacagctaaaagaaggggctaatgtccctgtctatgtactggaatatctgctcggtatgtactgtgcttcagacgatgatgaagtggtacgcgaaggtctggaaaacgtcaaaaaaatcctcgctgagaactatgttcgcccggatgaggctgagaaagtaaaatctctgattcgtgagcgtggtagctttaaagtgatcgataaaatcggagtaaagctcaaccagaagaaagatgtctacgaggctcagctttcgaacctcggtatcaaagatgccgtgatccccgccaacattgttaaagctaacgagaagctgctcaccggggggatctggtgtatcgttactcttaactatttttatgaagaagggcaaagaatttcgcccttctcaattttcaaccttaagcctatccagatgccctccatggatatggaagagctttttgccgcccgggctaatttctcaacagaccaatggctggataccctgatccgctctatcggcatggagccaaccaatctgaagcaacgggtgaaatggcacctgttgacgcggatgatcccctttgttgagaacaactataacgtctgcgaactcggcccacgtggtactggtaaaagccacgtctataaagagtgctcgcctaattcattactagtctcaggtggccagacgacagtcgccaatctgttttacaacatgagttcccggcaggttgggctggtaggtatgtgggatgtggtagcttttgacgaagtggctggtattaccttcaaagataaagatggtgtccagatcatgaaggattacatggcatcgggctctttttcccgtggccgtgattctatcgaagctaaagcatccatggtatttgtcggcaacataaaccaaagcgtagaaacgttagtcaaaaccagtcacctgctggcacctttcccggaagcgatgatcgatacagccttctttgaccgtttccatgcctatatcccaggctgggatatccctaagatgcggcctgaattttttaccaataactacggtctgatcaccgactatctggccgaatatatgcgagaaatgcgcaagcgtagcttctctgatgctatcgaccgcttctttaaactcgggaacaacctcaaccaacgtgatgtaatcgcagtacgccgcacggtctcaggtttgctcaaattactgtatcctcatggtgtgtttggtaaagaggaggtacgtccttgtctcacctacgcattagagttacgtcgtagaatcaaagagcagttgaaaaaactaggaggcatggagtttttcgatgtgcatttcagctatctcgacaacgaaactcttgaagagtttttcgtcaatgtacctgagcaaggcgggagccagttgatccccgaaggtctgagtaaaccgggagttgtgcacatggccaccaagggtgtcacaggccaactgggcctgtatcgcttcgagactcagatgacccctggtaatggtaaacacacgacatctggcctaggctccaatacaccagcaaaagaagcaatccgtataggttttgattatttcaaaggcaacctaaatcgcatcagtgctaccgccaaattttccgagcatgaataccatctacatgccgttgagttacataactcaggccctagtaccaaaaccagccttgccgccttggtagccttctgttccattttgatgggcaagccagtgcaagaacagatggtcgtgctcggagatatgacacttggtggtgttgtgaatccggtcgaagatctggctggtagtttgcaactggcaatggatagtgggggcaaacgtgtgctgctgccgatggcatcagcttctgatatcccaactgtgcctgctgagattttctccaaattccaaatcagtttctatgcagatccggtggatgctgtgtataaagcattaggtgttcaataa

SEQ ID NO: 3680 - DNA, 2085 bp, Erwinia sp.
atgcaaacccattatgacttacccgttccagtgatatccgaaggggaactcgtcgcagaaggttacgatctggacgctttgctgaatcagcattttcgcggacgcgtggtgcgtaaggatctgaccaagcagctcaaggaaggggctaacgttccggtttatgtgctggagtatctgctcggtatgtattgtgcttccgacgatgaccagatcgtcgagcaagggttgcagaacgttaagcgcattctggctgataactacgtccgccccgatgaggcagaaaaggtgaaatcgctgattcgcgaacgcggatcctacaagatcatcgacaaagtgtcggtaaagctcaatcagaagaaagacgtttacgaggctcagctctcaaacctcggtattaaagatgcgctggtgccgccgcagatggtaaaggacaatgagaagctgttgaccggcggcatctggtgcatgatcaccgtgaactatttctttgaggaagggcagaaaacgtcgcccttctccctgatgaccatcaaacctatccagatgcccaatatggatatggaagaggtgttcaccgcgcgcgcgcacttcaaccgcgatcagtggattgatgtcctgctacgttccgtggggatggaacccgctaacattgagcagcgaaccaagtggcacctgatcacccgtatgatccctttcgtggaaaacaactacaacgtctgcgaactgggtccacgcggtaccggtaaaagccatgtttataaagagtgttcacctaactcactgttagtctccggcgggcaaaccaccgttgcaaacctgttttacaacatggccagccgccagatcggcctggtaggaatgtgggacgtagtagcattcgatgaggtggcggggatcacttttaaagacaaagacggcgtacaaataatgaaagattacatggcgtctggctcgttttcccgcggtagagattcgattgaaggcaaagcatcgatggtattcgtcggcaacatcaatcaaagcgttgaaacgttagtcaaaaccagccatcttttagcccccttccctgccgcaatgattgacacggcgtttttcgaccgcttccatgcctatatccccggctgggaaatcccgaaaatgcgcccggaattctttaccaatcgctacggccttatcaccgattatctcgccgaatacatgcgggaaatgcgcaaacgcagcttctccgatgcgattgataaattctacaagctgggtaataacctcaaccagcgcgacgtaatcgcggtaaggcgcacggtgtcaggtttattgaagctgctacatcctaatggagcctacagcaaagaagatgttcgtgtttgcctgacctacgctatggaagcccgtcgtcgcgtcaaagaacagcttaaaaagctgggtggactggagttcttcgatgtgaatttcagttacatcgataacgagacgctggaagaattcttcgtcagcgtgccagaacagggcggcagcgaattaattcctgctggtatgcctaaaccgggcgttgtccatctggtgactcaagccgaggggggaatgaccgggctgtatcgttttgaaacacagatgacagcggggaacggtaaacattcggtttccgggattggttcaaataccggcgctaaagaagccatccgcgtggggtttgattatttcaaaggaaatctcagccgcatcagtgccacagcgaagttctcagaccatgaatatcatcttcatgctgtggaactccatagtaccggccccagcatttcaaccagccttgcagcactcattgcattctgctcggtgttactgtcaaaacctgttcaggaacaaatggtggtactgggtagcatgacgcttggcggtgtcattaacccggtgcaggatctggccgcatgcctgcaggtggcatttgatagtggcgcgaagcgcgtattgttacctatggcatccgcaatggacatcccaaccgtaccgacagagctgtttactaaattccaggtcagtttttattcagagccggttgatgcggtgtataaagcattgggtgttaattaa

SEQ ID NO: 3681 - DNA, 2085 bp, Erwinia pyrifoliae
atgcaaacccatcatgacttacccgttccagtgatatccgaaggggaactcgtcgcagaaggttacgatctggacgctttgctgaatcagcattttcgcggacgcgtggtgcgtaaggatctgaccaagcagctcaaggaaggggctaacgttccggtttatgtgctggagtatctgctcggtatgtattgtgcttccgacgatgaccagatcgtcgagcaagggttgcagaacgttaagcgcattctggctgataactacgtccgccccgatgaggcagaaaaggtgaaatcgctgattcgcgaacgcggatcctacaagatcatcgacaaagtgtcggtaaagctcaatcagaagaaagacgtttacgaggctcagctctcaaacctcggtattaaagatgcgctggtgccgccgcagatggtaaaggacaatgagaagctgttgaccggcggcatctggtgcatgatcaccgtgaactatttctttgaggaagggcagaaaacgtcgcccttctccctgatgaccatcaaacctatccagatgcccaatatggatatggaagaggtgctcaccgcgcgcgcacacttcaaccgcgatcagtggattgatgtcctgctacgttccgtggggatggaacccgctaacattgagcagcgaaccaagtggcacctgatcacccgtatgatccctttcgtggaaaacaactacaacgtctgcgaactgggtccacgcggtaccggtaaaagccatgtttataaagaatgttcacctaactcactgttagtctccggcgggcaaaccaccgttgcaaacctgttttacaacatggccagccgccagatcggcctggtaggaatgtgggacgtagtagcattcgatgaggtggcggggatcacttttaaagacaaagacggcgtacaaataatgaaagattacatggcgtctggctcgttttcccgcggtagagattcgattgaaggcaaagcatcgatggtattcgtcggcaacatcaatcaaagcgttgaaacgttagtcaaaaccagccatctcttagcccccttccctgccgcaatgattgacacggcgtttttcgaccgcttccatgcctatatccccggctgggaaatcccgaaaatgcgcccggaattctttaccaatcgctacggccttatcaccgattatctcgccgaatacatgcgggaaatgcgcaaacgcagcttctccgatgcgattgataaattctacaagctgggtaataacctcaaccagcgcgacgtaatcgcggtaaggcgcacggtgtcaggtttattgaagctgctacatcctaatggagcctacagcaaagaagatgttcgtgtttgcctgacctacgctatggaagcccgtcgtcgcgtcaaagaacagcttaaaaagctgggtggactggagttcttcgatgtgaatttcagttacatcgataacgagacgctggaagaattcttcgtcagcgtgccagaacagggcggcagcgaattaattcctgctggtatgcctaaaccgggcgttgtccatctggtgactcaagccgaggggggaatgaccgggctgtatcgttttgaaacacagatgacagcggggaacggtaaacattcggtttccgggattggttcaaataccggcgctaaagaagccatccgcgtggggtttgattatttcaaaggaaatctcagccgcatcagtgccacagcgaagttctcagaccatgaatatcatcttcatgctgtggaactccatagtaccggccccagcatttcaaccagccttgcagcactcattgcattctgctcggtgttactgtcaaaacctgttcaggaacaaatggtggtactgggtagcatgacgcttggcggtgtcattaacccggtgcaggatctggccgcatgcctgcaggtggcatttgatagtggcgcgaagcgcgtattgttacctatggcatccgcaatggacatcccaaccgtaccgacagagctgtttactaaattccaggtcagtttttattcagagccggttgatgcggtgtataaagcgttgggtgttaattaa

SEQ ID NO: 3682 - DNA, 2085 bp, Erwinia pyrifoliae; identical to SEQ ID NO: 3681

SEQ ID NO: 3683 - DNA, 2082 bp, Erythrobacter litoralis
atgagcgcactcgacgataagattaacgagcatttcgcaggctatgtggtccgcaaagaccttgtgaaagcggtcaagggcaacgcgatcgtcccaacctacgtccttgagtacctgctcggccaatattgtgcgactgatgatgaagcctcgatcgatagtgggatcgatacggtcaaagatatactcaagaagcactacgttcacagaagtgaagccggcctgattcagtcgacgatcaaggaaaaaggacgctacaaggtcatcgaccagataagcgtctctttgaacgaaaagacagatagctacgaagctgtcttcgacaatctgggcattaagaaggtcgcagtagacagtggcacggtcaaagcgcatcccaagcttcttgtgaccggggtatggtgcattgctgatgtccaatacgagtattcagaggactcgcggatttctccgtgggtaattgagaccatcaagcccatccagatcgcaaaagtcgattacgagggctacaagcaagcgcgagcgcaattctccaaagacgaatggatcgaccttctcatgcagtcgattggcttcaaccctgaagccttcggtcgtcgaagcaagctactgcaactcatgcggctgatccccttcgtcgagcgcaactataacatcattgaactcggcccgaagggaacgggtaagtcccacatctactcagaattctctccgcatgggcagctgatctccggaggggaagtcaccatcccgaaattgttcgtgaacaacgcgaatgggcggatcggcttggtgggctactgggatgttgtggcctttgatgaattcgctgggcgcgaaaagactgcgaacaaagccttggtcgacatcatgaagaactacatggcgaacaagaccttctcgcgtggaatcaatcccatgggagccgaagccagctttgccttcgttgggaacacagaccacaatgtgcccttcatgctgaagaacagcgacctgttcgaagctcttccccctcagtttcatgattcagcctttatcgaccgccttcacgcctatcttcctgggtgggagattgacgtaattcgcagtgaaatgttcaccaccggctacgggttcatcgtcgactatctcgcagagatacttcgccacttgcgccaggaagacttctccaaccggcctgacctgcatttcaagatcagtgagaagatctccacccgtgaccgtgatgccgtctacaaaaccatgtctggctttttgaaagtcattttccccgccgggggcgaaacggctgaagacgtcgaggagcttttgcagctcgcactggagagccgaaagcgcgtaaaagaccaattgttccggatcgatgcgacctatccagaggtcgatttctcatacacaggctctggcggcgaaaagcgtcgtgttcagaccgttgaagaacaagagttcccacaattctattatctgaaaccagccttggatcccaaacagcaggatgaatcgagcgatgctgtcgatgaggatgtgaccggggaccgacctgaagcagctaacgcatcagtttccacaagacctgcgaagccggtcgccgaagagggccatcacgtcttcgctgaaaaccgcaaggggatcagctacaacaagctgttcgcaccctatctggagggagcgtcccggatcgtcgtgacggacccttacattcgctatttctaccagatcaaaaacatgatggaatttgtcgaaatggtcattcagcgcaaagcgctcgaagaccaagtcgccgtccatctcgtcacagggcctgacgatggcaacgtgcaaaagcaacgcgagctgctcgatagcataacagaggcatgcacaggtacgggcgtggacttcacttgggcgtttgacagttcaggcacgggccactcgagggatatcatcactgacactggctggaaaatcgttctcgatcgaggtctcgacatatttcaggcgccgatgcggcgggacggatttacccttggcgaccgtttgcaagagcaccgcatgttgaagaacttctatgtgacttatgttcgacaggaccagcggtga

SEQ ID NO: 3684 - DNA, 2085 bp, Escherichia coli
atgcaaacccatcatgatttacctgtttcaggcgtatccacaggggaaattgcctccgagggttacgatctggatgccctgctgaaccagcattttgctggtcgcgtggtgcgtaaagatctcaccaagcaactcaaggaaggggcaaacgtcccggtgtatgtgctggagtatctgctcggcatgtactgcgcctctgacgatgacgatgtggtcgagcaagggttgcaaaacgttaagcgtattctggctgataactatgtgcgcccggatgaagcagagaaagtgaagtcgctgatccgcgagcgtggttcgtacaaaatcatcgataaagtgtcggtgaagctaaaccagaaaaaagacgtttacgaagcccagctttctaacctcggcatcaaagacgcgctggtgccatcacagatggttaaagacaacgagaagctactgacgggcggtatctggtgcatgattaccgtcaactatttctttgaagaagggcagaagacttcgcccttctcattgatgacgcttaagcctatccagatgccgaatatggatatggaagaagtgttcgatgcgcgtaaacactttaaccgtgatcagtggatcgatgtgctgctgcgctcggtgggtatggagcccgccaatattgagcaacgcaccaaatggcaccttatcacccgtatgatcccgttcgtggagaacaactataacgtttgcgagctggggccgcgcggcaccggtaaaagccatgtgtataaagagtgttctcctaactccctgttagtttctggcgggcaaacgaccgttgccaacctgttctacaacatggccagtcgccagatcggcctggttggtatgtgggatgtggtggcgttcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagacactcgttaaaaccagccatttgctggcgccgtttccggctgcgatgattgataccgcctttttcgaccgctttcatgcctatattcccggttgggaaatccccaaaatgcgcccggaattctttaccaaccgttacgggctgattacggattatctcgctgaatatatgcgcgaaatgcgcaaacgcagtttctctgatgcgattgataaattctttaagctgggtaataacctcaaccagcgtgacgtcattgccgttcgacgtaccgtgtcggggttgttaaaactcatgcatcccgatggcgcgtacagcaaagaagatgtgcgagtctgcctgacctatgcgatggaagttcgtcgccgcgtgaaagagcaacttaaaaaactgggcggcctggagttcttcgatgtgaactttagctacatcgataacgaaacgctggaagagttttttgtgagcgtaccggaacagggcggcagcgaacttattcctgccggaatgccaaagccgggcgttgtgcatctggtcactcaggcagaaagcggcatgaccgggttgtatcgttttgaaacgcagatgactgctggtaatggtaagcatagtgtatcgggtctgggttcaaatacctccgcgaaagaagctatccgcgtcggtttcgattacttcaaaggcaatttgaatcgggtaagcgcggccgcgaaattctccgatcatgaatatcaccttcatgtcgttgaactgcataatactggcccaagcaccgcaaccagtcttgctgcgcttatcgctttatgttcgatattgctggcaaaaccagtgcaggaacagatggtggtgttgggcagtatgacgcttggtggagtaattaacccggtgcaggatcttgccgccagtttacagctcgccttcgacagcggcgcaaaacgagttctgttgccgatgtcctcggctatggatattccaacggttccggcagagttatttaccaagtttcaggtgagtttttactcagacccggttgatgctgtttataaggcgctgggtgtgaattaa

SEQ ID NO: 3685 - DNA, 2085 bp, Escherichia coli; identical to SEQ ID NO: 3684

SEQ ID NO: 3686 - DNA, 2085 bp, Escherichia coli
atgcaaacccatcatgatttacctgtttcaggcgtatccgcaggggaaattgcctccgagggttacgatctggacgccctgctgaaccagcattttgctggtcgtgtggtgcgtaaagatctcaccaagcaactcaaggaaggggcaaacgtcccggtgtatgtgctggagtatctgctcggcatgtactgcgcctctgacgatgacgacgtggtcgagcaagggttgcaaaacgttaagcgtattctggctgataactatgtgcgcccggatgaagcagagaaagtgaagtcgctgatccgcgagcgtggttcgtacaaaatcatcgataaagtgtcggtgaagctaaaccagaaaaaagacgtttacgaagcccagctttctaacctcggcatcaaagacgcgctggtgccatcgcagatggttaaagacaacgagaagctactaacgggcggtatctggtgcatgattaccgtcaactatttctttgaagaagggcagaagacttcgcccttctcattgatgacgcttaagcctatccagatgccgaatatggatatggaagaagtgttcgatgcgcgtaaacactttaaccgtgatcagtggatcgatgtgctgctgcgctcagtgggtatggagcccgccaatattgagcaacgcaccaaatggcaccttatcacccgtatgatcccgttcgtggagaacaactataacgtttgcgagctggggccgcgtggcaccggtaaaagccatgtgtataaagagtgttctcctaactctctgttagtttctggcgggcaaacgaccgttgccaacttgttctacaacatggccagtcgccagatcggcctggttggcatgtgggatgtggtagcgttcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagactctcgttaaaaccagccatttgctggcgccatttccggctgcgatgattgatactgcatttttcgaccgctttcatgcctatattcccggttgggaaatccccaaaatgcgcccggaattttttaccaaccgttacgggctgattacggattatctcgctgaatatatgcgcgaaatgcgcaaacgcagtttctctgatgcgattgataaattctttaagctgggtaacaacctcaaccagcgtgacgttattgccgttcgacgtaccgtgtcggggttgttaaaactcatgcatcccgatggcgcgtacagcaaagaagatgtgcgagtctgcctgacctatgcgatggaagttcgtcgccgcgtgaaagagcaacttaaaaaactgggcggtctggagttcttcgatgtgaactttagctacatcgacaacgaaacgctggaagagttttttgtgagcgtaccggaacagggcggcagcgaacttattcctgccggaatgccaaagccgggtgttgtgcatctggtcactcaggcagaaagcggcatgaccgggctgtatcgttttgaaacacagatgactgccggtaatggtaagcatagtgtatcgggtctgggttcaaatacctccgcgaaagaagctatccgcgtcggtttcgattacttcaaaggcaatttgaatcgggtaagcgcggccgcgaaattctccgatcatgaatatcaccttcatgtcgttgaactgcataatactggcccaagcaccgcaaccagtcttgctgcgcttatcgctttatgttcgatattgctggcaaaaccggtgcaggaacagatggtggtgttgggcagtatgacgcttggtggggtaattaacccggtgcaggatcttgccgccagtttacagctcgccttcgacagcggtgcaaaacgggttctgttgccgatgtcctcggctatggatattccaacggttccggcagagttatttaccaagtttcaggtgagtttttactcagacccggttgatgctgtttataaggcgctgggtgtgaattaa

SEQ ID NO: 3687 - DNA, 2085 bp, Escherichia coli
atgcaaacccatcatgatttacctgtttcaggcgtatccgcaggggaaattgcctccgagggttacgatctggacgccctgctgaaccagcattttgctggtcgcgtggtgcgtaaagatctcaccaagcaactcaaggaaggggcaaacgtcccggtgtatgtgcttgagtatctgctcggcatgtactgcgcctctgacgatgacgacgtagtcgagcaagggttgcaaaacgttaagcgtattctggctgataactatgtgcgcccggatgaagcagagaaagtgaagtcgctgatccgcgagcgtggttcgtacaaaatcatcgataaagtgtcggtgaaactgaaccagaaaaaagacgtttacgaagcccagctttctaacctcggcatcaaagacgcgctggtgccatcacagatggttaaagacaacgagaagctactgacgggcggtatctggtgcatgattaccgtcaactatttctttgaagaagggcagaagacttcgcccttctcattgatgacgcttaagcctatccagatgccgaatatggatatggaagaagtgttcgatgcgcgtagacactttaaccgtgatcagtggatcgatgtgctgctgcgctcagtgggtatggagcccgccaatattgagcaacgcactaaatggcaccttatcacccgaatgatcccgtttgtggagaacaactataacgtttgcgaactggggccgcgcggcaccggtaaaagccatgtgtataaagagtgttctcctaactccctgttagtttctggcgggcaaacgaccgttgccaacctgttctacaacatggccagtcgccagatcggccttgttggcatgtgggatgtggtagcgttcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagacactcgttaaaaccagccatttgctggcgccatttccggctgcgatgattgataccgcctttttcgaccgctttcatgcctatattcccggttgggaaatccccaaaatgcgcccggaattctttaccaaccgttacgggctgattacggattatctcgctgaatatatgcgcgaaatgcgcaaacgcagtttctctgatgcgattgataaattctttaagctgggtaataaccttaaccagcgtgacgtcattgctgttcgacgtaccgtgtcgggattgttaaaactcatgcatcccgatggcgcgtacagcaaagaagatgtgcgagtctgcctgacctatgcgatggaagttcgtcgccgcgtgaaagagcaacttaaaaaactgggcggcctggagttcttcgatgtgaactttagctacatcgataacgaaacgctggaagagttttttgtgagcgtaccggaacagggcggcagcgaacttattcctgccggaatgccaaagccgggcgttgtgcatctggtcactcaggcagaaagcggcatgaccgggttgtatcgctttgaaacacagatgactgccggtaatggtaagcatagtgtatcgggtctgggttcaaatacctccgcgaaagaagctatccgcgtcggtttcgattacttcaaaggcaatttgaaccgggtaagcgcggccgcgaaattctccgatcatgaatatcatcttcatgtcgttgaactgcataatactggccctagcaccgcaaccagtcttgctgctcttattgctttatgttcgatattgctggcaaaaccggtgcaggagcagatggtggtgttgggcagtatgacgcttggtggagtaattaacccggtacaagatcttgctgccagtttacagctcgccttcgacagcggcgcaaaacgagttctgttgccgatgtcctcggctatggatattccaacggttccggcagagttatttaccaagtttcaggtgagtttttactcagacccggttgatgcggtttataaggcgctgggagtgaattaa

SEQ ID NO: 3688 - DNA, 2076 bp, Escherichia fergusonii
atgacaactgatttttcacaagatcataaagacgaaaaaaatcagatgcaaagcgccgatttagacgcattgctcaaccaatattttaaaggccgtgtcgttcgaaaagatctgacaaagcaattgaaagaaggcgctaacgtccctgtctatgtgcttgagtatttactaggcatgtattgtgcgtccgatgacgacgaagttgtaatgcaaggccttgataatgtgaaaaaaatcttggctgagaactatgtccgaccagatgaagcggagaaagtgaagtcactgatccgtgaacgcggcatgtttaaaatcatcgacaaagtaagcgttaagctcaatcagaaaaaagacgtctatgaagctgcgttgtcgaacctgggtatcaaggatgcccttgtaccgaccaaaatagtacaagacaacgaaaaattattaactggcggcatctggtgcattattaccgtgcagtatttctttgaggaaggtcagaagacatcacctttctccattatgagtttaaaaccgatacaaatgccgtccatgaacatggatgaggtgttttcaaccagaagacattttagtaccgatcagtggatggatgtgttgcttcgttccgtgggtatggagccaaccaacttagagcatcgggtgaaatggcatcttatcactcgtatgatcccattcgttgaaaacaactacaacgtttgtgagctcggaccaagagggacaggtaaaagccatgtctacaaggagtgctcaccaaactcattgcttgtctcgggcggacaaacaactgtggcgaacttgttctataacatgagctcgcgccaagttgggttggtcggaatgtgggatgttgtcgcctttgatgaagtagcgggtattaactttaaagacaaagacggcgtccaaataatgaaagattatatggcgtcagggtcttttgcccgtggtcgtgattcaatcgaagcgaaggcttccatggtattcgtcggtaacatcaatcaaagcgttgagacactggtgaagaccagtcatctgttggcaccttttcctgaagccatgattgacactgctttttttgaccgtttccattcctatattcctggatgggaaataccgaagatgcgtcctgaatttttcaccaatagttacggattaatcacagactatcttgctgaatacatgcgtgaaatgcgcaaaagaagttttgcggatgctatcgataagttcttcaaactcggtaataaccttaatcagcgtgatgtaattgctgtacgcagaactgtttcgggcttgttaaagctactacaccccgacgcacagtacacaaaagatgatgtaagagcctgcctgacctatgcgctggaaactagacgtagagtcaaagagcaattgaaaaagcttggcggaatggaattttttgatgtgcactttagctacatcgataacgattcattagaagaattcttcgtcaatgtaccggaacaaggtggcagcaagctaattcctgagggcttacctcgcgctggtgtcgtgcacttggttactcagggaagcactgggcagcttgggttatatcgctatgaaacccagatgatggctggttctggtaaacactcagtgtctggccttggttcgaataccgcagcgaaagaagctgtgcgtgttggctttgattatttcaaaggtaacctgaatagaatcagtgcgtcggcgaagttttctgatcatgagtatcacctccatgttgttgagctccacaatacggggccaagtacaaagtcatcgctcgctgcattaattgcgttctgttcaattctgatgaaccgaccgattcaagagcagatggttgttttgggtgagatgactttaggtggtgtcgtcaatcctgttcaagatcttgcaggcagtcttcagttagctatggacagtggcgcaaagcgtattttgctcccaatggcctcagcctcagatattccaacggttcctgctgagttgttctcaaaattccagatcagcttttatgcagaccccgtcgatgccgtgtttaaggcgcttggggttaattga

SEQ ID NO: 3689 - DNA, 2058 bp, Exiguobacterium sibiricum
gtggcagaagaaacagatgggacttcgacattagatcttgataagaaattaaatgatatatttgctgggcgagttgttcgtaaagacttaactaaactcattaaagaaggtgcaaatgttcctgtatatgtacttgagtatttgttaggaatgtatgcagcgactgatgatgagcagagcattcaagaaggtgtggaccgggtaaaaaaaatcttgactgacaactttgttcgtccagacgaatcagaaaagatcaaatctagaattcgtgaattgggacaatattcaattattgataaagtgacagtagctttaaatccgaagattgatacgtatgaagcagagttttcgaatcttggattaaaaggtgttccgattccttctaattttgtaaaagagtttgataaacttcttgtcggtggcatttggtgtatggtcaagattgattattattacgatgaagaagggcgagcttcaaatccatttagtgttagcagtcttcagccaattcaaatgccgaatatggacatgaatgaggtatttgaagggcgcaagcaatttacaaaaaatgaatggatcgatgcattgattcgatcgactgggatggaaccgacacaattagaggaacgtgtaaagtggcatttacttttacgactggtacctctcgtagaaaacaactacaacatgtgtgaacttggacctcgtggaacaggaaaatcacatgtatacaaagaaatttcacctaactccatcttagtatcgggtggacagtcaacagtagccaatttgttctataatatgtctactcgaaaagttggactggttggaatgtgggattgcgtcgcatttgatgaagtcgcaggtattcgatttaaagacaaagatggcattcaaattatgaaggattacatggcttcaggatcgtttgccagaggtaaagaagaaaaaaatgcttcggcctctatggtgtttgttggtaatatcaatcaaagtttagatgtcttattaaaaacctcacatttatttgcaccattccctgaagaaatggcaaatgatacggcattttttgatcgaatgcattattatatgccgggctgggaaattcccaaaatgcgaccagacttctttactgataaatacggattcattgtagactatatcgctgaattctttagagaaatgagaaagcgctcgtttgcagattcaacagatcgctattttaaattgggtaataacttaaaccaacgagatactatagccgttcgtaaaacagtatcagggatggtaaagctcatctatccaaatggaatttatacgaaagaagatattgaagaaattttgcgttatgcattagaaggacgtcgccgagtcaaagaacaattaaagaaaattggtggtatggaattttatgatgtgatgttctcttatatcgataaagagacgctggaagaagagcatgtttcagtcccagaacaaggtggcggaaagctcattcctgaaggtatgggtaagtctggacatatctatgtcgtagggcatggtaactcaggtatgataggcgtttacaaactcgaaaatcaagttgtcagtggaacgggtaagtttgataaatcgggtgttggttcttctcgagagacaaaagaaagcttagacacagcttttcgtttcttcacagctaacagtaaaagtattagtaatacgattagtaccaaaacaaaagattatttgatgcatattagtgatcttcaaggaattggactaacgaatgaacttgcgattgcggaactaattggcttatgctcagcagcattggacaaatcggttcaagaaagtacagtcgttattggtaatatgactgttgggggaacaatcgcaaaggttgaagaatttgcaagtgtcttacaagtctgtgtcgatgcgggagcgaaaaaagtattaatccctgcatcatctgttatggatttacaaactgttccacctgatttattagtcaaagtacaaccagtgttttatgcagatccgacagatgctgtgtttaaagcacttggtgtgaattga

SEQ ID NO: 3690 - DNA, 2049 bp, Flavobacterium branchiophilum
atgatagtccttgacgatttagataaaaaagcattagaccactttcgtgggtatgtggtaaaaaaagatttagtaggtatcatcaaaggtggggctaatgtaccagcttttgtattggaatatttattagcaaatacctgtagcacagaagatgaggaaaaactaaaagaaggaatggaaaatgtaaaaacaattttacgtgaccattacatcaatccagaagaaagtactttaattcaatcaaaattaaaagaaaaagggagttataaaattattgacaaaatatccgttcaattagatcctcaaaaagataaatattgggcaaatatcagcaatagtaatattagaaaagcgaacatcagtgatgagttagttacaagtcatgagaagctacttttaggaggtatttgggcaattattgacatggaatatgaccctatgataacagtaggttcaactgtttttccatttgtggtaaaagaaattagacctatacaactatcatcgtttgacaacagtaaaatttccgataaaagaaaagaattcacaacagaggaatggaaaaaattattactacgtagtgctggatatgaaccctatagcgaaggattagatgaaagaaagctaaacctattactttgccgtttaattccattagtagaagccaatttcaatatggtagaattgggtcctcgttcttcgggtaaatcatatatctacaaagaaattacaccttacgctattctaatttcaggaggtcaaggttctgttgctcaattatttgtaaacaatacttctggtcgtgtaggtgcagttggtctttgggacgccatttgttttgatgaaagtaccgacaaacttttcaaagatagagatgcaattccattaatgaaagattatatggaaagtggttctttttcaagagcaaagggaggtgaaatttcaggttcagcttctataatattaaacgggaatataaaccaaccagtagaaaccgtattacaaacatcacacttattcagtccattatcagatgaagtaaaccacgataccgcatttttagaccgtatcaatttatttttaccaggttgggaaataacaaaattcagtcctcaaaactttactcatcattttggttttagtaccgatttcttttccgaagtattgaaatcacaaagaaaaacaacgtattacgatgcgttgaataaatatttttctttaggatctcatttaaaacaaagagatagcaaatcaataagacgtataatttcgggctttttaaaattactgcatccaaacggtgagtattcaaaagaagacattagagagtacttaattattgcaatggaaatgcgtcgcagagtaaaagaacagctcaaacgtattggcggtatggaattttgggacactaatttctcctacatcgacaaagaaacacaagaagaaatattcgttggattaccggaagaaaaaggctcgtcattgatagaagcaaatccattggctccgggagtatgttacaccgcaacaagtgatggagataataattctttaataaaaattgaagtagtagcattaaaaggctcagggaaattaaatattactggaaccaattcaaccgaagtaaaagaaaacataaagaacacctttaactatatcagagccaacgaaaaaacaattctaaacgaacaacattcattagcaaactatgacctaaatattcaagtaagcaatattatgggagctaatattcacgatggtataggtagtgctgtatatgtggcaataatttcagcgatttacaaaaagaacctaaaagctggtttagcagttttaggtaatgtatcaattggtggcgctatagagagagctttaaatttcgccgacaaagtaacattactttccgaaaacggagcaaaaacagttatagtaccaatggataacttatcagaaataggaacattaccaaccacaattttaggaaaaacggacgtgcctttctatggtaacagtcaaatgttattacaaaaatctgtattgggggaataa

SEQ ID NO: 3691 - DNA, 2031 bp, Gallionella capsiferriformans
atgattgattcgaatcaggaaaaaagccttgatgtgctattgaacgaatttctgcccggcaaggtggtgcgcaaggatctgaccaagctgattaaggaaggcgcgaatgtgccggtttatgtgctggagtatttgctcggcatgtactgcgcatcggatgatcctgcgaccattgaggcaggcttaaccaatgtgaagcgggtgctggcggaaaactacgtgcgtccggacgaagctgaaaaggtaaagtccaaaatccgcgagagtggcagctataaggtgatcgataaggtcacggtcaagctgaacgagaagcgagactcttacgaggcgatgctttccaacttgtctatcagggatgcggaaattcctgattccgatgtacgtaattttgagaagctgctggtcggcgggatctggtgcatcgtgacgctgcgctaccgctttgaggaaaatcagaagggctcgccgttttcgatttctgatttgaagccgatccagatgcccaacatggatatggaggcattgttcaatgcgcgcaaaggttttaccgaggaacagtggatcgacagtttgatccgttcgacgggcatggagccaacttgttttgatcagcgggtgaaatggcatttgctggcacgcatgattccgctggtggaaaataattacaacatctgcgagttaggccctcgcggcaccggcaagagccatatttacaaggaaatcagcccgaatagcattcttgtatctggcgggcaaaccactgtcgccaatctgttctacaacatgggatcgcgcaagatcggtctggtcggattatgggatgtggtcgcgtttgatgaggtggcaggtatcaacttcaaggaacaagacggcattcagatcatgaaggactatatggcgagcgggtcattctcgcgcgggcgtgagtcgatcaatgcaagcgcatccatggtgttcgtcggcaatatcaatcagtctgtcgaacagatggtaaaaaccagtcatttgctggagcccttcccggacgcgatgattgattcggcattttttgaccgattccatgcctatgtgccgggctgggaaatccccaagatgcgcccggaatttttcactaaccagtacggcatgatcgtggattacctggcggaatggatgcgcgagatgcgtaagcgcagctttgccgatgccatcgacaagtggttcaaactgggtaataacctgaatcagcgcgatacgattgccgtgcgccgtaccgtgtctggtctgctcaaactaacttgcccgcatggcgaatatggcaaggaaagcgtgcgacgtgcgttggaatatgcacttgaaacgcgtcgcaggataaaagaacagctcaagaaaatcggcggcatggaattctacgatgtccatttcagctatatcgatctggaagatgggcaggagcggtttatatcagtgccggagcagggtggtggttcgcttattcctgatggcagacccaaccccggaacattgcataccatcagtatcggtgaaaacggcatgccgggtgtgtaccgactggaaatccagtctattgccggcaatggcaagatttcgatttctgggaataattccagagagccatccagagtcgcattcgactactttaaagcccacgcttcacgggtaagcggggcgatcaagccgagtgattatgattaccatttgcatctggtcgagctgcaaaattccggtgcgccagaaactttgacgctcgccaactttatcgcgctgtgttctgcaacactgggcaagtcgatgcagagtcagatggtcgtgatgggcgatatgagtctgggtggaaccattacacaggcgcgtaacttggcggaaagtttgcaagtggcgtttgatgccggtgcgaaacgtatcctgctgccgatgtcgagcgtgaccgatattccaacggttcccggcgaactgtttgcaaaattccagaccagtttttactcagatcctgtggacgcggtattcaaggcgttgggggtggagtga

SEQ ID NO: 3692 - DNA, 2046 bp, Gallionella capsiferriformans
atgcagcttgatgacttggatcgcaaggcagctgatgcctttgatggctatattgtgcgcaaagacctggtgcggcagttttcgcgccaatttccggtaccaacctatgtggtcgaattcatgctcggacggtattgcgcgacaattgatgaaaatgaaattcaggaaggtttgggcattgtgcagcgccaactttccgaacgtactgtgcgtgccggtaacgaggaactgattaagtccacggccaaagaaaaggggcaagtgcgcattatcgacatcatcgcggcgcgcctagatgccaagacagactcatacctggtggaactgccttcgctcaaattacgtgacgtgcgtgtttcctccgaactggttaatcagcaccaacgcatgctgaccggtggattttatgccgaggtaactttaggatacgacgcgagcattgcgttggaaaaaggcggacgaccattttccgtagatggattgcgcgcgattcagctttcacagcgcgacgtactggataagctgtcacaggctcgtgctaaattcaccacggcggaatggaaagattttctgcttcgctccattggtatcgaacctgcgggcatgctcgaccgagcaaaggatgccatgctgctgcgcatggtgcctttcgtggaacgcaactacaacatggttgagattggccctcgcggaacgggcaagtcacatctattccaacaggtgtcaccctatgcacacctagtttctggcggaaaagccactgtggcacgcatgtttgtgaacaatgccaatggccagcgcggtttggtatgtcagtacgatgtggtttgctttgatgaagtgtccggcatttccttcgatcagaaggacggcgtgaacatcatgaagggctacatggaatccggggagttctcacgcggcaaggagagcattcgtgccgatggttccatcgtcatggtaggcaactttgatgtggatgtggaacatcaacaacgcatcggtcatttattccaaccgctgccgccagaaatgcgtgatgacacagctttcatggatcgtatccattgttacttgccaggatgggatgttccaaaactaaaaccggatattttcacgaatcactttggcttagttagcgattttctttctgaatgcttgacgcaactgcggtctcaaagtcgtttagccacactgcaaaaccgcgtattcttcggtggtgctctgtcaggtcgcgacatcaatggcgttaataaaaccatcagcggcttgttaaaactgatatccccaaaccaggatgctgaaatcagcgatgaagatttggagtgggctgtccgtctgggattggaagttcgccgccgcgtgaaagagcagcagaaacgcattggcgcggccgaatttcgcaacacgcatttcggctacacgattggtgcagaaggcgttgaaaaatttgtatcgacgcccgaactgcaaggccagaacgggattggtgatgaaccactggaggctgggcagatttgggtgctgtcgcctggtggtcaggatgagcatcctgggttattccggctggaagtcactgaaggcccaggcagcggtgtgcgcattctcaacaagccagtaccacaagcgttccaggaatccatccgctgtgccgaacagaatctctatgcgcgtgcattacagttagtaggtgatcgtgatccacgctctcatgaattttcagcccaactccgtggctttgattcagccaaaactggtgccaaaaccggcgtagcttcgttaattgcgctatgcagcgcattgctccgcaagtctgtacgcggcgggttgatcgtggtcggagaagtcacactcggcggcacgatagagcctattcataatgcagtgagcctggcagaactggccgtcgaaaaaggagcgaagtcgttgctgcttccagttgcttgccgcagacagctatttgacctgtccgatgatatggccaccaagctagatattgagttttatcaggatgccaaggatgcgttgttgaaggcgctggtggattaa

SEQ ID NO: 3693 - DNA, 2031 bp, Geobacter sulfurreducens
atgaacgatgttctagaccagaagctggtcgatgtattctccggcaaggtggtgcgcaaggacctggtgcgcaaggtcaaggtcggggccaacgtgccggtatttgtcctcgaataccttctgggaaaatactgcgccacggacgacgaggcggcaatggaagcgggacttcgggtggtgaacaacaccctcgccgaaaattttgtccgccccgaggaggcgaacaaggctcaagcactggtccgagagaaggggcgccatacctttatcgacaaggtgaaggtccgctaccttgcagaggatgacaaatactgggcggaatgcgtcaacttcggccacaagtacctgcatattccggaacgctacatacgggagtacgatcggctgctcatgggcggtgtctgggcgcagatggagatccggcaccagtacgacgaggaggccaaggggcgccggagtcccttctggattgaaagcatcacccctattcagttggccaccttcgacttaaacgcttaccaagaaggacgtcggcagttcacgtccgaagagtgggtggatatgctgatccgcagcgtcggcatggagccggagcatttcacgcggcggctgaagctgctgtttctgatacggctcattccgctgtgcgaggccaactacaaccttgtcgagcttggaccgcgcggcaccggcaagtcctacgcttatcaggagttgagcccctacgccattctgatgaccggcccgacgaccgtggcaaacctgttcttcaacatatccaccaataagatggggcttgtgggattgtgggatgcggtggcttttgatgaggtggccgatctggagaagatgcccaaggaagtcgtaaccacgatgaagacgtactgcgagtccgggtcgttcgcccgtggcaaggagtcgctctccggcatggcatccattgcgctgttcgggaacaccaaccagcctgtggagacgatggtgaagtcctcacacctcttcatccctttgccggagattgtcagggaagacatggcgttcctggaccggattcactattacatccccggctgggaaatccccaagatgcggatcgagtatttcacccagcattacggcttcgtcgtggactaccttgccgaggccctgcgggaactgcgccggcataactttactgaagtcagcgaccgatatttctcgttcggcgcccacctgaacgcccgggatgtgaaggccgtacgcaagacggtgtctggcctcgtcaagctgctctatcctcatggtgagttcactaaagacgaactggccgagaccgtcgacatcgccatggagggccggcggcgggtgaaggaacaactcaagaagatgggctccttcgagtaccaccagacatccttctcataccgtgacaacgagagcacggaggaacgctacatcggcgtccccgaggaaggtggccgtgccctgatatccactgacccgctggcacccggctccgtttatgcggcatccgtcaatgctgatggcaaggtaggtctctatcggatcgaagtgggtgtctcagccggcaccggcaaattgaagcttgccggtggcgtggagtcaacgatgaaggaatccattactcgcgctttcggattccttcagggacacaaggttccgatggggatagcgagtattttcgatacaacggacttccatgtcgaagccatcgatcttcttaccaaccgggtaggttgcgaagccggtattgccttcatcatagccatcatatcggccataaagaaaacccaggttgccccgggaatggtgatccttggtgacctgagtatccaagggaacataaagggggtctcttctctgtcggaaccgcttcagatcgcaatggaaaacggcgcaaagcgggcactcattcctcttgagaacaagcgcaacttcctagaagtatccggggagatcgtggaaaaggttgaccctgtgtttttctctgacccccagactgctgctgcgaaggcgttgaacttatcttga

SEQ ID NO: 3694 - DNA, 2046 bp, Haliscomenobacter hydrossis
atggaattagaccagattgatcaattgtccgccaaagccttcgaaggcttcatcgttcggaaagacttgctggagcagtttcgcaaaacctatccagtccccacctatgtcattgaattcctgttgggcaggtattgcgccaccaccgatgaagaagaaatccaggaaggcctggagatcgtcaaacgccaactccaagaccgcacagtgcgccccggtgaagaagaatatttcaaatccaaagcccgcgaaaagggctccatcaagctcatcgacatcatcactgcgcgcctggacaccgcatccgacagctacgtggctaccctccccagcctgcaactgaataaggtgcgcatctcccccgagctggtcaacgccaacgaccgcatgctcaccggtggtttttatgccgaaattgaattggaatacgatgccaccattgctcaggaaaacaatggccgccccttcggcatcagcaacatccgtcccatccagctctctcagcgcaatgtcctggaagtcctctacaaaggccgcgagtttttcagcctcacggaatggaaagacttcttgatccgcagcgtcggaatggaacccgcctccttgtcggaacgagccagaaatgtcctttttgcccgcatgatcccctttgtagagcgcaactacaacctgatcgagctggggccccggggcaccggcaaatcccatttgtaccaacaaatctccccctacgcgcacctggtttcgggcggtaaagccaccgttgccaagatgtttgtgaacatgggcagcggcgagcgggggctggtctgcaaatacgacgtggtttgttttgacgaggtttccggcgtgtcctttgaccaaaaagacggcgtcaacatcatgaagggttacatggaaagcggcgaattcagccggggcaaagaacccatccgtgccgatggcggcatcgtgatggtgggcaactttgacgtagacgtagaacaccagcaacgcatcagccacctctttggccccatgcccaaagaaatgcgcgacgatacggcctttatggatcgcatccacgccttcgcccccggctgggacttccccaaactcaataaaacgtatttcaccacccactttggactggtcagcgacttcctggccgagtgttggacccgcctgcgcgacaccagtcgtttgtcttcggttttgccccgcatcgactttggcggagccctcagcggtcgggataccaccgccgtcaacaaaaccatcaatggcctcctgaaattgatgcaacccaaccccgaagcgcccatctcggatgaattgttggaatgggccatcaaagtagccctggagtaccgacgccgggtaaaagagcaacaaaaacgcatcggttccgccgagttccgcaacacccacttcagctaccgcatcggcgaagatggcatagaaacctttgtaaccacccccgaaatccacagcgaaagcaccatcggcgacgatccgcttccccccggccagatctgggccctcaacgccggtggccaggaggaaaccaccggcttgtacaagattgagatcaatactggccccggctctagcgtaaaaatcctcaacaaacccgcacccccccaattccaggagagcgtgcgttatgccgaacaaaacctctacagcaaaggcaaggaactgctgggtgatcgtgacccccgttcccacgagttctccatccaacttcgggcttttgatgcctccaaaagtggcaacggtatgggcatggccgtcctgatgggcatgtgcagcgccatcttgggcaaaaacaccaaaggtggcctggttatcatcggccagctgaacctgggtggctccctggatttggtctacaatgccgtcaatctggccgaaatagccgtcgaaaaaggggccaccaccctcctcgtccccctcaacgcccgcaaacaactcaatgagctgtctgatgacatgatcaccaaaatcaacattcagtattatacggatttaagggattgtttgatgaaggcgttgttggattaa

SEQ ID NO: 3695 - DNA, 2085 bp, Klebsiella oxytoca
atgcaaatccatcatgacttacccgttccagccgtctccgaaggggaactcgtcgcagaaggttacgatctggatgccttactgaatcagcattttcgtggtcgggtggtgcgtaaagatctgaccaagcagctcaaggaaggggctaacgtcccggtctatgtgctggagtatctgctcggtatgtactgcgcttccgacgatgaccagatcgtcgagcaagggttgcagaacgttaagcgcattctggctgataactacgtccgccctgatgaagcagagaaggtgaaatcgctcattcgtgagcgaggatcctacaagatcatcgataaagtgtcggtaaagctcaatcagaagaaagacgtttacgaagcccagctctccaacctcggcattaaagatgcactggttccgccgcagatggtcaaggacaacgaaaagctgttgaccggcggcatctggtgcatgatcaccgtgaactacttctttgaggaaggacagaaaacgtcccccttctctctgatgacgcttaaacctatccagatgcccaatatggacatggaagaggtatttaccgcacgtacgcacttcaaccgcgaccagtggattgatgtcctgctacgttccgtgggtatggaaccggccaacattgagcagcgaactaaatggcacctgatcacccgcatgatccctttcgtggaaaacaactataacgtctgcgaactgggcccacgcggcaccggtaaaagtcacgtctataaagagtgttcgccaaactcgctattagtttccggcgggcaaaccacggtagcaaacctgttttacaacatggccagccgccagattggcctggtcggcatgtgggatgtggtcgcgtttgatgaagtggcagggatcactttcaaagacaaagacggcgtgcaaatcatgaaagattacatggcgtctggctcgttttcacgcggcagagattcgattgaaggcaaagcgtcgatggtgttcgtcggcaacatcaatcagagcgttgagacgttagtcaaaaccagccatctgttagcccccttccctgccgcgatgatcgacacggcgtttttcgaccgcttccatgcctatatacccggctgggaaatcccgaaaatgcgcccggaattctttaccaaccgctacggccttatcacagattatctcgccgaatacatgcgggaaatgcgcaaacgcagcttctccgatgcgattgataagttctataagctgggtaataacctcaaccagcgagatgttatcgcggtaaggcgcacggtttctggtctattgaaacttcttcatcccaatggctgttacagcaaagaggacgtccgtgtttgcctgacctacgccatggaagcccgtcgtcgagtcaaagaacagcttaaaaagctgggcggtctggagttcttcgatgtgaatttcagctacatcgataacgagacgctggaagaattcttcgtcagcgtgccagaacagggcggcagcgaattaattcctgctggcatgccaaagccaggcgtagtgcatttagtgacgcaagcggaaagtggcatgacgggtctgtaccgcttcgaaactcagatgaccgcaggcaatggtaagcatagcgtttccggtctgggatcaagtacctcggcaaaggaagctatccgggttggatttgactatttcaaaggcaacctcagccgcgttagcgcaacagcaaaattttctgaacatgagtaccacctgcacgtagtcgaattgcataatactggaccaagtaccgcgaccagtctggcggcacttattgccctttgttccgttttactggcgaaacccgtccaagaacaaatggtcgtgttaggtagcatgacgctcggtggagtaatcaaccctgttcaggatctggcggctagcttacaacttgctttcgatagcggcgcgaaaaaggtccttctgccgatgtcttccgcggtagatatcccgacagtgccagccgagttgtttaccaaattccaggtcagtttttactctgaaccggtagatgcggtttataaggcgttgggagtaaactaa

SEQ ID NO: 3696 - DNA, 2055 bp, Lactobacillus casei
ttgacatctgatagcgcgcatgatgaagcgtctgaaaatgacgctactttaatcaagttggagcagaactttcctgggcggtttgtccgaaaagatctaacgcaaagaatcaaggaaggcgcaaatgtgccaacttatgttcttgagtttttattggggcagtttgcgaatagttcggatacggagacaattgagcgtggcgttgagaatgtcaaaaaaacgttggcgcataattatgtccgacccgatgaggccgagaaagtaaaatctaagattcgagaagacggtgcttatacagtcatcgataaactttcagttcggttaaatgaaggtgaggatcggtatgaagcgagcttcagcaatcttggcttaacgggcgtgccggttgacgagcattatgtgcaagattatgagcgtttgttaatcgggggtatctggtcaatcgtgcgagttagttacgatcacgaaagccttgaccatttctcaattcaaaagctgaatcctattcaagtaccatttgttgatatgcaagaagtctacgccggaagaaaggccttcaccactgaggagtggctggatgttttattgcgaacaacagggatggagccaactcaatttactgagcgcgaaaagtggctattactttctcgattaatcccctttgttgaaaataattacaattttgtcgaactgggtcctcgtgggacaggtaaatctcatgtctataaagagctatcgccggattcaattctgatttcaggtggccagacgactgtcgccaacttgttctataacatgtctagacgtgaagtgggacttgtcggcatgtgggacgtcgtggcattcgacgaagtggctgggattcacttcaaggataaagatggcgtgcagattatgaaggattacatggcttcgggatcgtttgcacgtgggcgaaatgagattcaagcctcagcaggaatggtgtttgtcgggaatatcaaccagagtgtggatgtccttttgagaacttccaatctctttgaaccttttcctgagatgatgggcaatgatacggctttcttggatagaattcataactacttacctggttgggagatccctaagtatcggcctgagttctttaccaaaggatttggatttatcactgattattttgcagaggtaatgcgcgagctccgtaaaatttcttatgcagatgcgattgacgagtatttttcgtttggtaaacagcttaaccagcgtgacgtgattgcggttcgtaagactgtttctgggcttatcaaattactttatccagacggtgtgtttgaaaaagcagacgttgcgaaaattcttgaatttgctatggaaatgcgtcgtcgagtaaaagaacaactcaaacgaatcgggggcatggaattctatgatgtcaacttttcttatattgataagacgacctttgaggaaacttatgtctcggttccggaaactggatcaagttcgctcattcctgatggtcaagaaaatcccggccatgtttatactgttgcttatgacgagagtaaacggcttagtctgatcaaattagaaacacaggtcgttccaggacttggtagactgagtaaatcgggcgtcggatcaagtacaaaagctaaagaggcaatggacacagcctttaagtatcttgaggccaactataaaggaattgatcaacgaattaatgccaacgcccgtgatttcgtggttagcgcgactaatttgaataattcagttccatctagccatatttctttggcgacatttatcgcgctagtttcgatcgcattagggaaaccgacactagatcgtttagtcatcttgggtgatttcacgattggcggaacgatttcacgcatcgatgatcttgccgatacattgcaagtcgccttggacagtggagcaaaacgtgtcttgctgccagctgcagcggccagcgacatcagcggtgtgccaacagatctgatgagttcatttaacttgatcttttataattcggttaaagatgcggcttttaaggccttgggtgtgagctag

SEQ ID NO: 3697 - DNA, 2055 bp, Lactobacillus rhamnosus
ttgacatctgatgacacgcaagctgattccgtaaaaaatgatgaagtgttggtcaagttggaacaaaactttcccggacgattcgtacgaaaggacttgactcagagaattaaggaaggggctaatgtgccaacctacgttctcgagtttttgcttggtcaattcgctaatagttcagatgaggagacgatcgagcgcggcgttgaaaatgttaagaagaccttagcgcataattatgtccgccctgatgaagccgaaaaggttaagtcaaagattcgcgaagatggcgcctatacggtcattgataaactcactgttcatttgaatgaaggtgaagatcgttacgaggctagttttagtaatctgggattaaccggtgtgcctgttgatgaacgctatgtacaagattatgaacgtctgttaatcggcggtatatggtcaattgtgcgcgttagctatgatcatgaaagtctcgatcatttttccattcagaaattgaatccaattcaagtacccttcgtggacatgaaggaagtttatgcgggacggaaggcatttaccactgatgaatggttggacgttttgctgcggacaactggtatggagccgactcagttcacggaacgcgagaaatggctgttattgtcacgcttaatcccgtttgtggaaaataattataactttgttgaactgggacctcgtggaactggtaagtcacacgtttacaaagaactctctccggattccattcttgtatcaggcggacaaacgacagttgcaaatctgttttacaatatgtcgcggcgagaggttggtttggtcggcatgtgggatgttgttgcattcgatgaagtggcgggaattcacttcaaagataaagatggtgtccagatcatgaaggactatatggcttctggatcatttgccagaggaagaaacgaaattcaagcttcggcaggtatggtctttgtgggaaatatcaatcaaagtgtcgatgttttgttgcggacatcaaatctgtttgaaccatttccagagatgatgggtaacgatactgcctttcttgatcgaattcataattacctacccggctgggagattccaaagtatcgtccggagttctttacaaagggctttggtttcatcaccgattactttgcagaggttatgcgtgagttacggaagatttcatatgctgacgccattgatgaatacttttcatttggaaaacagttgaaccagcgtgatgttatcgctgttagaacgacggtttcgggactagtgaagcttttatttcctgatggcgtctttacaaaagatgatgtcgccaaaattcttgaatttgcgatggagatgcgaagacgcgttaaagagcagctgaaacgagttggcggcatggaattctacgatgttaacttttcatatattgataaagtatcgtttgaggagaagtatgtttccgttcctgagtcaggctcaagttcacttattccggaagggcaagagaatccggggcatgtttatacagtggcctacgatgatagcaagcgattaagcttaattaaattagaaacgcagacagtaccgggacttggaaggctaaatcgctcaggtgttggctctagtacaaaagcaaaagaagctatgaataccgcctttaattatcttgaagccaattacaaatcaattgaccaaagaattaatgccgatgcacgggatttcttcgtcagtgcgacgaatctaaacaattcagcaccttctagtcacatttcactagcaacactgattgcacttgtttccatcgctttaggaaaaccaacacttgataggcttgtcattctaggggatttcacgatcggtggaacaatttcgcgaatcgatgacttggcagacaccctgcaagtagctttagatagtggtgctaagcgagttttgttgccagctgctgcagctagtgacatcagcagtgtgccgactgatctcatgagttcgtttaatttaatcttttacaattctgtgaaggatgcagcgtttaaagctctgggggttggctga

SEQ ID NO: 3698 - DNA, 2055 bp, Lactobacillus rhamnosus; identical to SEQ ID NO: 3697

SEQ ID NO: 3699 - DNA, 2139 bp, Leuconostoc kimchii
ttgactttagttaatgatgacaacaacttacacgatgacttagagagttcaaatgacgacgtagatattactgccactgaagttttagcctctgggagtgatagtaatttcgacttgctggacaagttggaaattaactttcctggtcgttttgttcgtaaggatttgacgcagcgaatcaaagaaggcgcaaacgtgccgtcttatgtgttggagtatctgcttggtatgtatgcaaactcatcggatccagcaactatcgagcaaggtgtagaaaacgtcaagaaaacactagcaaacaattatgttcgtccagacgaggcggagaaaattaagtcaaaaattcgagagaacggtgcttataccgtaattgataaattgactgttactttgaacacgcgattagatcggtatgaggcggcgttcagtaatttaggcattacgggagtgccagtggattcacgttatcctcaggattatgagcgtttgctaggcggaggtatctgggcgattgtgcgactaagttattatcacgatgatatggaaagtgatagcacagcgccattcaatgtagaaaagcttactccaattcaagttgccggactggacatgtctgaagttcgacagggaagagaaaaattcactacggacgagtggatcgatttgttgcttcgaacgattgggatggaaccaactcaatttgaaaagcgacaaaagtggttattcatttcacgtctaattccaatggtggaaaacaactacaacttcgtggaactgggtcctcgtggaaccggaaagtcacacgtgtataaagaattatcaccaaattctattttggtttcaggtggtcaaacgactgttgcaaacttgttttataacatgagccgccaccaagtagggctggttggaatgtgggatactgtcgctttcgacgaagtagcgggtattacatttaaagataaagacggcgttcaaattatgaaagactacatggcatcgggatcattcgcacgaggcaaggatgaaattcaagcaagtgcgtcaatggtgtttgttggaaatatcaaccaaagtgtagatgttgttatgcggacatcacatttgtttgatccattccccgatgtaatggccaacgattcggcatttttggaccgaattcataattacttgcctggctgggaaattccaaagtataagccttctttttttacaaagggatatggcttcatcactgattattttgcggaagtgatgcgtgagttgcgtaaaatttcatatggtgatgctttcgaagcgtacttcaaactagggaatcaattgaatcaacgtgatacaatcgcggttcgtaagacagtgtctggaatgatcaagcttatctatcctcatggagagtttagcaaggaagacgttgaagaagtacttcgattcgccattgaaatgcgacgccgtgttaaggaacaacttaagaaaattggtggcatggagtttttcgatgtgaacttaagttacattgataatgaaacgtttgaagagaagtttgtcgcagtacctgaacaaggatcttcaacattaattcctgttggaactgagaagccggggcatgtttactcagtcggttatgatgctggaaaccgactgagtttgtttaagattgagactcaaatgactgcgggtaacggcaagtttgcgactactggtattggtggtcaccgtggcgcgaaggaaagtatggatacagcatataagtatctgaaagcaaatgcaggccaggttagtggtactatctcgttgtcacaacatgactttatattgaacgctaccaacttaaataatggcttgatgacagaccatttgtcattggcgacgtaccttgctttgatttcaattagtctcgcaaagccaactgttgatagccttgttgttgtaggagatttaacaattggcggatcagtagttaagcctgagaatcttgctgatacgctacaggttgcacgggatagcggtgcaaagaaagtgttactaccaatgacctcagctgccgattttggtactgtccctagcgatttgctaggatcatttacaattattttctataatacgattgaagaagctgcttttaaggctttgggtgttgaatag

SEQ ID NO: 3700 - DNA, 2037 bp, Methanoculleus bourgensis
atggcagaattagacgccctcgaccagttagttgccgacgtctttgacggctacgttgtcagaaaagacctcgcgcagaagttcaaaggaaactacccggtccccacctacgttgcggagttcctcatcggaaaatactgtgccacaaccgatgaagaggagatcagagaggggctcgagattgtccagcgtcagctcagcgaacgcatcgtccgtgcaggggagcaggaactctacaaagcgcaggcaaaggtccacggcagcgtcaaagtcattgaccttatcaccgcccggctcgatgccaagtcagattcgttccttgccacggtcccctctctcctcctgaacgatgtccacatctcatcagaactcgtctacgaacatgagcggatgctgaccggcggattttatgcagagatcgaactcgcatacggcgatcctgagagcaaccgcccgttctcggttatgcgcctgcgccccatccagctctcaaagaggaacgtcctcaatgatgtcacccgagggcgggagagcatgtcagaccaggaatggaaggatatcctcatccggagtgtcgggatagaaccctcctcgttatcatcgagagcacaggatgtcctcttcctccgcatggtcccgtttgtcgagaagggctacaacatgatcgagcttggcccccggggaaccgggaagagttacctctaccagcaggtcagcccatactcccacctcgtctccggcggaaaggcaacggtcgccaagatgttcgtgaacaatgcaaccgggcagcgcggcctcgtatgccagtacgacatcgtctgtttcgacgaagtatcagggatcaactttgaccagaaagacggcgtcaacatcatgaagggctacatggagagcggggagttctcccggggcagggaaagcatcagggccgagggtggcattgtcatgctcggcaacttcgacgttgacgtcgagcaccagcagcgggtgggccacctcttcggcccgctgccaaaagagatccgcgacgatacagcgttcatggaccggattcacagttatgtcccggggtgggattacccgaagattcacccggatatgatgacagaacatttcggtcttgtcagcgatttcctgagtgaatgctggagacagcttcgaagcgagaaccggctccacctcatcaatgaccgtgtcttcttcggggacgcattgagcggccgtgaccgccgggccgtgaataagaccgtaaacgggctcctgaaactcatctacccctcaccagatatggagatatctgatgagacccttgagtgggcggtgcgcatagccctcgagtgtcgccgcagggtcaaagagcaacagaaacggatcgggtctgccgagttccgcaacaccatgttcagttacaggctcggtctggacggtattgaacagtatgtttcaaccccggagttacacagcgaaaacgagatcgggcaggacccgctgcccccaggtcaggtctgggcagtcggtccgggtgacgagaacgaaggaagcggcctctataagattgaggtcacggttactccaggttcatccatccgcctgatcaatgtaaaagcaccctccggacttcgcgaggggctccgcgctgcagaacaggttctctacacacaggctaagtcgcttataggcgaccgggatccgaaggggagcgaattctccgttcaggtccgtgcgctcaccgcggtaaagggggcgtcgtcgctaggaatgtcaattcttcttgcactctgctccgcggcgttgggcagaagtctcaaaggcggggtggtcgtagcagggggtattagtgtgggcgggacggtcgaaccggtctatagtgcactggatatggcggagttagccgcggaaaacggggcatcagcaatcctgctaccagtatccagccggaggcaactcaacgagatgtcagatgacctggcgtcccggctgatggtcatctactataaggatccacgggacgccctgttcaaggttcttggtgagtga

SEQ ID NO: 3701 - DNA, 2040 bp, Methanolobus psychrophilus
atgctgaccaatgacacagacatcggaactgacgaaaaactgaatctatactttcctggaagagtggtcaggaaggacctgacaaagcagatcaaggtaggccacaacgtccctgtctatgtccttgaatacctgctgggagctaactgcgccaccactgatgaggagctgatacagcagggtgtcaagaaggtcaaaggcatcctctcagacaactatgtccgcccggatgaagcagagaagatcaaatcaaagataagggaaacaggctactacacaatcatcgacaaggtctctgtgaaactgaacgaaaaaagagacatctatgaagctctcttctccaacctcggcctgtcggctgtacaggtagaccctgagtatgtcacacgatacgataaacttcttggtggaggtatctggtgcataataaagatggagtacaacgccgaaatggtgccatccccttttatcatatcaagcctgaagcccatacagatccctaacatcaacatctctgaggtaatagagcagcgcaagaacttcaccaaggatgaatggatagatgtcctcctaagatccgtaggcatggaaccaacacaactggaaatgcctgccaaatggcatctcttggaacgcatggtgcctctcgtggagaataattacaacctctgtgaacttggcccccgcagcacgggaaaatcccatatctacaaggaaatatcccccaactccatacttatatccggaggacagacaacagttgcaaacctcttctacaatctgggtacacgtcaggtaggtcttgtgggtctctgggacgttgtagcctttgacgaggtagcaggcatccgtttcaaggacaaggatggcatccagatcttaaaagactacatggcatccggctcctttgcaagaggcaaggaccaaatcaacgccaatgcctccatcgccttcgttggtaacgttaaccagagcatatcatcgttacttaagacatcccatctcttctctccattccctgaggcaatgaacaatgacagcgcattctttgacaggatgcattactacttgccaggatgggaagttcctaaattccgaccggagcatttcacagacagatatggtttcatcgttgactatctggcagagttcctgagggagatgagaaaacgctcctacagcgatttgatcttcaggtatttcagcttgggtaacaacctgaatcagagagatgttatcgcagtcaaaaaaaccgtttcaggacttgcaaagatcatccacccagatgaggatatatcaaaacaagatgcgcaggagatactggaatatgccctcgtgggaaggcgaagggtcaaagagcaactgaaaaagatcgggggcatggagttctttgatgtgaatttctcctacatcgacaacgaagatatggaagagcactttgtcaacgtccctgaaagcggggggaacaagataataccacctggtcttacaaagcccggacaggtctatgcagttgctgcaacagagtccggaaagataggcatttacaagacagagctccaggtagtatcaggttcaggcaaatatgaagcatccggtctcaattcgaatgcaaaagcaaaggaatccgtaaaaacagcgatcaactatttcaaagccaacgccaagtccataagccaatcgatctccactaaagaaagagattatttcatgaatctgcaggatgtctatggagtcggggcctctgatggcctgtcactggctgctttcatcagtctctgttcaggagcgctggaaagaccaatacaggaacagacagctattatcgggactatgaccataggcggctccatcttgaatatagacaacctctcagatcttctgcaagtctccctagatgccggggccaggaaggtattgattcctgcatccgctacatcaaaattgggtactgtgccagctgatttgttgagcaagttccagcttgcattttatgctgatccggttgatgcggtgcataaggcgctgttctttggatga

SEQ ID NO: 3702 - DNA, 2037 bp, Methanomethylovorans hollandica
atgccagaagcagacacagacataacaactgacaggaaactgaacacatatttccagggcagagtggtcaggaaagacctgacaaagctggtaaaagtaggccacaatgtccctgtctacgtcctggaatacctgctgggtgcgaattgcgctaccgatgacgaagaactcatagagcagggtgtcaggaaagtcaagaacatcctctcagagaactacgtgcgtcctgatgaggcagagaagatcaaatccaagatacgggaaacaggttactataccatcatcgataaggtctccgtaaagctgaatgaaaaaagagacatctacgaagctgttttttcacacttgggactttccaaggtgcaggtagacccggaatacgtcacaaagtacgacaaactgctgggcggtggcatctggtgcatcattaaaatggaatacagcgctgaaatgctgccttctccttttgtcattgcaagcctcaaacccatacagatccccaacatcaacatctcagagatcattgatcagcggaagaactttaccaaggacgaatggatagatgtgctcttgcggtccataggcatggagcctactcaactggaaactcctgcaaaatggcatttgatggaaaggctagttcctttgatagagaacaactacaacctctgtgaacttggtccaaggagcacaggcaaatcccacgtgttcaaagaaatatcccctaattccatccttatctcaggcgggcagacaactgtcgccaacctattctacaatatgggtacacggcaggtcgggctcgttggcctgtgggatgttgtagcctttgacgaggttgcaggtatcaagttcaaggataaggatggcatacagatcatgaaagactacatggcatccggctcctttgcccgtggcaaggaccagataaatgccaatgcgtccattgtattcgtaggcaacatcaaccagagcgtctcctcgatgctcaagacctcacatctcttcgttcctttccctgaagagatgaacaacgacagtgcatttttcgacaggatgcactactacctgccaggctgggaagttcccaagttcagacccgagcacttcactgacagatatgggttcatagtggattatctggccgagttcctgagggagatgagaaaacggtcattcactgatgtgcttttcaaatactataaactcggcaacaacctgaaccaaagagatgttatcgctgtcaagaaaacattctccggtcttgccaaactcatatatcccgatgagaacatcacaaaagaggatgctagggagatcctcgagtatgcacttgtagggagaagaagggtcaaggagcaattgaagaggatgggaggcatggaattcttcgatgttaacttctcctatattgacaatgataacatggaagagcactttgtcaatgtccccgaaataagtggtaataagatcattcctccgggtcttacaaaacccggccaggtctatgctgtgtcagcaaccgattccgggaagataggcgtttataaaacagaactgcaggttgtctcaggtacaggtaaatacgaaccctccggtttaagctctaattcaaaggccagagagtccataaggactgctatcaactacttcaaggcaaatgcaaaatccataagccaatcaatatccacaaaggaaaatgactatttcatgaacatacaggacctgtacggagtcggtttgtcagacggcctggcccttgcaggcttcataagtctctgttcaggagctatggaaaggccagtccaggagcaaactgccatcatcggaacaatgaccataggaggttcaatactgaatatagataacctttccgagctcttgcaagtctcccttgatgccggggctaagagggtgttgatacctgcctcatccacatctaaactgggcactgtgccttcagacctgctgagcaaattccagctgtccttctatgctgatccgatggatgcggtgcataaggcgctgtatttttag

SEQ ID NO: 3703 - DNA, 2049 bp, Methanosarcina acetivorans
atgaccgaagaagctcttgagatagcaagcctcgaaaccgacagaaaattaatccagtattttcctggaagagttgtacgaaaagacctaacaaaactgctgaaagtcgggcataatgtccctgtctacgtactggaatacctgctcggctcttactgtgctgatgaggacgaagaagtaatccaggaaggcatccagatagtcaaaaatatcctgtcccagaactatgtccggcctgatgaagccgaaaagatcaagtcgaggattcgtgagacgggctactatacggttattgacaaaatcacggttatgctcaatgaaaggagagacatatatgaagctacattctccaatctcgggctcaaaagcattgaggtcgactctgattatgtcataaaatacgacaagcttctcggcggtgggatctggtgcatgatcaagatggagtattcaacagaatcagcttcttcgccattcataatatccagtttgaaacccatccagatcccgaatgtgaacatccaggagatcctggttgaaaggaagaacttcaccaaagatgagtggattgatgtccttatgaggagcatcgggatggagcctacccagctcgaagcttccacaaaatggcatatgctcgaaaggctcgtccctcttgtagaaaataactataacctctgtgagctcggtccgaaaagtacaggaaaatctcatgtttacaaggaaatatccccgaataccatcctgatgtccggaggacagaccacagttgcaaatcttttctacaacatggccacccgacagataggacttgttgggtactgggatgtcgtggcatttgatgaagtcgcaggaatccgtttcaaagacaaggacggaatacagatcctcaaagattacatggcctccggctcttttgcgagaggaaaagagcaaaagaacgcgaatgcttccattgtttttgttggaaatgtcaaccagagtatagaatccttattgaagacctcacacctgttctctcccttccctgaagccatgaacagtgataccgccttttttgacaggatgcactattacatccctggttgggaaatccctaaattcaggcctgaacacttcacggacagatacggattcatagttgactatattgcagaattcttcagggaaatgaggaagaggtcatacgccgacaacataaacaggttctttaagctagggaacaacctgaaccagcgggatgtaattgccgttaaaaagaccttctcaggtttaatgaaacttctttatccggatgaaaatatcaccagagaacaggcacaggagattcttgagtacgccctcacaggaagaaggcgtgtaaaagaacagctcaagaaaattggggggatcgagttctttgatgtcaatttctcttacattgacaatgaaaacctgaaagaagctttcgtgtccgttccagaaagcggcgggaacaaaataatcccttcaggcattacaaaacccggagaagcctatgctgttgcagctaccgacttcggcaagatcgggatttacaagtttgaagttcaggtaattgctggttcgggaaaatacgaaaaatcaggcacagggtcaaattctcagaccaaggaatccataaaaacagctttcaattacttcaaagccaacgcaaaatccataagccagagcatctctgtaaaagaaaaagattactttttgcacgtccaggacctctacggagttggcatgtccgaagaacttgcccttccagccttcataagcctttgctcaggagcattggaaaggtctcttcaggaacagaccgcaattctagggagtatgacaatcggaggctctgtaggtgtacttgaaaaccttgctggtcttttgcaggtctgccttgatgcaggagcaaaaagagtaatgatcccgatttcttctgcaggcaagattgctacagtgccgccggatcttttcagtaagttccagatttcgttttatgaggaccctattgatgctgtttacaaatctatggctttgatttaa

SEQ ID NO: 3704 - DNA, 2049 bp, Methanosarcina mazei
atgaccgaagaatctcttgagacagaaagcctcgaaaccgacagaaaactaatccagcatttccccggcagagttgtgcgaaaagacctcacaaaactgctgaaggtcgggcacaacgtccctgtctatgtactggaatacttgcttggctcttactgtgcagatgatgacgaagaagtaatccaggaaggcatccagatagtaaaaaacatcctgtcccagaactatgtccggcctgatgaagctgaaaagatcaagtcaaggatccgtgaaacgggctactatactgttattgataaaatcactgtcatactcaacgaaaggagagatatctacgaagctgagttctccaaccttgggctcaaaaacattgaaattgactctgattatgtcataaaatacgacaagcttctaggcggtggaatctggtgcatgatcaagatggaatactcaacagaatcagcttcttcgccattcattatctctagtttaaaacccatccagatcccaaacgtgaatatccaggagatcctagctgaaagaaagaacttcaccaaagatgagtggattgacgttctgatgagaagcattgggatggagcctacccagcttgaaacttccacaaagtggcatatgctcgaaaggcttgttcctcttgtcgaaaataattataacctctgcgaactcggcccgaaaagtactggaaaatctcatgtttacaaggaaatatccccaaacaccatcctgatgtccggagggcagaccacagttgcaaaccttttctacaacatgggcacccgacagatagggcttgttgggttctgggacgttgtggcgtttgacgaggttgcaggaatccgtttcaaagacaaggacggaatacagatccttaaagactatatggcctcaggctcctttgcgaggggaaaagagcaaaagaacgcaaacgcttccattgtttttgttggaaatgtcaaccagagtattgagtccttattaaagacttcacacctgttctctcccttcccggaagccatgaacagcgataccgcctttttcgacaggatgcactattacctccctggctgggaaatcccgaagttcaggcctgaacactttacggacaggtatggattcatagttgactatattgcagaattcttcagggaaatgaggaagaggtcctacgccgacaacataaacagattctttaagctagggaacaacctgaaccagcgtgatgtgatcgccgttaaaaagaccttctcaggtcttatgaaactcatttacccggatgagaatatcaccagggaacaggcgcaggagatccttgagtataccctcgttggaagaaggcgcgtgaaagagcagcttaaaaaaataggagggatcgagttcttcgatgtcaatttctcctatattgacaatgaaaacctgaaagaatccttcgtgtccgtcccagaaagcggtggaaacaagattatccctgcaggtatcacaaaacctggtgaagcctatgctgttggagctaccgaatctggtaaaattgggatttacaagtttgaagttcaggtagttgcaggctcgggaaaatatgaaaaatcaggtacaggctcaaatactcagacaaaggaatccataaaaacggcattcaattacttcaaagccaatgcaaaatccataagtcagagcatatctgtaaaagaaaaggattactttttgcacgtccaggacctttacggagttggcatgtcagaagaacttgcccttccagccttcatcagcctctgctccggcgcattggaaaggtcacttcaggaacagactgcaattctagggagtatgacaatcggcggctctgtaggtatacttgaaaatcttgctggtcttttgcaggtctgcctcgatgctggggcaaagagagtaatgattccaatttcttctgcaggcaagatcgcaacagtgccgccggatcttttcagtaagttccagatttcgttttatgaggatccaattgatgcagtgtataagtccatgtcactgatataa

SEQ ID NO: 3705 - DNA, 2046 bp, Methanospirillum hungatei
atggccgaattagataacctggacgaacaagtaaccaagatatttgatggatacgttgtccggaaagatctggcacagcaattcagaggaagttatccggtccctacctatgtagctgaattccttatcggacgatattgcgcaacaactgatgacgaagagatcaaagaaggacttgagatcgttcaaagacaacttcaggaacggatagttcgggcaggtgaacaggagttatttaaagcccgtgccagggagaaaggatcagtcaaaataatagatctcgttaccgcacggctggatacgaaaactgatacttttgaagctagtcttccctctttgatccttgatgatgtatacatccctgcggaaatggtctatgataatgaacggatgctcaccggggggttttatgctgaagtcgagatcgaatatggaagcggaatagaggggaaagggggccgaccattctctatcacaaacttaaaaccgattcaactctcgaaaagaaatgtcctttccgatcttgctgaaggtcggaagcagatgagcaccgaagactggcgttcatttcttatcagaagtattggacttgaaccagaaaccctctcaaaaagagcacaggatgttattttcctccggatgatcccctatgtagaaaagaactacaattgtgttgaactaggtccaagaggaacgggtaaaagttacatctaccaggaaatcagtccatattcacatctcgttagtggaggaaaagcaaccgttgcaaagatgttcgtcaataatgcaacgggccagagaggacttgtctgtcaatatgatcttgtttgttttgatgaagtagcgggaataaaatttgacacgaaagagggggtcaatatcatgaaaggctatatggcctccggtcaattcagccgtggaagagaaaatatccgggctgagggggggcttgtaatggtgggaaatttcgatgtcgatgttgaacatcaacaacggatcggtcatctttttggccccctccctccggagatgagagatgatactgctttcatggaccggattcacagttacataccaggatgggatttcccgaaatatcacccgacacaacttaccactcatttcggtcttgtatctgatttcctgtctgaatgctttagacaactcagaaatgattcccgcttaccgaagataatggatcgggtatcatttggggatgctctatcaggaagagaccggacaggtgtcttaaaaacccttgatggattactaaaacttctatatcctgctcatgactcggatatttcggatgaagatcttgaatgggctgtccgccttgctcttgaatgtagaagaagagtaaaggaacaacaaaaacggatcggttccgcagaattccgaaatactatgtttagttaccggctcggaatagaagggattgagcaatatgtatcaacaccagaactccatcgcgagaatacaatttcacctgagcctctccctcccggccaagtctgggctttaggtcctggagaaggaaatgaagggaacggactttataaactcgagattactgttactcccggatcttctatccggctgataaatgtaaaagctgctgctggacttcgggaaagtttaagatctgctgaacaagttctctatactcgtgcaaaatctcttgtcggggatcatgatcctacttctgttgaattctcagttcaggtccgggcaatgaccccggtcagtggaggatcttcattgtctgttcctatattaatcgccctttgttctgctgctcttaataaaagcacaaaaggaggatatgttattgctggaggaatgagtgttggtggaactcttgagccggtttacaatgcacttgatatggctgaacttgcagcagaaaaaggggctttagcaatagttctcccggtttcctgcagaaaacagatgaacgaaatgtctgatgaactcgctgccagattggttgtattgtattatacagaaccaagggatgcattgctgaagatgctggatgagtaa

SEQ ID NO: 3706 - DNA, 2064 bp, Methanospirillum hungatei
atgactgacctgacacccgaaccactaccggaacagagcgatgatcctgatacagataggaagcttaacacctggtttcccggcagggtggtcagaaaagacctcaccataaaactcaaagggtccaataatgtcccggtctatgtccttgaatacctgcttggatcctattgtgccaccgatgatgaatcactcatagaagaaggagtcacaaaagtaaaacggattctggcagacaattacgtccggcctgatgaagctgaacttatcaaatccagaatcagggagaccgggtattacaccgtcattgataaaataaccgtccggctgaatgaaaagagggatgtatatgaagcagagttctcatcccttggaatcaaggagatagagattgaaccggaaacaatcagaagatatgagaaattgctcgggggtgggatctggtgcatcgtaaagatggaatatatgtccgaaggatcgcgatcaccctttgtcatcgcaagtctcaaaccgattcagatcccgaacatggatataaatgaactcatcgaccggaggaaatacttcaccaaagatgagtggatcgatatactactccggaccgtcgggatggaaccggacacccttgattatacggtaaaatggcacctgctcctgaggcttgtacccctggttgaaaataattacaacctttgtgaacttgggccgagaagcactggcaaatcccatgtatacaaagagatatccccaaattcaatcctcatctccggaggacaaaccaccgtcgcaaacctcttttacaacctaagcttacgacaggtcggacttgtcgggctctgggatgtcgttgcttttgatgaagtagccggaatcaggttcaaggacaaggatggcatccagatactcaaggattacatggcatccggttcatttgcccggggaaaagaccagatcaatgcaaatgcctcaatcgtatttgtcggaaacgtcaatgaaagtatccagtccttactcaagaccgcccatctctttgctccgttccctgatgcaatgaacaatgacagtgccttttttgaccggatacattactatctccccggttgggaagttcccaaattcagacctgaacacttcaccatgcggtatggattcatcgtggattacctggccgaatacctccgtgagatgaggaaacgttcgtttggtgacactatcttcaaatacttcagatttggcagtaacctgaaccagcgtgacaccatagccatcaagaaaacctgttccggtcttttaaaactcatctacccggatgacagtgccacaaaagaagatgttcgtgagatactggaatatgcccttgtcggacggagaagggtaaaagaacaactcaaaaaaatcgggggcattgagttttacgatgtcaacttctcttatttcgataacgaagaagggaccgagcatttcgtgacagtcccggagagcggagggagtaagttaatccccgaaggtatgaccaaaccaggtcaggtatattcagtaagtcgaaatgaagagggtaaaataggagtatataagtttgagctccaggttatacccggctctggaaaatatgaaaaatcgggtcttggatcaaatatgaaagcaaaggaatcagtccagaccgcttttcattatttcaaagccaatgcaaagtctgtaagccagagcatctccaccaaggaacgggattatcagctccatgtgcaggatctcatgggtgttgggatatcagatgaactggctcttccggctttcatcagtctctgttccggtgctcttggaaaaccggtccatgagtcgattgtcattcttgggaccttcaccatcggtggctcggtgagcactattgataatctatccgatctccttcagattgctcttgatgccggggcaaaaaaagtcctgataccgatctcatcagcaggaaagatctcggttgttccccctgacctcttcagcaaatttcagatatcattctatgaagatccagtcgatgcggtgtataaatcgattgtattgtcgtag

SEQ ID NO: 3707 - DNA, 2142 bp, Microlunatus phosphovorus
atgaccgacaccgggagcccgggcgcgcagaatccggaagccgagccgagcgcaccgcagcagagcgacctcgactacatgatcaacctgctgttcggcgggtccgtcgttcgcaaggacctcgtgaaggccgtcaagggcaacgcgatcgtcccctcgtacgtgctggagtatttgctcgcgcagtacgcggcctcggacgacgaagcgacgatccaggcgggcatcgatgcagtgcgcaggatcctggctgaccactacgtgcaccgcaacgagtcggaactggtgaagtccaccatccgcgagaagggccgtcaccggatcatcgacaaggtcaccgtgaccctgaacgacaagcaggatgtctaccaggcttcgttcgccaacctcggcctcaacggcgtgatcgtcgaaccggcgacagtgaaggccaacccgaaactgctcgtcggcggcgtgtggtgcatctgcgacatcgaatacttccacaccgacgatgcccgagtcgtgccgtggattctcgggtcgctgaagccgatccagatgtcgagcttcgactacgagggctatctcgcgtcgcgtgagggcttcaacaccgaagagtggatcgacctgctgattcagtccatcgggttcaaccccgagatgtttgggcggcgggccaagctgctgcagctggttcggctcatcccttttgtggaacgcaactacaacctcgtcgagctagggccgaagggcaccggcaagtcgcacatctactccgagttttcaccccacggcatgctgatctccggcggcgaggtcaccgtcccgaagcttttcgtcaacaatgccaacggccgcatcgggctggtcggctactgggatgtcgtcgcgttcgacgagttcgccggcaagaagaagcgcaccgacaaggcgctggtcgacatcatgaagaactacatggcgaacaagtcgttctcccgtggcgtcgagacgctcggcgccgaagcctcaatggtgttcgtgggcaacacctcgcacaacgtgccctacatgctcaagcactccgacctgttcgacgagctacccgaggcgtatcacgactccgcctacctcgaccggctccacttctacatccccggctgggaagtcgacacgatccgcagcgagatgttctcctccggttacggcttcgtcgtcgattacatcgccgaggtcctacgggcgatgcgccacaccgactactccgaccgctaccagcagcacttcaccctcggctcggacatctccacgcgagatcgcgacggtatccacaagaccttctctggcctgatgaagctcatctatcccaacggtcaggcgacgccggatgagatcgaggaactgctccgcttcgccgtcgagggacgcaagcgcgtcaaggaccagatcctgcgaatcgacaccaccatggccgccgtcaacttcggctactccgacaaaacgggcacctggcgcggcgtcacgacactcgaagaggacgagtaccccgactactaccaagcccggcgagcccagaccgaggaagaccccgatccgttcggccctgctgagtcctcggaggagaagggtgaggctccgctcctgccaccggttgaagtcgtgccccagctattcgagggccaccgcgagttccaggagaaccaacgcgggatctcgtacgaaacgttgctcatgccgtacttgctcggcgccagcgagatcagcatcgtcgacccctacatccgcctagcgcaccaggggcgcaacctcgtcgatctgctcgcgctgctggccgccagcaaagaccccgccgacgagatcgccgtgacgctggtgaccaaggaggtcaggggtgagtacgaacagcaacacctcctcatgctcaaggacatccaggacagcgcagccaccgtcggcattcagttcacggtcgcctgggatcaaaccatccacgatcgttcgatccgcaccgaccatggctggaagctcctcctcggccgcggccttgacatcttccagaagggctcgggcaaccaattcgacctcggctctcgccgccaggagttccgccaggtcttcgcgtttggcatcacctatatcaacgaatgcaaggggcctgatgacgacttcaagcactga

SEQ ID NO: 3708 - DNA, 2049 bp, Moorella thermoacetica
atggagcttgatgccctcgataaattggcagcttctgtatttgacgggtatatagttcggaaggacctggtgcgcaaatacagccggcagtatcctgtacccacctacgtggtagaattcctgctcggccggtattgtgcaactgtcgatgaaaaggagatcgaggaaggcctggagattgttgagaggcaattgcgggatcgcactgtcaggaccggtgaagaagaactttttaaggcccgggcaagggagatcgggtcgatcaaaataatcgatctcatcaaggctcgacttgacaccaaaaacgattgttttgttgcccaactgccgagcctggggctgaaagacgtccggattgacgacgccctggtgcatgaaaatgagcgcatgcttactgatggtttttatgccgaagtcaccctcgtctatgatgccaccattgcccaggagaagaacggtcgtcctttcgccattgaaaacttgcgggccattcaactttctaaagtggatgccctggcagcgctgcagcgagggaggagccagtttaccactgacgaatggaaacgcctcctgatacgctctgtaggtttggaaccggataccctttcagaacgggctcaggatatcgccctgctgcggatggtgccttttgtagagcgaaactacaacctggtggaaataggcccccggggcacgggcaaaagccatttgtttcaacaaatctccccatactcccatctgatttcaggcggtaaagccacagtggccaaaatgtttgtgaataatgccaccggacagcgggggcttgtctgccactatgatgtcgtgtgctttgatgaagtgtccggcatatccttcgatcagaaggacggcgtcaacattatgaaggggtacatggcatcgggcgaattctcccgcggcaaggagagtatccgtgcttccggcggcattgtaatgctcgggaactttgatgtggatgtccagcaacagcaacgcatcggccacttattcagtccactcccgccggagatgcgggatgatacggctttcatggaccgcattcacgcctatgttccagggtgggagtttcccaaactcaaccccaatatccatcttacggatcattttggcttggtcagcgactttctctccgaatgctggcatagactgcgtgatggtagccgggtttccgtgctccagggccgggttaactggggtggagccctcagcggtcgcgatattgaagccgttcataaaaccgttagcggcctgatcaagctacttttccccgatccggagatgccgatacctgatgaagagctagaaaagatcgtccgtttggccctggaatcgcgtcgaagggtaaaggaacagcaaaagcgctgccttaagacggaatttcgcaatactcacttcagcttctctatgggcgtggagggggtggaacagtttgttgccacgccggaactccacagtgatgaaaccatcgacagcgatcccctgcctcccgggcaggtgtgggccatcagtcccggcggccaggacgcttcaccagctctctatcgaatagaggttgcggcgggtcctggcagtggagtaaaaattcttaacgcacctgtcccgccggcatttcgggaaagcgttcgttacggagaacaaaacctgtacgtcagggctaaagagctggttggtgaccgcgatccgcgcgcccgtgagttttcaatccaattacgcgctatggacgtggaacgttcaggccagggacttggtttaccagtgctgattgcactttgcggcgctctaattgagcgaagcgttaagggtggattgatcatagtcggagccttaaaccttggtggctcaattgagatgataccaaatccggttgctgtggccgaactggccctcgagaaaggagcaacgacgctgttaatgcctatatcttctcgaaggcaattgtttgatcttcctgacgaaatggctacgaagatcaacatcgaattttatgctgatgcaacggatgcttttgttaaggcgattgttgactaa

SEQ ID NO: 3709 - DNA, 2094 bp, Parvularcula bermudensis
atgacggcactggataacaagatcaacgagcatttcgcgggcttcgtcgtgcgtaaggatctcgtgaaagccgtcaagggcaacgccattgtcccgacctatgtgctcgaatatctgctcggtcagtattgcgccacggatgatgaagcctcgatcgccaccggcatcgaaacggtcaaagacattctccggatgcactatgtgcatcggagcgaatcccgactgatccagtcgactatccgcgaaaagggccgatacaaggtcatcgatcaggtcagcgtcgcgctcaacgaaaagaccgacaattacgaagctgtgtttgaaaatctggggatcaagaaagttgccgtcgatagcggcacggtaaaggcccacccaaagctgctcgtgacgggcgtctggtgcattgctgatgttcagtacgagtttaacgaggatgcacgtatttcaccatggatattggaatccatcaagccaatccagatcgcgaaagtagactacgatcagtacagagcgttgcgcggcgaattcacgaccgatgagtggattgacttgctgatgcagagtatcggtttcaatccggaggcgtttggtcggagaagcaagctgctccagctgatgcgcctgatcccctttgttgagcgcaactacaacattattgaacttggaccgaagggaacgggcaaatcccacatttattcagaattctcaccgcacggacaactgatctctggtggtgaggttactgttccgaaactcttcgtcaacaatgccaatggccggatcggattggttggttattgggacgttgtcgcattcgacgaatttgcgggtcgggaaaagacggccaacaaagcgctggtcgacattatgaaaaactatatggcgaacaagagcttttcgcgcgggatcacgccaatgggcgctgaagccagtttcgcctttgtgggcaacactgaccacaatgttccctacatgcttaagaataccgatctctttgaggcgttgcccgcgcaattccatgactcggcattcattgatcgtttgcatgcctatctgcccggctgggaagtcgacgtgatacgcagtgagatgttcaccagcggttatggtttcatcgtcgactacttagctgagatattgcggcatcttcggtctgaagatttttcaaatcgtcccgacgagttttttagcatcagtcctaaggtctcgacgcgcgaccgggatgctatctacaagaccatgtccggctttctgaagctggtttttccggctggcgaccaaactgaagctgaggttgaagaattgctccggctcgcaatggagagccgcaaacgcgtgaaagaccagcttgctcggatcgacagcacctatcccgaagtggatttctattttgtcggatcagatggtgaaaaacatgcggtcacaacagtggaagaagaggagtatccccagttctattacaagggatcgcgaagtgagcatgatggcgagggcgacccttccacagcacaaggggaaaagcagcgcactagcggagaacagacggcccctccttcggaagggcaacattcggtgattggcggggtggccctggaggaaggtcaccatgtttatgcggagaaccgaaaaggcgtcagctatgacaagctctttggaccatacatctccggcgcgcagcgaattgtcgtaaccgatccttatatccgctttttctatcagatccgaaacatgatggaattcgtcgaaatggtcattcgcaggaagccgccggaagaccaggtttccatccatcttgtgactggtcctgatgacggaaatatcagtcgccaaagagaactgttagattcaatctcaaccgcttgtacgggaaccggtgtcgagttcagttgggcctttgacgagagcggcacagcacatgcgagggacattttgatagataccggctggaagatcgttctggatcgcggcctcgacattttccaggccccaatcaaaacggatggtttcgcgttgggagatcgacttcaagaacatcgcatgctgaagaacttctatgtgacctatgttcgcgaagatcaggcggcgcggtaa

SEQ ID NO: 3710 - DNA, 2085 bp, Pectobacterium carotovorum
atgcaaacccatcatgacttacccgttccagctgtatccgaaggggaactcgtcgcagaaggttacgatctggatgccttactgaatcagcattttcgtggtcgagtagtacgtaaggacctgaccaagcagctcaaggaaggggctaacgtcccggtttatgtgctggagtatctgcttggtatgtactgcgcttccgacgatgaccagatcgtcgagcaaggcttgcagaacgttaagcgcattctggctgataactacgtccgccctgatgaagcggagaaggtgaaatcgctcattcgtgagcgaggatcctacaagatcatcgataaagtatcggtaaagctcaatcagaagaaagacgtttacgaagcccagctatctaacctcggcattaaagatgcgctggtaccatcacagatggtcaaggacaacgagaagctgttgaccggcggcatctggtgcatgatcaccgtgaactacttctttgaggaaggacagaaaacgtcacccttctccctgatgaccctcaaacctatccagatgcccaatatggatatggaagaagtgtttaccgcgcgcacccacttcaaccgcgaccagtggattgacgtcctgctacgttcagtgggcatggaacccgccaacattgagcagcgaaccaagtggcacctgctcacccgcatgatccctttcgtagaaaacaactataacgtctgcgaactgggcccgcgcggcaccggtaaaagtcacgtctataaagaatgttcgccaaactcactgttggtttccggcgggcaaaccacagtagcaaaccttttttacaatatggccagccgtcagattggcctggtcggcatgtgggatgtggtcgcgtttgatgaagtggcggggatcactttcaaagacaaagacggtgtgcaaatcatgaaagattacatggcgtctggctcgttttctcgcggcagggattcgattgaaggtaaagcatcgatggtgttcgtcggcaacattaatcaaagcgttgagacattagtcaaaaccagccatctgctagccccctttcccgccgcgatgatcgatacagcatttttcgaccgtttccatgcctatatacccggctgggaaatcccgaaaatgcgcccggaattctttaccaatcgctacggccttatcacggattatctcgccgaatacatgcgggaaatgcgcaaacgcagcttctccgatgcgattgataagttctataaattaggcaataacctcaatcaacgcgatgttatcgcggtaaggcgcacagtttcaggtttactgaaacttcttcatcccaatggttcttacagcaaagaggatgtccgcatttgcctgacctacgccatggaggcccgccgtcgtgtcaaagaacagcttaaaaagctgggtggacttgagttcttcgatgtgaatttcagctacatcgataacgaaacgctggaagaattcttcgtcagcgtaccagaacagggcggcagcgaattaattcctgctggcatgccaaaacctggcgttgtgcatttggttacgcaagcggaaagtggcatgacgggtctgtatcgcttcgaaactcaaatgactgcaggcaatggtaagcatagcgtttctggtctgggatcaagcacctcggctaaggaagctatccgggttggatttgactatttcaaaggcaacctcagtcgcgttagcgcaacagcgaaattttctgaacatgagtaccacctgcacataatcgaattgcacaatactggaccaagtaccgcgaccagccttgctgcgttgatcgccctgtgttccgtattgctggcgaaacccgttcaagagcaaatggtcgttttaggcagcatgacgctcggtggcgtgatcaacccggttcaggatctggcggctagcttacaactcgctttcgacagcggcgcgaaaaaggttcttctgccgatgtcttccgcggtagacattccgacagtaccagcagagttatttactaaatttcaggtcagtttttactctgacccggtggatgctgtgtataaaacgctaggatttaattag

SEQ ID NO: 3711 - DNA, 2040 bp, Pelobacter propionicus
atggatacccaattgaattgcagcctggacagcctcctgaaccagcactttgccggtaaggtcgtcaggaaagacctgaccaagctggtgaaggaaggggcgaacgttccagtctatgtcctggaataccttctggggatgtattgcgcttcggataacgaagaggtcattcaggacgggttggtgaacgtcaagaagatactggccgagaactatgtccgtccggacgaagccgagaaggtgaagtccaaaatccgcgaactgggaacctataaggtcatcgacaaggttacggtcaagctgaatgaaaaacgggatacctatgaagctctgctgtctaacctgggggtgaagggggttgagatcgccagtggcaccgtcaagaagtacgaaaagctgctggtcggcgggatctggtgcattgtcacccttaattatttctacgaagagaatatgaagggctctcctttcagcatcggtgacctgaagccgattcagatgccgaacatggacatggaggggctgtttgaaggtcgcaaggcattcagccaggaacagtggatggatgttcttgtccgctccaccggcatggaaccttccgtgctggagcagcgggttaagtggcacctgatcgccagaatgatcccctttgtcgagaacggctataacctctgtgagcttggcccgaggggaaccggcaagagccatatctacaaggaaatcagtccgaacagcatccttgtttccggcggacagacgaccgtagccaatctgttctacaacatggggtcgcatcaggttggccttgtgggtatgtgggatgtggtcgccttcgacgaagttgcaggcatatccttcaaggacaaagatggcgtccagatcatgaaggactacatggcttccggttcttttgccaggggtaaagatcagatttccgccaatgctgccatggtcttcgtcggtaacatcaaccaaccggtggataccttggtcaaaaccagccatctgctggcaccattccccgagagcatgattgattcagccttcttcgaccgcttccactgctacatccccggctgggaagttccgaagatgcggccggagttcttcaccaaccagtatggcttgattgtagactaccttgccgaatatctgcgggagatgcggaagtacaatttctcggatgccatcgacaagtttttcaagctggggaacaacctcaaccagcgggataccatcgccgttcgccgaacggtatccgggctattgaagctcctgtatccccatggtgaatttgacaaggaagcagtacgccaatgcctgcactatgccttggaggtccgcaggaggatcaaggaacagctcaagaaaatcggtggcatggaattttacgacgttcatttcagctatatcgacaacgaaagcatggaagagcgctttatcggagttcccgagcagggaggcagctccctcatccctgaaggacagctgaaaccgggtacgttgcacaccgtatcaaccggatctggcggcatgcttggcctatatcgccttgaattgcaggtcatcggcggcaatgggaagttgtccctgtcggggttcggcacatcccaaaatgcgaaagagccggtcaaggtggcattcgactatttcaaagccaatctgaccagggtaagcggaatcgccaaggcgattgaccatgattaccacatgcacatggttgagctgcataataccggacctgcatcggctttgaccatagcctcgtttgtctgtttctgttcggggttactgggcaagccgatacaaagccaaatggtaattctgggtgacatgagccttggggggagcattattccggcggagaacctggccgaatcgctccaggttgcttttgatgcaggagcaaaaaggattctgattcccatgagcagtgtcaaagacataccgacgataccgggggagttgttcgccaagttccagaccagtttttatgctgatccggtggatgcggtatttaaggcgctgggggtggattag

SEQ ID NO: 3712 - DNA, 2055 bp, Pelodictyon phaeoclathratiforme
atgagtatcgttttagaccaactggatgaaaagcttctcgaacattttcgaggctttgttgtcaagaaagacctggtgcagatgctcaaagtcggcgaaaatgtccctgtgttcgtactggaatatctgattgctaattcatgttctacgaatgacgaagaggctatcaaaaaggggcttgataatgtcaagcgcatcctcagcgaccactatgtcaaccccgaagagagcgcccttatccattccaaaatcaaaaatgagggccgctacaaaatcatcgacaaaatcagcgttgaacttgataccggcaaagatgtctactgggcaaaattgcagaacagcaatatcaagcacgccaacatcagcgaaagcctggtaaaccagcacgaaaagatgatgcttggcggtatctgggcaatcatcgaaatgcgatacgatcccggcatcatgattggctcaaccatctatcccttcgtggtggaagagatcaaaccgattcagctctccaattttgagaacggccactttgtgcgcaaccgctcacacttcactacggaagagtggatcgacatccttttgcgcagctcagggattgaaccctcggcggaaggaatcacccgccgcatcaagttgctcctgatatcgcgcctcattccgctggtggaggcgaacttcaattttctggaaatagggccacgatctacaggaaaaacctatgtgttcaaggagcttaccccttatgctgttgtcatttctggcgggcagggaaccgttgccaagctctttgtacacggttccaccggcaaggttggcgctgtcgggcagtgggatgctattacctttgatgaagcaaccgacaagctcttcaaggagcgggatgccatcccgctgatgaaagattatatggaatccggctccttctcccgtgcaggtgccggtggcgaaattacaggcagcgcttcaattgtgctgaacggcaacatcaaccagccgattgaaaccgtgttgcagaactcaaacctcttaagcccgctttcccctgaaatcaacaccgataccgcctttcttgaccgtatacactactatttgcccggctgggaaatgcctaagttcgcgccaaagcatttcactaaaaacttcggcttcagcacggacttcttttcggaatgcctcaagtcacaacgcaagataaaccataccgacgttgtcgaggagttcttcgcgctcggctctcaccttaagcagcgtgacaccaaacctgtgaagaaaacagtttcaggatttatcaagctgatccatcctgacggcaaatacacacgggaggaggtgcaggaatatttgaccattgctctcgaaatgaggcgtcgtgtgaaggaacagctcaaacgtatcggaggcatggaattctgggacactaacttttcctacatcgacaaaaacactcaggaagaaacctttgtctccctgcccgaagagcgaagctctcacctcatcgaaaactcgccccttcagccgggcgtctgctacacagcaacaagcgatggagagaacctgactctggttaggatcgagaccgccgttgttaccggaagcggaaaactgaacatctccggcaccaacagcaccacaccaaaggaagacattaaaaacacctatcaatacatcaaggccaacgagaaaaccatcctcaacgagcagcactccctcaagaactacgatatctccattcaggtgacatcactcctcggctcaacgattgcgtcagggataggggccgccgcctacgtcgccatcatctccgctatctacaaaagaaacctcaagccagccctgtcgattctggggaacatctccatcggcggcgccatcgagcgggcaatgaacttctctgacaaagtatcaatgctctccgaaaatggagccaagctcgtgctggtacccatgagcaacctcaacgagttgcaggatctgccgccttctgtgctcggggctaccgatgtgcccttttatggcaataaccagatgcttatgcaaaaggtgattttgggggaatag

SEQ ID NO: 3713 - DNA, 2061 bp, Polaromonas sp.
atgacgcaagccctgacaacccctgacacccagaccgagtctttggccgacattagcctggacgatttgctcaacacccactttggcggcaaggtggtgcgcaaggatctgaccaagctgatcaaggaaggggccaacgttccggtctatgtgctggagtacctgctcggcatgtattgcgcgagcaatgatgacgccaccatccagaacggaatgcagggcgtcaagcgcatcctggccgagaattacgtgcgccccgatgaggccgaaaaggtcaaatccaaaatccgcgagagcggcacctacaaggtgatcgacaaggtgaccgtgaagctcaatgaaaagcgggacgtatacgaagcattgttgtcaaacctgggggtgaagaacgccgaagtgtcagacacctatgtgcgccagttcgagaagctgttggtgggcgggatctggtgcattgtcacgctgaaatatcagtttgaagaagatcagaagggatcacctttttcggtgaccgagctcaagccgatccagatgcccaatatggacatgcaagagctgttcacagcacgcaaggctttcaccgacgaacagtggatcgacgccctgatccgctcaaccggtatggagcccagctgcttcaaggagagggtcaaatggcacctgctggcgcgcatggtcccgctggtcgagaacaactacaacttctgcgagctgggcccgcgcggcacgggcaagagccacatctacaaggaaatcagtcccaacagcattttggtgtcgggcggccaaaccacagtggcgaaccttttttacaacatgggcgcacgcaaggtgggactcgtcgggttgtgggatgtggtggcatttgacgaggtggccggcatcaacttcaaggaccacgacggcgtgcaaatcatgaaggactacatggcctcgggctctttcagccggggtcgtgagtccatcaatgcaaacgcagcgatggtgttcgtgggcaacatcaatcaaagtgtggagtcactggtgaagacatcacacctgctcgctccgttccctgaagcgatgattgattccgcattttttgatcgttttcacgcctacgtgccgggttgggaaatcccgaagatgcggccagagttcttcactaatcaatacggcttgatcgtcgactacctggccgaataccttcgcgagatgcgcaagtacagcttcgccgacgccatcgacaagtggttcaagctgggcaacaacctgaaccagcgcgacaccatcgcggtgcgccggacgacctccggcttgctcaagctggtttgccccaacggcgaatacaccaaggagtcggtgcgcaagtgcctggaatacgcgctggagacgcgccgcagggtcaaggaacagctcaagaagatcggtggcatggagttctacgacgttcactttagctacatcgacctcgcagacagtgtcgagcgcttcgtaacggttcccgaacagtcgggcggcgctttggtgccggagggccgcctgcagcctggctcgctgcacaccatcagcatgggatcggccgagatgcccggtatttatcggctggaaatccagtccataccgggcgccgggaaggtgaatgtatcgggcgcggctccgcgtgaggcggtgcgggtggcgttcgactatttcaaggccaacgcatcccgcgtgagcgcatcgattaggccgggcgagcgcgattttcatacccatttggttgagttgcaacacagtggcgccccgcaggcactcactctggccagtttcatcgccttgtgttccgccgcgctgggcaagcctgtccagtcgcagttggcggtgatgggcgacatgagcctgggaggaaccatcgttcaggtacgtaaccttgccgagtccatgcaagtcgcgttcgatgctggagcaaaacgaatcttgttacccatgtcgagcgtgacggacatcccgtcggtaccaggggagttgttcgcgaagttccagaccgggttttactccgacccggtggacgcagtcttcaaggcacttggggtcgaatag

SEQ ID NO: 3714 - DNA, 2064 bp, Pseudomonas brassicacearum
atgaatgagctcgaccaaaagcttaccgccacctttgatggcaaggtactgcgcaaggatttactccatcggattaagaagggaaccaacgtccctaccttcgtgctggagttcttgcttgcgcgcttttgtgcgagtgatgatcaggccgaaatggatgcgggcatggaggcggtgctcgccagcctacaagacaactatgtaaagcctgacgaggccaatgccgcgcagtcaaaggtggcaaccaaaggcaagcatcgctttatcgacaaggtccatgttcggtatgtcgagaaggaaaagcgccactgggcctcattggagaatttcaattcacagcgtattgctattggtgagaagttctatcgagataatgaccgcctactggagggcggaatttgggctgaggtgacgttggcacataacgcgatcgaagaagacgactacgcgttttatatcgaagacctgcgccccatccagatcagccgctttgattttgatcgctactgtgatggtcgtactcagttcacccgtgacgagtggattgcggtgattttgcgcaccgttggcctggagccaacaaagctgtcaaagcgcgtgtgcatgcactttattgcgcgcttggctgccctcgtcgaacccaattacaactacattgagcttgggccacgcggcactgggaagtcgtatttcttcagtgaattttcgccctacgccacattgatttcaggtggacaggcgaccaagtcggcgctgttctacaacaacgcacgccgtaaggttggtctggttgggttctgggataccgtggctttcgacgaagtaggcggcatcaaagtcaaagatccggacaccattcaaatcatgaaggatttcatggcgaatggtcgcttttcgcgtggcgctgaagtgatcgctgatgccagccttagctttgttggcaatttcgatctctccatcagccaagtagttaactcggttgagcatgatcttttccaaccattgcccgctgagtttgacttggcgatcatggatcgattcgcagcctacatacctggctgggaaatgcccaagaacagcagtgaatttctaaccagtagctacgggttcattactgactacctggcggaagcattccactaccagttcaagcacaccaatcggtacgaagaagtcagcaaacgcatccgacttggcaagagtgttgagggccgtgatgaaaaaggcatcaagaagaccgtctgtgccttcctgaagattcttcaccctaccggttctccgaccgatgaggacttcgaagaatatgtagcctacgcagttgagtgccgtcgacgtgtgaaggaacagatgaataaacgcaaacccgatgatgagtttgcgcgcatcgatctatcattccttaatgcgcaggggcaagaaattgttgtctattgtcccgagtcgaaggatgctgcagctacgcagcaaccgtttagacggcagctcaacgacaaacttgcacctgagcgtgacgttgcgacagaggctacgcaagagccactggtgcccgagcctgctatcaaagtcgcagcaactccccctgttgttccagaagagttggtggagaagcacttcacgattatgtacggtgacgtcggccacacctacgaatcgatcattggcccctacctgcgaggagcaaagaccgtcgtcattgaagacccttacattcgccttcagcaccagatccagaatttcgttcgcttttgtgagtgcgtcttaaaggccggaacggtgaagaagatcaagctcatcaccggatacgacgacaacacgcagctggccgatattgcagagaagctggaagagttgaagcagagcttgcttgagatggatgtggagctagaggtcaaactcaatccgaacttgcacgatagggaaatccgcctggacaacggctgggtcatcaaagtcgggcgaggcttggatttttaccaaaagccgggtggctgttttgaggtgggcgcgaacgacttgagcttgcgaaagtgccttgaaaccaaggtggatatttttcgtgagtaa

SEQ ID NO: 3715 - DNA, 2070 bp, Pseudomonas stutzeri
atgaacgaacttgaccagaaaatcaacacacacttcccgggactcgttgtccgcaaggatctcgtcaagacggtcaagggcaacgccatcgttccctcctacgtgctggagtacctgctgggacagtactgcgccaccagcgatgagccgaccatccagaccggtatcgagacggtcaaagaggttcttgctaagcattatgttcaccggaatgaagccgggttagtccgctcgaacatcaaggaaaaggggcgctacaaggtcatcgacaaaatcagtgtcgatctgaacgacaagaaggatgtctatgaggcgcagttctccaacctgggtatcaaagaggtccttgttgattccggaacggtgaaaaagcaccccaagctcttggtcggcggagtgtggtgcattgctgatctggaatatgagtttaccgaagacaaggccgtcagcccctgggtcttgtccactctcaagccgatccagctctcccatttcgatttcgacggctatgtcgaggcccgcaagcaattcaccaccgacgagtggatcgacctgctggtgcaaagtatcggcttcaacccggatatgttcggcaagcgcagcaagctgacccaactggtccgcctgatcccgttttgcgaacgcaactacaacctgatcgaacttggccccaaggggaccgggaaatctcacatctactcggagttctcgccgcacggcattctgatctccggcggcgaggttacggttcccaagcttttcgtgaacaactcttccggaaagatcggactggtcggctactgggattgtgtcgccttcgacgagtttgccggaaagcaaaagcgcgtggacaaggccctggtcgacgtcatgaagaactacatggccaacaagtccttctcgcggggcgtcgagacgctgggcgcagaggcctccatggtgttcgtgggcaacacccagcacaccgtgccctacatgctcaagcactcggacctgttttgcgagttgcccgacaagttctacgactccgcgtttctggaccgcatccatttctatatcccgggctgggaggtcgacatcatccggggcgagatgttctccagcggctacggtttcgtggtggactacctggcagagattcttcgctcgctccgcaatcacgattactcggaccgctacaaggagcacttctccctctcctccgatatctcgacgcgtgaccgagatggcatcaacaagacattctctggcttgatgaagatcctgtttccgcatgggggggcgaccaacgaagaagtcgaggagctgctgcggttcgcaattgagggccgcaagcgcgttaaagaccaactgatgcgaatcgattccacctacgggaacgtccgctttacctatctgggcactgatggccaggccaagcctgtcaccacgctcgaagaggaggagtaccccagctactaccacaagaccatcgccgagggtgaagacgggaatatcttagaagctgcgcaaccgagcttaccgccagttccaaccgaaccactggcaccggccgagcctgtcctcaaggaaatgcaccttacattccaggagaaccagaaaggcctctccttcgatacgctgctcggtccttatctcaaggacgcgactgcaatcacagtcaccgatccgtacatccgcctgttctaccagatgcgcaacttcatggaatttttggagaccgtggtcaagcacaaggctccggatgaggaagtgtccgtgcatctggtgacgacggaagacgagttcaaaggcgaacagcagaaagaaaacttcgagaagatgaaggagtccgccagctcggtgggcgtgaacttcacctgggagttagacagcaccggaactatccatgcccgccacattgtgaccgaccacggctggaaaatctccctagatcgaggcctcgatattttccagcgatacgagttgaacgatgcctttacctttgcaaatcggttgcagcaataccggccatgcaaggcgttcgaggtgacgttcattaaacaaaagccgaatcgagctgaggggtaa

SEQ ID NO: 3716 - DNA, 2145 bp, Rhodococcus erythropolis
atgaccgaagtgagtgagacctcctacgaagctcctgtcgacagtcggccggtgcagagcgagctggatcgcaagatcaaccgtctcttccctggtgtcgtcgtccgtaaggacttggtcaagacggtcaagggcaatgccatcgtgccctcctatgttctggagtatctactcggccagtacgcggcctccgacgacgaggccaccatccaggcaggcatcgacacggtacgcaagatcctggccgaccactacgtgcaccggaaccaatccgagctggtgaagtccacgatccgcgaacgcggtcggcaccggatcatcgacaaggtcaccgccacactcaacgaaaaggcggacgtctacgaagccgagttcaccaacctcggcatcaagggtgtgctcgtcgatccgtccaccatcaaagcgcaccccaaattgcttgtcggcggggtctggtgcatctgcgatatcgagtacttccatagcgatgactcacgtgtcgtgccatggatcctgggatcgatcaaacccatccaattgtcgaacttcgacttcgaagggtatttagcggctcggcgggaattcaccaccgacgaatggatcgacctgctcgtacagtccatcgggttcaaccccgagctattcggacgacgagccaagctcatccagctcgtgcgactcatcccgttcgtcgaacgcaattacaacctcgtcgaactcggccccaagggaaccggcaagtcgcacatctattcggagttttcaccacacggcatgctcatctccggtggtgaagtcacggtcccgaaattgttcgtcaacaacgccaacgggcgtattggtctcgtcgggtactgggatgtcgtcgccttcgacgaatttgcgggtaagaagaaacgcaccgacaaggccctcgtcgacatcatgaagaactacatggcgaacaggtccttttcgcgtggcatcgagacgctcggcgccgaagcctcgatggtgttcgtcggcaacacttcccacaccgtgccctacatgctcaaacactcggacctgttcgatgagctgcctgagagctaccacgactccgcttacctcgaccgcctccaccactacattccaggctgggaagtcgacaccatccgcggtgagatgttctccgacgggtacgggttcgtcgtcgattacatcgccgaggtgctcagatcaatgcgttcggcagactactcggaccggtaccagccgcacttcacactctcatccgacatctccacccgcgacagcgacggcgtccacaagacgttctccggccttatgaagatcctctacccacacggggaggcacatccagaggaaattgaggagatccttcggtttgcgatcgagggtcgcaagcgcgtgaaagaccagatcctgcgcatggactcgacgatggttgacgtcaagttcggatacaccgacaccagcggagcatggcaccctgtctcaactctcgaagaggacgagtacccgacttactaccaccgtgagcaccacgacgttaccgagacgactgacgacacgcgtggactcacagtaggtaccccaacgtccgcaacgaaggtcgaaacaccacctgaagccgagccgccggcggaggctccactgttcgccggataccgtgagttccaggaaaatcaacgcggcgtctcgttcgacacactcctcgtcccatacctgcgcggagccgggaagatcaccatcaccgatccctacattcgtcagttccaccaagcccgcaacctcatggaactcatcgaagggatcgcgaacgtcaaagatcctgccgacgaggtacacatcaaactcgtcaccgccgaaaaccgcgacggcgacggcgacaagctgcgcaagcaactcgagtacctcgtgaagattaaacagggagccctagccgggggcatccacttcgatgtcgcattcgacggagcgatccatgaccgctcgatcgtcaccgacaccggctggaagattctgcttggtcgcggactcgacatcttccagtacgtgaccggtgacgtattcgaccttgccaccaaactccaggagtatcggcaggtcaaagcatttggggtgacctacatccgcgatgtcagtgatcggcctcgatag

SEQ ID NO: 3717 - DNA, 2037 bp, Rhodopseudomonas palustris
atgagtaccgcccctgtacgcgacgctctcgacgacaaggtcaaccggaccttcgctggcaaagttgttcggaaagacctcgtccggaaggtcaaggtcggtgccaacgtgccggtcttcgtcctcgagtttctgctcggaaaatactgcgcgtcgtcggacgagatggcgatccagatgggcctgcaggtggtcaacgacacgctggcgaacaactacatccgctccgacgagtcgatgaaggcgcagagcaaggtcaaggaaaagggtagctggaccttcatcgacaaggtcaaggttcgcctggtcgactccgattattgggcggagttgagcaacttcgggaacaagttcgtacacatccagaatcagtacgtcagggactatgagcgtctgctgaccgggggtgtctgggcccaggtggacatgcgctttgagtacgacgaggagggcaaggggaaaaaccccttttggatcgagaagctcacgccgatccagatcgcggctttcgacctcgccgagtaccagcggcttcgcgcggagttcacgacggacgagtggatcaacctcatcctgcgtagcatgggctacgagcccggcgagatgacgaagcgcttgaagctcctcttcctgacgcgtctgatcccgttgtgcgagcgcaactacaatctggtcgaactgggcccgcgcggtaccggcaaaagctatgtcatccaggaagtttctccgtacgccgccctcatgaccggcccgacgacggtcgcgaacctgttcgggcacatgggcggacgcgcgaagggcctcgttcagatctgggacgtcgtcggcttcgacgaagtcgcggatctcgagaagatgcccaaggaggtcatcaccacgatgaagacctactgcgaatccgggtcgttccagcgtggtcaggaggccgcgtccggagaagccggtgtcgccttgttcggcaacacccagcagccgatcgacgtcatggtccaaaccggacacctgttcgaaccgatgcccgaggttatccgggacgacatggcgttcatcgaccgcctgcacttctacctgcctggctgggaaatccccaagatgcggaacgacctcttcacggaccactacggtttcgtggtggatttcctggctgaggcgctgcgcgaattgcggcggcacaatttcacggagatcagcgaccggcacttcacgatgggatcccacctgatcacccgcgaccgaaaagcggtcaagaagaccgtgtcggggttgatgaagatcattcatccgagcggcgaggccacccaggacgagatcgccgagctcctggagttcgccatggagggccgacgccgggtgaaggagcagctgaagaagatgggctcctttgaatactaccacacgtccttcagctacaccctcaacgacaccggcgaagagcggttcgtgggcgtgcctgagcagggcggccgcaacatgatctcggccgatcctctcccgccgggcagcgtctacacggcggccgtcgcgcaggacggcacggtcggcatgtaccgcatcgaggtttcggtctcgtcgggatccggaaaactgaagacggccggcggcgtcaacggcgtgaccaaggaatcgatcaatcgcgcgttcagttacatgctcgcaaagaagggggatctttccatcgcccgcgaactcgacgtctccgaccttcacgtcgaggtcatcgacctcatgaacaaccgcgtcgaaggcgagatcgggctcggcttcttcatcgcggcgttctccgcactcaaaaaggctcctccatctgccgccatgctggtagtcggcgatcttagcgttcagggtaacatcaaggggctgcgatcgctggcggaaccgcttcaactcgccatggacaatggcgccaagcgagcgctgatcccgatcgagaacaaacgcagcttcctagaagttactggggacgtggtggagcacgtcgatccaatcttctatggagatcccaaaacggctgcgttcaaggcgctgggaataaactga

SEQ ID NO: 3718 - DNA, 2049 bp, Saccharophagus degradans
atggaattagaccaactcgatcaaattgccgctgcgcatttggaaggttacttagttcgtaaagatttggtgagaacctttgctcggcaatttcctgtgcctacctatgtggttgagtttttgctgggccgatattgtgccagtaccgacccggatgaaattgaggaagggttggagattgttcaacgtcaattggagtcgcgcacggtcagggctggtgaagaagagctgtttaaagccagagcctataagaacggtacggtaaagctgatcgatttggttagcgctcgattcagtcaaaaagacaatggttatgtggctactttgcccagcgtacagcttaatcgagtgcgtattaatgataacgtcgtagacgataatgagcgactgttaacgggtggattttatgccgaaatcaccttggaatatgactcactgatcgccgaagaaaaaggcgatgccttcggtattaaagacttacggcccattcagctttctaagcgggatgtactggatgatttagctgaagcaagaaagcagtttaccagccagcaatggaaggatttccttttgcgtagcactggtcttgaagcaaacgttttgagcgaccgcgcgaaggatgccaacttattgcgtatggttccgtttgtagagcgcaactataacctggtagagcttgggccacgtggtactggcaagagccatctcttccagcaggtttccccctatgcacatttaatttccggcggtaaagcgaccatcgccaagatgttcgtgaataacgcttcgggcgcccgcggcttggtgtgccaatacgatgtggtttgttttgatgaagtaagcggtatttccttcgattccaaagaagggatcaacatcatgaagggctacatggagtctggtgagttctctcgtggtaaagagagtattcgcgcagatggctcaatggtgtttgttggcaacttcgatgtggatgtagagcatcagcagcgcgttggccatttgtttggaccgctgccacaagaaatgcgggacgataccgcttggatggatcgcatccattgttatctgcccggctgggatgtgcccaaaatgcacaaagaactcacgaccgatcattttggtttggttagtgattttttctctgagtgtttaagccgcttgagattccagagccgagttagcgtactgcaaaatcgtgttcattttggcggtgcgctaagtggtcgtgatgttaatgccgtgaacaaaaccgtttctggcctgctaaagctgatgtacccgtctcaggatatggagatcagcgacgaagatcttgagtgggcggtaaggctcggtctggaagttcgtcgtcgcgtcaaagagcagcagaagcgcgtgggtgccgcagagttccgtaacacccactttagctacttcctgggtgatgacggtgttgagaagtttgtcgccacgcctgagctgcgatccgataacgaaattggcgatgatccattagaaccaggccagatttggacggtcagcgagggtggtcaggacattgacgacaaccctggcttgtaccgcatcgaggttaatgaaggccctggctctggtgtcaaaatcctcaacaacccggttccgccagcattcagggagtctgtccgttacgctgaacaaaacctctattctcgatctatgcagctggtaggtgatcgcgaccccagagcgcatgagttcacgatacagctccgggcatttgacgcttctaaaaagggatcgaagctcggcatagcctctctcgtcgctatgtgcagcagcttgctcaagaaaccggtgaaaggcggcctgatcgtcgtaggagaaataaacctggggggctcgattgaaccgatacacagtgctgtgaatattgctgaactggcggttgaaaaaggcgcgtcgtcattgttgatgccagtgacctgtcgcaggcagctatatgacctctcggatgatatggccaccaagatcgatatacagttctaccaagatgcaagggatgcgctgttgaaggcgattgtggaataa

SEQ ID NO: 3719 - DNA, 2085 bp, Salmonella enterica; identical to SEQ ID NO: 3644

SEQ ID NO: 3720 - DNA, 2085 bp, Salmonella enterica; identical to SEQ ID NO: 3644

SEQ ID NO: 3721 - DNA, 2085 bp, Salmonella enterica; identical to SEQ ID NO: 3644

SEQ ID NO: 3722 - DNA, 2085 bp, Salmonella enterica; identical to SEQ ID NO: 3644

SEQ ID NO: 3723 - DNA, 2085 bp, Salmonella enterica; identical to SEQ ID NO: 3644

SEQ ID NO: 3724 - DNA, 2085 bp, Salmonella enterica; identical to SEQ ID NO: 3644

SEQ ID NO: 3725 - DNA, 2085 bp, Salmonella enterica; identical to SEQ ID NO: 3644

SEQ ID NO: 3726 - DNA, 2085 bp, Slackia heliotrinireducens
atgaacgaactcgataggaagcttaatgaaatcttcaccggttacgttgtccgtaaggacctcgtaaaactggtgcgcggtaatgccgccgttccgagctacgtgctcgaatacctgctcgggcaaaattgcgctaccgatgatgaggagcagattgccgcgggcgtggagcgcgttcgcgatatcctcgcgaaacattacgtgcagcgagccgaggcgggggcaatacgcagcgacatcaaacaatcgggctacatgcgcgtcatcgataaagtatccgttatgctcaacgagaagcgcgacgcctatgaggcgacgttcgaaaaccttggcatatcgcgggtgctcgtcgactcggacaccgtgaagcgtaacaggcgccttctggtatccggcgtctggtgcgtcgctgatatcggctacagcccaaacgaggcgaaggatgagtcgccttatctgctccagcagcttaaaccgatccagatggcgcggttcgatctcgacgggtacatagagaagcgcacaagattcaccgtcgatgaatggctggatgtaatcatcagaagtatcgggctcgacccagagcagctcgggaagcgctcaaagctcttccaattgactcgcctcgtcacctattgcgaacggaattacaatctaatcgagttgggccctaaaggcactggcaagagccatgtgttcagtgagttcagccctcacggcatccttatctcaggcggcgaagtgacgccggcaaagctgtttgtgaacaactcaaccggacgcatcggcctcgtcggctattgggactgcgtcgctttcgacgaattcgcaggcgttaacaagcgcccgaaggccgacatcgtggacatcttgaagaactacatggctaacaagagcttcagccgcggcatcgagcaggttaccgccgaggcttcgatggcgtttgtcggcaacacgagtcacgatgtcgcttacatgatcaaccagactgacctgttcgaggacctgccgaaggtctaccacgatccagcgttcatcgaccgcattcacgcctatatcccgggatgggaggtcgacatcatccgcggcgagatgttctgcaccgactacggcttcatcgtggattaccttgcagaagcgctgcgcagtctgcgtggcctcgattactcgggacagctctgggagcgattcgagctgtccgaaactctctcgacgcgcgaccgcgacggagtcatgaaaacctactcgggcctcatgaagctcctgttcccaggaaagaatgcgacgatcgaggaagaggccgagattatcgagttcgccttggagatgcgaaaacgtgtcaaagaccagctctaccgcatcgacgagacattcgcaagggtcgatttctcgtaccgagagataggcgggcaatggcgcgaggtgtcaacgctagaggaaatcaacttcccgaacacgtaccactcgcgcgataaagtgccttgggagagaagggacgctgaggaacctctgctttccatggatgacgcatcagttcccgagaatcctgatcttcaattgtcgcaaagcgctatcgtgagtaaggcagacgaaggtccattcgtcggacataagtcgtatcgcgagaaccaacgaggagtgtcgtacgagaagcttttcggcccgtatctcgaaggcgcacggagcatcgagattatcgacccttacattcgaacgttccaccagtgtcgaaacctgatggaggttctcgaggtcattattacccacttcgactactgcgttccggaaatacacgtgcacctgctcacatgtccggaccagtacgacccagtgaagcaagatgactatctgtgccagattgcagatgcgttgcatccgttcggtctgacgttagagtgggatttcgacgatacaaacaccattcatgctcgtcatttcgtaatcgacgacaagtgggacattctgctcgaccgcggactcgacatctggcaaaaattcgacagcggtaatgcgtttgcaattgaaagccgcgtccaagagatgcgcatggtcaagcagtttgagattacgtatatgaagctttag

SEQ ID NO: 3727 - DNA, 2028 bp, Spirosoma linguale
atggaatacgccgataaagtacggactttcttttctggcaaagtagttcgtaaagacctgacagctcaaataaaaggaagtgccgtggtgccgacttatgtgctggagtacctattaggtcaatactgtgcctcagatgatgaagtgatcgttgccgatggtattgagcgcattaaagatattatcaagtcaaattttgtgcatcgtagcgatgctgaattggttaagtcgcgcgtacgtgagcagggtgagcaccgaattatcgataagataaatgtggtgctaaatgacaagcagaatcaatatgaggctgattttgccaatttaatgttgcgcgatgtgcctattgtcgaccgcatcgtgacccagcataagaagctactaagtggggcgggggtttggtgtatcatcgacctaagctatgatcatagccgggatgctaaagtacgctggggcattgagtcaataaagcctattcaggtatctgccatcgacgtacaggaatatttgggtgcccggcctcagttcactacagacgaatggctggatctgttgctgcatagcattgggtatgaaccccaatattttagccgtcgtgataaatttatacagttatcacgactcattccttttgttgaaagcaattttaactttatcgaacttggtccaaagggaactggtaaatctcacgtcttctcagagctatctccacacggcgtattggtatcaggaggtgatgtttctaaagcaaccctatttgtcaataataatacaaggcaattgggtctagtaggcttttgggatgtggtagctttggatgaattcgagcaagaaaagaacagcaaaaccattgatggagacttagtaaaaattcttcagaattacatggccaaccaatcgttcaaccggggtaatgataccatcatggcaaccgcttccatggcctttgtgggtaatacaaagcacacggtgccgtatatgcttaaaaacagtcacttgtttgagtccataccccaaggttacctaaaaggggctttcctggaccggatgcatctgtatattcctggttgggaagttcgaattctgaaagaaagcgtatttagccatgggcatggctttattgttgactatttagcggaaatcctgcgtgagatgcgtcggctcgatttttccgatttactttcatcggttgcaattctggatccatccctaacccaacgggataaattagctgttttcaaaacgttttcgggcttagcaaagctgttatatccgcatcggcaactgaccgaagaggaagcagaagagttagtcgaatttgcaatggaaggccgtcgccgggttaaagaacaactgtatcttattgatgagaccttccaacaacagccatccctgtttcgatacgtacataaggccactggccaggagagggaagttgctttgctggaaagtctaagcctggactcaacgttcgaaattccagacgtgattacggttgatgtcgactcaggaagtgtaaatacgacaagtacaaatcctacgaccaacaaactatttataggtgatagggcattcaaggagaaccagaccggtttgtcatttcgcaagttattcggtgattatattgaaggggctaaacaaatttcactgattgatccatacatccgtcagcctcatcaataccgattgcttatggaatttctggtgttaatctccgaaagaaaaccacttgaccaagaagtagacgttgaagtagttacctactttgagtcaccggataaagagatagaagcgaaagctaactttgatcagttaactgaatctgttgcagacctagggattcagttaacttaccgctttgatcccgcaatccatgaccggttcatttatctgaacaacggctggcgaataaaattaggaatgggattggatatgtttcaaaagcctgacttaatggatatagctagtgtcttcccagaaaagagaaagtgtaaaaaacgttttgaaataagttatcagcgtatttaa

SEQ ID NO: 3728 - DNA, 2025 bp, Sulfuricurvum kujiense
atggatttgaaccaaaaaatcatcgacaattttccgggaaaagcggtccgaaaagatctgaccaaaaagctcaaagggggcgtgagcgtcccggtctatgtcctcgaatacctgctggggatgtactgcgccacggacaacgaagagacgattgccgaggggatcgagaaggtcaaagagatcctgacccaaaactatgtccgccccgatgaagcggagatggtcaaatcccggatcaaagagcgggggcgctacaaagtcatcgacaagatttcggccaaactcaatgaaaaagaggaccgctacgaagccgatttctctaatctcgggatcaaacgggtcatcatccccgccgaggtgatcaaagaataccaaaaactccttgccggggggatctggtgtatcgttaccatcagctatttttacgacgagaacaacaagggagaatccccatacgtcctcgaatcgctcaaaccgatccagatgccggggatggatctctctgagttcctgagtgcccgcaaagcgttcgagaaagaggagtggatggatctgctgatccgttcgacggggatggaaccggcaaacctcgatatgagtgccaaatggcacctgatggcacgtctgatcccctttgtcgaaaacaacttcaatatgtgcgaactgggaccacgcggaacgggtaaatcgtatgtctacaaagagatctcccccaactcgatcctcgtcagtggcggccagacgacggttgccaacctcttttacaatatgtcgagccggaccgtcggactggttgggatgtgggatatcgtggcgtttgatgaagtggccggaatccggttcaaagacaaagacggcgttcagattatgaaggactatatggaatcaggcagctttgctcggggcaaggagatgaaagaagcccgtgcttcgatgatcttcgtcggaaacatcgacggcagcatcgccaatatcgtcaagacctcccatcttctcagtccgttccccagcgagatgatcgatacggcgtttttcgaccgtttccatcactatctccccggctgggaagtgccgaagatgcgtccggaattcttcacagaccagtacggatttattaccgactatatggccgaatggatgcgtgagcttcaaaagagcaatttttccgatgcgattgaccgctatttccgtttcggaaaagatctcaaccagcgcgacgtcaaggcggtccgaaaaacgacgagcggattgctgaagctgatgttcccggatggcagctttaccaaagaggatgtcgaacaagcattgatctatgcactcgtcggacgccgccggattaaagaacagctcaaaaagattggagggatggagttctatgacgtccatttcagctacatcgatctcgaaaacggtgaagagaagtacgtcaccgttcctgaaagcggtggcggcggattgattccggagggtgaactctctccgggtgcactctatgcggttgcgaccaacagtgccaatggccataaaggtctgatccgactcgatttgcaggtaatgggcggaaacggtaaaatgaccgatacgggatttggaacgggtacgatcaaagatgagcttaaagaggcccgcaactatcttcaggcaaacctctcccgtgtgtcgctctctgccaaattcagcgagcacgattaccatatcaaagccaacgatttaaacggcataggaggagctcaggggctcacattggcgatatggctatccctggtttcaggaacgctttccaagccattattgcctcaattagctgtactggggtcaatggggatcggcggtggaatcatcggaaccgacaacctcgcagatgcgttgcagatcgcagcggacagcggtgcgaaacgggttctcatccctgcggccgatatggtccattacggaacggttccaaccgatttgatgtcaaagttgcagccgattatctatacggatccagttgatgcggcgatgaaggcgatgggggtgaattga

SEQ ID NO: 3729 - DNA, 2028 bp, Synechococcus sp.
gtgtctgagctagatcgtaaagtagcatctgtatttgcaggcaaggtagttcgcaaggacttggttcgtaaggtaaaagtcggagcaaatatccctgtctttgtacttgagtatttgctgggaaaatattgcgctacggatgaccctgtagcgattgaagccgggttaaaagttgtgaataacactttatcatctaactttgtccgacccgatgaatctaacaaagcacaatcgatggtcaaagataagggaagatataccttaatcgataaagtgcaggtacgttacctctctgaagatgacaaacattgggctgaactgaagaactttggccataagttcgtccatatccctgaacattacttgcgggactacgaccgcttactgatggggggagtttgggcacaactggatattcggcaccagtacgacgaggagcaaaagggcaaacgcagccccttttggattgacaacctcaagccgattcaactagccacatttgatcttgatgattaccgttcttgcagagcagagttcacctctgaagagtggattgaccttctgcttcgtagtattggactggagccgtcgcactttgataaacggagtaagctactattccttgcaaggttaatacctttatgcgagcagaattttaacctagtagaactgggcccccgaggaacgggcaaaagttatgggtatcaggaattgactccttactccattcttcttactggccctacaacagcggctaacctcttctacaacatagctagtggcaagatgggtctagttggtatttgggatgcggtagcttttgacgaggtggctgatctacaaaaaatgcctaaagaagtggttaccacattgaagacctactgcgagtctggcacttttgcccgtggcaaagattcgctttcaggtatggcatcgatagcaatgtttggtaacactaatcaacccgtcgatgtcatggttcggtcatcacacctgtttatgccaatgcccgaagtaatcagggaagatatggcattcctcgaccgcattcacttctacattccgggttgggaactcccaaaaatgcgcatggagttcttcacaaatagctatggctttgtagtcgattatttagcagaggccttaagggaactccgcaagcacaattttaccgagataatcgaccgctatttttcacttggatcccacttaaatgctcgagatgtcaaagcggtacgaaaatcagtatcagggttaattaagttgatttatccccacggagaagtgcccaagagtgagctaggcgaacttctggaattagcaattgaaggtcgacgacgagtgaaagaacaacttaaaaaaatgggttcatttgagtaccaccaaacatccttctcttatataaatggagaaacctgtgaggagcgatttgttggggttcctgaacagggggggcgggatatgattgctactgatccgctcgcgcctggctccgtctatactgcttccgttgatgaccaaggtaaggtgggactataccgctttgaagttggctgctctcctggaacggggaagttaaagctgtcaggagggatagaaggtttgatgaaagaatctctccagagagcttttgcctacttacaaagccagaaaggaaagataggcatcgggcagcagtttgatactactgatttttatgttgaagccatagatctattaagcaaccatattccctgtgaagcaggaattgctttggtggtggcaatctattcggccctcaaaaagcaatcagtcttggcgagtctagtcgttcttggtgacttgagcattcaaggaaatattaaagcagtacgaacacttgtcgaaccattacaggtaagcatggataatggggcgcgtcgagcattagttccccttgagaataagcgtaattttctagaagtagccggtgagattatggagagggttgacccaatatttttctcagatccgatgaccgcagctatgaaagctttagggatgagctaa

SEQ ID NO: 3730 - DNA, 2040 bp, Syntrophomonas wolfei
atgatagataatttggacaaaaaggctttagaacattttcggggatatgtagtaagaaaagatttggctcctttaataaagggcggtgccaatgtgcctactttcgtactggaatatttgctggccaatacctgcagtacggaagatgagcaaaaaataaatgtgggcatggagaatgttaaaagtattctgcgcgaccattatgtaatccctgaagaaagcagtttaattcaatccaagctgagggaaaaaggacgctataaaattattgataaagtatcggttgatcttgacccgcagcgcgatcgctactgggccaatatcagtaacagcaatataaaaagggctaatatatctgatgagctggttaagaaacatgaaaaaatgttattaggtggcatttgggccattatcgacatggaatatgaccccatgataagcattggctcaagcgtttatccttttgtggtaaaagatattaaccctatccaattatctagctatgatgccggtaagctggccgccaaaagaaaagagtttagcaaagatgaatggatgaccctgcttttaagaagtgcgggctatgaaccgggcagtgaaggcctggatgacaggaagcagagccttttgctgatgagattgataccactggtggaagccaactttaatatggtggaattgggaccccgttcttccggtaaatcctatatctataaagagataactccttatgctctgctgatttccggtggccaggggacagtagcccagctctttgttaacaacactaccggacgagttggctcagtaggggagtgggatgctatctgttttgacgaaagcaccgacaaattatttaaagatagagatgccgttcccttgatgaaagattatatggaatcgggctcattttcccgcggcggtaagaccggtgaaattgctggccatgcctcggttatttataatggcaatatcaatcagccggttgaaaccgttttgcaaacttcccatttgtttagcccgttatcggatgaggttaatcacgatactgcgtttttggacaggattaatctgtacctgcccggttgggaaataagcaaattcagcccggataattttacccgccactacggtttcagtaccgatttcttttccgagattctcaaagctcagcgtaaaactacctattatgaagtaatagataagtatttttccctgggacatcacttaaaacagagagattccaagtcagttcgtaaaaccatttccggttttattaaactattacatcctgacggcaattttactaaagaggatatccgggaatatctagtggtagccctggaaatgagaagacgggttaaggaacagttgaaacgcatcggtggcatggaattctgggataccaatttttcatacatagataaggaaactcaggaagagttcttcgtcactttgcctgaggaacgggggagcgacctaattgaaagaaatcccttgcccccgggagtttgctacactgctaccagtgacgggaataccaacgcactggttaaaattgaagtggtggctgtgaaaggcagtggcaagctaaatattaccggaaccaacaataaccaggttaaggaaaacattaagaacacctacaattacttgcgcgctaacgaaaagaatattcttactgagcagcgctccttgaaaggctatgatttaaatatccagataagtaacctgttaggtgcctatatcagcgaggggattggctcggcggtatatgtagccattatttcctctatttataataaaaacttgaaagctggattagcagtcctgggtaacctctctattggaggtgctattgagcaatccctacattttgccgacaaggttaccctcctgtcagacaatggagccaaaacggttttggtgccaattggcaatataaatgaattaaccacattaccagccagtgttttcgaaaaagctgatgtacctttttacgggaatagccagatgttgttgcaaaaagccgtggaatag

SEQ ID NO: 3731 - DNA, 2037 bp, Syntrophomonas wolfei
atggaaacgtcgtatttggatgccaaactgaatcggcattttgcgggccgggtagttcgcaaagacctgaccgggatgattaaacagggagcaaacgttcctacttacgttttagaatatctcctggggatgtactgtgccaccgatgatgaagaagctatccatgatggggtggagcgggttaaaaaaatcctggcggataacttcgtccgtcctgatgaagcggaaaaagttaaatcacgtattaaagaattgggtcagtatacggtaattgataaattaaccgtaaaactcaacgaaaagcgtgatatctatgaagccgagttttccaacctgggtattaaaggggtagcggtcagctccgagtatgtaaaaaagtacgagaagctattagcgggtggcatttgggcgattcttaaaatggagtatttctatgatgaggaaaaccggcacaataatcccttcagcattgtaagcttgaaacccattcagatgcccaacatggatttaaatgagataaaggtaggacgcaagcagtttaccaaagacgaatggatagatctgctgattcgttccaccggcctggagccaactcagttagaaccggtggtgaagtggcatttgctgctgcggttggtgccgctggtggaaaataattataacctgtgtgaactggggccgcggggaaccggcaaatcccatgtttataaggagatttcccccaactcaatattggtctccggggggcagactacggtggccaatctattttataatatgtccacccgttcgattggattagtcggcttatgggattgtgtggcctttgacgaagtggccgggattcactttaaagataaagacggcatccagattatgaaggattacatggcttcggcctcttttgcccgcggcaaagaagagaaaaacgccaatgcctccatggtcttcgtgggtaatatcaacgagagcctggatttcttgttaaaaacctcgcacctgtttgctcccttcccggaaggaatggccaatgacagtgctttttttgaccgcatgcactactatttgcctggttgggagattcctaaaatgcgtcccgagctgattacccataattatggatttattgtggattatctggccgagtacctgcgggagatgagaaaacagagctttgcggatgccattgaccgctattttaagctggggaataaccttaaccagcgggatgttattgccgttcgcaaaactgtatcgggaatgatgaaactactctatccccacggagaatatacctgtgatgatgtagctgaaatcctggaatatgccctggtgggccgccgccgggtaaaagagcaactcaagaaaatcgggggtatggaattttatgatgtgcatttctcttacattgaccgggaaaccctggaggagaaattcgtttccgtccccgagcagggagggggaaaacttattccggaagggctgggcaaacctggtcatgtttatctgataggcaagggcgactccgggatgataggggtcttcaaactggagaatcaggccgtatccggaactggcaaatttgaaagaaccggtctgggctcccgtaaagaggtaaaagaaagtatcgacaccgctttccgctacttcacggccaattgtaaaaatgtcagcagcggtatcaccaccaaaaacaaagactaccttatgcatgccaccgacctgcagggtatcggtatgaatgcagaattagccctggccgagtttatcggcctttgctcatccgccctggaccgaccggtacaggaaagcctggtggtattgggcaatatcaccgtttccggcaccattgaaaaaatctccgatttcgccaatgtgctgcaggtctgtgtagatgctggtgccaaacgcgtacttatcccggccgtatcagtagttgacctccagaatgtccccccggaactgctgattaaagtacaaccaatcttctattccgatcccattgatgcggtgttcaaggcgttaggggcggtgtag

SEQ ID NO: 3732 - DNA, 2052 bp, Syntrophus aciditrophicus
atgaaagaactcgaccatcttgaccaacttgcggcatctgcattcgacggttatttggttcgcaaggacctggtaagacggtacagccggcagtaccccgttccgacttacgttgtggaattcctgctcggacgttactgcgcgtccgtagactcacaggaaatcgacgaaggattgaaaatcgttgaacgtcagctgcaggatcgcactgtccgcacaagcgagcaggaacttttcaaggcacgggcgcgtgagaagggttcagtaaaattgatcgacattgtcaaggcgcgcctcgatgccaagacagactcattcctggttgaattgccaagtttgggaatcagggacgtccggattgcagacgcgatagtgcatgagcatgagcgaatgctgaccgatggtttctatgctgaagtaacactgacctacgatgcagccattgcggctgagaaacacggcaggccattcgctatcgatagtctgcgggcaatccagctttccaagtcggatgtcctggcaaccctgagaaaaggccgcgagagttttactagttatgagtggaaggatttcctcctgcgctctgtaggtttggaaccggcgacaatgtcggatcgggcacagatggtggtgctactgcgaatgatcccctttgtcgagcgtaactacaatcttgttgagctcggcccacgtggcacgggcaagagtcatctgtaccagcaaatatcaccttattcgcacttgatttcgggcggaaaagcaacagttgctaagatgttcgtaaacatgtccagcggtcagcgggggcttgtctgcctatatgatgcggtttgcttcgatgaagtgtcaggtatctcttttgaccagaaagatggggtaaacatccttaaaggctatatggcggccggtgaattttcgcgtggtaaggaaagcattcgagcttccggtggcatcgtgatggtgggcaacttcgatgtggacgtggagcagcagcagagaatcggccatttgctcagcccgctgccaccagaaatgcgcaacgatacggcctttatggaccgcattcacgcctatgcacccgggtgggatttcccaaagctcaaggcaagtgaccaccttacaaatcatttcggtctggtgacggactacctttccgagtgctggacgaagttacgcgaaggcacgcgaatatcggcactgcaaggccgggcgcattggggcggcgcgctgagtgggcgggatattgaggcggtcaataagaccatcagtggtttactcaagcttttatttcccgacccgaatatgtcaatacccgatgatgatcttgagttcataatccggattgccttggaggcacggcgccgggttaaagaacaacagaagcgttgcctgaaaacagagttccgaaatacgcatttcagctattttatgggcatggatggagtagaacaattcgtatcgacgcctgaactacacagcgatgaagcgatcgaagcggacccattgccgcccggacaggtatgggcgatcagccccggtggacaagatgcagcgccatctctatatcgcatcgaagtaacgtgcggtccgggcaatggagtgaagatacttaatgcacccgttccaccggcgtttcgagaaagcgtccgttttggagagcaaaatctctactcgcaggccaagtctcttgttggggatcgcgaccctcgcagccatgagttttccgtgcagttgcgggcgatggatacagaccattccggacatggcttggggttgcccttattgatagccctgtgtggaagtttgatggagaggagcacgaagggtaggcttatcgttattggctcgctcaatttgggaggttcagtggaaatgatccccaacccggtcgccgtcgccgagttaggggttgaaaaaggagctgcccagattctcatgccaatttcggcacgaagacaactactagaattgccagacgaaatggcgacaaaagtaaatatcgtcttctatgcggacccagcggatgcctttatgaaggccatcctcgaataa

SEQ ID NO: 3733 - DNA, 2013 bp, Tepidanaerobacter acetatoxydans
atggatgagcttagtaaaaaattaaataggtatttccccggaagagtcgtaagaaaagacctgactaaaaaaattaaagaaggagccaatgtacctgtttatgtccttgaatacttgttagggatgtattgtgctactgatgatgaaaacagtatcaacgatggtgttgagacagtaaagaacattctggcggaaaatttcgtaaggcccgatgaagcggaaaaagtcaagtcaaaggtacgggaacttggcagattcaccgttattgatatgataacagttaagctcaatgaaaaacttgatatatatcaagcagagttttctaacctcgggctaaagggcgtagagatttctccgcaatatgtgaaagactttgacaagctcctcgctgggggtatctggtgtattgttaaaatgagctatttttatgatgaggaagttaagatggcaagcccttttaatatagattccctcacacctattcagatgcctcatatggatattcaagagatttttgaaggcagaaagcatttttcaaaagatgaatggatagatgttctgatgcggtctgtcggtatggaaccgacgcagttagaacaaaaagtaaaatggcatattcttgagcggatggtgccacttgttgaaaataactacaatctttgcgagctgggacctcgaggaactgggaagtctcatttgtacaaagaaatctcgcctaattctatactagtgtccggagggcaaactactgtagcgaatttattttataacatggcatcacggcaaatcggccttgtgggattgtgggactgtgttgcctttgatgaagtggccgggataaaatttaaagaccaagatgggattcagattatgaaggattttatggcatctgggtcctttgctagaggcaaagaagaaaagaatgcaaatgcatcaatggtgttcatcggaaatatcaatcagagtgttgacgtgcttttaaaaacatctcatttatttgaaccattccccgaagccatggctaatgatgctgctttttttgaccgtatgcactattacttacccggatgggaaatacccaagatgcggcctgaatattttaccgatgaatacggatttattactgactatttatcagaatttatgcgagaaatgaggaaaagatcttttactgatgcttttgacaaatattttaagctaggcaacaacttaaatcagcgggatgtaattgctgtcagaaagactgtatcaggcctgcttaaattgatttatcctgatgggaacttttcaaaagaagatgtagaagaagtattaagatatgccttggtaggtcgaagaagagttaaagaacaacttaagaaaataggcggtatggagttttatgatgtgcatttttcatatatagacatcgaaactatggaagaaaaatttgtatcagtgccggaacaaggcgggggtaagataatcccagaagggttaagtaagcctgggcatttatatactgtcggtcgtggaaagtcgggcatgattggagtctataagatagaaaccgaggtagtaaatggcaccggtaagtttgaaaaaacaggtcttggttcagatagagaagcgaaggaagcaattgaaactgcctttaggtattttagagcaaatagcaagaatataagtggcacgataagtacatcaaaaaaagattatttaatgcatgttgaagatattcaaggcgtaggactcacatcagaactggcattggctgcatttattgcattatgctcaggagctttaagccggccggtgcaaagccagctggtagtgttaggttctatgagcataggaggaactatcaataaagtagaagaattggcaaatgtccttcaagtatgttttgattcaggagcaaaaaaaagttttaattccaatgtcatcagcagcagatataggcacagtacctccggaattgtttgcaaaattccagatatccttctatcaagatcccaaggatgctgtttttaa

SEQ ID NO: 3734 - DNA, 2031 bp, Tepidanaerobacter sp.
atggatgagcttagtaaaaaattaaataggtatttccccggaagagtcgtaagaaaagacctgactaaaaaaattaaagaaggagccaatgtacctgtttatgtccttgaatacttgttagggatgtattgtgctactgatgatgaaaacagtatcaacgatggtgttgagacagtaaagaacattctggcggaaaatttcgtaaggcccgatgaagcggaaaaagtcaagtcaaaggtacgggaacttggcagattcaccgttattgatatgataacagttaagctcaatgaaaaacttgatatatatcaagcagagttttctaacctcgggctaaagggcgtagagatttctccgcaatatgtgaaagactttgacaagctcctcgctgggggtatctggtgtattgttaaaatgagctatttttatgatgaggaagttaagatggcaagcccttttaatatagattccctcacacctattcagatgcctcatatggatattcaagagatttttgaaggcagaaagcatttttcaaaagatgaatggatagatgttctgatgcggtctgtcggtatggaaccgacgcagttagaacaaaaagtaaaatggcatattcttgagcggatggtgccacttgttgaaaataactacaatctttgcgagctgggacctcgaggaactgggaagtctcatttgtacaaagaaatctcgcctaattctatactagtgtccggagggcaaactactgtagcgaatttattttataacatggcatcacggcaaatcggccttgtgggattgtgggactgtgttgcctttgatgaagtggccgggataaaatttaaagaccaagatgggattcagattatgaaggattttatggcatctgggtcctttgctagaggcaaagaagaaaagaatgcaaatgcatcaatggtgttcatcggaaatatcaatcagagtgttgacgtgcttttaaaaacatctcatttatttgaaccattccccgaagccatggctaatgatgctgctttttttgaccgtatgcactattacttacccggatgggaaatacccaagatgcggcctgaatattttaccgatgaatacggatttattactgactatttatcagaatttatgcgagaaatgaggaaaagatcttttactgatgcttttgacaaatattttaagctaggcaacaacttaaatcagcgggatgtaattgctgtcagaaagactgtatcaggcctgcttaaattgatttatcctgatgggaacttttcaaaagaagatgtagaagaagtattaagatatgccttggtaggtcgaagaagagttaaagaacaacttaagaaaataggcggtatggagttttatgatgtgcatttttcatatatagacatcgaaactatggaagaaaaatttgtatcagtgccggaacaaggcgggggtaagataatcccagaagggttaagtaagcctgggcatttatatactgtcggtcgtggaaagtcgggcatgattggagtctataagatagaaaccgaggtagtaaatggcaccggtaagtttgaaaaaacaggtcttggttcagatagagaagcgaaggaagcaattgaaactgcctttaggtattttagagcaaatagcaagaatataagtggcacgataagtacatcaaaaaaagattatttaatgcatgttgaagatattcaaggcgtaggactcacatcagaactggcattggctgcatttattgcattatgctcaggagctttaagccggccggtgcaaagccagctggtagtgttaggttctatgagcataggaggaactatcaataaagtagaagaattggcaaatgtccttcaagtatgttttgattcaggagcaaaaaaagttttaattccaatgtcatcagcagcagatataggcacagtacctccggaattgtttgcaaaattccagatatccttctatcaagatcccaaggatgctgtttttaaagctttgggggttgaatag

SEQ ID NO: 3735 - DNA, 2031 bp, Thauera sp.
atgaccgaacccgtagataccgcccgacttgatgggctgctcaacacgcacttcgccggcaaggtggtccgcaaggacctgaccaagctgatcaaggagggggcaaacgttcccgtttatgtgcttgagtacctgctcgggatgtactgcgcgtcggacgacgaggcgacgatccagaacgggatgacgatggtcaagcgcatcctggccgagaactacgtgcgcccggacgaggccgagaagatcaagtcgaagatccgcgagagcggcagctacaaggtcatcgacaaggtgaccgtgaagctcaacgagaagcgcgatgtctacgcggcgctgctctcgaaccttggggtgaagaacgctgaggtgtcggacgccttcgttcgccagttcgaaaaactgctcgtgggcggcatctggtgcatcgtcaccctgaactacctgttcgaggagaaccagcgcggctcacccttcacggtgaccgatctcaagccgatccagatgcccaacatggacatggcgggcctgttcgaggggcggcgggccttcaccgaggacgaatggatcgacgcgctgatccgctcgaccggcatggagccgagctgcttcaaggagcgggtgaagtggcatctgctcgcgcggatgattccgctggtcgagaacaactacaacttctgcgagctgggtccgcgcggcacgggcaagagccacatctacaaggaaatcagccctaacagcattctggtgtcaggtgggcagacgacggtggccaacctcttctacaacatgagcgcgcgcaaggtgggcctggtgggcctttgggatacggtcgccttcgatgaggtggctggcatcaacttcaaggaccacgacggcgtgcagatcatgaaggactacatggcgtccggctccttcagccggggcagggaggcgatcaacgccaatgcctcgatggtcttcgtgggcaacatcaaccagaccgtcgaatccctggtgaagaccagccatctgctcgccccgtttcccgaggccatgatcgactcggccttcttcgaccggttccatgcctatgtgccgggctgggagatcccgaagatgcgcccggagttcttcaccaaccagtacggcctgatcgtcgactatctggccgagtacctgcgcgagatgcgcaagcgcaacttcgccgacgcgatcgacaagtggttcaagctcggcaacaacctcaaccagcgcgacaccatcgccgtgcgccgaaccgtctccggcctgctcaagctgatctgcccgcacggcgagtacgacaaggagatcgtgcgccgctgcctggagtacgcgctcgagagccgtcgccgggtgaaggagcagctcaagaaaatcggtggcatggagttctacgacgtccacttcagctacatcgacctggaggcgggcgaggagcgcttcgttacggtgcccgaacaatccggcggggcgctgatcgcggaaggccggctcaacccgggtaccctgcacaccatcagcctgggcgacaccgagatgccgggcgcttatcgcatcgagatccagaccatcgccggcggcggcaaggtctcggcctcgggccttgcgccgcgcgaggcggtcaaggtcgccttcgattacttcaaggccaactcgggccgggtgagcgcatcgatcaagccgggcgagcacgattttcacctgcacttggtggagctgcagcacaccggcacgccgaaggcgctgaccctggccgggttcatcgccctgtgctcgggtgcgctcgccaagccggttcagagccagatggtggtgatgggcgacatgagcctcggcggaacggtcgtccaggtgcgcaacctggccgagagcctgcaggtggccttcgatgccggcgcaaagcggatcctgctgccgatgtcgagcgtgacggatattccgtcggtgcctggggaactgttcgcgaagttccagacgagcttttactcggatccggtggatgcggtgttcaaggcgttgggggtggagtga

SEQ ID NO: 3736 - DNA, 2049 bp, Thermacetogenium phaeum
atggagcttgacgccctcgataaactggcagcttctgtattcgatgggtatatagttcggaaagacctggtgcgaaaatacagccggcagtatcctgtgcctacatacgtggtagaattcctgctgggcaggtattgtgcaagtgtcgatgaaaaggagatcgaggaaggtctggagattgtggagaggcagttaagggatcgcacggttaggaccggtgaagaagagctttttaaagcacgggcaagagagattggttcgatcaaactaatcgatctcatcaaggctcgattggataccaagaacgattgttttattgccgagctgccgagcttggggctgaaagaggtccgaattgacgatgacttggtgcataaaaatgagcgcatgctgaccgatgggttttatgcagaaattaccctcatctatgatgctgccattgcccaggagaagtacggtcgtccatttgcgatcgagagtttacgacccatccaactttcaaaagttgatgcactggcagtgctacagcgagggaggagacaatttaccactgacgaatggaaacgtcttctaatacgttccataggcttagaaccggaggcgctttcggaacgggctcagagtatcgccttgttgcgaatggtgccttttgtagagcgaaactacaatcttgttgaaataggcccccgggggaccggcaaaagccatttattccagcaagtctctccttactcccatttaatttcagggggtaaagccacagtggccaaaatgtttgtgaataatgccacaggacagcgtggtcttgtctgccactatgatgtggtgtgctttgatgaagtatccggcatatccttcgatcagaaagacggagtcaacattatgaaaggatacatggcttccggtgaattctcccgcggtaaggaaagcatccgtgcttccggcagtattgtgatgctcgggaactttgatgtcgatgttcagcagcagcagcgcatcggccatctatttagcctcctcccgccggaaatgcgggatgatacagcatttatggaccgtattcattcctatgttccgggatgggagtttcccaaactcaatccaaatattcagctcacggatcactttggtttggtcagcgactttctgtcggaatgctggcacaaactccgtgatggtagccgggtttccgtgctgcaggggcgtgttaactgggggggtgctctcagcggtcgggatattgaagccgttaataaaaccgttagcggccttatcaagctgctattccccgatcccgagatgccgatacctgatgaagagctggaaaagatcgtccgtatggccctggaatcgcgtcgcagggtgaaggaacagcaaaagcgctgtctgatgacagaatttcggaatacgcatttcagctactctatgggagtggatggagtggaacagtttgtttccactccggaactccacagcgacaaagccattgacagtgatccgttgccaccggggcaggtatgggcgatcagccccggcggtcagaacgcttccccggctttatatcggatagaggttaccgttggtcccggcagtggggtaaaaatacttaatgcgcccgttccgcctgcctttcgggagagcgtgcgttacggtgaacagaacctgtatgttagggccaaagaactggtcggggaccgcgatccgcgcgcccatgagttttccattcagctgagagccatggacgcggaacgttccggccaggggctcggtttaccggtgctgattgccctttgcagcgctctgatcgagcgcagcgttaaggggggattgatcatagtcggagccttaaaccttggtggctcaattgagatgataacaaatccagtagctgtagccgaactggcccttgagaaaggagctacgacgttgttaatgcccatctcttctcgaaggcagctcttcgatcttcctgatgagatggctacgaagatcaacatcgagttctatgctgatgcgtcagatgcttttgttaaggcagttgttgattag

SEQ ID NO: 3737 - DNA, 2031 bp, Thermoanaerobacterium thermosaccharolyticum
atggatgaattaagcaaaaaactaaataaatattttgctggcagggttgtaagaaaggacttaacaaaaaagataaaagaaggagcaaatgtacccgtatatgtccttgaataccttttgggcatgtattgtgcaacagatgatgaagaaggtatagccgaaggcgttgaaactgtaaaaaggattctggctgaaaattatgtgcgtcccgatgaagcagagaaggtaaaatctaagataagggaaataggaaagtatactgttattgacaaggttagtgtaaaactcaatgaaaagaaggacgtatacgaggccgagttttcaaatttgggcataaagggtgtggccatatccccgacatatgtaaaacaatacgaaaaactcctgtgtggcggcatatggtgcatcataaagatggactactattatgatgaagaggctaaaggtgtaagcccattcaatatcagcagcctgactcctatccagatgcccaatctggacatggaggagattttcaacggaagaaagtattttacaaaagatgaatggatagatattctgctcaggtccatagggatggaacctacaagattcgaaaatagtgtaaagtggcatcttctggcgaggatgatacccctggtagagaacaactacaatctctgtgaactggggccaaggggtacgggcaaatcccatgtttataaggagatttctccaaacagcatcttggtgtcgggtgggcagacgacagtagcaaacctattctacaatatggcttcaaggcagataggccttgtggggctttgggattgtgtggcttttgacgaggtagcaggcataacatttaaagacaaagatggaattcagataatgaaggattacatggcttcgggctcttttgccagagggaaggaagaaaagaatgcttctgcctctatggtatttgtggggaatatcaatcagagtgtggatgtcttacttaaaacatcccatctctttgacccgttcccggaggcaatggcaaatgatactgcattttttgacaggatgcattattacatacctggatgggagatacccaaaatgcgtccagaattctttacagatgaatacggttttattacagactacgtatcagagtttatgagggagatgaggaagaggtcattctctgatgcattggataagttctttaaactgggcaacaacttaaatcagagagatgttattgcagtaagaaaaacagtttcagggcttgtaaaactcatatatcctaacggtgagtttacaagggacgacattgaagaaatactgcgttatgcattggtaggaagaaggcgtgttaaagagcagttgaaaaaaatcggcggtatggagttttatgatgtccacttctcatatatagataatgaaacaatgaatgaggaatttgtgtcggttcccgaacagggtggtggcaaaataatccctgaaggtatgggaaaacctgggcacctttataccgttgccagagggaaatcaggcatgataggggcttataagattgaaacacaggttatatcaggtactggtaaatttgaaaggacaggccttggctctgacagagaggcaaaagaaagtatcgagacagccttcagatacttcagggcaaacagtaaaaatgtaagtggaagtataagtgttaccacaaaggattatttgatgcatgtacaggatatacatggagtgggcatgacacgtgaacttgcattggcagcctttgttgccctatgttcaggggcattgggtaagccaccacagagccagttggttgttctgggttcactcagcataggtggcacaattattaaggttgaggaattggcaaatgtgctgcaggtatgttttgattcgggtgccaagagggtgcttcttcccatggcatctgcggtggatattccaaccgttccgcctgaactatttgcaaagtttcagatttcattctaccagagtccagaggatgctgtatttaaggcacttggggtagagtag

SEQ ID NO: 3738 - DNA, 2100 bp, Thioflavicoccus mobilis
atggacgcattggataccaagctcaacgaggtcttttccggccgggtggtgcgcaaggacttggtccagcaggtcaagaagggcaccaatgtgccgaccttcgtgctggagttcctgctggccaagtactgcgcgagcaacgatccggacgagatcgccgcgggtatcgaggcgaccctggagtatctggcgcgccactacgtccgcccagacgagagcaacaaggcccaatcgacggtgcagcagaagggaacccacaagtacgtggacaaggtgcatgtgcgccacgtggagaaggagaagcggcactgggcggcgatggagaacttcaactcccagcgcatcgcgatcaatcagaagttctacaaggacaacgaccggctgctggagggcggtctgtgggccgaggtgacagtcggctacaacgacgtcgaggacgacaactacgccttctacgtcgaggacctgcggccgatccagctctcgcggttcgacttcgaccgctatctggagggacgtgcccggttcacccgtgacgagtggatggacatcgtcctgcgctcggtcgggctgaagccttcgaagctgagtcctcggctcaagctgcacttcatcgcccgcctcctgcccctggtggagccgaactacaacttcatcgagctggggccgcgggggaccggcaagtcctatttcttcagcgagttctcgccctacgcgaccctggtcagcggcggtcaggccaccaaggcgacgctcttctacaacaacgcccgcggcaaggtgggtctggtcgggttctgggacgcggtggccttcgacgaggtggccgggatcaagatcaaggatcaggacgcgatccagatcatgaaggactacatggccaacggccgattctctcgcggggtggaggtcatcgccaatgccagcatggccttcgtcggcaacatcgacgagtcgatccatcagttggtcaactccaccgagcacgacctcttcctgcccctgccggctgccctggatctggcggtgatggaccgcttctactgctacctgccgggctgggagatcccgaaaaacagcagcgcctacctcaccggggccttcgggttcatcaccgactacctggccgaggccttccatcatctcttcaagcagacgaaccgctacgagtacgtcaacagccatatccgtttgggccccgcggtggaggggcgcgacgagaaggggatcaagaagaccgtcgccgccttcctgaagatcctgcatccgggcggcgcgccggagccggcggagctggaggagtatgtcgcctatgccgtggaggcgcgccgacgcgtcaaggagcagatgaacaagcggaagcccgatgacgagtttgccaggatcaatctgtcctatttcggcgccgatggctcggaggtcgtcgtctactgtcccgagtcgaagggtgcaccggcgacccagtcaccttcacgccgaaccctggataggggagcggaggcgcgggcgccgacagcgtcaacagtcgaaggcccggcagagatccaactgactcggccagcggccgtgcctgacgacgagcaggcggcacccgagcacccgcgagaacccgagctgaaggagcagcatttcaccatcctgtacggagacaccggatatacctacgactcactgattggcccctacctggctggggcccggtccgtcacgatcgaggacccctatatccgggcgccgcaccagatcgcgaacttcgtgcggttctgcgagacggtgagcaagacccccggcgttcgctcagtcaccctggtcacgagctacgacgatcaaaccaacctggccgatctgaacgacaagctgggggagctcaagcagagtctgatggaggtcgacatcgttctggagatccggatcaacgagaagctgcacgaccgggagatccgcctggacaacggctggatcatcaagctcgggcgggggctggacttctaccagaaacccgagagctggttcgcgatcggggcaagcgatttcagcctgcgtaagtgcctggagaccaaggtcgatatcttcagggaggcgcctcgtagcaatgactga

SEQ ID NO: 3739 - DNA, 2076 bp, Vibrio cholerae
atgacaactgatttttcacaagatcataaagacgaaaaaaatcagatgcaaagcgccgacttagacgcattgctcaatcaatattttaaaggccgtgtcgttcgaaaagatctgacaaagcaattgaaagaaggcgctaacgtccctgtctatgtgcttgagtatttactaggcatgtattgtgcgtccgatgacgacgaagtcgtaatgcaaggccttgataatgtgaaaaaaatcttggctgagaactatgttcgaccagatgaagcggagaaagtgaagtcactgattcgtgaacgcggcacgtttaaaatcatcgacaaagtaagcgttaagctcaatcagaaaaaagacgtctatgaagctgcgttgtcgaacctggggatcaaggatgcccttgtaccgaccaaaattgtacaagacaacgaaaaattattaactggcggtatctggtgcattattaccgtccagtatttctttgaggaaggtcagaagacatcacctttctccattatgagtttaaaaccgatacaaatgccgtccatgaacatggatgaggtgttttcaaccagaagacattttagtaccgatcagtggatggatgtgttgcttcgttccgtgggtatggagccaaccaacttagagcatcgggtgaagtggcatcttattactcgcatgatcccattcgttgaaaacaactacaacgtttgtgagctcggaccaagagggacaggtaaaagccatgtctacaaagagtgctcaccaaactcattgcttgtctcgggtggacaaacaactgtggcgaacttgttctataacatgagctcgcgccaagttgggttggtcggaatgtgggatgttgtcgcctttgatgaagtagcgggtattaactttaaagacaaagacggcgtccaaataatgaaagattatatggcgtcagggtcttttgcacgtggtcgtgattcaatcgaagcgaaggcttccatggtattcgtcggtaacatcaatcaaagcgttgagacactggtgaagaccagtcatctgttggcaccttttcctgatgccatgattgacactgctttttttgaccgtttccattcctatattcctggatgggaaataccgaagatgcgtcctgagtttttcaccaatagttacggattaatcacagactatcttgctgaatacatgcgtgaaatgcgtaaaagaagttttgcggacgctatcgataagttcttcaaacttggtaataaccttaatcagcgtgatgtaattgctgtacgcagaacggtttcgggcttgttaaagctactacaccccgacgcacagtacacaaaagatgatgtaagagcctgcctgacctatgcgctggaaactagacgtagagtcaaagagcaattgaaaaagcttggcggaatggaattttttgatgtgcactttagctacatcgataacgagtcattagaagaattcttcgtcaatgtaccggaacaaggtggcagcaagctaattcctgagggcttacctcgtgctggtgtcgtgcacttggttactcagggaagcactgggcagcttgggttatatcgctatgaaacccagatgatggctggttctggtaaacactcagtatctggccttggttcgaataccgcagcgaaagaagctgtgcgtgttggctttgattatttcaaaggtaacctgaatagaatcagtgcgtcggcgaagttttctgatcatgagtatcacctccatgttgttgagctccacaatacggggccaagtacaaagtcatcgctcgctgcattaattgcgttctgttcaattctgatgaaccgaccgattcaagagcagatggttgttttgggtgagatgactttaggtggtgtcgtcaatcctgttcaagatcttgcaggcagtcttcagttagctatggacagtggcgcaaagcgtattttgctcccaatggcctcagcctcagatatcccaacggttcctgctgagttgttttcaaaattccagatcagcttttatgcagatcccgtcgatgccgtgtttaaggcgcttggggttaattga

SEQ ID NO: 3740 - DNA, 2052 bp, Vibrio cholerae
atggctgttttgaacgatttagatcacaagctgttagagcactttcgaggctatgtggtaaagaaagacttagtgcgtatggtaaaagttggtgccaacgtaccggtatttgtattggaatatttgattgctaattcttgctctactgatgatgaagaaaaaattaaagtaggcatggaaaacgttaagaaaattcttagcgagcactacgttaaccctgaagaaagttctctaatacattctaaaataagagaaaaaggtcgatttaaaataatcgataaaatttctgtcaaactggattcgaaaaaagatatctattgggctcagcttcaaaatagcaacattaacaacggtaatatccgtgatggccttgtgaaagagcatgagaagatgttgatgggtggtatttgggccattattgacgttgaatatgaccccgacataagaatcggtcaaaacatatatccgtttgtagtgacaaatataaagcctattcaactgtcgacttttgataacagtaagattatccagaaaagaaatgagttttcgagagatgaatggctgaatgtattgctacgtagctgtggatatgagcctgatgctgaagggatgacaacccgcgtaaaaatgctgttacttgcacgtctgctgccaatggttgagagtaattttaactttgtagagttaggtccgcggtcaacaggtaagtcgttcgtttttaaagagcttacaccttatgccgtgcttatatcaggtggtcaaggaacagttgccaagctctttgttcacggttctactggcaaagttggtgccgttggtcaatgggatgcgatatgtttcgatgaggcaacggacaagatcttcaaagaaaaggatgctgttcctttaatgaaggactatatggagtctggctcgttttcgcgagctggtgcaggaggtgaaatcactggtgttgcttcaattatcctaaacggcaatataaatcaaccagttgagacggtattgcaaacatctcacttatttagtcctctttctgatgaagtgaataacgatactgcattccttgatcgtattcatttttatctacctgggtgggaaatgatcaagtttgctccaaaacacttcacatctaattttggtttcagtacagactacttctcagaagcattgaagtcgtttcgtcgcgttacatacactgatgctcttgaaaactttttttcgctaggttcacacttaaaacaacgtgacaccaagccagtaaaaaagacggtatcaggtctgattaaattgcttcacccgaatggtgaatacaccaaggaagatgtgcgtgaatacctcgagatagctcttgaaatgcgacgtcgcgtgaaagaacagttaaagcgaatcggtggaatggagttttgggatacgaatttttcttacatagataaagaaacgcaggaagagcactttgttggcttgcctgaggaaaagggatctcacttaatcgaaaatacgccactgccgcctggtgtttgttacaccagtacaagtgatggtgacaatgtcgcgctcgttcgtattgaagctgttactacctcgggttctgggaaactcaatatttctggtgtaagtaacaccggagtcaaagaaaacatcaagaacacttatcagtatattaaagccaatgaaaaaacaattttaagtgagcagcattcgcttaaaaattacgatatcactatccaagtgaccaatatgctgggggcttcaatatcaacgggaattggctcggctgtttatatcgcaatcgtgtctgctctttacaaaaagaacctaaaggctggccttgcagtgttgggtaatatatccgttggcggtgcgattgaaaggtcaattaactttgctgacaagataacaatgttgtctgagaatggcgcgaagacggttgttgttccaatggataatctagttgagctaacaaatgtaccaccaacagttcttggaaatacggatgttccgttttatcagaataatcagatgcttatgcaaaaaagcatactgcttgactga

SEQ ID NO: 3741 - DNA, 2082 bp, Zymomonas mobilis
atgtcgacccttgatgacaagatcaacgagcattttgccggtttcgtggtacgcaaagacctggtgaaggcggtgaaggggaacgccattgttcccacctatgtgctcgaatacctgctcggccaatattgcgcaaccgatgacgaagcctcgattgcgacaggcatcgagacggtcaaggacatcctgcgcaagcactacgtccatcgttccgaagcggggctggttcagtcgacgatcaaggagcgcggccgctacaaggtcatcgatcaggtcagtgtggcgctgaacgaaaagaccgatgcctatgaggcgatgttcgaaaacctcgggatcaagcgcgtcgcgatcgacagcgccacggtcaaggcgcatccgaaactgctggttacgggcatctggtgcatcgccgatgtgcagtacgagttttcggaagacagccggatttctccctggatcatcgacactctaaaaccaattcagatcgcccgcgtggactatgacggctatcgcgagatgcgggacaagttcaccacagaggaatggatcgatctgctgatgcagagcatcggctttgatccgtccctgttcgggcgcaggtcaaaacttttgcaactgttgcgcctggtccccttcgtcgagcggaactacaacctcatcgagcttggtcccaagggtacgggcaaatcgcatatctattccgagttctcaccccatggtcagctgatctctggcggcgaagttacggttcccaagctcttcgtgaacaactccaatgggcggattgggttggtgggttattgggacgtcgtggcctttgatgagtttgcaggccgtgagaagacagccaacaaggcgcttgtcgacatcatgaagaactacatggcgaacaagcagttttcgcgcggtgtaaatccaatgggtgccgaggccagcttcgccttcgtcggcaacaccgaccataatgttccatggatgctgaagaataccgacctgttcgaggctctgccaccacagttccacgacagcgcctttatcgatcggctgcacgcatatctgcccggctgggaggtcgatatcatccggggcgagatgttcacatctggctatgggttcatcgtcgactatctggccgaaatcctacgccatctgcgcgccgaggacttctcgcatcggccggatcggttcttcaccgtgcccgttcagacccacatccgggatcgcgccgcgatcaacaaaaccatgtcaggtctgctgaagctgatattcccgaatggaggcgagacagaagccgacgttgaagaactgctgcggtttgcgattgaatgccgtaagcgggtgaaggaccagctgctgcggatcgacagcaccttcgaggacgcggacttccattacgtcgcctcggatggcgcaaagcgccctgtcaccacgctggaggaagaggagtttccccagttctaccatcgccgatcgactggcgatggggatggtagtggggggcaatctgtaaccacgccggtatccgcgcagcagtcgtcaacaccagctacttctcaagcacctgctgttgccgttgtccctgcgtctgctccgaagcctggacatgtcgttttcacagaaaaccgcaagggcatcagtttcgacaagatctttggtccttggacggatggtgcgaccagaatcatcatcaccgacccctatatccggaagtatcatcaggcgcgcaacgtgatggaactgatcgagatgctgatccggcgcaaacagcccgaggatcaggtcgcagtgcatctcgtcaccgcccctgacgatgggaacattcaggagcagcgggaatgcctggacgggatcgccgaggcctgcacaggcacaggcgttgatttcacttgggcatttgatgggactggagcgattcatgctcgcgacatcgccacggatacgggctggaagatggttctggatcgtggcttggatattttccagccaacgcctcgcaagatgaacggtttctcgctgggagaacggatgcaggagcaccggatggtccgtggtttctacgtgacttatgtcaagaacctttag

SEQ ID NO: 3742 - DNA, 2028 bp, Magnetospirillum magneticum
atgagcgacagccttgatgatctgttgaactcccactttgcgggcagggtggtacggaaagacctgaccaagctggtgaaggaaggtgcgaacgtccctgtctacgtcctggaatacctgctgggcatgtattgtgcgtcgaatgacgaggtgaccatccgcgagggactggagtcggtcaaaaaaatcctggccgaaaactatgttcgtcctgatgaagccgagaaggtcaaatcgaagatcagggaacgcggtagctacaaggtcatcgacaaggtgactgttcacctgaatgagaagcggaacgtctaccaagccttgctgtccaacctcggcgtcaaggatgccgagatgccagaccactatgtgcggcagtacgagaagctgctggtcggcggcatctggtgcatcgtcaccatccagttctaccacgaggaaaaccagaagagttcaccgttcatcgtcagtgatctgaagcccatccagatgcccaacatggacatggacgagctatttgaagggcggaaggctttcgatgaatcccaatggatcgacgtgctggtgcggtcgagcgggatggagccaaccacccttagcgaacgggtgaagtggcacctgttggcccgcatggttccgctggtggaaaacaactacaacgtttgcgaactcggacctcgcggaaccggtaagagccacatctacaaggaaatcagccccaacagcatcctgatctcgggtggtcaaaccacggtcgccaacctgttttacaacatgggccgcaggaccgtggggctggtcggattgtgggattgcgttgcctttgacgaggtggctggcatcacgttcaaggaaaaggacggggtgcagatcatgaaggactacatggcatccggctccttcgcccgtggcaaggattcggtcagtgcctatgccagcatggttttcgtcggcaacatcaatcagccggtcgataccctggtgaagaccagccacctgctcgcaccgttccctgaagccatgatcgattcagcgttcttcgaccgttttcatgcctatattccaggctgggaaattccaaagatgcggcccgagtttttcaccaaccagtacgggctgatcgtggactatcttgcggagttcttccgcgagatgcggaagcgaaccttcggcgatgccatcgacaaattcttcaaactcgggaacaacctgaaccaacgggataccatcgccgttcgtcgcactgtgtctgggctgctgaagctgctctatccacatgaagaatacgacaaggacgcggtgcgtcgctgcctggaatacgccctggaatcgcggcgtcgggtgaaggagcagttgaagaagatcggcggcatggagttctacgatgttcatttttcctacatcgacatcgagtcgatggaagagaagtggatcagcgttcccgaacaaggtggcggtaagatcattcccgaaggtccattgaagccgggtgtcctacacaccgtggcaactggtgccgccgcccatcttggcctgtatcgatttgaaacccaggtcacggcgggtaatggcaagttgaccacctcgggattgggatcaagttcaggtgccaaggaagcggtgaaggtcgccttcgactatttcaaagccaacctcacacgtgtcagcggtgtatcgaaggctggtgatcatgatttccacctgcacaccgttgaactccacaacacgggtgccgccaaggcgatgaccctggcaagcttcgtggcgttctgttcggcaatcattcagaagccgttgcagtcccagatggtggtgctgggtgacatgagcctgggtggcagcgtggtgccggtggagaaccttgccgaatgcctccaggtcgcctttgattcgggtgcaaaacgcatcctgatcccgatgtcatcagcggcggatataccaacgattcccgccgaattgttcgccaaattccagaccagtttctacagcgatccggtggacgctgtgttcaaagctttgggggtggactga

SEQ ID NO: 3743 - DNA, 2061 bp, Marinobacter aquaeolei
atgagcacgcttgaccaaaagatcaacgagcacttccaagggttggtggtgcgcaaagacctggtgaaaacggtcaagggcaacgccatcgtcccatcatacgtgctggagtacctgctcggccaatactgcgccaccaacgacgaggccacgattcagaccgggattgaaacggtcaaggagattctggccaagcactatgtccaccgcaacgaggccggactggtgcgctcgaatatcaaggaaaaggggcgctacaaggtcatcgacaagatcagcgcggccctgaatgagaagacggatgcctacgaggcgcagttttccaacctgggaatcaagaaggtattggtggattctgggaccgtgaaggcccaccccaaactgctggtaagcggcgtctggtgcattgcggacatcgaatacgtattttctgaagaccagaacgtcagcccctggattctgtccaccctcaaaccgattcagctatctcacttcgactacgacgcctacgttgccgcgcggcagcagttcagcaccgatgagtggattgacctgctgatccagagtatcggctttaacccggagatgtttgggcggcgcagcaagctaacccagctggtccgcttgattccgttttgcgagcggaactacaaccttattgaacttggccccaaggggacgggtaaatcccacgtttactccgaattctcgccccatgggatcctggtatcgggtggtgaagtcaccgtacccaagttgtttgtgaataactccagcggcaagatcggcctggtgggctactgggattgcgtggccttcgacgagttcgccggcaagcagaaacgcgtcgataaagcactggtcgacatcatgaagaactacatggctaacaagtccttctcccggggcgtggaaaccctgggcgccgaggcgtccatggtgttcgtggggaacacccggcataccgtgccttacatgctgaagcattcggacctgttcgatgagctgccggacaagttctatgactctgccttcctcgaccggatccacttctacatccccgggtgggaggtcgacatcatccggggcgagatgttctccgacggctatggcttcgtggtggactaccttgcagaaatcctgcgctcgatgcggaactacgattattccgatcagtaccgggagtactttaccctctcttcggatatctcgacccgtgaccgggacggtatcaacaagaccttttccggcttgatgaagatcctattcccccagggcggagcaaccagggatgaggttgaagaagtgctgcgttttgccatcgaggggcgcaagcgggtcaaggaccagttacagcggattgacaccacctacggcgaagtccgattttcctatcaggaccaggaaggccaggaaatactggtcacgacacttgaggaggaagagtacccgggctactaccaccagacggtctctactcctgatgacgagggagtagaactcgagccaacagcgggcgttaaaggaggcgagccggaagagctccacgcccccgagcctgcgctggaggaaaagcacctgaccttccaggaaaatcagaagggcatctcattcgacggcttgtttggcgcatacctgaaaggagccagcaagatcaccgtcacagacccctacatccggcttttctaccagatccgcaatttcatggagtttctcgaagccatcgtgaagaacaaggccgaggaagatgaagtggcggttcacctcgtcaccgtccgggacgagttcaagggtgacctacaagacgagagttttgaaaagatccaggaatccgctcgcaccgtgggcatcgacttcacctgggagtttgacgacagcgggaccattcacgcccgtcatatcgttacagaccacggctggaagatttcgctggatcgagggttggacatcttccagcactacgagatgaatgaagccttcgcatttgccaaccggttgcagcagtttcggtctagcaaggcctttgaggtgacgtttatcaggcaagaacaaaaagcttaa

SEQ ID NO: 3744 - DNA, 2019 bp, Nostoc punctiforme
atgcatgacctgaatcaaaaactaaacagcatttaccctggaaaggtagtacgtaaagacctgactaaacgtattaaagaaggtgctaacgtaccagtgtatgtgctggaatacctactcggtatgtactgcgcgaccgacgacgaaaccaccattgaagaaggcgttacccgtgtaaaaaacatcctggcacagaattatgtccgtcctgatgaagcagaacagatcaaatctaaaattcgggaattgggacgatttaccatcattgaccgggtaacggtaacgcttaacgacagagatgacatctatcagggaactttaatgaacctgggtgtcaaaggcgtagtcattgacccagaaattgtcaaacccaaccaaaagcttctgggtggtggtatttggtgtattctacaactggaatatgaagcaggaaccaaacccagtcccttcattgtcggaagtctcaaacctatccaaatgcctagtgtggatatggatgaattgtttgcgggtcgcccagcttttacccgcagtgaatggattgacctgctgattcggtcaacagggctggaacccactaccgtcagcgaagatgtaaaatggcatctacttgcccgtttagtagccctttgtgaaaataactacaactgctgcgaactcggcccccgttctacaggtaaatcacacgtctacaaagaagtttctcctaactcaatcttggtttccggtggaaaaactacagtagcgaatcttttctacaatatgtccaaccgtcgcgtgggactagtgggtttatttgacgtggttgcctttgatgaagtagcaggcatgagcttccatgataacgacggtgtacaaatcatgaaagactacatggcatcaggttcttttgcacgcggtaaggcagagattaccgctaatgcttctatggtttttgtgggcaacattaatcaaagcgtggaatccttagtgaagacctcacacctgctggcacccttccccgaagccatgattgacaccgccttcttcgaccgttttcacgcttatattcctggttgggaaatccccaaatttagcccagagaatttcaccaaccagtacggcttcattgtcgattacttagcagaatggctgcgggaaatgcgtaaacgcagttttgctgatgctatagacctccacttcagactaggtaacaacctgaagcaacgagatgttcaagcagttcgcaaaactgtatcagggctgctgaaactgctgttcccagatggctcatttagtaaggaagatgtgcgcgaagctctagtgtatgggctgcgggtgcgacggcgcgtgaaagaacagttaaagaaaattggtggaatggaattttacgatgtgcatttcagctacatcgacttggaaactctagatgagcattttgtctcagtaccggaacagggtggttcgagcttgattagtcaggaaatgctaactcccggtcacttgcactttgtcagcactggggatagcggcataatcggagcattcaaacttgaactgcaagcagtacccggtagtggcaagctagtacgtactggtgtagcaacggctggcaagatgaaggatagtttaaacattgctatgaattactttaaagctaacgctcaaagagttagcagtagtattcacccaagtaatttggattttttgctccagttactagacttgcaagggtctggcgcaccgcaagagagtggattagcattgttcgtttctttatgttctgcttctctaaaacgaagtgttcaaacgcaatttgcaatatttggggaaatgaccattggtgggacgattacaccagtcagtaacctagcgggtagtctgcaagtagcctttgatgctggcgctaaacgtatcctcttaccaatggcaagcgccgtggacttaggcagtgttccgccagaattgtttgctaaatttcaaacatcattttacgctgaccccgtagacgcagtatttaaagcgttagcagtcgattaa

SEQ ID NO: 3745 - DNA, 2112 bp, Rhodobacter sphaeroides
atgagtgacctcgacgccaagatcaacgagcatttcgcaggcttcgtggtccgaaaggacctcgtgaaggcggtcaagggcaacgccatcgtcccatcctatgtattggaatatctactgggccagtactgcgccacggatgacgaggcctcgatccagaccggaatcgagaccgtgaaggagatcctgcaccggcactatgtacatcggaacgaggcgggcctaatccggtcgaacattcgggagaagggacgcggcaaggtgatcgacaaggtgtcggtcgcgcttaacgaaaaatcagactcctatgaggccagttttgccaaccttgggatcaagaaggtcctggtggacagcgacacggttaagaagaaccagaaaatgctcgtttccggggtctggtcgatcgcagaccttgagtatgatcataaagaggaggcgaacgcggtcccatgggttctcgcggggctgaaggcaatccagatgtccagtttcgacttcgacgcgtacttggccgcgcgggcgaagttcacgacggaggagtggatcgacctcctgatccagacgatcgggttcaacccggacgcgttcggtcggcgcagcaagctcctccagctgttgcggctgatcccttacgtcgagcggaactacaacctgatcgagcttgggcccaaagggaccggcaagtcgcacattttctcggagttctccccgcacgggatcttgatctccggcggcgaggtgaccgtccctaaattgttcgtgagcaacgcgagcgggaagatcggtctcgtcggctactgggacacgatcgcattcgacgagtttgccggccggcaaaagaaggtcgacaaggcgcttgtcgacatcatgaagaactacttggcgaacaaatccttctcgcggggggtcgagacgctcggggcggaagcatcgatggcgttcatcgggaacaccaagcattccgtcgcgtacatgctcaagcatacggacctgttcgaggaactgcccgagaagtattacgatagcgccttcatcgaccggctccacgcctacctaccaggctgggagatcgacgtgatccggggcgagatgttcgcaataggctacgggttcatcgtcgactacctcgcggaggtgctgcgccacatgcgcgggcaggaccgatccctcgactaccgggacttgttcacgttggacgcttccatctcgacccgagatcgggacggggtgcaaaagaccttctccggcttgatgaagcttcttttcccgaacgggggcgcaaccccggaggaaatccgggagctgctgaccctttcgatagaggggcgaaaacgcgtcaaggaccagttgatgcggatcgacagcacctaccctgaggtcgagttcagcttcgccgacaaggcaggtcgcgtaactaaggtgcagaccctcgaggagcgggagcacccgcgatggtatcaccgccgaaacgtcgaggaggcgggcgaggcagtcatcgagccggattcgacccacttggattcgagcgcgcccgccttcgcaccagtccaggacgcccccgagagccgccatccgccccgacccgcggcgctgaacgtcccgcgcgagcccctgcccggtcatgtcacgttcgcggagaaccaaaagggagtcagcttcgacaagcttctcggcccatggctcgacggggcgtcggtgatcacgctcaccgacccctacatccgggtctatcaccagatgcgcaacctaatggaacttctcgaggtagtggcgctacgcaagccggacggggaggacgtccagttccggctcatcacagccccagacccggacgacattgagcgccagacgggctatctcgagcaggtccgggacgggatcgcatccctgggcgtggagtttagctgggcctttgacgggacaagcacaatccacgcacggcaccttgtgacagacactggctggaagatcctgctcgatcggggactcgacgtctttcagcgggcagacttaaacaacgggtttagccccgccaacaggcatcaacgcttccggcaagtgaaggcttttgaggtgacctacctgcaagaaggagcggcggccctttga

SEQ ID NO: 3746 - DNA, 2028 bp, Runella slithyformis
atggacctcttagacagcaaactcaatcaatcctttgcgggtaaagtggtacgcaaagacctcaccaaacaaatcaaggaaggggcaaacgttccggtctatgtattggaatacttattgggaatgtactgcgccaccgacgatgaggccacgatcaaagagggtattcaaaaagtaaagcagatattgtccgaaaactacgtccgccccgatgagtcggaaaaagtaaaagccaagataaaagagaaagggcggtttaagatcattgataaagtctcggtaaagctcaacgaaaaggccgaccgttacgaagggttactatccaatatcaatctccgcaacgtcatcattgatgatacttatatccgcaaatacgaaaaactgctgtcaggaggtatctggtgcatcctgacgctggaatattggtttgatgaaaactcaaaggattcccccttcaaaatggtggagctcaagcccatccaaatgcccgaaaccgacatttcagatttcatcaggcatcgtcaggattttacactcgacgaatggataaacgtcatttgccgcagcgttgggatggaacccgtcaatctggacgaaaaagccaagtggcatttagtggcccggatgattccctttgtcgagaaaaatttcaatatctgcgaattaggcccaagaggaacgggcaaatcgtacgtttacgacgaaatatcaccttactccatcctcatctccggcggacaatcaacggtagccaatctgttttataacatgagcacccgcaccgtgggtttggtgggtatgtgggatgtagtggcctttgatgaagtggcaggcatcaatatgaaagacaaagacggcattcaaatcatgaagggtttcatggccaacggttcgttcagtcggggaaaagaaagtatcaatgccgatgcttcgatggtatttgtcggaaacatcaacggttccgttgaaaatctggtaaaaacgagtcatttgctggccccctttcccgccgacatgatagatacggccttttttgaccgcttccatcactatttaccgggttgggaaatccccaaaatgcgcccggagttttttaccaacgcctacggattcatttcggattattacgctgaatgtttacgcgaactgcgcaaacataatttttccgatgccatcagccactacttccgattaggaaaagacctgaaccaacgggattccattgcagtcaaacgtaccgtaagcggtttgataaagcttctgtttccggacggaaaatacaccaaagaagacctccgcaaatgcctggaatatgcgttggtgggtagaagacgcgtaaaagaacagttgaagaaaattggtggaatggagttctatgatgtgcatttcagctacgtggatttggagcagaacgaagaacattttgtgagtgtgccggaaagtggcggcaaatcgctcatcccggaaggcgatttacccgcaggaaccgtttataccatcggcaaaaatgcagcctcgggtcataaaggactctttcgattggacattcagcgaatgcccgggaacggaaaaatcagcgatacggggtttgggggcggcactgccatcaaagaagagttgaaagaagccgtcaactacgtacgttccaacctgaatcgaatcacccaaacggctaaattcaacgattttgaatttcacctgaaagcgactgacctcaacggtattggaaacaccaaaggattggaattggcgatttttctgtcaattgtctcctccattgtagaaagacccctgctgccacaattggcggttttgggctctatgagtattggcggggcaatcattggctccgataatctggccgaatatttgcaagtctccgccgacagcggagccaaaaaagtgctgattccggcagtcgatgtaatacagttaggcaaagttcctaccgacttgatttcaaaattcagcttacttatttattcagatcccattgatgccggctttaaagcgatggggttggggtga

SEQ ID NO: 3747 - DNA, 1425 bp, Aciduliprofundum sp.
atgaatgagttagatgataaaataaagagaatatttccagaggaatccgtgtttaaaagtccaaaagaatataggatattttctggatataatcttccatcttttgtcaaggattggatattaaggaagtttacagatgagtatggaaatttggatgttgatgctctaaagctttttttgaatgcccatattgcacataaagagagcaaaataaaaggaactcttttaaacgatttaaaagaggtcacattgcttgcgagaattgtagtagacccagatataaagtcaggaatactgagattttctataccagatataggtataaaacccaatgagggtcggattcctcagtatattgctaaaaagttcccagaattaaaaggaggggaagtctggggtgtcgttaaattagtttatattccgcctgaaggaaaacaaagaggagcaatagaaatagtggattacaaaccatttaaaccttatgatgtggatgtgaaatatttcagggagaagcgaaaagaatttactttagaagaatggatagaccttatgatacgttctatggaatacaatcccgatgggtttgaatcgctttctcaaaagttattatttttggctcggcttctcgtttttgttgaaccaaacttgaatatgatagaacttgctcccaaaggaactggcaaatcttatacatttaataatctaagtaaatacggttgggttataagtggtggtgttgtttcaagggcaaagttgctttacgatgttgcccgttcaactcctggcataataacccgctatgattttgtagtcttggatgaaatcgaaactataaaatttacggacccaagtgaattacaaggggctttaaaaaattatttagaatcaggaaatttttctgtagcagactatagaggagtttcttctgctggatttatgttattgggaaacatcccattaaaaaaagatagaaaacccctacataacaaatatttcgttaatttaccaaaattctttcaagattctgcactattagatagatttcatggtttcattgaaggatggagattacctagaatgcgagaagatttaaagttgagaggatatgcattgaatgtagaatatttctccgaaatattacacaaattaagaacaatacctgattttgctaaagtagtagattctttgttagatatacctaaaaacgctgacacgagagatacaagagcgatagtgaaaataagcacaggttatttaaaactgcttttcccgcatatacacaaagttgaagatatttataaaaaagagtttgaaacattttgtttaaaaccagcgatagaaatgagaaaaatcattaagaagcaaataagtctaattgataatgagttcaatgatactttacccgaaattaaaataagaggttga

SEQ ID NO: 3748 - DNA, 1461 bp, Anaerobaculum mobile
atgaatgctaacgatgttttacaggacaaaataagaacttttttccaagaaatggtcgtctataaggatccaatccagaataaatttttttcatccttgagcatcccttcctatttgcgtgattggattgttatgcgcttctccgatgatgatgggaaactgaatttggatgaagtcagagattacataaaaaccaatattcccactaagaatgattgggaattgttaaaaagcaagatggtccacgatgggcaacgggtcaaatttttggccaaaatacgagtcgagatagatgtccgtactggtcacggcgtttttaaactgccggatttgggcttccctaatcgtaaatacgaggccattgtcaaggatcatgtgcttaatcataatcgcgaggaactcctgaatgatagcgaaacttggggagtcattgaatgcgagtggaatccttttggagtgactggaaaagaaggcgatggagctatttatatgataagcttcaaaccctttaagccttataaagtagatgttaactattaccaggaagtacgtaaagaatttacgttgagcgagtggatagatatgttgcttttggcagtagattataatcctgcagggtttttggatactcgccaaaagcttgccctcctcagcaggcttcttccatttgtagaaaaccgcattaacttaatcgaattagcgcccaaaggtacgggtaaatcttacatgatgtctcaactatcgaaatatggttggctggtcagcggaggaagtattactcgagcacgtttgttttacgatatctcacgtagcactccaggcttacttagccgttatgactatgtagcttttgacgaggtgcaaaccatcagctttcccgatgtggacgaaataaggggtgcattaaagggatatatggaatcgggggagtatcgtgtaggtgattatcggggtacaggaaaagcaggattggtattgatgggcaatatatcagacgaaaagatgcgtgaagacacggatgtgtttaccgagttgccttatgcttttcaagaatcagcactcattgatcgcttccatggttttataaaaggttgggacataccaaggatgcgagaaaatatgaaagctcatggatgggctcttaatgtggagtatttctctgaagttatgcattcgttgagaaacgagattatttatccggctattgtagagaacctcctgatggttccaaagtcaagcgatacacgcgatgtgaccgccataagacgcatttgctctggtttcatgaggttattttttcctcatgcaaagagcgctgaggatgttaacatcgatgaatttaggacttattgtttggaccttgccttaaaaatgcgcggtattatcagacaccaacttcacctcatggatagtgagtatagtgacactctacccgatatccaggtaaagcaaaagatctag

SEQ ID NO: 3749 - DNA, 1458 bp, Candidatus Desulforudis
ttgacgcaactggatcagactatcggaaaaatgaggtccgtttttagcggcatggtggtttacaagaacccgcagcagaacagtttctttcaaagtcttaacataccgccttaccttcgtgactggctcaccatgaagttcggtgggaaagagggaaaaatagattctgagcagatccaaggctttgttagccgctatatcccccggcgtagggactgggagcgccttaaggtcgaaatgatcaaggaagcgcggcgtgtacgttttcttgccaaggttcaggtcactattgatgtacagtccggagaagggctgtttcatttacccgacttaggcttcccacgcaagaaatacgaggcacgtatcgctggcagactgctgcgcgagaaaaaggaagaactcttggtctcttcagaaacgtggggtgtaatcgaactcgaatgggtacccgctggtgtcaaaggcaagagagggcaaggcagcgtggtaatgattgatttcactccctttcgtccttacacgatcgatgtggatttctaccgggaggctcgaagggagttttcggttgaggaatggatagatgtcctgttattagctgtggattaccatcccgcaggctttttggacgagaggcagaagcttgcactcctgagtcggcttctccccttggtagaaaagagggtcaaccttgtggaactagctcccaaaggaactggtaaatcctacctgttctcgcagattagtaagtacgggtggttggtcagtggcggcagcgtgagcagagcgcgcctcttttatgatttgaaccggcgggaaacgggtctcgtcagccgctacgactatgtagctttggacgagatccaaagcattagctttccggatgaagaggagattcgaggggcgctaaaaggctacttggagagcggggaataccgcgtaggtgatcaactcggtgtgggagaggcgggtctggtattgttgggtaacattagctacgagtgcatggacgaaaacaaggttatgctcagggaactaccagctgtttttcaagaatcagccctccttgatcggtttcacgggtttatcaaaggttggaatatacccaggatgcgtgagaatttaaaggcagaggggtggggactcaacactgagtatttctccgaggtcatgcatgcactccgagatgatgtgcgctatgcgagcgtagtagacgagttgctccgcgttcccaaaggtgctgatacgcgggatacacggagtataaagcgcctcacaacagcttggctcaagctgttgttcccgcacgtagttcagtcagagacagcggacagagcggcatttgataagtattgcctcacaccagcgctaatgatgcgcggcattatccgcaggcaactgcacttaatggatgcagagtatgctgatatcttacccgaaatagttttagcaggagaatag

SEQ ID NO: 3750 - DNA, 1449 bp, Coprothermobacter proteolyticus
atgagcgaggacttagacaggaagataagggacgttttcccggatgaatccgtttacaaaatgccacaaaattatggcgtctttagtggtagaaacataccatccttcataaaagattggctcataaaaaagttcactgatgaagacggcacactggataagcaaggtctgcttagttaccttgacaggtttctcccagataagaagcaagcacagattatcaagaaacagcttgttcagactcaagaaccatatacggtgttggcgcgcgtacagacacaagcagacattaagaagggcatcatacgcttttccataccagatttcggcataggtccaggggaaggcataatacctcgatctcttatagaagctcatccggagctaatggcagatgaaatatggggcatatttacgttggtttacgagcctgaggatgagcacacaccaggacatatctcggttatggattttaaacctttcaaaccttatgaagtggacttggattactttaaggaagggcgtaaggagttcaccttggaggagtggattgatgttctcataagagccatggaatacatgcctacaggtttcgagagtgcccagcaaaaactgctattccttagcagattgctcgtcttcgttgagccaaggctgaacatgattgaacttgctccaaaaggtacggggaagtcatacattttcaacaacttaacaaaatacggttggtgcataagtggaggcacagtgaccagagcaaagatgttttacgatatctcacgtcggtcttttggctacattaccaggtacgattttgttgctctggatgaaatagaaactttaaaattcgcggaggaagaagaacttaaaggtgcgctcaagaactatctggagcttgggaagtttaccattgcagatgttaccaagacctctgaggccggtttcatgcttcttggcaatattcctttaactagtgaacataagcccataaacgatatttactttagtcatttgcctgacttcttccgcgattctgctttacttgacagatttcatggtttcatcgaggggtggcatttaccccgcataaatgaggatatgaaagttagcgggtacacactaaatgtggagtttttctccgagatactacacaaagtaagagagcgtagcgaatatgcggccatagttgatgagctgctagatataccacctaaagcagataccagagatgtaaccgcggtaaaaagattgtgtacggcctatctgaagatcctttttccgcacattactgatagttcccaaataactaaagaggagttcgagacgtattgtctgaagcctgctttggagaagcgtgccattgtcaagaggcaaatccatcttatggatcctgaattcaaagctgctattcccgacatcgtggtgaagcaagaccatgttagcacatga

SEQ ID NO: 3751 - DNA, 1464 bp, Cyanobacterium stanieri
atgaatttttctaacaactattcaacctatgacaatgaattagtaactagagtatttggttcactttctatcgataaaaaacgcttaccttcaagtagtttaaccagtgttggtgtacccagttttgtcggcgaatggatattggaacatattgtagcaggtactggggagttaaacgatggggaaaaagaaaaagtccgtaattttgttgataaagcctttcctcgtaaagatgataaagaagaaataaaatttgaattaacccagggaggaatttataccttaattggcttaatgcaggtaagagtaacattggaaaaaacctccgaacaaattcccgaacctgttgctagtatttctgttctaaatttaaccgattgtgaaatatctacagatatagttaatcgtcatcgccgattattaagacaaggaatatggggaaaaattaccttaagatatagcccagatatgaaaggtaaatttaaagtatcagttatcgattttgctccttttcaatgttcagcagtcgatttgaaatcatatggagaattgcgttctcaattttccacagaaaaatggcgagatttaatgttttgttcgatgggttttaatcctgaacatccagactacaatcatcaagcaaaaacatggattttaagtcgtttattacccttagttgaacctaattttcatctaattgaattagcaccaaaaggtacagggaaaagttttttttatgagaatattaataataaagtgtcggtagtcagtggaggaaaaattacccccgcaagattatttattgatggaaaaactagagaagttggcttattgggacgctataacgtggttgttttagatgaagttcaaagtttaacttttgataatcctgatgaaattatcggaccattaaaaacttatcttgccaacggaagttataatcgtggcggatattctgatatagccagtgattgctctttagtattattagctaatattgaattaaatgaatatcaacgcccgaaaaatgaatataatttaatggctaatctgcctaaatttttctcagaaacggcttttttagatcgttttgctggtattttacccggttgggaaatacccaagtttcaaaaggaaatgatggctaatcaaatcggattaaaaatggatttttttggagaagttttatttgcattaaggagagatacccgtttccaacaatacgcagaaacccatacaaattttctgtctaaagtttctattcgacatcaacaaggaattataaaaacagcatcgggatttctaaaaattctctatcctcatcttgatttaactttacaagattattggaatgactgtttaaaacctgcctgtttattacgtcagcaaattcatagtttaatctataatcttgatgatgaatttaaacagtatggaaaagaaattattgttgatattatataa

SEQ ID NO: 3752 - DNA, 1443 bp, Denitrovibrio acetiphilus
atgactgataaacttagaaattgtttcgacgaaatggtcgtattcaaagaccttaaaaagaataattttttttcatctcttaatctgccttcttttatgcgagactggttacttaaaaaatttgaggatgataatgggcagtttgaaacagaagaactgattcggtttgttcgcacataccttccaggtaaagatggttggacagcaattaaggaccgtataattaaagaaaatgaaagagtcaaatttcttgcaaaaatatcatcggacattgccattaaaactggcgaagtttcattctctcttcctgattttggtttgacaagtaaagatactattatagaagataatgtttggaatgactgtaaaaatgaattagttcgcggtcgagaaacgtggggaatggttgaactaggataccgaatggctgaaccagaattaaaactaacaggtaaaatcaagctgacaagttttaagtctttttgcccctatactatagatctcgaatactataaagatgcacgccgagagtttgaaacatccgaatggttagatgtccttctcggtgctgtggattataatgcgagtgggtaccttggagatgaagagcagaaactgacaatgctgacccgtcttcttccttttgttgagaaacgtttgaatcttatagaacttgcaccaaaagggacaggtaaatcatatctctttggtcgtgtgagccgttttggatggttatcttctggtggagtaatgagccgtgcaaagatgttttacgatcaaaataaacgaacagaaggtttagtttctgggaacgattttgttgttctagatgaagttcagactatttcgtttactgatgttgacgaaatgagagcagctttaaaaggctatcttgaatcaggtgttttcaccgttggtaactatgaaggcaaagcagattccggagtcatcctttgtggaaatatcaaaaaagaaactatggatagcgatggttttagtagcatgtttgaagaattaccggcaatctttcacgaatcagcactcattgaaagattccatgggttcataaaaggatggaatattcctagaatgaatgatgatctcaaaatatcaggttgggccttaaactcagaatatttttgttcaatattacacgaattacgtgaagatttaagctaccgtgctatagttgatgaacttattcatgtgtctgaagctgctgacacccgtgatactgaagctgtaaagcgtattgcaactgcatatttgaagttactttttcctcatgtccgtgatgcatctgatatatcagcaagtgagtttaaaaggtactgccttgatagagcacgtaaaatgcgtgatactattaaatatcagctcggactattagatattgaatacagaggtaaagacattcctacatttagtgttagaggagattaa

SEQ ID NO: 3753 - DNA, 1503 bp, Desulfitobacterium dichloroeliminans
atgtatgatgttgataaattacgggagtattttccttctaccacggtctataaagacccatctgtcatggctatgttcaaatctgcaaaaattgaggcttttcttcgtgattggatactgaagcgtaaagcaggaccagacggacgtgtcgaaaatgttgatgtgcttagtgaatatgttgcatccattattcctcctcgtagcgaaaaagaacgtttacaagacgaggcacgttctaacggagaaactcgcccatttcttgcaaaggttaatatttcatttaattcaagcgcagactactactgctttgagatacccggtctgggattcacttattcccatactatcatagaggactatgtgtgggatagaattaaggatgaacttatcggcgaagcgggcggctggggcttggtgaggcttggctatatgccgccggagggaaataagaaaaatggccggttcacattgctcgactataaaaatttctgtccttacgaagtcaatttggacgctttccgtgaggctagaacccattttgaggtcgaagagtggatgggtatcatacttggcgctatagactacaatccagatggttttgaacgcgaaggttggattgacactgacatttggaatgcgaaacatacgatgcttactcgccttttgccgtttattcagccacgcattaacctgattgagctcgcgccgcaacagacgggaaagtcctatattttcggcaaggtagggaaatatggctggttattgagcgggggcagtgtcagccgcacaatgctctttttagatcggcgtgcaggggcacgggcaaaaggtctagttacttttaatgattttgttgcgattgatgaagttaaatcaattagctttaccaatgacaaggaaatgggcggcatcctcaaaggctatatggaagacggttacactacggttggtggaacaagggttgatggcgacgcgggaattatattccttggcaacattgctgttgaggatatggacgcttcaaaggatatgttgcgtgaactccctgatattttccgcgatagtgcgctcatacagcgtattcacggctttgttcctggtcaatttatcccaccgctctctccaagaatgtatataagcgggtgggcgctcaataccgaatatttcacggaaattatgcatttgcttcgtagccctgctgaaacgatgcgttaccgtggttttgtagaagaactcgtagatgtaagctcaaagtccggcgatacgtcagggcgggagcaagatgcgattatgcgtctttgcacggcttatctgaagctgttctttcctcatgccgatagcgccttgattcgggactcaaagttcaaacgtgaatttgataagtactgtttgcaacccgcaaaacgcatgcaggaaactgtattaaagcagatgaaaattataaatccaggtatgttcggaaacacgggatttgcgacttataaggtgaggtatgatatttaa

SEQ ID NO: 3754 - DNA, 1458 bp, Geobacter sp.
atggtcgatacagataaattgcgggcggcatttccagacacaacggtttttaaggccccgaacatcgtggcgatcttcaaagctgcgtcgattccgtcttttttgcgtgactggattttgaagcgcaaggccgaatcggacgggagaatccacaatgccgaggcattgcgcaattatatctacgatattatcccccgccgggaggatttactgaatttgcagactgccgcgcgaagtgaggggcgcacaaagaaatttctggctaagattgaaatccaattcagcgtacggtccaacgagtacacgtttgcgattccggaattgggtctggggcatgcggaaacgctgattgaggattatgtatggactcggatcaaagatgatgttgtaaatactgctggtggctggggactagtgcaacttggataccggagtccggacgacgagaatgcacgtggatgtttcacactcttagagtacaagaatttctgcccgtacacgatagatctggacgcctatagagaagcacgctgccagttcacaaccgaggaatggatcgacgttgtgttgggggcaatcgactacaatccggagggttacgaagactgggtacagaagcatacggtactgacgcgcctgctgccattcatcgaaccgcgccttaatttgattgagctagcacccaaggggacaggcaagtcatatatgttcgggcgggtagggaaatacggctggctggtcagcggggggacactgacgcgcgcgaagatgttcggcgatatcaatgggaagagtcccggcctgatcgcgtcgaacgactttgtagcgctggacgaaatccagtccatcaactttcccgatccgagtgagatgcagggcgggctaaaagcctacatggaaagtggggagatcacggtcggcaaaaaccgtatcattggcggtgccggtgtcatactactgggaaacatcccacaaacagatatggacgagaccaaagacatgttccagaggctgccgcaagtgtttcacgagtcagcattgctggaccggtttcacggttttatccgtgggcgcgacataccgcgcatgagtgagaacttgaaaattaacggttgggctctgaacacggagtatttttccgaaataatgcatctgcttcgccagcccgcagaaacaatgatttatcggcatgtcgtagaaagactagtagactacccttccggggcggatacccgcgatacggaagcggttttacggttgtgcacggcataccttaaactgctgtttccgcacgttacagcacccggcagaatcgacaagggggagttcaagcgatactgtctgcgtcctgccgttcagatgcgcacggtgatccgacagcagttgcagagtatagacccccttgaattcggagggaagaacgtagcagcctacacgttacgcgaggtaaatgaatga

SEQ ID NO: 3755 - DNA, 1464 bp, Prevotella denticola
atgaaagaagaaatatgtaataagataagacagcatttctcggcaatgtctatttataaagaccctgcatcaacaagtagtctttttgcaggacgaaaccttcctgcatttgttagggacttcctgctgaagcgctatctgaacattcagactggagaggttgatagaatggcactctctcaattcttagataaagttattccagcaaaacaaggtagtgttaaagatagattgcaaagtggagaagaagttatgcttttggctcgctttgtagtgtacattgacatagtaaagaatgagcgtcaatttgccattcctgattatggcattaagcaacgtgaggggttaattccagaatatgtctattctcgtaactctggagaatttgttgaaggtgagaaatggggtattatcaaactttgtctactgcctgacgccgatggcaagaaaaaccatatccaaatggtagattataagccattcaagccttatagttctgtggacatctcctatctagcagaggcgcgccactatttcactactttagaatggattgacgtattgttgtctgctatggagtatgaccctgatggatttacatcactaacccaaaaaatagaattccttacccgattactcatttttatagagccacgtctaaatgtgatagaattggctccaaaaggaacagggaaaagctatgtatttggcaatctttctaagtatggctggttggtaagtggtggcaaggtaacacgtgctaagttgttttttgacaaaacgaaacagcagaatggtattatcaaaaaccatgactttacagtattcgatgagatacagactatcgttttccaagaacctgctgagattcaagctgctctaaaatcatatttggaaagtggaaagacaaccattgataataatgaattttcttcagagtgtggcttgatgcttatgggtaacattcctttatctgctcaacacatgcctgtgtcacctttttatttcaccaacctgccagagaacttccgtgagtcggctttgctcgaccgctttcattgctttattgaagggtggattcttccacgagtagacaaaagcatgattttcaaaggatggactatcaatgtggaatacttttctgaaattcttcatacaatgcgtacacaaaatacctatggattattgttcgatcaactcgtccgatttgaagaaaaagccgatgtgcgagatagtaaagctgtgaagcgtattgctacagcttatatgaaactgctattcccgcactggcagcgtaccgaagatgtaaatgaggaagaatttaagatatattgtcttgacccagcgatacatcgtcgtggtatcgtaaaggaacaatgttataacatcgatcctgagtttaagagtcgaatgccacacgttgaaattgtacaaaaaggtttcaccgaaaacaagcttttttaa

SEQ ID NO: 3756 - DNA, 1422 bp, Thermotoga petrophila
atgaatgagttagatgaaaagataaagaaaatattttcagaggaatctgtgtttaaaagtccaaaagaatatagaatgttttctggatataatcttccatcttttgttaaggattggatattaaggaagtttacagacgaatttggaaatttggatgtagatgctttaaaactttttttgaatacccacattgcacataaaggaagcaaaataaaagggactcttttaaatgacttaaaagaagttacattgcttgcgagaattatagtggagccagatataaagtcaggaatattgagattctctatacctgatatcggtataaaactcgacgaaggacgaattccccctcatgttgctaagaagtatctggagttgaaaggaggagaagtttggggtgtcgttaaattagcttatattccacccgaaggaaaacaaaaaggaacaatagaaatagtggattataaaccatttaaaccttatgaagtagatgtagaatatttcagagagaaacgaaaggaatttactttagaagagtggatagatcttttaatacgttctatggaatacaaccccaatgggttcgaatcactttctcaaaagttattatttctagcccgacttctcgtttttgttgaaccaaacttgaatatgatagaattggcacctaaaggaacgggcaagtcttatacatttaataatttaagtaaatacggttgggttataagtggcggcactgtttcaagggcaaagttgctttacgatgtagctcgttcgactcccggtataataacccgctatgattttgtagtcttagatgagattgagagtataacatttacagatccaagcgaattacagggagctttaaaaaattatttggaatcagggaatttttctgtggcaaactatagaggggtttcttctgcaggtttcatgttattgggaaatattccactaacaaaagatagaaaaccactacatagcaaatacttcgttaatttaccaaaattctttcaagattctgctttgctagacagattccatggtttcattgaaggatggaaattacctagaatgcgagaagatttaaagttgagaggatacgcattgaatgttgaatatttctctgaaatattacataagctaagaacaactccagattttactaagatagtggattctttgttagatatacctaaaaatgcagatacgagggatactagagctatagtaaaaatatgcacaggatatttaaaactgattttcccccatgtacacgagagagatgacattagcaaaaatgaatttgaaacgttttgtttaaaaccagcaataaaaatgagaaaaatcattaagagccaaataagtctaatcgataatgagttcagtgatactttacctgaaattaaaatcaaataa

SEQ ID NO: 3757 - DNA, 2217 bp, Actinomyces sp.
atgagcatctcgcccgaagaagccctagagcgcgaggattccccggcctcgtctctgatcgggggtagcgagggaggaaagctcgcggagtacgaggaaatcgccgcgcgcgcatacgacggcttcgtcgtccgcaaggacctggtcggccaggtcaagggcaacgcgatcgtcccctcctacgtgctcgaattcttgctcgctcagtactgcgcgaccacgagcgaggcggccattgtcgagggtgtcgagagtgtccgtcgcatcctcgccaagcactacgtcaaccgcggagattccgagctcatcaagtcacgcatccgcgaggagggacagtatcggattatcgacaaggtctccgtcaaccttgacgaaacgcacgaccgatacaacgcctccttcgaaaatctcggggtcaccaacgcgctggtatccgacgagaccgttcgtgagaacgaccgcctcctgaccggtggtgtctggtgcctggctgagatgtcctacgtgccgatgggagattccggagcaaaagcatccagcccgtggatcgtctcccgccttcaagccatccagctgccgcgcttcgatttcggccgctactgcacggggcgcgcctctttcagcaccgaccagtggatcgacctgctcgtcgcctcggtcggtctcgatcccgataagctcagccgacgctcgaaactcttccagctgacccgcctcattccctacgtcgaacgcaactataacctcgtcgagctgggccccaagggcaccggaaaatcgcatatctactccgaattctcgccccacggcatcctcgtgtcgggcggcgaggtgacgctggcaaaactcttcgttaataacgcgacccggcgcatcggcctggttggctactgggacgtcgtcgccttcgatgaattcgccgggcacaagcgcgtggaacgcagcctggtcgacacgctcaagaactacctcgcgaacaagtcgttctcacgtggcgacagcacgatcacggccgaggcctcgatggtcttcgtcggtaacacgacgcggaccgtacccgcgatgctggccagcgccgaccttttcgaggccctgcccgaggcgtatcacgacacggcgtacatggaccgcgtccactactacctgcccggatgggaagtggacattgtgcggcccgagctcttctcgcgcgggtacgggctcattgtcgattacctggcggaggcgctgcggcacctgcgtaccctggattactccggtgacctggataccctcgcgacgctcgatccggcgatgtccaagcgcgatcaggacgctgtgcgaaagacgttctcgggcctggcgaaactcatcttcccggcacgcgatggcgagcctgaggaactcgaggagctgctccgcttcgcgatcgaggggcgtaagcgcgtcaaggatcagatcatccgactcgacgacacgatggctgcgtccgggtcccacttcacgtacatgctgggacgcgtggaccaggaccactacaatgcctcgagcgcccgatccgttcccacgcaggaggaactggactacccgcagtacttcacgtcgcacggtgatgctgatgagcgggggagtggtcaatgggatgccggagagctttccgacggtcttccgaagtcggacgttgtagtcgatgcacgcggagacaataagccggcctcgcccgtctttgaccgtcgagccctgttgaaagcacgcgccatccccaagcgctacaagatcgagccgagcatgggtaattccatgccggacatcctgctcccgtacctgttcgatgcggctgagatacggatccgtgacccgtacttgcgccagacgcaccaggttcgaaacgtgcacgaaatactgctgcagctgatccagaatgccgatgtcgcgaagctgccgcacattgtcatcgagacgtgcgccagcgacgaggacatctatcgcttgcggcaggaagagacgttcaagcaactacagcaatcgtgggagcccttcggcatcgtgatcgactggagcatcgttgattacttccatgaccgctgcattacgaccgacaccggctgggtcatcgacctcggtcgcgggctggacgtctatgacgcgtacacgccgctatcgcaattcgaccctcgttatgcgatcccgcacctgcggcggacgaaggagattacgatcaacatcagcagggagtaa

SEQ ID NO: 3758 - DNA, 2076 bp, Vibrio cholerae
atgataactgatttttcacaagatcataaagacgaaaaaaatcagatgcaaagcgccgacttagacgcattgctcaatcaatattttaaaggccgtgtcgttcgaaaagatctgacaaagcaattgaaagaaggcgctaacgtccctgtctatgtgcttgagtatttactaggcatgtattgtgcgtccgatgacgacgaagtcgtaatgcaaggccttgataatgtcaaaaaaatcttggctgagaactatgtccgacctgatgaagcggagaaagtgaagtcactgatccgtgaacgcggcacgtttaaaatcatcgacaaagtaagcgttaagctcaatcagaaaaaagacgtctatgaagctgcgttgtctaacttggggatcaaggatgcccttgtaccgaccaaaatagtacaagacaacgaaaaattattaactggcggtatctggtgcattattaccgtgcagtatttctttgaggaaggtcagaagacatcacctttctccattatgagtttaaaaccgatacaaatgccgtccatgaacatggatgaggtgttttcaaccagaagacattttagtaccgatcagtggatggatgtgttgcttcgttccgtgggtatggagccaaccaacttagagcatcgggtgaagtggcatcttattactcgcatgatcccattcgttgaaaacaactacaacgtttgtgagctcggaccaagagggacaggtaaaagccatgtctacaaagagtgctcaccaaactcattgcttgtctcgggtggacaaacaactgtggcgaacttgttctataacatgagctcgcgccaagttgggttggtcggaatgtgggatgttgtcgcatttgatgaagtggccggtattaactttaaagacaaagacggcgtccaaataatgaaagattatatggcgtcagggtcttttgcacgtggtcgtgattcaatcgaagcgaaggcttccatggtattcgtcggtaacatcaatcaaaccgttgagacactggtgaagaccagtcatctgttggcaccttttcctgatgccatgattgacactgctttttttgaccgtttccattcctatattcctggatgggaaataccgaagatgcgtcctgagtatttcaccaatagttacggattaatcacagactatcttgctgaatacatgcgtgaaatgcgcaaaagaagttttgcggacgctatcgataagttcttcaaactcggtaataaccttaatcagcgtgatgtaattgctgtacgcagaacggtttcgggcttgttaaagctactacaccccgacgcacagtacacaaaagatgatgtaagagcctgcctgacctatgcgctggaaactagacgaagagtcaaagagcaattgaaaaagcttggcggaatggaattttttgatgtgcactttagctacatcgataacgattcattagaagaattcttcgtcaatgtaccggaacaaggtggcagcaagctaattcctgagggcttacctcgcgctggtgtcgtgcacttggttactcagggaagcactgggcagcttgggttatatcgctttgaaacccagatgatggctggttctggtaaacattcagtgtctggccttggttcgaataccgcagcgaaagaagctgtgcgtgttggctttgattatttcaaaggtaacctgaatagaatcagtgcgtcggcgaagttttcagatcatgagtatcacctccatgttgttgaactccacaatacggggccaagtacaaagtcatcgctcgctgcattaattgcgttctgttcaattctgatgaaccgaccgattcaagagcagatggttgttttgggtgagatgactttaggtggtgttgtaaatcctgttcaagatcttgcaggcagtcttcaattagctatggatagtggcgcaaagcgtattttgctcccaatggcctcagcctcagatattccaacggttcctgctgagttgttctcaaaattccagatcagcttttatgcagaccccgtcgatgctgtgtttaaagcgcttggggttaattga

SEQ ID NO: 3759 - DNA, 2097 bp, Vibrio harveyi
atgacagaaaattataatcaacaagagcctattgacgttcctagtcaggcagatgaaacccaacatgtcagagatgtcgatctggatgagttgatgacggctcaatttaaaggaagagttgtacgtaaagacctgaccaaacaactcaaggaaggagccaatgttcctgtctatgtcctcgagtacctgttagggatgtattgctcgactgatgatgatgagttgatagaagctggcttaggtcgagtaaaacaaattctgactgataactatgttcgtccagacgaagctgaaaaggtcaaatcactgatcagagaaaaaggcacacataaagttattgataaggtcactgtaaagcttaatcagaaaaaagacgtatacgaggcgagcctatcgaatttaggtatcaaggacgcggtgatctctgccaatgtcgttaaagagaatgaaaagctgctaacaggcggtatttggtgcattattactctaagctacttctatgaggaaggccaaaaaacgtcaccattttctgttgttggcttaaaagcaattcagatgccttcaatgaatatgcaagaagtgtttgatgctcgacgcaacttcactatggatcaatggctagatatgctattacgctcaattggtatggaacctgccaatctggagcaacgtgctaagtggcatatcttagccagaatgataccgttcgttgaaaataactataacgtctgcgagctaggccctcgcggtacaggtaagtctcacgtttataaagaatgttccccgaactctttattggtatcaggcggtcaaaccaccgtcgctaaccttttctataacatgtcaagccgccaagtcggtttggttggcatgtgggatattgtcgcttttgatgaagtcgctggtatccgatttaaagacaaagatggcgtgcagataatgaaagactacatggcttcaggttcatttagccgtggtcgtgattccattgaagcgaaggcttcaatggtctttgtaggtaatattgatcaaagtgtcgaaacactggttaaaacgagtcatctacttgccccattccctccagagatgattgactctgcattttttgaccgtttccacgcttatattcctggctgggaaattcctaaaatgcgcccagagtttttcacaaaccgttttggtctgatcaccgattatcttgctgaatacatgcgcgaaatgcgcaaacatgcatttgctgatgctatcgacaaattcttcaagctgggaaacaatctcaatcagcgagatgttatcgccgttcgccgtaccacatctggactactaaaacttttagtgccacatggcgagtactctaaagaagatgtacggatttgcttgacctatgcactcgaggttcgccgccgagtcaaagagcagctcaaaaaaattggagggatggagttcttcgatgttaacttctcttacattgataatgaaacgctcgaagagttctttgtaaacgttccagaacaaggaggttcacagattatcccaccaggtatgcctaatgctggcgttgttcacttcgttagccatggtactgcgggtaagctcggagtgttccgaattgaaactcaaaaaacggctggcaatggtaagctaactacttcaggtttaggatcagataccgaagcaaaagagcaagtaaaagttggatttgagtatttcaaaggaaacctatcacgaatagcggcgaacaatcagtattcggaacatgagttccatttgcattttgttgacctccagatgtctggtcactcacatagttctagcctagccgctttgattgctaactgctctgctctacttggaaaaccgatgcaagaatcgatggtggttttggggtcgatgaccctaggaggcgtattgcatccagttcaggatttggcaggctcaatgcaggtcgctctcgaagctggtgcaaccaagattctcattcctatggcatctgctacagatattccgacggtgcctgctgaaacatttactaagtttcaagttagcttttacagtgaccctgtagatgctgtttacaaggctctcggggttagttga

SEQ ID NO: 3760 - DNA, 2085 bp, Escherichia coli
atgcaaacccatcatgatttacctgtttcaggcgtatccgcaggggaaattgcctccgagggttacgatctggacgccctgctgaaccagcattttgctggtcgtgtggtgcgtaaagatctcaccaagcaactcaaggaaggggcaaacgtcccggtgtatgtgcttgagtatctgctcggcatgtactgcgcctctgacgatgacgacgtggtcgagcaagggttgcaaaacgttaagcgtattctggctgataactatgtgcgcccggatgaagcagagaaagtgaagtcgctgatccgcgagcgtggttcgtacaaaatcatcgataaagtgtcggtgaagctaaaccagaaaaaagacgtttacgaagcccagctttctaacctcggcatcaaagacgcgctggtgccatcgcagatggttaaagacaacgagaagctactgacgggcggtatctggtgcatgattaccgtcaactatttctttgaggaagggcagaagacttcgcccttctcattgatgacgcttaagcctatccagatgccgaatatggatatggaagaagtgttcgatgcgcgtaaacactttaaccgtgatcagtggatcgatgtgctgctgcgctcagtgggtatggagcccgccaatattgagcaacgcaccaaatggcaccttatcacccgtatgatcccgttcgtggagaacaactataacgtttgcgaactggggccgcgcggcaccggtaaaagccatgtgtataaagagtgttctcctaactccctgttagtttctggcgggcaaacgaccgttgccaacctgttctacaacatggccagtcgccagatcggcctggttggtatgtgggatgtggtagcgttcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagacgctagttaaaaccagccatttgctggcgccgtttccggctgcgatgattgataccgcatttttcgaccgctttcatgcctatattcccggttgggaaatccccaaaatgcgcccggaattctttaccaaccgttacgggctgattacggattatctcgctgaatatatgcgcgaaatgcgcaaacgcagtttctctgatgcgattgataaattctttaagctgggtaacaacctcaaccagcgtgacgtcattgccgttcgacgtaccgtgtcgggattgttaaaactcatgcatcccgatggcgcgtacagcaaagaagatgtgcgagtctgcctgacctatgcgatggaagttcgtcgccgcgtgaaagagcaacttaaaaaactgggcggcctggagttcttcgatgtgaactttagctacatcgataacgaaacgctggaagagttttttgttagcgtaccggaacagggcggcagcgaacttattcctgccggaatgccaaagccgggcgttgtgcatctggtcactcaggcagaaagcggcatgaccgggttgtatcgttttgaaacacagatgactgccggtaatggtaagcatagtgtatcgggtctgggttcaaatacctccgcgaaagaagctatccgcgtcggtttcgattacttcaaaggcaatttgaatcgggtaagcgcggccgcgaaattctccgatcatgaatatcaccttcatgtcgttgaactgcataatactggcccaagcaccgcaaccagtcttgctgcgcttatcgctttatgttcgatattgctggcaaaaccagtacaggaacagatggtggtgttgggcagtatgacgcttggtggagtaattaacccggtacaggatcttgccgccagtttacagctcgccttcgacagcggcgcaaaacgggttctgttgccgatgtcctcggctatggatattccaacggttccggcagagttatttaccaagtttcaggtgagtttttactcagacccggttgatgcggtttataaggcgctgggtgtgaattaa

SEQ ID NO: 3761 - DNA, 2127 bp, Coprobacillus sp.
atgccggatctggacgaaaaatataacgaatttagccgagagctgagtcaaagcgtgtcgcctgaaacggagccgaccaaagaaaatatatgtgacgagcgcagctatgacgaacgattgaaggatatttttcaggggaaaatcgtgcgcaaagacctgacaaaaaagatcaaggaaggcgcaaatgttcctgtgtatgtcctggaatttctattgggacaatattgcagcagcgatgaccctgaaatcatcgaaagaggcgttgaaacggtaaagcatattttaagcgataactttgtgcgccctgatgaagcacaaaaaatcctttcacgcctgcgctctcgtggtagccatacggtaatcgacatgatcaccgtgcatttggatatgcgcaagaatacatatcttgcggagttttccaacctgggcattaaggatattccgattgccgatggatacccggaaaagtacgaccgccttttgtgcggaggtatttggtgcatcgtgcagctgagctatgagtttatcgaggaagaaaagaacgctgcacctattcgcattgataagctgacgcccattcagatgccacatattgatttgcctgaattgcagcaagggcgcaaagcgtttaccaaagaagaatggatggaactgatgctgcgctctgccggatatgagccggagtctctgactgtgcgtgaacagtggctgttgctgactcgtatgattccgctggtggagaacaacttcaacttatgtgagttggggcctcgcagcacgggtaaatctcacctgtataaagaaatttccccgaacagtattctcgtatccggcggtcaaactacggtagccaacctgttttataatatggggcgcaaaaccgtgggcttggttggtctttgggactgtgtggcatttgatgaagtagccggtatccgctttaaggataaagatggcgtacagatcatgaaggactacatggcgtccggctcctttgcccgtggcaaagaggaaaaagcagcttcggcatctatggtctttgtaggcaatatcaatcagagcgtagatgtgctgttaaaaaccagcagcctgtttgaccccttcccgcctgagatgggcactgacacagcgttcctggatcgtattcattgctatctgcccggttgggaaattccaaaattccgtccggagcattttaccaacagctacggatttatcagcgactatctggcagagtttattcgtgagctgcgcaaggtacagtatggcgatgcgctggacaagtatttcagattgggtaaaaatctgaatcagcgtgatacgattgctgtgcgccgcatggtagacggttatctgaagctgatgtaccccaacggggaatttaccaaggatgaactggaagaagtgctgcggctttccttggaaatgcgtcggcgtgtaaaggaacagctgaaaaagctgggtggcatggagttctacgatgtgaacttctcctacatcgacaacgaaacctttgaagaaaagtatgtttctgttccggagcaaggcggtgatacgctgattcccgaaggattgggtacaccggggcaggtatatacggtttctcacggcaagtctggtatgattggtgcattccgcttggaaagccaaatgctacccggtaacggcaaattcgataaaaccggtttgggcagcgatgccaaagccaaggatgcggtcaacattgcattcaatttcctgaaagcaaatgcacggcgtatcagcggcagcatcagtaccacagataaggattacatcatcaactatcaagaccttcagggcattggaatgaccgacaaactggcgcttcccacagtaatctcgctgtgttcgattgccattggtcgcccgacattaagcagccttgcggtacttggcgatatttctatcggtggtactttgattaaggttgacgagttggcgaataccttgcaggcttgcgtggattgcggtgcaaagaaagtgctgttgccggctgtgtcaatgattgattttgcaacagtacccgcagacttgatgtcggctttccagctgattccgtatcagagtgccgaagatgctgtgtttaaggcattgggagtggaataa

SEQ ID NO: 3762 - DNA, 2034 bp, Enterococcus faecium
gtggaacaacaggaaattttaaagttatctgaattctttcccggaaagattgtcagaaaagatttaacaaagaaaattaaagaaggtgcgaatgtacctgtttatgtattggaatatttacttggtatgtatgcttcgtcattggatgaaacattggttgaaaaaggtgtggaaaatgttaaaaatattcttgctcgaaactatgtgcgtcctgatgaagcagaaaaagtaaaagcaaaaattcgtgaattgggtggttatacagttattgataaagtaactgtacatttaaatgaaaagaaagattgttatgaagcagaattctctaacctgggattaaaaaatgttcaaattagtgaagagtatccgaaaaaatttgatcgattattaggtggggggatctggtgtattgtttcgatggaatattggtatgatgagaatgatcgttggaatagcccttttattgcaaaaaaggttgatccaatccaaatgcctggtttagacattgaggcttacaagatggctcgcaaggagtttactacaaatgaatggattgacttacttctacggtccattggtatggaacctacacaatttaataaaagggtaaaatggcttcatttagcaagacttattccattaattgaaaataattttaatctctgtgaactaggaccacgtggtacaggtaaatcgcatgtatataaagaaatttcaccaaactcaatccttgtttcaggtggacaaacaacagtagcaaaccttttctataatatggctagtcgtacaatgggacttgtaggtatgtgggactgtgttgcttttgacgaagttgctgggattaaatttaaggataatgatggcgttcaaatcatgaaagattacatggcttcaggatcttttgctagaggcaaagaagaaaagaatgcttcagcatcaatggcttttgtaggaaatattaatcaaagcgttgatgtaatattgaaaacttcgaatttatttgagccatttccggaggttatggggacggattcagcctttttggatcggatgcattgttatttaccaggttgggaaattcctaaatatcgaccagatttttttacaaatgactatggcttcattacagattatttttctgaagtcatgcgtgagcttcgaaaagttagttttggcgatagttttgataaatatttcaaacttggttctcaattaaatcagcgggatacgattgcagttcgtcggattgtatctgggatgatgaaactgttgtatcctgatggtagatttgaaaaaagtgatgtcgaagaaatactaagatttgctcttgaaatgcgtcgtcgtgtaaaagaacaattaaagaaaattggtggaatggaattttatgatgtcaatttttcatacattgatttagaagaagagcgagaagagtatgtttctgttcctgaacaaggtggaggaactttgattccagaagggttagggaagccagggcatttgtacacggtatcttatggcaaaactgggcaattaggtacctataaattggaaacgcaaatgacttcgggaaatggaaagtttgaacgtactgggatcaattcagatgctggagcaagagaagcgatggattcggcataccgatatttaagagctaattatggaagtgttagtcagtctattagtttgacgacaaaagattttgtcgttcatgttcaagatatgaatggcattggtatgacaaaaacattatcgttatcaactataatagctttatgctcagtttccttaaataaacctgtattaccaagtttagttattttaggggatattacaattggtggttctatgattaaggtagataatttagctaactgtttacaagtagcaaaagatgccggagcgaaaaaagtacttgtacctatgataagcgctgctgatattggaactgtacccccagaattaatgggtacctttaatttgattttttatcaaacgccggaagatgctgtctttaaagcccttggggtggaatag

SEQ ID NO: 3763 - DNA, 2052 bp, Vibrio cholerae; identical to SEQ ID NO: 3740

SEQ ID NO: 3764 - DNA, 2085 bp, Escherichia coli
atgcaaacccatcatgatttacctgtttcaggcgtatccgcaggggaaattgcctccgagggttacgatctggacgccctgctgaaccagcattttgctggtcgcgtggtgcgtaaagatctcaccaagcaactcaaggaaggggcaaacgtcccggtgtatgtgcttgagtatctgctcggcatgtactgcgcctctgacgatgacgacgtggtcgagcaagggttgcaaaacgttaagcgtattctggctgataactatgtgcgcccggatgaagcggagaaagtgaagtcgctgatccgcgagcgtggttcgtacaaaatcatcgataaagtgtcggtgaaactgaaccagaaaaaagacgtttacgaagcccagctttctaacctcggcatcaaagacgcgctggtgccctcgcagatggttaaagacaacgagaagctactgacgggcggtatctggtgcatgattaccgtcaactatttctttgaagaagggcagaagacctcacccttctcattgatgacgctcaagcctatccagatgccgaatatggatatggaagaagtgttcgatgcgcgtaaacactttaaccgtgaccagtggatcgatgtgctgctgcgctcggtgggtatggagcccgccaatattgagcaacgcaccaaatggcaccttatcacccgtatgatcccgttcgtggagaacaactataacgtttgcgagctggggccgcgtggcaccggtaaaagccatgtgtataaagagtgttctcctaactccctgttagtttccggcgggcaaacgaccgttgccaacttgttctacaacatggccagtcgccagatcggcctggttggcatgtgggatgtggtagcgttcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagactctcgttaaaaccagccatttgctggcaccatttccgactgcgatgattgatacagcatttttcgaccgctttcatgcctatattcccggttgggaaatccccaaaatgcgcccggaattctttaccaaccgttacgggctgattacggattatctcgctgaatatatgcgcgaaatgcgcaaacgcagtttctctgatgcgattgataaattctttaagctgggtaacaacctcaaccagcgtgacgttattgccgttcgacgtaccgtgtcggggttgttaaaactcatgcatcccgatggcgcgtacagcaaagaagatgtgcgagtctgcctgacctatgcgatggaagttcgccgccgcgtgaaagagcaacttaaaaaactgggcggtctggagttcttcgatgtgaactttagctacatcgacaacgaaacgctggaagagttttttgtgagcgtaccggaacagggcggcagcgaacttattcctgccggaatgccaaagccgggtgttgtgcatctggtcactcaggcagaaagcggcatgaccgggctgtatcgttttgaaacacagatgactgccggtaatggtaagcatagtgtatcgggtctgggttcaaatacctccgcgaaagaagctatccgcgtcggtttcgattacttcaaaggcaatttgaatcgggtaagcgcggccgcgaaattctccgatcatgaatatcaccttcatgtcgttgaactgcataatactggcccaagcaccgcaaccagtcttgctgcgcttatcgctttatgttcgatattgctggcaaaaccggtgcaggaacagatggtggtgttgggcagtatgacgcttggtggggtaattaacccggtgcaggatcttgccgccagtttgcagctcgccttcgacagcggtgcaaaacgggttctgttgccgatgtcctcggctatggatattccaacggttccggcagagttatttaccaagtttcaggtgagtttttactcagacccggttgatgctgtttataaggcgctgggtgtgaattaa

SEQ ID NO: 3765 - DNA, 2085 bp, Salmonella enterica
atgcaaacccatcatgacttacccgttccagccgtatccgaaggggaactcgtcgcagaaggttacgatctggacgccttgctgaatcagcattttcgtggtcgggtagtacgtaaagacctaactaaacagctcaaggaaggggctaacgtcccggtctatgtgctggagtatctgctcggtatgtactgcgcttccgacgatgaccagatcgtcgagcaagggttgcagaacgttaagcgcattctggctgataactacgtccgccctgatgaagcggagaaggtgaaatcgctcattcgtgagcgaggatcctacaagatcattgataaagtatcggtaaagctcaatcagaagaaagacgtttacgaagcccagctctccaacctcggcattaaagatgcactggtgctgccgcagatggtcaaggacaacgagaagctgttgaccggcggcatctggtgcatgatcaccgtgaactacttctttgaggaagggcaaaaaacatcgcccttctcgctgatgacgcttaaacctatccagatgcccaatatggacatggaagaggtatttaccgcacgcacgcacttcagccgcgaccagtggattgatgtcctgctacgctccgtgggtatggaacctgccaacattgagcagcgaaccaagtggcacctgatcacccgcatgatccctttcgtggaaaacaactataacgtctgcgaactgggcccacgcggcaccggtaaaagccacgtctataaagaatgttcgccaaactcactgttagtttccggcgggcaaaccacggtagctaacctgttttacaacatggccagccgccagattggcctggttggcatgtgggatgtcgtcgcgtttgatgaggtggcggggatcacttttaaagacaaagacggcgtgcaaatcatgaaagattacatggcgtctggctcgttttcccgcggcagagattcgattgaaggcaaagcatcgatggtgttcgtcggcaacatcaatcaaagcgtagagacattagtcaaaaccagccatctgttagctcccttccctgccgcgatgatcgacacggcatttttcgaccgcttccatgcctatatccccggctgggaaatcccgaaaatgcgcccggaattctttaccaatcgctatggccttatcacggattatctcgccgaatacatgcgggaaatgcgcaaacgcagcttctccgatgcgattgataaattctataagctgggtaataacctcaaccagcgagatgttatcgcggtaaggcgcacggtttctggtctattgaaacttcttcatcccaatggttcttacagtaaagaagatgtccgtgtttgcctgacctacgccatggaagcccgtcgtagagtcaaagaacagcttaaaaagctgggcggactggaattcttcgatgtgaattttagttacatcgataatgagacgctggaagaattcttcgtcagcgtgccggaacagggtggcagcgaattaattcctgctggcatgccaaagccaggcgtagtgcatttagtgacgcaagcggaaagtggcatgacgggtctgtatcgcttcgaaactcagatgaccgcaggcaatggtaagcatagcgtttccggtctgggatcaagtacctcggctaaggaagccatccgggttggatttgactatttcaaaggcaacctcagccgcgttagcgcaacagcgaaattttctgaacatgagtaccacctgcacgtagtcgaattgcacaataccggaccaagcaccgcgaccagtcttgccgcgctgattgcgctgtgttccgtattactggcgaaacccgttcaggaacaaatggtcgtgttaggtagcatgacgctcggtggagtgatcaacccagttcaggatctggcggctagcttacaacttgctttcgatagtggcgcgaaaaaggtccttttgccgatgtcttccgcggtagatattccgactgtgccagccgagttgtttaccaaattccaggtcagtttttactctgaacctgtggatgcggtttataaggcgttgggagtaaactaa

SEQ ID NO: 3766 - DNA, 2076 bp, Pectobacterium wasabiae
atgcaacagcaggacaactcggctaataacatggagatggcctctgcgttggctcaagacctggattcattgttgaatcagcactttcgcggtcgcgtggtgcgtaaagacctgacgaagcaacttaaagaaggggccaatgttccggtctatgttctggaatatttgctcggtatgtactgtgcatccgatgacgatgaggttgtcgagcagggactacagtcggttaagcgcattctttctgataactacgtccgcccggatgaagcggaaaaagtaaaatcgctgattcgtgaacgtggctcttacaaaattatcgataaggtcacggtaaagttaaaccagaagaaagacgtttacgaagcccagctctctaacctcggcattaaagatgccttggtaccgtcgcagatggtgaaagataacgagaaactgctgacaggtggtatctggtgcatgatcaccgtgaactacttttatgaggaagggcaaaaaacgtcacctttttcactgttcacactgaagccaatccagatgccaaacatggacatggatgaggtgtttgaggcacgtaagcagtttgatcgtgaccagtggattgatgtgttgttgcgttctgtagggatggaacccgcgaatattgaacagcgtaccaagtggcatctgattactcgcatgattccctttgtggaaaacaactataacgtctgcgagcttgggccacgtggtaccggtaaaagccatgtttataaagagtgctctcctaactcgctgctagtttctggtgggcagactactgtggcaaacctgttttacaacatggccagccgccaggttggattggtggggatgtgggacgtagtcgcgttcgatgaagtggcagggattaccttcaaagacaaagacggcgtgcaaataatgaaagactacatggcgtcaggttcgttctctcgtggtcgcgactccattgaaggtaaagcctccatggtgtttgttggtaacatcaatcagagcgtggatacgcttgtgaaaaccagccacctgcttgcaccgttcccagatgcgatgattgatactgcatttttcgatcgtttccatgcctatattcccggttgggaaattcctaaaatgcgtccggaatttttcactaaccgctatggtttgatcactgattatctcgctgaatacatgcgcgaaatgcgtaaacgtagtttctccgatgcaattgataagttcttcaagctgggaaataacctcaatcaacgtgacgttattgccgtacgccgcactgtctccggtctgttgaagctaatgcacccagacggtgcttacgacaaagaagatgtgcgcgtgtgcctaacctatgcattggaagtccgtcgacgtgtgaaagaacagctcaagaagctcggcggccttgagttttttgatgtaaatttcagttatatcgataacgaaagtctggaagagtttttcgtcagtgtgccagaacaaggtggcagcgagttgatcccagcaggcatgtcaaagccaggtgtcgtgcatctggtcacacaggcagatttaggcatgacaggactttaccggttcgaaacacagatgacagccggtaacggaaaacatgcggtatcgggactgggttcaaacacgtcagcgaaagaagcaatccgtgtgggatttgactacttcaaaggcaacctgagccgcatcagcgctgcggccaaattctctgaacatgaataccatctacatgtcgtggaattgcatagcacaggccccagtataacaaccagtctggcagcattgattgccttctgctcagttttacttgcaaaaccagttcaagagcagatggtcgtgctgggcaatatgacattaggtggcgtgattaatccagtacaggatttggctgtatgcctacaggtggcattcgacagtggggctaaacgcgtgctgctccccatggcttctgcaatggatattccgaccgtgccgacagaattgtttactaagtttcaggtaagtttttacgcagatcctgtagatgcggtatataaggcgcttggtgtgagttga

SEQ ID NO: 3767 - DNA, 2085 bp, Escherichia coli; identical to SEQ ID NO: 3760

SEQ ID NO: 3768 - DNA, 2070 bp, Ruminococcaceae bacterium
atgagcgagtttattgaaacggtatcacaagaggatgcaaatgccgtaatcgacagcaaactgcgcaaggtgttcgacggcaggattgtccgcaaagacctcacaaagaaaatcaaggaaggggcaaatgtccccgtttatgtccttgagtttcttcttggacagtattgcagttccgatgacgaggatgtcattgaaaccggggttgcaaacgtcaagcggattctggctgaaaactacgtccgtcccgacgaggcgcagaagatcctttctgtcctccgtcagcgaggcagctataccgtgattgacaaaatcacggtgaatctcaacattaagacggacagctatgaggctgagttttccaatcttggaatcaaagctattcctatctctgaggattacccgactaaatacgaccggcttctctgcggcggtatctggtgcattgtccagcttgaatatgaatatgtggaagaggataagcgcagatccccaatactcattcataagctcacgcctattcagatgcctcatgtggacattgaggaattgaagcaggggcgaaaagcgtttacgcaagaagaatggatcaagatcctacttcgctccatcggtatggaaccggacaagttgaacgaccgcgaacgctggcttctgcttgcccgtatgctgccgcttgtcgagaacaacttcaacctctgtgagttaggtccgcgaagcactggtaaatcccatatctacaaggaaatctccccgaacagcatccttgtttccggcggtcagaccaccgtcgcgaacctgttttacaacatgggcagaaaaaccgtgggcttggttggcttgtgggactgcgtagcgtttgacgaggttgccggtatcaactttaaggacaaagacggcatccagatcatgaaggactatatggcgtccggctcctttgcccgtggcaaggaagaaaaagccgcaaccgcttctatggtcttcgtcggcaacatcaatcagagcgtggatgtgctgctgaaaacgtccagtctctttgacccattccctcccgaaatgggaacggacacggcatttctcgaccgtatgcactgctacatccccggctgggagataccgaagttccgccccgaacatttcaccaatgactacggattcatcaccgactatctggcagagtttatccgggagcttcgcaaggagcagtacggcgatgcgctggacaagtatttccgcctcggcaaaaaccttaatcagcgcgataccattgccgtccgcaagatggtcggcggaatgatcaagttgctctatccggacggggagttcacgaaagaacagcttgaagaaatcctcaagtttgcgctcgaaatgcgccgccgcgtcaaggaacagctcaaaaagctgggcggtatggagttctatgacgtcaatttttcgtacattgacaacgatacctttgaggaacatttcgtgtctgtcccggaacagggcggcggaaaactcatccccgaaggaatgtgcaatcccggtcaggtctatacggtttctcagggaaagagcggtatgatcggcgtcttccgtctggaatcgcagatgcttcccggcaacggcaagtttgagcggacaggactgaactctgacggaaagtgcaaggaagcggcaaataccgcattcaactatctgaaagcgaacggcaaccgcatcagcggcacgattagcacaacaacaaaggactatatcatcaactatcaggatttgcagggcatcggcatgaccgagaaacttgcgcttcccacgctgattgcactctgctcgattgcgcttgggaaaccgaccctcagcagtctggcggtgctgggcgagatcagcattgccggaaccatgctcaaggtggacgagcttgcaaatgcccttcaggtctgcctcgatagcggtgcaaagaaggtgcttcttcccattacctctgcggctgacctcggaacagctcccgccgatctaatcggctgcttcaacctgattttctatcagagtgcggaagacgctgtttataaagcattgggcgttgagtga

SEQ ID NO: 3769 - DNA, 2040 bp, Holophaga foetida
atgacttctgaaaccgatacgagccttgaccacctcctgaaccagagcttcgggggccgcgtcgtccgcaaggacctcaccaagcggcttaaggagggggccaatgtgcccgtgtatgtcctggagtacttgctggggagccactgcgcctcggatgacgaggcggtgatcgaagacggcatgcagtccgtcaagaagatcctggcggagaactacgtgcgccccgacgaggcggagaaggtgaagtccaagatccgggagcggggcagcatgaaggtcatcgacaaggtgacagtggtgctcaacgagaagcgggatgtctacgaggccttcctttccaacctgggcaccaagggtgtcgaggttccctccggactggtaaagaagttcgagaagctcctggcggggggcatctggtgcatcgtcaccctggactacctctacgaggagggccagaagagctcccccttcgttctccaggatctaaagcccatccagatgcccaacatggacatggaggccttcctggaggggcgcaaggccttcaccgagtcccagtggatcgatgtgctgatccgctccacaggcatggaacccacccatttcacggagcgggtgaagtggcacctgctggcccggatgatccccctggtggagaacaactacaacgtttgtgaactggggccgcgaggcacgggcaagagtcatatctacaaggaaatcagtcccaatagcatcctgatcagcggtggccagaccacggttgcgaatctgttctacaacatggcccgcaggaccgtgggactagtgggcctgtgggataccgtggcctttgacgaggtggcgggcatctccttcaaggagaaggatggtgtccagatcatgaaggactacatggcctccggctccttcgcccggggcaaggacgccgtggcggcctacgcctccatggtcttcgtgggaaacatcaaccagtccgtggacaccctggtgaagaccagccacctactggcgcctttcccggaggccatgatcgactcggccttctttgaccgcttccacacctacatccccggctgggagatcccgaagatgcgtccggagttcttcacgaaccaatacggcctgattacggactacctggcagagttcatgcgggagatgcgcaagcgcaatttcgccgatgccatcggtaagcactttaagctggggcgggatctgaatcagcgggataccatcgcggtgaaacacacggtgtcgggcctgctgaagctgctctacccggcggaggactattccaaggaagcggttcagaagtgtctggaatacgccctggaaggtcgtcgccgggtgaaggagcagctcaagaagatcggcggcatggagttcttcgatgtccatttcagctacctggatctggaggctggggaagagcactacatcagtgttctggaacaaggcggcggatcgctgatcccggatgggcctttgagccctggctgcctgcataccgtggcgaacgggagcagcgggcacctcgggctctatcggatcgagacccaggtgacctcaggttccggcgccctgaagacatcagggctcggatccaacggagccgcgaaggaggccgtgaaggttggcttcgactacttcaaggcccacgcgggccacatcagcgcctcggccaaggctggggaccatgactaccatctccacttcgtagagctgcacaacaccggccccacggaatccatgaccctggcctcattcgttgccctctgctccggtatcctggccaagcccatccagtctcagatggtggttctcggcagcatgagcctggggggcaacatcatccccgtggagaacctcgcggagaccctacaggtcgccttcgacgcaggcgccaagcggatcctcatccccatgtccagcgtgagggatatccccaccatccccggagagctgtttgccaagttccagaccgccttctacgcggatccgcaggatgcggtgtttaaggcgttgggggtgcagtag

SEQ ID NO: 3770 - DNA, 2085 bp, Escherichia coli; identical to SEQ ID NO: 3760

SEQ ID NO: 3771 - DNA, 2061 bp, Oribacterium sp.
gtgtcggaatttttagagacagatgataaaagaattgtactaaaaaacaagcttcgtcagtattttgatggaaagattgtgagaaaggatctgacaaagaagatcaaagaaggagcgaatgtgcctgtctatgtattggagtttctactcggacagtattgcagctctgatgatccgggagtgattgaagaaggcgttgagaatgtgaagagaattcttgccgataatttcgtgcgtccggatgaggttcagaaaattctttccgtcctccgtcagcgcggtagtcatactgtgattgatatgattacagtgaatttggatattaagcatgactgctatgtttctgatttttcgaatcttggtctcaaaggaattcccattgatgaggaataccctacaaaatatgacagactcctctgtggcggtatctggtgtatcgtacagctggattatgagtttgtagaggaagagaagaaaggaactccgattcatatccgaaagttgacgccgattcagatgccacatgtggatatcgatgaactgaaacttggccgaaaagcatttaccaaggatgagtggattgaagtcttgcttcgctccattggcatggagcctgacgagctccaatatcgggaaaagtggctgctcctcacaagaatgctacccttgattgaaaataactttaatctttgtgagcttggcccgagaagtaccggtaaatcccatctattcaaggaaatatccccgaatagtattctggtttccggtggacagacaacagtggcaaatctgttttataacatgtctaggaagcaggtggggcttgttggtctctgggattgtgtggcatttgatgaagtggccggcatccgattcaaagataaagatggcgtgcagatcatgaaggattatatggcatccggctcttttgctcgtggaaaagaggagaaggcagcctctgcttctatggtatttgtcggcaatatcaatcagagtgtagacgtccttctaaagaccagcagtttgtttgatccatttccaccagaaatgggcacagatacggcatttctagatcgtatgcactgctacattcctggatgggaaattccgaagtttcgtccggaacacttcacggatcattatggctttattacggactatctgtcagaatttctccgtgagcttcggaaagagcagtacggagatgctctggacaagtatttccgcttgggaaagaacttaaaccagcgagatactattgcagttcggaaaatggtggatgcttatgtgaaacttctttatccagatggcatatttgacaaagaacaaatcgaagagattctgtctattgctcttgaaatgcgccgtcgtgtgaaggagcaactgaaaaagcttggagggatggagttctatgatgtgaatttctcatacatcgataatgagacatttgaggagcactatggctctgttccggaacaaggagggggaaagctgattcctgacggcacgtgtaatcctgggcaggtttatacgatatctcatggaaaatctggaatgcttggagtgtttcgccttgagtctcagatgctgttgggaaatggaaagtttgaccgcacaggtcttggctcagatcgggaatgccgagaagcttccaacacagccttcagctttttaaaagcaaatgggaaccggatcagtgctagtataagcacaaacactaaggattatattgtaaattatcaggatttacagggtattggaatgaccaataagcttgcactccctacattgattgcgctcagctccatcgccctaaacaaacaaacgataagttctctggcagtgctgggagaaatcagcatcagtggaactatcatcaaggtggatgaacttgctaatgcactgcaagtttgtttggattctggcgcaaaaaaagtactactaccaataacctcggcaggagatttgggtgcagttcccgcagaacttgtcggatgctttaatctaattttctataatagcgctgaagatgcggtgtataaggcgttgggggttgagtag

SEQ ID NO: 3772 - DNA, 2085 bp, Escherichia coli
atgcaaacccatcatgatttacctgtttcaggcgtatccgcaggggaaattgcctccgagggttacgatctggacgccctgctgaaccagcattttgctggtcgtgtggtgcgtaaagatctcaccaagcaactcaaggaaggggcaaacgtcccggtgtatgtgctggagtatctgctcggcatgtactgcgcctctgacgatgacgacgtggtcgagcaagggttgcaaaacgttaagcgtattctggctgataactatgtgcgcccggatgaagcagagaaagtgaagtcgctgatccgcgagcgtggttcgtacaaaatcatcgataaagtgtcggtgaaactgaaccagaaaaaagacgtttacgaagcccagctttctaacctcggcatcaaagacgcgctggtgccctcgcagatggttaaagacaacgagaagctactgacgggcggtatctggtgcatgattaccgtcaactatttctttgaagaagggcagaagacctcacccttctcattgatgacgcttaagcctatccagatgccgaatatggatatggaagaagtattcgatgcgcgtaaacactttaaccgtgaccagtggatcgatgtgctgctgcgctcggtgggtatggagcccgccaatattgagcaacgcaccaaatggcaccttatcacccgtatgatcccgttcgtggagaacaactataacgtttgcgagctggggccgcgcggcaccggtaaaagccatgtgtataaagagtgttctcctaactccctgttagtttccggcgggcaaacgaccgttgccaacctgttctacaacatggccagtcgccagatcggtctggttggcatgtgggatgtggtagcattcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagacgctcgttaaaaccagccatttgctggcgccatttccggctgcgatgattgataccgcctttttcgaccgctttcatgcctatattcccggttgggaaatccccaaaatgcgcccggaattctttaccaaccgttacgggctgattacggattatctcgctgaatatatgcgcgaaatgcgcaaacgcagtttctctgatgcgattgataaattctttaagctgggtaataaccttaaccagcgtgacgtcattgctgttcgacgtaccgtgtcgggattgttaaaactcatgcatcccgatggcgcgtacagcaaagaagatgtgcgagtctgcctgacctatgcgatggaagttcgtcgccgggtgaaagagcaacttaaaaaactgggcggtctggagttcttcgatgtgaactttagctacatcgataacgaaacgctggaagagttttttgtgagcgtaccggaacagggcggcagcgaacttattcctgccggaatgccaaagccgggcgttgtgcatctggtcactcaggcagaaagcggcatgaccgggttgtatcgctttgaaacgcagatgactgccggtaatggtaagcatagtgtatcgggtctgggttcaaatacctccgcgaaagaagctatccgcgtcggtttcgattacttcaaaggcaatttgaatcgggtaagcgcggccgcgaaattctccgatcatgaatatcaccttcatgtcgttgaactgcataatactggcccaagcaccgcaaccagtcttgctgcgcttatcgctttatgttcgatattgctggcaaaaccagtgcaggaacagatggtggtgttgggcagtatgacgcttggtggagtaattaacccggtgcaggatcttgccgccagtttacagctcgccttcgacagcggcgcaaaacgagttctgttgccgatgtcctcggctatggatattccaacggttccggcagagttatttaccaagtttcaggtgagtttttactcagacccggttgatgcggtttataaggcgctgggtgtgaattaa

SEQ ID NO: 3773 - DNA, 2040 bp, Acinetobacter johnsonii
atggaatctgctaacgataaagaactggatcagctgctgaatgaacactttgctgggcgggtggtacgtaaggatctgactaaactgatcaaagaaggggccaatgtcccggtctatgtactcgaatacctgctagggatgtactgtgcctcggatgatccagagatcatagagcagggactacgtaacgtaaagaccgtgctggcagagaactatgtacgacctgatgaagctgagaaggtgaaatccctggttcgtgagcgtggcagttataaggtcattgatcgggtgactgtaaagctgaatgagcgtaaagacaaatacgaagcatcatttagtaatctgggcatcaaagatgccgaaatctcggcaggcatcgtcaaagagtatgaaaaattacttgttggtggtatctgggtcattgctacgctcagttattattttgaagaaggacagactagttctccatttggggtgagtttactcaagccgattcaaatgccgaatatgaatatggaggagctgttcaacggacgagcagcattaagcacggatcagtggcgcgagagtttaatccgttccatcggcatggaaccggcttcgttaaaagaggacgtgcaatggcacctattagcgcgtatggttccgttcgttgaaaataactataacgtctgtgaactgggaccacgcggtaccgggaaaagccatatttacaaagagtgttcaccaaatagtattttagtctccggtgggcaaacgactgtcgccaacctgttctataacatgagtagccgccgtattggtctggttggcttatgggatgtggtagcttttgatgaagtcgccggtatttcctttaaggacaaagatggcgtacagatcatgaaagactacatggcctcaggatcttttgcccgtggtcgtgaacagatggaagcctcagcttcgatggtttttgtgggtaatatcaaccaaagcgtggaatccctggtcaaaaccagccatctattggcacctttcccggaagccatgattgattcggcattcttcgatcgttttcatgcttacatccccggctgggaaattcccaagatgcgcccggagttcttcaccaaccgttatggtctaatcgttgattatctggctgaattcttccgggaaatgcgcaagcgtagctttgcagattccattgagaagtacttcaaactcggaaataaccttaatcagcgcgatgtgattgccgttcgcaagacggtttctggattgatgaagctgctttacccacacggtcagtttaataaagaagatgtacgccaatgtctggaatatgcgctgcaggtacgccgtcgggtcaaagagcagctgaaaaaaattggtggcatggaattctatgatgtgcatttcagctatatcgataatgataccttagaagaacattttgtttcagtcaaagagcagggtggagttggacttattcccgaaggtccagccaagccaggtttcttatataccattggccttagtaataagggcatgccaggcttataccgcttagaacttcaagtcactaaaggttcaggaaagttggcgacatctggcttatggaattcaagcagtgccaaagaacaggtcaagattgcttttgattacttcaaggccaacgcctctcggatctcggggggcagtaaggtactggaacatgacttccacttacatgtggtggagttacagaataccggcccgctcagccatcttgctctgccaagtttagtggctttcgcttctggcctcttaggacgatcggttcaaagtcagatggtggtactgggtgatatgagcttgggtggttctgtgacaccggtggaaagtattgccgaatgtctgcaagttgcttttgatgcgggtgccaagaaggttgctttgccaatgagtagtgcggcagatatcccaacgattcctgtggaactgtttaccaagttccagaccagcttctatgcagatccggtagatgcggtgtttaaagggctaggggtggattaa

SEQ ID NO: 3774 - DNA, 2040 bp, Acinetobacter junii
atggaatctgctaacgataaagaactggatcagctgctgaatgaacactttgccgggcgggtggtacgtaaggatctgactaaactgatcaaagaaggggccaatgtccctgtctatgtactcgaatacctgctagggatgtactgtgcctcggatgatccagagatcattgaacagggattacgtaacgtaaagaccgtactggctgagaactacgtccgaccggatgaagctgagaaggtgaaatccctggtccgtgaacggggcagttataaggtcattgatcgggtgaccgtaaagctgaatgagcgtaaggacaaatacgaagcatcatttagtaatctgggtatcaaagatgccgaaatctcggcaggcatcgtcaaagagtatgaaaaattacttgttggtggtatctgggtcattgctacgctcagttactattttgaagaaggacaaaccaattctccatttggggtgagtttactcaagccgattcaaatgccgaatatgaatatggatgaacttttcagtggcagagcagcattaagcacggatcagtggcgcgagagtttaatccgttcgatcggcatggaaccggcttcgctaaaagaggatgtgcaatggcacctattagcgcgtatggttccgttcgttgaaaataactataacgtctgtgaacttggaccacgcggtaccgggaaaagccatatttacaaagagtgttcaccgaacagtattttagtctcgggtgggcaaacgactgtcgccaatctgttctataacatgagtagccgccgtattggtctggtggggttgtgggatgtggtggcctttgatgaagttgccggtatttcctttaaggacaaagatggcgttcagatcatgaaagactacatggcatcgggatcttttgcccgtggccgggaacagatggaagcatctgcttcaatggtttttgtgggtaatattaaccaaagcgtcgaatcgttggtaaaaaccagccatctcttggcacctttccctgaagccatgatcgattcggcattcttcgatcgttttcatgcctatattccaggttgggaaattccaaaaatgcgtccggaattctttaccaaccgttatggtctaatcgttgattatctggctgaattcttccgggaaatgcgtaagcgtagttttgcggatgccattgagaagtacttcaaactcggaaataacctgaatcagcgcgatgtgattgccgttcgcaagacggtttctggattgatgaagctgctctacccacacggtcagtttaataaagaagatgtacgcctgtgtctggaatatgcactgcaggtccgccgtcgcgtcaaagagcagctgaagaaaattggtggcatggaattctatgacgttcatttcagctatatcgataatgataccttagaagaacattttgtctcagtcaaagagcagggtggtggcggactgattccagatggtccagcgaaaccaggttttctgtataccatcggactcagtaataaaggcatgcctggcttgtatcgcttagagcttcaagtcaccaaaggctcaggtaagcttgcaacttcaggcctctggaactccagcagtgccaaagaacaagtcaagattgcctttgactacttcaaagcgaacgcctctagaatatcgggtggcagcaaagtcatggagcatgacttccatctgcatgtggtggaattacagaataccgggccacttagtcatctggctttgccgagtctagtcgcttttgcttcaggcttgctcggacggtcagtacagaatcagatggtggtcctgggagatatgagcctgggtggaaacgtcacaccggttgaaagtattgctgaatgtcttcaggttgcattcgatgccggagccaagaaagtcgctttaccgatgagcagtgcggcagatatcccaaccattccagttgaactatttactaagttccagaccagcttttatgcagatccggtagatgctgtgtttaaggggctaggggtggattaa

SEQ ID NO: 3775 - DNA, 2241 bp, Shewanella baltica
atgaatggcaacaatggtaaagatgtagctgaacatcaaatggaacaaggtgaatgggtaggtgctgatactaccaactcctcttttatccagaatgtttatgtcgcgaatatgcaggtaaatttatcaactacagcagatggcgctgcagaagaacataccgctgaacatacacggcaatcgctagcgtctgaacaggagattgccgatttaaggagtactgatctcgatagtctacttaatcgtttttttaagggcaaagtggttcgtaaagacttaactaagcagttaaaagaaggcgctaatgtgccggtttatgtgctggaatatttgcttgggatgtattgcgcctcagacgacgatgaggtggtgctcgagggactggaaaacgttaagaagatcttggcggaaaactatgtgcgccccgacgaggctgaaaagattaaatcgctgatccgtgagcgtggtagcttcaaagtgatcgataaagtcggggttaagctcaaccagaagaaggatgtgtatgaagcgcagctttctaaccttggcatcaaggatgcggtgatccctgctagcatagttaagcaaaacgagaagctgttgatgggggggatatggtgcatcattaccctcaactatttttatgaagaaggccaaaaaacctcacctttttcagtttccatgctcaagcccattcaaatgccttctatggatatggaggagctgtttgtcgctcgcgctaatttttcaaccgatcagtggttagatgtactcattcgctcaataggcatggagcctaccaaccttaagcaacgtgttaagtggcatttgctcgctcgcatgatcccctttgttgaaaataactataacgtgtgtgagcttgggcctcgtggtacagggaagagccatgtgtataaggaatgctcccctaattctttgctggtatccggcggtcaaaccacagttgctaacctgttttacaatatgagttcgcgccaagtgggcttagtgggcatgtgggatgtggtggcctttgatgaggtggcgggcataactttcaaagataaagatggcgtgcagatcatgaaggattacatggcgtcaggttcattctcccgtggccgtgattcgattgaggctaaagcttctatggtgtttgtcggcaatattaaccagagcgtagaaactctggttaagaccagtcatctgttagcgccattccctgaggcaatgattgacactgccttttttgatcgcttccatgcctatattccgggatgggatattcctaaaatgcggccggaatttttcaccaatagctatgggttgattaccgattatcttgcggagtacatgcgcgaaatgcgtaaacgcagcttctccgatgctatcgatcgctattttaagctagggaataacttgaaccagcgcgatgtgatcgcggtgcgccgaacagtctctggtttgttgaagctgctgcatcctcatgatgtatttgacaaagaagatgttcgccgttgcctgacctatgccttagagttgcgtagacgcattaaagagcagttaaagaaactcggcggcatggagttttttgatgtgcattttagctaccttgataatcagacccttgaagagttctttgtgaatgtaccggaacaaggtggcagccagttgatccccgaaggccaaggtaaacccggtgtggtacatatggtgacgaaaggtgcaaccagtcagttggggctttatcgttttgaaactcagatgatgcctggcaatggtaagcactcgacttccggtcttggatctaatactccggcgaaagaggcgattagagttggttttgattacttcaagggaaacctgaatcggatcagcgccaccgctaagttttctgagcatgaatatcacctgcatgtggtcgagctgcataactctggcccaagcacaaaaaccagtttggcggcgctcgtcgcgttttgctccattctgatgggaaaaccagtacaagatcaaatggtggtactcggtgatatgacgctgggcggtgttgttaacccagttgaagacctcgcgggcagtttacagttggcaatggatagtggcggaaagcgagtattactgccaatggcctccgcctcagatattcctacggtgcctgcggagatattctcaaagtttcaaatcagcttttatgctgaccctgtggatgcggtgtataaagcattaggtgtgaattag

SEQ ID NO: 3776 - DNA, 2052 bp, Vibrio cholerae; identical to SEQ ID NO: 3740

SEQ ID NO: 3777 - DNA, 2085 bp, Escherichia coli; identical to SEQ ID NO: 3687

SEQ ID NO: 3778 - DNA, 2085 bp, Halomonas sp.
atggatttcgagccatcttccgctacgcaaatgactgattcgctccacgacgcagacttggacacgctgctcaatagccactttgctggccgagtggtgcgcaaggatctaactcagcgcgtgaaagagggcgccaacgtgccggtttacgtgctggagtacctgctgggtatgtactgcgcatctgatgatgcagaggtgattgcaaaaggcctggaaaacgtcaaagcgattttgacgaacaactacgttcggcctgatgaagcggagaaggtgaagtctattgttcgggaacggggcagcttcaaggtcattgatcgtgtcacggtgcgactgaacgagaagaaagaccgctatgaagcagcgtttagcaacttaggcatcaaagatgctgagatctccgcaggcatcgtcaaagagaacgaaaagctgctagtaggcggtatttgggtcatcgcaacgctaagttacttccatgaagaggggcagacaacatcaccattcggcgtcagcctgctcaagccgattcaaatgccgcacatgaatatggacgagctatttgaagggcggcgtgggttcaccaattcacaatggcgtgaagtactgatccgctcgattggcatggaacccgctgagctagacgagagcgtgcagtggcacttgctcgccaggatgatcccgtttgttgaaaacaactataacgtttgtgagctagggccacgcggcaccggcaaaagccatatctataaggagtgctcccccaacagtattctggtctccggcgggcagaccacggtggctaatttgttctacaacatgagctcacggcgcattggtttagtcggcatgtgggacttggtggcgttcgatgaagtagcgggtatctcgttcaaggataaggacggggtgcagatcatgaaagattatatggcgtccggttcatttgcccgtgggcgtgagcagatggaggcatcggcctcgatggtgtttataggcaacatcaatcagagcgttgagtcgatggtgaaaaccagccatctgttgacgccatttcccgatgcgatgattgatgcggcgttttttgatcgcttccatgcctacattcctggctgggaaatccccaagatgcggccatcgttctttacccagcgctatgggtttatcgtcgattatctggctgaatttttccgtgaaatgcgcaagcgcagtttcgccgatgcgattgatcgctacttttctctgggtgacaacctcaatcagcgtgatgtgatcgcggtgcgtaaaacggtttctggcctgctcaaactgatgttcccgcatggcggcggttcacaaggacttgcgaaagaagatgtgagggagtgcctggaatacgccatgcaagtgcgacgccgggtgaaagagcagctgaaaaaaattggaggtatggagttttacgatgtccatttcagttacatcgacaaggagaccctggaagagcactttgtgtcggtgaaagagcagggtggcggtggcttgattccagaaggccagggcaagccgggcgtcgtgcataccattggcctaagcgataaaggtatgccgggtgtttaccgcatcgaaatgcaggtaaccgcaggcagcggcaagctggcgatgtcggggctatggaactccaccgcagccaaagagcaggtcaaaatggcatttgattacttcaaggccaatgccagccgcatcagtggtgcccgtaaggtcatggagcatgatttccacctccatgtggtggaccttcaaaatagcggtgtcctgcgcgatttgtcgttagccagtttggtggcgttttcatcaggccttgtcagcaagccgacgcaaagccaaatggtggtgctaggcgatatgagcctgggcggaagtttaaaacccgttcaaaaccttgcagagtgcctgcaggtcgccttcgatgccggcggtaagcgagtcaccctgccgatgagcagcgccatggatattcccaccatccccggcgagctatttaccaaatttcagaccagcttctatgcagagccaatcgacgcagtcgtgaaggcgttgggagtggattaa

SEQ ID NO: 3779 - DNA, 2208 bp, Bifidobacterium angulatum
atgaatgagcagggtatgagccagaacggttggattgaaagtcctgaacacaacgcggatgggaattccctgagcgcgttggatgtcaagaccaccgacctgttccccggagtcaccgtccgcaaggatctggtgaacaaggtcaagggcaatgcgctggtgccctcatatgtgctggagttcctgctcagcgcatatgccacgaacaccgaccaggccagtatcgagtcgggtgtggatcgagtgcgtaccattcttgcaaacaactatgtgcatcgtgaggaagccaatcttatccagtcgaaaatccgcgagaaagggagccataggattatcgaccgtgtacaggtggcccttaacgagaagaccgacctgtatgaggcgacattctccaatctcggcatcagccaggtcattgtcgatccaagccttgtaaaggcctatccgaaactgctggtgacgggcatctggtgcatgtgtcagatcggttacgcatattccggcgacccgcgcgaagtaccatggcagttgctacagctcaagcctgtgcagatgtcgcgtgatgatcgcgaaaactacatgcagcaacgttcgcaattcaccgatagcgaatggatcgatctgctgatgcaatccattgggttcaatcccgatctattctccgaccgggcgaaactgctgcatctggtacgcatggtgccgtttgtggagcgaaactacaatctggttgaactcgggccgaaaggcaccggcaagtcgcacatctactcggaattctcaccgcacggcatgctcatatccggcggggaagtgacagtggccaaactgttcgtgaacaattccaacggacacttggggcttgtgggctattgggatacggtggcgttcgacgagttcgcaggcaaggccaagaaggccggccgggacttggtggacatcatgaagaactacatggccaacaagtcgttctcccgtggcgtcgagacgttccaaggcgaggcgagcatggcgttcgtaggcaacacctcgcataacgtgccgtacatgctgaagaattccgacctgttcgaggaactgccgaagcaataccatgatccggcatttctggatcgtattcacttctatctgccgggttgggagttcgaacagatccgttccgagatgttcaccagcggattcggattcgtggtcgactatctggcggagattctgcacaacctgcgcgatgccgattacagcgaccggttcgaaaagtatttcgaactgtcttccacactgtccacgcgagataaggatggtatcaaaaagacgttctccggattgatgaagcttatttacccgggcggcaatgcttctcctgaacagatggagccgttgctgcgttgtgccatcgagggccgcaagcgtgtcaaggatcagctgtgccgcatcgactccaccatggaggaagtcgagttcacatacaagcgtgcgagcgacggtgaagtagtcgccgtgcagaccttggaagagcttgactacccgcagttgtattggcgtgggcgtgtagctgagaattcagaagataagggcgaggcggaagcgcctgttgccgatgatgccgtggcaattgagggtaacgagggagaagctggtgcttctgagaacgccaatgccttgcccgtagcgcggcagcaagaaacagctgcgatgactccagtcgagcgccttgcggcaaaggccgacggaaagcagtgggaattggtcgaaaaccaacgtggaatcacgtattacaaactgttcgggccatatttggctggtgcgaagaaaatcgttgtagaggatgcgtatgtgcgtaagccgtaccagctgcgtaatctggccgagttcttggaaatgctgctcagatgcaaaaaatccgatgaggatgtagccgttcatctggtgaccggacataatgatcctggattcgtggaagcgcagttaaatggtttgaacgaattggcatcgacgttctcacagctgggcgtgaacctcacctacgaattcagagacactttgcacgaccgttccattacttcggataccggatgggagattcttcccggccgggggcttgacatcttccaaaaattcgttgacggcgattggcttaacccgctgctgcgccatcagcagctccgccgcgtcaaggaatgcaaggtcacgtataggcgaattgaacgatag

SEQ ID NO: 3780 - DNA, 2052 bp, Vibrio cholerae; identical to SEQ ID NO: 3740

SEQ ID NO: 3781 - DNA, 2052 bp, Alcanivorax pacificus
atgagtacgcttgaccaaaagatcaacgaacacttccccgggttggtggtgcgcaaagacctggtgaaaacggtcaagggcaacgccatcgtcccctcctatgtgctggagtatctgctcggccagtactgcgccactaacgacgaggctacgattcagaccggtatcgagacggtcaaggagattctggccaagcactatgtccaccgcaacgaggccgggctggtgcgctcgaatatcaaggaaaaggggcgctacaaggtcatcgataagatcagcgtggccctgaatgagaagacggatgcctacgaggcgcagttttccaacctgggaatcaagaaagtgttggtggattctgggaccgtgaaggcccaccccaaactgctggtaagcggcgtctggtgcatcgcggacatcgaatacgtattttctgaagaccagaacgtcagcccctggattctgtccaccctcaagccgattcaactttcgcacttcgattacgatgcctacgttgccgcgcggcagcagttcagcaccgatgagtggattgacctgctgatacagagcatcggctttaacccggagatgttcggacggcgcagcaagctgacgcagctggtccgtttgattccgttctgcgagcggaactacaacctgattgaacttggccccaaggggacgggtaagtcccatgtttactcagagttctcgccccacggaattctggtatccggtggtgaagtcaccgtacccaagctgtttgtgaacaactccagcggcaagattggcctggtgggctactgggattgcgtggccttcgacgagtttgccggcaagcagaaacgcgtcgataaagcactggtcgacatcatgaagaactacatggccaacaagtccttctcccggggcgtggaaaccctgggtgctggggcgtccatggtgttcgtggggaacacccggcataccgttccttacatgctgaagcattcggacctgttcgatgagttgccggacaagttctacgattctgccttcttggaccggatccacttctacatccccgggtgggaggtcgacatcatccggggcgagatgttctccgacggctatggcttcgtggtggactaccttgcagaaatcctgcgctcgatgcgaaactatgattattccgatcagtaccgggagtactttaccctttcttcggatatctcgacccgtgaccgggacggtatcaataagaccttttccggcttgatgaagatcctgttcccccagggcggagcaaccagggatgaggttgaagaagtgttgcgtttcgccatcgaggggcgcaagcgggtcaaggaccagttacagcggattgataccacctacggcgaagtccgattttcctatcaggatcaacaaggccaggaaatactggtcacgacacttgaggaagaagagtacccgggttactaccatcagacagtgtctactcctgatgaggggggattagagaccgagccagcagcagacgttaaaggtggcgagcccaaagcgccccgcgcctctgaacccgtactggaggaaaagcacctgaccttccaggaaaatcaaaaaggcatctcattcgacggtttgtttggcgcatacctgaaaggagccagcaagatcaccgttacagatccctacatccggcttttctaccagatccgtaatttcatggagtttctcgaagccgtcgtaaagaataaggcagaggaggatgaagtggcggttcacctcatcaccgtccgggacgagttcaagggtgatctgcaagacgagagttttgaaaaaatccaggcatccgctcgcaccgtgggcatcgacttcacttgggagtttgacgacagcgggaccattcatgcccgtcatatcgttacagaccacggctggaagatttcactggatcgggggttggacatcttccagcactacgagatgaatgaggccttcgcgtttgccaacaggttgcagcagtttcgatcgagcaaagccttcgaggtgacatttatcaagcagtcataa

SEQ ID NO: 3782 - DNA, 2052 bp, Vibrio cholerae; identical to SEQ ID NO: 3740

SEQ ID NO: 3783 - DNA, 2052 bp, Vibrio cholerae; identical to SEQ ID NO: 3740

SEQ ID NO: 3784 - DNA, 2064 bp, Gamma proteobacterium
atgacggatctaaacgcaaaaattaacgacatcttccccggccttgtggttcgcaaggatctggtgaagaccgtaaaagggaacgccattgttccgtcctacgtccttgagtatctgctggggcagtattgcgcgacaaacgacgaagatagcattcagagtggcatccagacggttaaagagatcctcgccaagcactacgttcatcgtaacgaggcggggctggtacggtccactatccgtgagaaggggcgctacaaggtcattgataaggtgactgtggcactgaatgataaaaaggactgctacgagaccgagttttctaacctcgggatcaaaaaggtcttaattgattccggcacggttaaaaaacaccccaaactcttagtcggtggtgtctgggttattgcggatatcgagtacgagcatacggaagacaaggatgcggtgccttggatcttgggcactctaaaaccgattcagatgtcgcacttcgactacgaaggctaccttgaagcccgcaagcagttcacgctggatgagtggattgatgtgttggtacagagtatcggctttaacccggagtacttcggtgagcgcagtaaactcacccaactggtgcgactcattccgttttgtgagcgcaactacaacctgattgaacttggcccaaaaggaacgggtaaatctcatatctattctgagttctcaccccacggcattctgatttcaggtggcgaggttacggtacccaagctgttcgtaaacaactcaagcggcaagatcggcttggtcggctattgggataccgtcgcattcgatgagttcgcaggtaaagagaagaaggtcgacaaagcgctggtcgacatcatgaagaactacatggcgaacaagtcgttctctcgtggtgttgaaacgcttggtgccgatgcgtcgatggcgtttgtcggtaacactgaacatagcctagcttacatgctcaagcactctgacctattcgacgcgctacccgcaaaattctacgactccgcgttcttagaccgtctgcatttctatattcccggctgggaagtggacatcatccgtggcgagatgttctcaagcggctacggctttgttgttgactatcttgctgaggtgctgcgccacctccgcaaccaagactactcagaccaatacaaagggatatttgagctcgacccctctctctcgacccgtgatagagacggtatcaataagactttctcaggcctgatgaagatactcttcccgcagggcggggctacccatgaagagatagagaagattctcaaactcgcgatggaaggccgcaaacgcgttaaagatcagttgatgcgcatcgacactacctacgcttcagttaaattcaattacagcgatgaggcaggtaagcaggcttcggtttctaccttagaagaactgcaataccctaaatacttccaccatgaggtcgaggtggataccggtgagttacctgaaccaatacccgcgaataacgcatcaccgtcaacgccgagcgcgcctgtcgcgcctcaaagcgcaaagcctgagttaaaagagcaacacatcgtggtgatggagaatcagcgcggcgtcagttacgagcagctttttgggccgtatcttaaaggtgctacccatatcaccataacagatccatatattcgattgttctaccaggcgcgcaatctgatggagcttttagaatccgtcgtgaaagccaagtctgaagaggatgaagtggtagtaagcctgatcactgtcgaggacgagttcaaaggcgaacaacaacgtgaatggttgagccagattcagagttcgatgctcacggtcggcatcaaattcgccttctcatttgataactcagggaggcaacacgctcgccatatcgtgacggataccggctggaaaatctctttggaccgcggactcgatatcttccaacagtacgatatgaatgatgccttccagctgacaaaccgactgcaatcccagcggccatgtaaggcatttgaagtgacctatattcgagtgggagagtaa

SEQ ID NO: 3785 - DNA, 2085 bp, Escherichia coli; identical to SEQ ID NO: 3684

SEQ ID NO: 3786 - DNA, 2034 bp, Enterococcus faecalis
gtggatcaagttatattagataaattggtggcaaactttcctggaaagattgtccgtaaagatttaactaaaaaaataaaagaaggagcaaatgttccagtatatgtgcttgaatatttgcttggtatgtatgcatcttctttagatgaaaatttagttataaaaggtgttgaaaatgtaaaaaatattttggttcgaaattatgttcgtccagatgaagccgaaaaagtaaaagcaaaaattcgagagaatggtggctatacagtcattgataaagtatcggtatcattaaatgaacggcgagatcagtatgaagctgaattttctaatttaggactttctggcgtacgtattggtgatgaatatcccaaaaaatatgatcgacttcttggtggtgggatttggtgcatcgttcagatggaatattggtatgatgaaacggatcaaagaaattcaccatttattgcaaaaaaagttgatcctattcaaatgcctggtttggatattgaagaagttaggcgtggtcgtgctgcatttacagagaaggaatggattgatgttgttcttcgatcggttggaatggagcctacacgatttactgaacgtgtaaaatggttacatttggctcgccttgtcccgttgatagaaaataattttaacttatgtgaattagggccacgcggtacaggaaaatcgcatgtttataaagaaatctcgcctaactctattttagtttctggtggacaaactactgttgcgaatttattttataatatggctcaaagatctatgggattagttggtatgtgggatacggtggcttttgacgaggtagcaggtattaacgtgaaagatggagatttagttcaaataatgaaggattacatggcttcaggctcatttgctcgtggtaaagaagaaaaaaatgcatctgcatcgatggtatttgtaggaaatatcaatcaaagtgtagatgttatcttaaaaacttcaaatttatttgaacctttcccagaaaaaatgcgatctgattcagcatttttagatcgtatgcattgttacttaccaggatgggaaattcctaaataccggccagatttttttacgaatgattatggttttataacagattactattcagaagtaatgcgagaattacgtaagacaacttatagtgatgcaattgataactattttaagctaggttcacaactaaatcaacgtgatactattgctgttaaaaagatgttttctggacttatcaaactagtatatcctcatggggaatttggaaaagaagaagtagaaaaagtacttaaattttctattgaaatgagacgaagagtgaaagaacagcttaaaaaaattggtggaatggaattctttgatgttaacttatcttatattgatttagaagaaaatagagaagaatatgtttctgtcccagaacaaggaagtggcacactaattcctgaaggtattgggaaaccaggacatgtacatgctgtttcaggtggggctagtggacgagtgggcgtatttaaatttgaaactcaaatgatttctggaaatggtaaatttaaagcgactggattaggtagtgattctgcagccaaagaaaaaacttattcagcttataaatatcttagtgctaatgctgcttcaattagtgcatccatatccattgctagtcatgactttgtattcaatacccaagatctgaatggtgtcggaaatccagagtctctgactttaccaacaatgattgcactttgttcagtggcgttgaacaagccagtaatctccagtatagccgtatttggtgatataacgattggtggcactttagttagagttaccaacttagcagatatgatgcaagtggctcgtgatgcgggtgctaagaaagcgctggttccgatggctaatgcagctgacttagctacagtccctccagagttaatgtcgacttttaatattgttttctataattcaccagaagatgctgtctttaaagcacttggagttgaataa

SEQ ID NO: 3787 - DNA, 2040 bp, Pseudomonas syringae
atggacatcgaactcaataaagacctcgatcatctgctgaacgagcactttgccgggcgtgttgtacgcaaggatctgaccaagctcatcaaggaaggggcaaatgtacccgtctacgtgcttgagtacctgctgggcatgtactgtgcctcggatgatgcagaagtcatcgcgcagggtttgaagaacgtcaaaacggtgctggctgaaaactatgtccgccctgatgaagccgagaaggttaaatcgctggtacgtgagcgcggcacctacaaggtcatcgaccgtgtaaccgtacgccttaatgaaagaaaagaccgctacgaggcatccttcagcaacttgggcatcaaggacgccgaaatctccgctggcatcgtcaaagagtacgaaaaacttctggtcggcggcatctgggttatcgcgaccctgagttattaccacgaggagggtcagtcaggatcgcccttcggtgtaactctgctgaaacccattcagatgcctaacatgaacatgcaggagctgttcaccggtcgctcggcgctgaccaccctgcagtggcgcgagacgttgatccgttcaatcggcatggaaccttcgaccctggatgagtcagttcagtggcaccttcttgcgcgcatggttccctttgtcgagaacaactacaacgtctgcgaactggggccacgaggtacaggcaagagtcatatctacaaggagtgctcacccaacagcatgctggtatcaggtggccagaccacagtagccaacctgttctacaacatgagcagccggcgcatcggcttggttggtctctgggatgtcgtcgcattcgacgaagtcgcgggaatcaacttcaaggataacgatggcgtacagatcatgaaggattacatggcctcgggctccttcggtcgcggccgtgagcagatggaagcctcagcttcgatggtcttcgtcggcaatatcaaccagagcgttgagtcactggtgaaaaccagccatctgctagctcctttcccggagcaaatgatcgactcagccttcttcgaccgtttccacgcctatatccctggctgggaaattccaaagatgcgtccggagttcttcacaaacaaatacggcctgatcgtcgactatctggccgagtttttccgcgaaatgcgcaagcgcagctttgccgatgccatcgacaaacacttcaagctgggcaacaacctcaaccagcgtgatgtgatcgcggtgcgcaaaacagtgtctggcttgctcaagttgctttatccgcatgatgttttcagcaaagaagatgtgcgccagtgcctggagtacgccctacaggtacgccgtagggtgaaggaacagctgaagaagatcggaggtatggagttctacgatgtgcacttcagctacatcgacaatgagagcctcgaagagcactttgtcaccgtaaaggagcaaggcggcggcggcttaatccccgaaggccccggcaagcccggcttcatccataccatcggcttgagcagcaagggcatgccaggcttgtaccggatcgagctacaggtcaccaagggcagtggcaagctggtcacctctggcctctggaattcaactcaggccaaggagcaggtgaagatcgccttcgactacttcaaagccaacgcctcgcgaattagcgcttcggccaaggtactggagcacgacttccatctgcatgtggttgaactgcagaacaccggcccgctgacacacatggctctcgccagcctggtggcctttgcctccggcctgatgggtcgtcccgcacaagggcagatggtggtactcggcgatatgagcctgggcggcagcatcactccggtggaaagcatagcggagtgcctacaggtagccttcgacgctggcggtaagcgcgtttgcctaccaatgagcagcgccatggacattccgaccattccggcagagctgtttaccaagttccaaaccagcttctatggtgagcccgtggaagctgttttcaaggcgctgggggtggactaa

SEQ ID NO: 3788 - DNA, 2085 bp, Escherichia coli
atgcaaacccatcatgatttacctgtttcaggcgtatccgcaggggaaattgcctccgagggttacgatctggacgccctgctgaaccagcattttgctggtcgcgtggtgcgtaaagatctcaccaagcaactcaaggaaggggcaaacgtcccggtgtatgtgcttgagtatctgctcggcatgtactgcgcctctgacgatgacgacgtagtcgagcaagggttgcaaaacgttaagcgtattctggctgataactatgtgcgcccggatgaagcagagaaagtgaagtcgctgatccgcgagcgtggttcgtacaaaatcatcgataaagtgtcggtgaaactgaaccagaaaaaagacgtttacgaagcccagctttctaacctcggcatcaaagacgcgctggtgccatcacagatggttaaagacaacgagaagctactgacgggcggtatctggtgcatgattaccgtcaactatttctttgaagaagggcagaagacttcgcccttctcattgatgacgcttaagcctatccagatgccgaatatggatatggaagaagtgttcgatgcgcgtagacactttaaccgtgatcagtggatcgatgtgctgctgcgctcagtgggtatggagcccgccaatattgagcaacgcactaaatggcaccttatcacccgaatgatcccgtttgtggagaacaactataacgtttgcgaactggggccgcgcggcaccggtaaaagccatgtgtataaagagtgttctcctaactccctgttagtttctggcgggcaaacgaccgttgccaacctgttctacaacatggccagtcgccagatcggccttgttggcatgtgggatgtggtagcgttcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagacactcgttaaaaccagccatttgctggcgccatttccggctgcgatgattgataccgcctttttcgaccgctttcatgcctatattcccggttgggaaatccccaaaatgcgcccggaattctttaccaaccgttacgggctgattacggattatctcgctgaatatatgcgcgaaatgcgcaaacgcagtttctctgatgcgattgataaattctttaagctgggtaataaccttaaccagcgtgacgtcattgctgttcgacgtaccgtgtcgggattgttaaaactcatgcatcccgatggcgcgtacagcaaagaagatgtgcgagtctgcctgacctatgcgatggaagttcgtcgccgcgtgaaagagcaacttaaaaaactgggcggcctggagttcttcgatgtgaactttagctacatcgataacgaaacgctggaagagttttttgtgagcgtaccggaacagggcggcagcgaacttattcctgccggaatgccaaagccgggcgttgtgcatctggtcactcaggcagaaagcggcatgaccgggttgtatcgctttgaaacacagatgactgccggtaatggtaagcatagtgtatcgggtctgggttcaaatacctccgcgaaagaagctatccgcgtcggtttcgattacttcaaaggcaatttgaaccgggtaagcgcggccacgaaattctccgatcatgaatatcatcttcatgtcgttgaactgcataatactggccctagcaccgcaaccagtcttgctgctcttattgctttatgttcgatattgctggcaaaaccggtgcaggagcagatggtggtgttgggcagtatgacgcttggtggagtaattaacccggtacaagatcttgctgccagtttacagctcgccttcgacagcggcgcaaaacgagttctgttgccgatgtcctcggctatggatattccaacggttccggcagagttatttaccaagtttcaggtgagtttttactcagacccggttgatgcggtttataaggcgctgggagtgaattaa

SEQ ID NO: 3789 - DNA, 2076 bp, Pseudanabaena biceps
atgaatgctctagaccaaaaaataaacacccacttcgcaggactagttgttcgtaaagacctagtaaaaacagtcaaaggtaatgcgatcgtaccttcctatgtccttgaatatttgttaggtcaatactgtgccaccagtgacgaagcaacgattgcaactggaattgaaaccgttaaggagattttaggaaaacactatgtccatcgcaacgaagcaggattagtccgttctaacatcaaggaaaaaggacgatacaaagttattgataaaattagcgtctctctcaacgatagagccgatatttatgaagctgaattcgctaatcttggcatcaacaaagtattagttgactcaggcacaattaaaactcatcccaaacttttagtaagtggtgtttggagcattgccgatattgaatatcaattcgtagaagataaaaatatcagtccttgggttttagcatcactaaaaccaattcagttatcccactttaattttgatagttacatcgccgcccgccgacagttttccacaaatgagtggatcgatctgctaattcaaagtattggctttaatcctgctatgttcagcgatcgtcacaaactcagtcaattgatccgtttaattcctttttgcgaacgcaactataatctgatcgagttaggacccaagggaacaggtaaatcccatatctattcggagttttcaccccatggcattctcctctctggcggtgaagtgacagttcctaaactgtttgtcaataactcatctggcaaaattggtctagttggatattgggatgtagttgcctttgatgaatttgcaagcaagcaaaagcgcatcgataaatcccttgtcgatatcctgaaaaactatatggcaaataaaactttttcgagggggattgagacgctcggcgcagaagcatcaatggtttttgtgggaaacactaaaaatactgttccccatatgctgaagcattcagacttatttgaagagttaccgcccaagttttatgactcagcctttctcgatcgcctccatttttatattgctggctgggaagctgacataattcgtggagagatgttttccaatggatatggctttgtagtcgattacctcgccgaaattctcaggtcaatgcgaaattatgattactcacaacattacaaagagagttttgccttatcttcagatatctcaacccgcgatcgcgatgcgatcgataagactttctcaggattaatgaaacttattttcccacatcgagaggcaactaatacagaaatagaagaactcctcaaatttgcgatcgaaggtcgcaaaagagtaaaagatcaattaatgcggattgatgccacttactccgcagtccaattcgtttatttcgacaagttggacaaaacagaacaaccaaatcaagtcaagtgtcttgaagaagaagaatatcctgattactattatcaaactgctatttcccaaactaatcgtgaatcaaccaataatgaaagcggagaatcttcgataacatcacttttagaatccccagaactccttaattcaagtcttaaagagcaacatttaacatttatagaaaatcaacaaggcgtatcatttgatgctctctttggtgcatatttagcagaagcaaagcaaataactattaccgatccctatattcggatcttttatcaagtccgcaacttaatggatttcttagaaactgttgtcaggtataaacctgatgattgctcgatcaatattcatttagttaccaccgaagatgactttaaaggcacacagcaacaagaatattttgaagcgattaagcaatcttgtctcaatgtaggaatcgaatttacttgggaatttgatgaaagtcgaactattcatgctcgtcatatccaaaccgatcatggctggaaaattcttttagatcgtgggttagatatctttcaacaatatgacatgggtaatacttttagctttgcatcacgtcttcaacagtatagatactgcaaagctttcgagataacttacattagagcgatcgcaccaactctataa

SEQ ID NO: 3790 - DNA, 2052 bp, Vibrio cholerae; identical to SEQ ID NO: 3740

SEQ ID NO: 3791 - DNA, 2052 bp, Vibrio cholerae; identical to SEQ ID NO: 3740

SEQ ID NO: 3792 - DNA, 2085 bp, Escherichia coli; identical to SEQ ID NO: 3687

SEQ ID NO: 3793 - DNA, 2097 bp, Actinomyces sp.
atgacacgcgaactcacgcccgtcgaggcgaaggcctccaacgccttcgccgggtacatcgtccgcaaggacctggtgcaccaggtcaagggcaacgccgtcgtcccctcgtacgtcctggagttcctgctcgcgcagtactgcgcgacgacgaacgaggaggagatccgctccggcgtcgaatccgtgcgtaagatcctggccgcccactacgtgaaccgcggcgaatcagaactcatcaaatcccggatacgcgagcagggcggctaccggatcatcgacaaggtctccgtttccctggacgaggcgaacgaccgctacgtggcgtccttcgagaacctcggggtggccaacgccctggtctcggaccagactgtccgcgacaacgaccgcctgctcaccggtggtgtgtggtgcatggccgacatgtcgtacttccccgccctagagggcgccaagaccgccccgtggaacgtctcgcgcctgcaggcgatccagctgccccggttctccttcgaggagtacgccgacgcccggggccagttcacgacgcaggagtggatcgacctgctggtcgcatccgtgggcctggacccctcgaagctctccgagcgcgccaaaatgctccaagtcctgcgcctggtcccctacgtggagcgcaactacaacctggtggagctcggccccaagggcaccgggaagtcgcacatctactccgagttctcaccccacgggatcctggtgtccggcggcgaggtcaccctggcgaaactcttcgtcaacaacgcgacccaccgcatcggcctcgtcggattctgggacgtcgtcgccttcgacgagttcgccggacgcaagcgcgtcgagcagaacctggtcgacacgatgaagaactacctggcgaacaagtccttctcgaggggcgacagccccacgacagcgcaggcgtccatggttttcgtcggcaacaccatgcgcactgtgcccgccatgctggccacctccgacttgttcgaggcgctgcccgacgcctaccacgacacggcgtacatggaccgcatccactactacctgcccggatgggaggtcgacgtgatccggcccgagctgttcacctccggctacggcttcatcgtcgactacctggccgaggcgctccgtcacctgcgcaccctcgacttctcgggggacctctcgggccacttcgagttggactcccacatgtcgacccgcgaccgcgacgccgtccgcaagaccttctccggcctcgtcaaactcatccaccccgaccgggacggcacgcccgcagagttggagtcgctgctgcgcctggccatggaggggcgcaaacgcgtgaaggaccagatcatccgcctcgatgagaccatgcgggagtccggctcgcacttcctctacacggtgtcggcatccggtggcgagcgcgctatccgcacgcaggaggagatcgactaccccgagtacttcaccgcggacgacgaccgccccgcaggcgagccgcccaccacaggagggactcatccccaacccccggtgggcggggcggcgcaggagactgctcccagaccagccgaccgcctcgacaccctgcgttctcgcgcaatccccaaacgcgaggaggtcgaagcacggataggggtgtccctgcccaagatgctgctcccctacctggtggacgcccagaagatcaccatcgtcgacccgtacttgcggaagcgccaccagatcgcgaacatccacgacatcctgatccacatggtccaggccgtcggcctggcggcaccccctcgcgtccacctcgccaccggtcgggcagagcccgacagagccactgagcagatgcaactgctcaacgacctctgccagacgtggggccatttcggcgtcgagatcgactacgagttcgttgccgacatccacgaccgcgtcatcaaaacggacacaggctgggtcatcgacctgggtcgcggcctggacgtgtacgagcggttccaagcgctgtcgaggttcgatccgcgcttcgacctcatggagctgcgcaggaccaagggcttcaccttcaacgcgcaacgaacggagtag

SEQ ID NO: 3794 - DNA, 2040 bp, Acinetobacter radioresistens
atggaatctgctaacgataaagaactggatcagctgctgaatgaacactttgctgggcgggtggtacgtaaggatctgactaaactgatcaaagaaggggctaacgttcctgtctatgtactcgaatacctgctagggatgtattgtgcctcggatgatcctgagatcattgagcagggactacgtaacgtaaagacggtgctggcagagaactatgtacgacctgatgaagctgagaaggtgaaatccctggttcgtgaacgtggcagttataaagtcattgatcgggtgaccgtaaagctgaatgagcgtaaggacaaatacgaagcatcatttagtaatctgggcatcaaagatgccgaaatctcggcaggcatcgtcaaagagtatgaaaaattacttgttggtggtatctgggtcattgctacgctcagttattattttgaagaagggcagactagttctccatttggggtgagcttactcaagccgattcaaatgccgaatatgaatatggatgaactcttcagtggcagagcagcattaagcactgatcagtggcgcgagagtttaatccgttccatcggcatggaaccggcttcgttaaaagaggacgtgcaatggcacctattagcgcgtatggttccgttcgttgaaaataactataacgtctgtgaactgggaccacgcggtaccgggaaaagccatatttacaaagagtgttcaccgaatagtattttagtctctggtgggcaaacgactgtcgccaacctgttctataacatgagtagccgccgtattggtctggtgggcttatgggatgtggtagcttttgatgaagtcgccggtatttcctttaaggacaaagatggtgtacagatcatgaaagattacatggcctcaggatcttttgctcgtggtcgtgaacagatggaagcctcagcttcgatggtttttgtgggtaatattaaccaaagtgttgaatctttggtgaagactagccacttattggctccgtttcctgaagctatgatcgattcagcattctttgatcgctttcatgcctatatcccaggttgggaaattccaaaaatgcgcccggaattctttaccaaccgttatggcctgattgttgattatctggctgaattcttccgggaaatgcgcaagcgcagttttgcggatgccattgagaagtacttcaagctagggaataacctgaatcagcgtgatgtgatcgccgttcgcaagacggtttctggattgatgaagctgctttacccacacggtcagtttaataaagaagatgtacggcaatgcctggaatatgcactgcaggtgcgccgtcgggtcaaagaacagctgaagaaaattggagggatggaattctatgatgtgcattttagctatatcgacaatgacactctagaagagcattttgtttcggtaaaagagcagggtggaggtggacttattcccgaaggtcctgctaaaccaggcttcctgtataccattggcctcagtaataagggcatgccaggcttataccgcttagaactgcaagtcactaaaggttcaggaaaattggccacatcaggcttatggaattcaagcagtgccaaggagcaggtcaagatcgcatttgactacttcaaggccaatgcatcccggatctcgggggggagtaaggtgctggaacatgatttccacttacatgtggttgaattacagaataccgggccgctcagccatcttgccttgccaagtttagtggctttcgcttcaggcctgttaggacgatcggtacaaagtcagatggtggtactgggtgatatgagcttgggtggttcagtgacaccggtggaaagtattgccgaatgtctgcaagttgcttttgatgcgggtgccaagaaggttgctttacccatgagtagtgcggcagatatcccaacgattcctgtggaactgtttaccaagttccagaccagcttttatgcagatccggtggatgcggtgtttaaagggttaggggtggattaa

SEQ ID NO: 3795 - DNA, 2052 bp, Vibrio cholerae; identical to SEQ ID NO: 3740

SEQ ID NO: 3796 - DNA, 2208 bp, Bifidobacterium bifidum
atgaatgagcaggatatgagccagaacggttggattgaaagtcctgaacacaacgcggatgggaattccctgagcgcgttggatgtcaagatcaccgatctgttccccggggtcaccgtccgcaaggatctggtgaacagggtcaagggcaatgcgttggtgccctcatatgtgctggagttcctgctcagcgcatatgccacgaataccgaccaagccagtatcgagtcgggggtggatcgagtgcgtgccattcttgcaaacaactatgtgcatcgcgaggaagccaatcttatccagtcgaaaatccgcgagaaagggagccataggattatcgaccgtgtacaggtggcgctcaatgacaaaaccgacctgtatgaggcaacgttctccaatctcggtatcagccaggtcattgtcgatccaagccttgtaaaggcctatccgaaactgctggtgacgggcatctggtgcatgtgtcagatcggttacgcatattctggggatccgcgtgaagtaccatggcagttgctgcagctcaagcctgtgcagatgtcgcgcgatgaccgtgcaaactacatgcagcaacgttcgcaattcaccgacggtgaatggattgatttgctgatgcagtccattgggttcaattccgatctattctccgaccgggctaaactgctgcatctggtacgcatggtgccgtttgtggaacgaaactacaatctggtcgaactcgggccgaaaggcaccggcaagtcgcacatctactcggaattctcgccgcacggcatgctcatatccggcggggaagtgacagtggccaaactgttcgtgaacaattccaacggacatctggggcttgtgggctattgggatacggtggcgttcgacgagttcgcaggcaaggccaagaaggccggccgggacttggtggacatcatgaagaactacatggccaacaagtcgttctcccgtggcgtcgagacgttccaaggcgaggcgagcatggcgttcgtaggcaacacctcgcataacgtgccgtacatgctgaaaaactccgacctgttcgaggaactgccgaaacagtatcacgatccggcattcctggatcgtattcacttctatctgccgggttgggagttcgaacagatccgttccgagatgttcaccagcggattcggtttcgttgtcgactatctggcggagattctgcacaacctgcgcgatgccgattacagcgaccggttcgaaaagtatttcgaactgtcttccacactgtccacgcgagataaggacggcatcaaaaagacgttctccggattgatgaagcttatctacccggacggcaaggccactcccgaacagatggagccgttgctgcgttgcgccatcgagggccgcaagcgtgtcaaggaccagctgtgccgtatcgactccaccatggaggaagtcgagtttacctacaagcgtgcgagcgacggtgaagtagtcgccgtgcagacgttggaggagcttgactacccgcagttgtattggcgtgggcgtgtagttgagaactcggaagatgagagcgaggcggaatcgtttgttgccggtgatgacgtggcaattgcgggtagcgagggcgaagccggtgcttctgagaacgccaatgcccttcccgtagcgaggcagcaagaaacagccgcgatgactccagtcgagcgccttgcggcaaaggccgacggaaagcagtgggaattggtcgaaaaccaacgtggaatcacgtattacaaactattcgggccatatttggctggtgcgaagaaaatcgttgtagaggatgcgtatgtgcgtaagccgtaccagctgcgtaatctggccgagttcttggaaatgctgctcagatgcaaaaattccgatgaggatgtagccgttcatctggtgaccggacataatgatcctgaattcgtggaagcgcagttaaatggtttgaacgaactggcatcgacgttctcacagctgggcgtgaacctcacctacgaattcagagacactttgcacgaccgttccattacttcggataccggatgggagattcttcccggccgggggcttgacatcttccaaaaaatcgttgacggcgattggcttaacccgctgctgcgccatcagcagctccgccgcgtcaaggaatgcaaggtcacgtataggcgaattgaacgatag

SEQ ID NO: 3797 - DNA, 2094 bp, Bacteroides ovatus
atggattcacagcagaaagtattaaatgccttcattggcaaagtagtaagaaaagacctggcgtttttggttaagggtggacttcctgtaccgacttacgtattggaatacctgcttggccaatattgtgccagtgatgatgaagaaatcattaacgagggactagagaaagtaaaagatgtcatcaagaataactatgtacacagagctgaagctgagtcggtaaaaggacttatccgtgagcatggtaaacatcgaatcatagataaagtaactgttgtacttaatgaaaagaatgatgaatatcaggcaacttttgccaatctcggactctccggtgtaccaataggaactgactatgtacgtaagaacccgaagcttctgagcggaaacggtgtatggtgcatcgtcaccattggctacatcagtggagaagatgtaaaagtgagatgggaaatccagacattaaagcctatacagatttcgaatatcgatttgcaagagtatattgaacaacgtaaaaactttactacagaagaatggatcgatctgctcatgcatacagtgggcttaaatccagatacgatgaaccgacgggaaaagtttatcacacttgcccgtctgcttcctcatgtcgaaaataacttcaactttatggaacttggtcctaaaggaaccggaaagtctcacgtattccaagaattgtcaccttacggagtacttgtatcaggtggagatgtgaccagtgcacgactattcgtaaggatgtctgggaaaagagaagaacttggtcttgttggatattgggatgtggttgcatgggatgagtttgaacaacagaaaggacgtgcagttgatgccgtgctcattgataccatgcagaattatctggctaataaatccttcaaccgaggcaaaggaacacatgaggcaagtgcctccatggtttttgttggaaataccaaacatactgttcccttcatgttgaagaacacgcacctttttgaatctataccgacatcctttatcaaaggtgcttttcttgacagaatccatctgtataacccaggctgggaaatcaagatgctgaagaaagacagtttctccaagggctatggacttattacggattatatagctgcggtactacatgccatgcgcaacgatgatcgcaccgcggtattgaaagactatgccaagtttgacggatcactatctgaacgtgatcatttagcaatccgtaagactttctccggaatgatgaaacttctctacccagatggaaaaatgacagaccaggaagcatacgaattggttgattttgccgcagaaagtagaaagcgagtaaaagaccaactatatgtcattgatgaaacatttaaagctgagcctgcacatttcaaatatatcaatttaagaacgggtattgaaatgaatgtcgagacattggaaaaagttagcaatccttttataatcccaataaactcaacgacaggtacagctactggggagttaaccgatgcagatgctcagcctttgaatgaagaaatctcaggaaaatgctccgtggaggaaggaaccactgccggtcaaactgcaaagcgcccccgtattcatatactacaagaaaaaagtatgacgttcagaatgggacaaacgggagttagctatgagaaattgttcgcttcatatatggcaaacgcaaatgaaataactgtggaggatccatatatacgtgctccatggcaaattaaaaattttatggagtttgcgctgatgctcattaatacgcgtccagttgatgacttaaagctcaatcttattactaacgaggaggacgataagcttcctgaacttatagacaggcttgatgacattaaggatgacctcgctacatacggcatagactttgaatacaaattcagagattttcatgacagatgcatcaaaacagatacaggctggacgatctcgcttggacgtgggctggatatgtttgagaaatacaacaccttttcaatcgcttcgtcaagacaggatatgcgtaagtgtaaggaatttactgtaacatttatgaaaacaaaaaatgcataa

SEQ ID NO: 3798 - DNA, 2052 bp, Vibrio cholerae; identical to SEQ ID NO: 3740

SEQ ID NO: 3799 - DNA, 2094 bp, Parabacteroides sp.
atggattcacagcagaaagtattaaatgccttcattggcaaagtagtaagaaaagacctggcgtttttggttaagggtggacttcctgtaccgacttacgtattggaatacctgcttggccaatattgtgccagtgatgatgaagaaatcattaacgagggactagagaaagtaaaagatgtcatcaagaataactatgtacacagagctgaagctgagtcggtaaaaggacttatccgtgagcatggtaaacatcgaatcatagataaagtaactgttgtacttaatgaaaagaatgatgaatatcaggcaacttttaccaatctcggactctccggtgtaccaataggaactgactatgtacgtaagaacccgaagcttctgagcggaaacggtgtatggtgcatcgtcaccattggctacatcagtggagaagatgtaaaagtgagatgggaaatccagacattaaagcctatacagatttcgaatatcgatttgcaagagtatattgaacaacgtaaaaactttactacagaagaatggatcgatctgctcatgcatacagtgggcttaaatccagatacgatgaaccgacgggaaaagtttatcacacttgcccgtctgcttcctcatgtcgaaaataacttcaactttatggaacttggtcctaaaggaaccggaaagtctcacgtattccaagaattgtcaccttacggagtacttgtatcaggtggagatgtgaccagtgcacgactattcgtaaggatgtctgggaaaagagaagaacttggtcttgttggatattgggatgtggttgcatgggatgagtttgaacaacagaaaggacgtgcagttgatgccgtgctcattgataccatgcagaattatctggctaataaatccttcaaccgaggcaaaggaacacatgaggcaagtgcctccatggtttttgttggaaataccaaacatactgttcccttcatgttgaagaacacgcacctttttgaatctataccgacatcctttatcaaaggtgcttttcttgacagaatccatctgtataacccaggctgggaaatcaagatgctgaagaaagacagtttctccaagggctatggacttattacggattatatagctgcggtactacatgccatgcgcaacgatgatcgcaccgcggtattgaaagactatgccaagtttgacggatcactatctgaacgtgatcatttagcaatccgtaagactttctccggaatgatgaaacttctctacccagatggaaaaatgacagaccaggaagcatacgaattggttgattttgccgcagaaagtagaaagcgagtaaaagaccaactatatgtcattgatgaaacatttaaagctgagcctgcacatttcaaatatatcaatttaagaacgggtattgaaatgaatgtcgagacattggaaaaagttagcaatcctcttataatcccaataaactcaatgacaggtacagctactggggagttaaccgatgcagatgctcagcctttgaatgaagaaatctcaggaaaatgctccgtggaggaaggaaccactgccggtcaaactgcaaagcgcccccgtattcatatactacaagaaaaaagtatgacgttcagaatgggacaaacgggagttagctatgagaaattgttcgcttcatatatggcaaacgcaaatgaaataactgtggaggatccatatatacgtgctccatggcaaattaaaaattttatggagtttgcgctgatgctcattaatacgcgtccagttgatgacttaaagctcaatcttattactaacgaggaggacgataagcttcctgaacttatagacaggcttgatgacattaaggatgacctcgctacatacggcatagactttgaatacaaattcagagattttcatgacagatgcatcaaaacagatacaggctggacgatctcgcttggacgtgggctggatatgtttgagaaatacaacaccttttcaatcgcttcgtcaagacaggatatgcgtaagtgtaaggaatttactgtaacatttatgaaaacaaaaaatgcataa

SEQ ID NO: 3800 - DNA, 2076 bp, Escherichia coli
atgcaacagcaggataactcagccagtaacatggaaacggcctctgtgttggctcaggacctggattcattgttgaatcagcactttcgcggtcgcgtggtgcgtaaggatctgactaagcaacttaaagaaggggcgaatgttccggtttacgtactggaatatctactcggtatgtactgtgcctccgatgacgatgaggttgtcgagcaggggctacagtcggttaagcgtattctttctgataactacgtccgcccggatgaagcagaaaaagtgaaatcactaattcgcgagcgtggttcttacaagattatcgataaggtcacggtaaagctaaatcagaagaaagacgtttacgaagcccagctctctaaccttggcattaaagatgccctggtgccgtcgcagatggtgaaagacaacgagaaactgctgactggtggcatctggtgcatgatcaccgtgaactacttttatgaagaggggcaaaaaacgtctcctttctcgctgttcacactgaagccgatccagatgccaaatatggatatggacgaggtatttgaagcccgcaagcagtttgatcgcgaccagtggattgatgtgctgttacgttcggtcgggatggaacctgcaaatattgagcagcgtaccaagtggcatctgattactcgcatgattccctttgtggaaaacaactataacgtctgcgagcttggtccacgtggtacaggtaagagtcatgtttataaagagtgctctcctaactccctgctggtatctggcgggcaaaccacggtggcgaacttgttttacaacatggccagccggcagattggtcttgtgggaatgtgggacgtcgtcgcgtttgatgaagtggcagggatcaccttcaaagacaaagatggcgtgcagatcatgaaggattacatggcatcaggctcattctctcgtggtcgggactccattgaaggcaaagcctccatggtgtttgttggcaacatcaatcagagcgtagatacactggtcaaaaccagccatctgctagcaccgttcccggatgcgatgattgatactgcattttttgaccgcttccatgcctatattcctggttgggaaattcctaagatgcgcccggaatttttcaccaatcgctatggtttgattacggattatctcgctgaatacatgcgcgagatgcgtaaacgtagcttctccgatgcaattgataaattcttcaagctgggaaataacctcaatcagcgtgacgtgattgctgttcgacgtacagtgtcggggttgttaaaactcatgcatcccgatggcgcgtacagcaaagaagatgtacgagtctgcctgacctatgcgatggaagttcgtcgtcgagtgaaagagcaacttaaaaaactgggcggcctggagttcttcgatgtgaactttagctacatcgataacgaaacgctggaagagttttttgtaagcgtaccggaacagggcggcagcgaactaattcctgccggaatgccaaagccgggcgttgtgcatttggtcactcaggcagaaagcggtatgaccgggctgtatcgttttgaaacgcagatgactgccggtaatggtaagcatagtgtatcgggcctgggttcaaatacctccgcgaaagaagctatccgcgtcggtttcgattacttcaaaggcaatttgaatcgggtaagcgcggcagcgaaattctctgatcatgaatatcaccttcatgtcgttgaactgcataatactggccctagcaccgcaaccagtcttgctgcgcttatcgctttatgttcgatattgctggcaaagccggtgcaggaacagatggtggtgttgggcagtatgacccttggtggagtaattaacccggtgcaggatcttgccgccagtttacagctcgccttcgacagcggcgcaaaacgggttctgttgccgatgtcctcggctatggatattccaacggttccggcagagttatttaccaagtttcaggtgagtttttactcagacccggttgatgcggtttataaggcgctgggtgtgaattaa

SEQ ID NO: 3801 - DNA, 2052 bp, Vibrio cholerae; identical to SEQ ID NO: 3740

SEQ ID NO: 3802 - DNA, 2100 bp, Bacteroides ovatus
gtgattaagttttttgatatgacactacaacagaaaataatgaatgctttcttaggtaaagtggttcgtaaagatttagcttttcttgtaaagggagggctccctgtacctacatacgtattggagtatctgcttgggcagtattgcgcctgtgatgacgaagcgaccatagaagaaggcttggaaaaagtgagacaagtgatccaaaacaattatgtacatcgcgcggagtcagaagtcgttaagggtaaaatccgtgagcagggttgccatcgtatcattgataaggtaactgttactctcaatgagaaagcggacgaataccaagctcattttgctaacttaggtcttactaatgtgcctattggcactcaatatgtgacaaacaatcccaagctcttatcaggaaatggtgtttggtgtatcgtcactattggctatatatcaggcgaagatattaaagtacgctgggaaattcaaactctgaagcctgtacaaatatccaatgtggatgttcaagattatatagataaacgcaaggactttaccacggaggagtggttggacttcatgatgcataccgttgggttgaaccccgacaccttaaatcggcgtgagaagttcattacattagctcgtctgctccctcatgttgagaataatttcaactttatggagctgggacctaaaggaaccggtaagagccatgtttttcaggaactgtcaccatacggtgttttagtgagtggtggtgatgtgaccagtcctcgtctgtttgttaaaatgagcggtaataaagagattttaggattggtgggctactgggatgtagtggcttgggatgaatttgagcagcaaaaaggtcgcgccgtagatgcggtattgattgataccatgcaaaattatctggccaataagtcattcaaccgcggtaagggtacgcatgaggcttccgcttctatttgctttgtgggtaatacgaagcacacggttccttatatgctaaagaatagccatctttttgaatcaattcctacctcgtttatcaagggagcttttttagatcgtattcacctctacaacccaggttgggagattaggatgctgaagaaagatagcttctcaaaaggatacggtctgattaccgattacatagcagccattatgcacgaactgcgcaataaagatttgacagcattattgaaggattatgctaagtttgatggttccctgtctgaacgtgatcacttggccatccggaaaacattttctggtatggtgaagctgatatatccggatggtaacatgacggacgaagaggcatttgagttgatagactttgctgccgaaagccgtaagcgtgtcaaagaccagttatatattgtggatgagacatttaatgcagagcctgccaagttcagatacgtgcgtgagaaagatggtgtagaaattaatgtggagactctagagaaggtgagtaatgcacttatcatccctaacaatattcaccaagaatctactattatggcaaatttggatgatagcgatattccgcttttccaagaaggaactgaaacaacaatgcaagtagagccttcttcagaacgacagtctcgcaaaagattcattcctttacaggaaaagaatcagttcttccgtttaggacagactggggtcacttatcagtctctctttgccgaatatcttaaggatgcaactgaaatcacgattgaagacccgttcatccgaacaagttggcaagtaaagaatctcatggagtttctgacgatgctcattgatacccgcgacgtagatgaccttaaagtgcatctggtgaccaatgaagaagaagataagttacctgatctcatagataaactggatgacataaaaaacgatatgattggctatggcattgagtttgattataatttccgtgaatttcacgatcgttgtatcaaggccgacaatggttgggtaatttcaatggggcgtggacttgatatatacgagaagtatagtccgtattctgttgcagccactcggccggataaacgtaaatgcaaagagtttatggttacattcactaaggataaatag

SEQ ID NO: 3803 - DNA, 2076 bp, Yersinia ruckeri
atgcaacagcaggataactcggctaacaacatggaaatggcctctgcattggctcaggacctggattcattattgaatcagcactttcgtggtcgcgtggtgcgtaaagacctgactaaacaacttaaagaaggggcgaatgttccggtctatgtgctggagtatttgctcgggatgtattgtgcgtcggatgatgatgaagtaattgagcagggcttacagtccgttaaacgcattctatctgataactacgttcgtcccgatgaagcggaaaaaataaaatctctgatccgtgaacgtggttcgtacaaaatcatcgacaaagtcaccgtaaagctaaatcaaaagaaagacgtttacgaagctcagctatctaacttgggcattaaggatgccttggtgccatctcagatggttaaagataacgagaagctactgatgggcggtatctggtgcatgatcaccgtgaactatttctatgaggaaggacagagaacgtctcctttctcgttgatgacgctgaaacctatccagatgccgaatatggatatggacgaggtgtttgaggctcgtaaacagtttagccgtgaccagtggattgatttgctactgcgttctgtgggaatggagccagccaatattgagcaacgtaccaaatggcacttaattgctcgcatgatcccattcgtggaaaacaattataacgtctgtgagctggggccacgaggtaccggtaaaagtcatgtttataaagagtgttcacctaattcgctgttggtatccggtgggcaaaccaccgtggctaacctgttctacaacatggccagccgccagattggtttagtcggcatgtgggacgtggtggcatttgatgaagtggcgggaattactttcaaagacaaagacggcgtgcaaatcatgaaggattacatggcgtcaggctcattctctcgcggacgtgactccattgaaggaaaagcctccatggtatttgtcggcaacatcaatcagagcgtggatacgcttgtgaaaactagccatttgctcgcgccgttcccggatgcgatgatcgatactgcattttttgatcgcttccacgcctatattcccggctgggaaattcccaaaatgcgcccggaatttttcaccaaccgctacggtttgatcactgattatcttgccgagtacatgcgtgaaatgcgtaagcgtagcttctcagacgcgattgataaattcttcaagctgggagacaacctcaaccagcgtgatgtgattgctgtacgccgcactgtatctggcctgttaaagctaatgcatcccgatggggcctacgataaagaagatgtacgtgcttgcctgagctatgcgatggaagtacgtcgccgcgtgaaagaacaactgaaaaaactcggtggtcttgagttctttgatgtgaactttagttatatcgataacgaaagcctggaagagtttttcgtcagtgtgctagaacaaggtggaagtgaactgatacctgtggggacgcccaaacctggagtagtgcatttggtaacccaagcagattcaggaatgactggcctctaccggtttgaaacccagatgatggccggtaatggcaaacatgctgtttcaggtttgggatcaaatactgcggcgaaggaagctgttcgtgttggtttcgactattttaaaggaaacttgagccgaattagcgctgcagcgaaattctctgaacatgaatatcatcttcatgtggtagaactacacaatacaggcccaagtacaacaaccagtcttgcatcgttgattgccttctgctctatgttgctggcaaagcccgtacaggaacagatggttgtcctgggtagtatgactctgggtggggtgattaagccagtacaagatctagctgcatgtctgcaggtggcattcgacagcggagccaaacgagtgttgctaccaatggcatcagctatggatattccaacagtaccaaccgagctatttaccaagtttcaagtaagtttttactctgatcctgttgatgcagtctataaagcgcttggtgtaaattga

SEQ ID NO: 3804 - DNA, 2076 bp, Pantoea sp.
atgcaacagcgggataactcggcgaccgatatggaaatggcctctgctcagtctcaggacctggattcaatgttgaatcagcactttcgtgggcgcgtggtgcgtaaggacctgactaaacaacttaaagaaggggcgaatgttccggtctatgtgctggagtatttactcggtatgtactgtgcatccgatgacaatgaggttgtcgagcaagggcttcaatcggttaaacgtattctttctgataactacgtccgccccgatgaggcagaaaaagtaaaatcgctgatccgtgagcgtggttcctacaaaattatcgataaggtcacagtaaagttaaaccaaaagaaagacgtttacgaagcccaattatctaacctcggcattaaggatgccttagtaccatcgcagatggtgaaagataacgagaaactactaacaggtggcatctggtgcatgatcaccgtgaactacttttatgaggaagggcaaaaaacatcacctttctcgttgttcactttgaaacctattcaaatgccaaacatggacatggatgaagtgtttgaggctcgtaagcagttcgaccgagaccagtggattgatgtgttattacgctctgtgggaatggaaccagccaatattgaacagcgcaccaaatggcatctcattgctcgcatgatcccgtttgtggaaaataactataacgtttgtgagcttggacctcgcggcaccggtaaaagccacgtctacaaggaatgctcaccaaattcattgctggtttctggtgggcaaactacggtagccaacctgttctacaacatggccagccgccagattggtttggtcggcatgtgggacgtagtggcgtttgatgaagtggcaggaattacgttcaaagacaaagacggcgtgcagatcatgaaggactatatggcatcaggttcgttctctcgcggacgtgattccattgaaggtaaagcctccatggttttcgtcggcaacatcaatcagagcgtggataccctagtaaaaaccagtcatctactggcacctttcccagatgcgatgatcgatactgcattttttgaccgtttccacgcctatattcctggatgggaaattccaaagatgcgtccggagtttttcactaaccgctacggtttaattaccgattatcttgccgaatacatgcgagaaatgcgcaaacgtagcttctcagacgcgattgataaatttttcaagttgggaaacaaccttaaccaacgtgatgtgattgctgtacgccgcactgtatctggcctgttaaagctaatgcatccggatggggcctacgataaagaagatgtacgcgtgtgcctggcctatgcattagaggttcgtcgtcgtgttaaagaacagcttaagaagctcggtggtctcgagttttttgatgtgaatttcagctatatcgataatgacagcttggaagaatttttcgttagtgtgcctgaacaaggcgggagtgaactgatcccggcaggtatgccaaaaccaggcgtagtgcatttggttacgcaagccgattctggcatgactggactttatcggttcgaaacacagatgacagcaggaaatggaaaacatgcagtatcagggctaggttcaaacacggcagcgaaagagtccattcgtgttggttttgattacttcaaaggtaacctcagccgtatcagcgctgcggcaaaattctctgagcacgaataccatcttcatgtggtggaactgcatagcacgggtcccagtacgacgaccagcctggcttcattaattgctttctgctcagttttattagcaaaaccagtgcaggaacagatggtcgtgttgggaagtatgacactaggtggcgtgacaaatcctgtacaggatctagctgcatgcctgcaagtggcattcgacagcggggccaaacgtgtactgttgcctatgtcttcagcaatggatatcccaacagtacctacggaattgtttaccaagttccaggtaagtttttacgctgatccggtggacgcagtgtataaagcattgggcgtgaattaa

SEQ ID NO: 3805 - DNA, 2085 bp, Escherichia coli
atgcaaacccatcatgatttacctgtttcaggcgtatccgcaggggaaattgcctccgagggttacgatctggacgccctgctgaaccagcattttgctggtcgcgtggtgcgtaaagatctcaccaagcaactcaaggaaggggcaaacgtcccggtgtatgtgcttgagtatctgctcggcatgtactgcgcctctgacgatgacgatgtggtcgagcaagggttgcaaaacgttaagcgtattctggctgataactatgtgcgcccggatgaagcggagaaagtgaagtcgctgatccgcgagcgtggttcgtacaaaatcatcgataaagtgtcggtgaaactgaaccagaaaaaagacgtttacgaagcccagctttctaacctcggcatcaaagacgcgctggtgccctcgcagatggttaaagacaacgagaagctactgacgggcggtatctggtgcatgattaccgtcaactatttctttgaagaagggcagaagacctcacccttctcattgatgacgctcaagcctatccagatgccgaatatggatatggaagaggtgttcgatgcgcgtaaacactttaaccgtgaccagtggatcgatgtgctgctgcgctcggtgggtatggagcccgccaatattgagcaacgcaccaaatggcaccttatcacccgtatgatcccgttcgtggagaacaactataacgtttgcgagctggggccgcgtggcacaggtaaaagccatgtgtataaagagtgttctcctaactccctgttagtttccggcgggcaaacgaccgttgccaacttgttctacaacatggccagtcgccagatcggcctggttggcatgtgggatgtggtagcgttcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagactctcgttaaaaccagccatttgctggcgccatttccggctgcgatgattgatactgcatttttcgaccgctttcatgcctatattcccggttgggaaatccccaaaatgcgcccggaattatttaccaaccgttacgggctgattacggattatctcgctgaatatatgcgcgaaatgcgcaaacgcagtttctctgatgcgattgataaattctttaagctgggtaacaacctcaaccagcgtgacgttattgccgttcgacgtaccgtgtcggggttgttaaaactcatgcatcccgatggcgcgtacagcaaagaagatgtgcgagtctgcctgacctatgcgatggaagttcgccgccgcgtgaaagagcaacttaaaaaactgggcggtctggagttcttcgatgtgaactttagctacatcgataacgaaacgctggaagagttttttgtaagcgtaccggaacagggcggcagcgaacttattcctgccggaatgccaaagccgggtgttgtgcatctggtcactcaggcagaaagcggcatgaccgggctgtatcgttttgaaacacagatgactgccggtaatggtaagcatagtgtatcgggtctgggttcaaatacctccgcgaaagaagctatccgcgtcggtttcgattacttcaaaggcaatttgaatcgggtaagcgcggccgcgaaattctccgatcatgaatatcaccttcatgtcgttgaactgcataatactggcccaagcaccgcaaccagtcttgctgcgcttatcgctttatgttcgatattgttggcaaaaccggtgcaggaacagatggtggtgttgggcagtatgacgcttggtggggtaattaacccggtgcaggatcttgccgccagtttgcagctcgccttcgacagcggtgcaaaacgggttctgttgccgatgtcctcggctatggatattccaacggttccggcagcgttatttaccaagtttcaggtgagtttttactcagacccggttgatgctgtttataaggcgctgggtgtgaattaa

SEQ ID NO: 3806 - DNA, 2052 bp, Vibrio cholerae; identical to SEQ ID NO: 3740

SEQ ID NO: 3807 - DNA, 2085 bp, Escherichia coli; identical to SEQ ID NO: 3772

SEQ ID NO: 3808 - DNA, 2184 bp, Collinsella intestinalis
atggattcgaatctcgacgcctgcggcgtgcccgcgtatgaaaaggatgacctcgaccgcaagatcatcgagcacttccccggcaagattgtgcgcaaggacctcacctccctcatgaagcgcggggcgggcatccccacctacgtgctggagtacctgctcggcatgtactgcgccaccgatgacgaggcggcgatcgccgacggcatggcgcgcatccgaaaaatcctcgccgagaactacgtgcgccccgaggagagcgagaagatcaagagccgcatccgcgagctagggcagtacaccgtgatcgataaggtgggcgcccgcctggacgaataccgcgacctgtacgtcgcgcaattcaccaacctcaacatcgagccgttcgtcatgcccgacgaatacgtccgtcagcacaccaaaatcctcacgggtggcatatggtgcatcatgcgcatccaatacctgcggcccgaggacatcgcggaagacccgcttgccgatatcttcggcgatgaccccgccgaacagcgcgggcgggcgcgcaaagggcgaacctcgggcaagggcaagcgcgggcccgaggactcccctttcaaaatcgcaagcctcacccccatccagatgcccagcctcgacctgtccgagcttgtgagccatcgagaggacttcacgaccgacgagtggatcgcactgctgctgcggtcggccggctacgagccctccgccctgacgccgcgcgagcgcctgcacttcctcacgcgcatggtgccgctcgttgagctcaactacaacctgtgcgagttagggccccgcgggacgggcaagtcacacatctacaccgaggtctcgccctattcctatctgttatcgggcgggcagaccaccacagccaagctcttcgccaacaacgcggcgcgggcggggcagcgtattggtctcgtgggacattgggattgcatcgcgttcgacgaagtcgcgggcatgaacttccgcgatcaaaacgccatccaaatcatgaagggctacatggcgaacggtaccttcggccgcggcaccgaatcgtttaacgccgaggcgtccatggtgttcgagggcaacatcaacgactccgtgtcaaacatgctcaagaccacacacctgttcgacccgttcccgcccgagttcaacaacgacagcgcgttcttcgaccgcatccactgctacctacccggctgggaggtgcccaagatgcgctcggacctcatctgcgagcgctacagcctcatcaccgattgcctgggcgaattcctccacgccatgcgcaggcgcgacttcacgcaccacatcgaccgatacttccgcctgaacagcgacttcaaccgtcgcgatgaaatcggcgtgcgaaagactttcagtggactcgccaagctcatcttccccgacggaaagatgagtcgcgaagacgtgcgcatgctgctggaatacgccatcgaggggcgcagacgcgttaaggaacagctcaagaccatggcgggcatcgaattcatcgatgtgaagctgggatatacggatatggaaaaccctgtggagatgcacctggtcagcgtattggaacaaaccgacgactcgctcattcccgataccacgccgcaagctggccacgtctttggcgtgggccgctcggttgccgacgagatggctgtatacaagctcgaaaacaaggccgtgaacggcaacgccgcatttaggatggagggcgctggatcgaaccgtgaggtacgcgacgcattgaatgccgcgttcgagcaattcaagaactgcgccccgcgactggcggctggcatgcacgtaacaagcaaagactacctgctcttttgcaacgacctgcaggcgaagggaccatctgcggagatttcgctcgcggagttcatcggtctgtgctccgccgcatcggggcgccccgtgatagcgggactggtgattcccggcatcctgcgcctctctgggtcactggagcctgtgggcaacttagcggatgtcttgcgcgttgcgaagaacgcgggcgcgaagcgcatcctgcttccgatgagctccatcgcggacctgcagaacgtggcacccgagctgatcggcgccgtgagtcctgagttctacgagaccggcgatgccgtggctgcggcgcggcgggcccttgggctgtag

SEQ ID NO: 3809 - DNA, 2085 bp, Salmonella enterica; identical to SEQ ID NO: 3644

SEQ ID NO: 3810 - DNA, 2085 bp, Escherichia coli; identical to SEQ ID NO: 3764

SEQ ID NO: 3811 - DNA, 2082 bp, Nitratireductor indicus
atgtcgacccttgatgacaagatcaacgagcattttgccggtttcgtggttcgcaaggacctggtgaaggcggtgaagggcaatgccatcgtcccgacctatgttcttgaatatctgcttggccaatattgcgccaccgacgacgaagcctcgatcgcgacaggcatcgagacggtcaaggacatcctgcgcaaacattatgtccatcgctcggaagcggggctagtccagtcgacgatcaaggagcgtggccgctacaaggtcatcgatcaggtcagcgtggcgctgaatgaaaagaccgatgcctatgaggcggtctttgagaacctcggtatcaagcgggttgccatcgacagcgccacggtaaaggcgcacccgaaactgctggttacgggtatttggtgcatcgccgatgtgcagtacgaattttcggaagacagccggatctccccctggatcatcgacacgttgaagccgatccagatcgcccgtgtggactatgacggctatcgcgagacgcgggacaagttcaccactgaggaatggatcgatctgctgatgcagagcatcggctttgacccgtcactgttcgggcgccggtcaaaacttttgcaactgttgcgcctggtcccatttgttgagcgcaactacaacctcatcgagcttggtcccaaggggacaggaaaatctcatatttattccgaattttcaccacatggtcagctgatctcgggcggtgaaatcacggttcccaagcttttcgtgaacaattccaatggccggatcggattggtcggcttttgggatgtcgtggcctttgacgaatttgccggccgcgagaagacggccaacaaggcgctcgtagatatcatgaagaactacatggcgaacaagcagttctctcgtggtgtaaatccgatgggcgccgaggccagcttcgcctttgtcggcaacacggaccataacgtgccttggatgctgaaaaataccgacctcttcgaagctctgccgccgcagttccacgacagcgcctttattgatcgattgcatgcctatttgcccggatgggaggtcgacatcatccggggtgagatgttcacatctggctatgggttcattgttgattatctcgccgaaatcctgcgccatctgcgtgccgaggacttctcacaccggccggatcgctattttaccgtcccagttcagacccatatccgggaccgcgcagcgatcaacaagaccatgtcaggccttttgaagctgatcttcccgaatggtggcgagacagaagccgaagttgaagagttgctgcggtttgcgattgaatgccgcaagcgggtgaaagaccagctcctgcggatcgacagcaccttcgaggaagcggacttccattacatcacctcggatggcgcaaagcgcgctgtctccaccctagaggaagaggagtttcctcagttctaccatcgccgatctgccagagatggggatggcagtaaggatcaacccgagatcacgccgatcccggcgcagccgtcctcaacaccggccgcctctgacgcacctgctgatatcgttacccctgcgttcgtaccaaagcctggacatgtcgttttcacggaaaaccgcaaaggcatcagcttcgacaagatctttggtccgtggacggatggggcgacacggatcatcatcaccgacccgtacatccggaagtatcatcaggcgcgcaacgtgatggaactgatcgaaatgctgatcaggcgcaagcaacccgaagaccaggttgcggtgcatcttgtcacggctccggacgatggcaacatccaggagcagcgagagtgcctggacgggattgctgaagcctgcacaggcacgggcgtcgatttcacatgggcctttgatgggagcggcactctccatgcacgcgacatcacgacggataccggctggaagatggttctggatcgcggattggatattttccagccaacgcctcgcaagatgaacggtttctcgctcggagaacggatgcaggagcaccggatggtccgtggtttctacgtgacttatgtcgagaacctttag

SEQ ID NO: 3812 - DNA, 2085 bp, Escherichia coli; identical to SEQ ID NO: 3805

SEQ ID NO: 3813 - DNA, 2040 bp, Acinetobacter baumannii
atggaatctgctaacgataaagaactggatcagctgctgaatgaacactttgctgggcgggtggtacgtaaggatctaactaaactgatcaaagaaggggccaatgtcccggtctatgtactcgaatacctgctagggatgtactgtgcctcggatgatccagagatcattgagcagggactacgtaacgtaaagaccgtgctggcagagaactatgtacgacctgatgaagctgagaaggtgaaatccctggttcgtgaacgtggcagttataaggtcattgatcgggtgactgtaaagctgaatgagcgtaaagacaaatacgaagcatcatttagtaatctgggtatcaaagatgccgaaatctcggcaggcatcgtcaaagagtatgaaaaattacttgttggtggtatctgggtcattgctacgctcagttactattttgaagaaggacaaaccaattctccatttggggtgagtttactcaagccgattcaaatgccgaatatgaatatggatgaacttttcagtggcagagcagcattaagcacggatcagtggcgcgagagtttaatccgttcgatcggcatggaaccggcttcgctaaaagaggatgtgcaatggcacctattagcgcgtatggttccgttcgttgaaaataactataacgtctgtgaacttggaccacgcggtaccgggaaaagccatatttacaaagagtgttcaccgaacagtattttagtctcgggtgggcaaaccactgtcgccaatctgttctataacatgagtagccgccgtattggtctggtggggttgtgggatgtggtggcttttgatgaagttgccggtatttcctttaaggacaaagatggcgttcagatcatgaaagacttcatggcctcaggatcttttgcccgtggtcgtgaacagatggaagcctcagcttcgatggtttttgtgggtaatattaaccaaagtgttgaatccttggtgaagactagccacttattggctccttttcctgaagcaatgatcgattcagcattctttgatcgctttcatgcctatatcccgggttgggaaattccaaaaatgcgtccggaattctttactaaccgttatggtctaatcgttgattatctggctgaattcttccgggaaatgcgtaagcgtagttttgcggatgccattgagaagtactttaagctcggcaacaacctgaatcagcgcgatgtgattgccgttcgcaagacggtttccggattgatgaagctgctctacccacacggtcagtttaataaagaagatgtacgcctgtgtctggaatatgcactgcaggtccgccgtcgcgtcaaagagcagctgaagaaaattggtggcatggaattctatgacgttcatttcagctatatcgataatgataccttagaagaacattttgtctcagtcaaagagcagggtggtggcggactgattccagatggtccagcgaaaccaggttttctgtataccatcggactcagtaataaaggcatgcctggcttgtatcgcttagagcttcaagtcaccaaaggctcaggtaagcttgcaacttcaggcctctggaactccagcagtgccaaagaacaagtcaagattgcctttgactacttcaaagcgaacgcctctagaatatcgggtggcagcaaagtcatggagcatgacttccatctgcatgtggtggaattacagaataccgggccacttagtcatctggctttgccgagtctagtcgcttttgcttcaggcttgctcggacggtcagtacagaatcagatggtggtcctgggagatatgagcctgggtggaaacgtcacaccggttgaaagtattgctgaatgtcttcaggttgcattcgatgccggagccaagaaagtcgctttaccgatgagcagtgcggcagatatcccaaccattccagttgaactatttactaagttccagaccagcttttatgcagatccggtagatgctgtgtttaaggggctaggggtggattaa

SEQ ID NO: 3814 - DNA, 2085 bp, Escherichia coli
atgcaaacccatcatgatttacctgtttcaggcgtatccgcaggggaaattgcctccgagggttacgatctggacgccctgctgaaccagcattttgctggtcgcgtggtgcgtaaagatctcaccaagcaactcaaggaaggggcaaacgtcccggtgtatgtgcttgagtatctgctcggcatgtactgcgcctctgacgatgacgatgtggtcgagcaagggttgcaaaacgttaagcgtattctggctgataactatgtgcgcccggatgaagcggagaaagtgaagtcgctgatccgcgagcgtggttcgtacaaaatcatcgataaagtgtcggtgaaactgaaccagaaaaaagacgtttacgaagcccagctttctaacctcggcatcaaagacgcgctggtgccctcgcagatggttaaagacaacgagaagctactgacgggcggtatctggtgcatgattaccgtcaactatttctttgaagaagggcagaagacctcacccttctcattgatgacgctcaagcctatccagatgccgaatatggatatggaagaggtgttcgatgcgcgtaaacactttaaccgtgaccagtggatcgatgtgctgctgcgctcggtgggtatggagcccgccaatattgagcaacgcaccaaatggcaccttatcacccgtatgatcccgttcgtggagaacaactataacgtttgcgagctggggccgcgtggcacaggtaaaagccatgtgtataaagagtgttctcctaactccctgttagtttccggcgggcaaacgaccgttgccaacttgttctacaacatggccagtcgccagatcggcctggttggcatgtgggatgtggtagcgttcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagactctcgttaaaaccagccatttgctggcgccatttccggctgcgatgattgatactgcatttttcgaccgctttcatgcctatattcccggttgggaaatccccaaaatgcgcccggaattctttaccaaccgttacgggctgattacggattatctcgctgaatatatgcgcgaaatgcgcaaacgcagtttctctgatgcgattgataaattctttaagctgggtaacaacctcaaccagcgtgacgttattgccgttcgacgtaccgtgtcggggttgttaaaactcatgcatcccgatggcgcgtacagcaaagaagatgtgcgagtctgcctgacctatgcgatggaagttcgccgccgcgtgaaagagcaacttaaaaaactgggcggtctggagttcttcgatgtgaactttagctacatcgataacgaaacgctggaagagttttttgtaagcgtaccggaacagggcggcagcgaacttattcctgccggaatgccaaagccgggtgttgtgcatctggtcactcaggcagaaagcggcatgaccgggctgtatcgttttgaaacacagatgactgccggtaatggtaagcatagtgtatcgggtctgggttcaaatacctccgcgaaagaagctatccgcgtcggtttcgattacttcaaaggcaatttgaatcgggtaagcgcggccgcgaaattctccgatcatgaatatcaccttcatgtcgttgaactgcataatactggcccaagcaccgcaaccagtcttgctgcgcttatcgctttatgttcgatattgttggcaaaaccggtgcaggaacagatggtggtgttgggcagtatgacgcttggtggggtaattaacccggtgcaggatcttgccgccagtttgcagctcgccttcgacagcggtgcaaaacgggttctgttgccgatgtcctcggctatggatattccaacggttccggcagcgttatttaccaagtttcaggtgagtttttactcagacccggttgatgctgtttataaggcgctgggtgtgaattaa

SEQ ID NO: 3815 - DNA, 2034 bp, Enterococcus faecium; identical to SEQ ID NO: 3762

SEQ ID NO: 3816 - DNA, 2049 bp, Alcanivorax sp.
atgcaaaatgagacggataacgtgctggatctggacgccaaactggtcgagcacttccccggcaagattgttcgcaaggatctgaccaagcggctgaaagaaggcgccaacgtgccggtgtatgtgctggagtacctgctgggcatgtactgttcctcggcggatgaagagcagattgccgagggcatggatcgggtcaagcaggtgctgtcacagaactatgtgcggcccgatgaggcagagaagatcaaggcccgtatccgcgagagtggcaatttcaaaatcatcgacaaggtgacggttcgccttaacgagaagaaagaccagtacgaagccattctctccaatctgggcatcaataacgccaatatcgacagccgccaggttcatgactacgaaaagctgctggtcggcgggatctggtcaattatctccatcaagtacgattacgaggatggccagagtagttcgccgtttaccatcaaggaactgaagcctatccagatgccgaatatggatatgaatgccttgatggaggcacggcaacagtttaccgaggatgagtggctggatgtgctgctgcgctccaccgggatggagccgacgcattttgatacccgcgtgaagtggcacttgctcgcgcgtttgattccgtttgtggagaacaactacaacgtttgcgagctgggcccgcgtggtacgggtaaaagccacgtttacaaggaatgcagcccgaacagcatcctggtgtctggtgggcagactaccgttgccaacctgttctacaacatgtcacgccggcaggtggggctggtgggaatgtgggatgtggtcgcgtttgacgaagtcgccgggatctcgttcaaagacaaagacggcgtgcagataatgaaggactacatggcttcaggctcctttgcccgtggtcgtgattccatctctgccagtgccagtatggtgtttgtcggcaatatcaatcattccgtggaaacgctggtgaaaaccagccatctgttgtcgcctttccctgaggccatgatcgattcggccttcttcgaccgtttccatgcctatgtgccgggctgggaaatccccaagatgcggcctgagtttttcaccaaccagtatgggctgatcgtggattacttggcggagtacatgcgcgagatgcgtaagcgtacgttctccgatgctatcgaccagtactacaaactcggcaataacctgaaccagcgcgacagcatcgcggtgcggcgcacggtgtctggcttactgaagttgttgtacccccatggcgattacgacaaggctgctgtggagcgttgtttgcaatatgcactcgaagtgcgtcgtcgcgtgaaagagcagcttaaaaaaattggcgggatggagttcttcgatgtccatttctcttacatcgatgtcgaaacgttggaagagcaatacgtcagtgtgaaagagcaagggggtggaggactgattccagagggacaggccaagccgggtactgtctatacggtttcgactggcgccaccagcggtcacttgggcctgtaccggctggaaacccaggctaccgcaggcaatggcaagctcaacacctcgggtttaggctctagctctggggccaaagaaggcctgaaagtcgctcatgattacttcaaggcgaatgtgaatcgggtaagtacgatgacaaaggccggagactttgacctgcatttgcatatgatcgagctgcacaacaccggtccatcgaagcagatgacgctggcgtcttttattgcctactgctctgcaaccatgaagaggccaacccagaaccagatgatcgtactgggcgacatgagcctgggtggcaacattatcccggctgaaaatatggctgaggcactacaggtgggcatggacgcaggagcgaagaaggtgttgctccccatggccaatgcccaggatatcccgacggtgcctgctgagttgttctccaagtatcaggtgagtttttactctgatccggttgatgcggtgtttaaggctttgggcgtggagtga

SEQ ID NO: 3817 - DNA, 2052 bp, Vibrio cholerae; identical to SEQ ID NO: 3740

SEQ ID NO: 3818 - DNA, 2052 bp, Vibrio cholerae; identical to SEQ ID NO: 3740

SEQ ID NO: 3819 - DNA, 2076 bp, Escherichia coli
atgacaactgatttttcacaagatcataaagacgaaaaaaatcagatgcaaagcgccgatttagacgcattgctcaaccaatattttaaaggccgtgtcgttcgaaaagatctgacaaagcaattgaaagaaggcgctaacgtccctgtctatgtgcttgagtatttactaggcatgtattgtgcgtccgatgacgacgaagttgtaatgcaaggccttgataatgtgaaaaaaatcttgactgagaactatgtccgaccagatgaagcggagaaagtgaagtcactgatccgtgaacgcggcatgtttaaaatcatcgacaaagtaagcgttaagctcaatcagaaaaaagacgtctatgaagctgcgttgtcgaacctgggtatcaaggatgcccttgtaccgaccaaaatagtacaagacaacgaaaaattattaactggcggcatctggtgcattattaccgtgcagtatttctttgaggaaggtcagaagacatcacctttctccattatgagtttaaaaccgatacaaatgccgtccatgaacatggatgaggtgttttcaaccagaagacattttagtaccgatcagtggatggatgtgttgcttcgttccgtgggtatggagccaaccaacttagagcatcgggtgaaatggcatcttatcactcgcatgatcccattcgttgaaaacaactacaacgtttgtgagctcggaccaagagggacaggtaaaagccatgtctacaaggagtgctcaccaaactcattgcttgtctcgggcggacaaacaactgtggcgaacttgttctataacatgagctcgcgccaagttgggttggtcggaatgtgggatgttgtcgcctttgatgaagtagcgggtattaactttaaagacaaagacggcgtccaaataatgaaagattatatggcgtcagggtcttttgcccgtggtcgtgattcaatcgaagcgaaggcttccatggtattcgtcggtaacatcaatcaaagcgttgagacactggtgaagaccagtcatctattggcaccttttcctgatgccatgattgacactgctttttttgaccgtttccattcctatattcctggatgggaaataccgaagatgcgtcctgagtttttcaccaatagttacggattaatcacagactatcttgctgaatacatgcgtgaaatgcgcaaaagaagttttgcggatgcgatcgataagttcttcaaactcggtaataaccttaatcagcgtgatgtcattgctgtacgcagaacggtttcgggcttgttaaagctactacaccccgacgcacagtacacaaaagatgatgtaagagcctgcctgacctatgcgctggaaactagacgtagggtcaaagagcaattgaaaaagcttggcggaatggaattttttgatgtgcactttagctacatcgataacgagtcattagaagagttcttcgtcaatgtaccggaacaaggtggcagcaagctaattcctgagggcttacctcgcgctggtgtcgtacacttagttactcagggaagcactgggcagcttgggttatatcgctatgaaacccagatgatggctggttctggtaaacactcagtgtctggccttggttcgaataccgcagcgaaagaagctgtgcgtgttggctttgattatttcaaaggtaacctgaatagaatcagtgcgtcggcgaagttttctgatcatgagtatcacctccatgttgttgagctccacaatacggggccaagtacaaagtcatcgctcgctgcattaattgcgttctgttcaattctgatgaaccgaccgattcaagagcagatggttgttttgggtgagatgactttaggtggtgttgtaaatcctgttcaagatcttgcaggcagtcttcagttagctatggacagtggcgcaaagcgtattttgctcccaatggcctcagcctcagatattccaacggttcctgctgagttgttctcaaaattccagatcagcttttatgcagaccccgtcgatgccgtgtttaaggcgcttggggttaattga

SEQ ID NO: 3820 - DNA, 2193 bp, Bifidobacterium bifidum
atgagccagaacggttggattgaaagtcctgaacacaacgcggatgggaattccctgaccgcgttggatgtcaagatcaccgatctgttccccggagtcaccgtccgcaaggatctggtgaacaaggtcaagggcaatgcgttggtgccctcatatgtgctggagttcctgctcagcgcatatgccacgaacaccgaccaggccagtatcgagtcgggtgtggatcgagtgcgtgccattcttgcaaacaactatgtgcatcgcgaggaagccaatcttatccagtcgaagatccgcgagaaagggagccataggattatcgaccgtgtacaggtggcccttaacgagaagaccgacctgtatgaggcgacattctccaatctcggcatcagccaggtcattgtcgatccaagccttgtaaaggcttatccgaaactgctggtgacgggcatctggtgcatgtgtcagatcggttacgcatattccggcgacccgcgcgaagtgccatggcagttgctacagctcaagcctgtgcagatgtcgcgcgatgatcgcgaaaactacatgcagcaacgttcgcaattcaccgacggcgagtggatcgatctgctgatgcaatccattgggttcaattccgatctattctccgaccgggctaaactgctgcatctggtacgcatggtgccgtttgtggaacgaaactacaatctggtcgaactcgggccgaaaggcaccggcaagtcgcacatctactcggaattctcgccgcacggcatgctcatatccggcggggaagtgacagtggccaaactgttcgtgaacaattccaacggacatctggggcttgtgggctattgggatacggtggcgttcgacgagttcgcaggcaaggccaagaaggccggccgggacttggtggacatcatgaagaactacatggccaacaagtcgttctcccgtggcgtcgagacgttccaaggcgaggcgagcatggcgttcgtaggcaacacctcgcataacgtgccgtacatgctgaaaaactccgacctgttcgaggaactgccgaaacagtatcacgatccggcattcctggatcgtattcacttctatctgccgggttgggagttcgaacagatccgttccgagatgttcaccagcggattcggtttcgttgtcgactatctggcggagattctgcacaacctgcgcgatgccgattacagcgaccggttcgaaaagtatttcgaactgtcttccacactgtccacgcgagataaggacggcatcaaaaagacgttctccggattgatgaagcttatctacccggacggcaaggccactcccgaacagatggagccgttgctgcgttgcgccatcgagggccgcaagcgtgtcaaggaccagctgtgccgcatcgactccaccatggaggaggtcgagtttacctacaagcgtgtgagcgacggcgaaatagtcgccgtgcagaccttggaagagcttgactacccgcagttgtattggcgtgggcgtgtagttgagaactcggaagatgagagcgaggcggaatcgtttgttgccggtgatgacgtggcaattgcgggtagcgagggcgaagccggtgcttctgagaacgccaatgcccttcccgtagcgaggcagcaagaaacagccgcgatgactccagtcgagcgccttgcggcaaaggccgacggaaagcagtgggaattggtcgaaaaccaacgtggaatcacgtattacaaactattcgggccatatttggctggtgcgaagaaaatcgttgtagaggatgcgtatgtgcgtaagccgtaccagctgcgtaatctggccgagttcttggaaatgctgctcagatgcaaaaattccgatgaggatgtagccgttcatctggtgaccggacataatgatcctgaattcgtggaagcgcagttaaatggtttgaacgaactggcatcgacgttctcacagctgggcgtgaacctcacctacgaattcagagacactttgcacgaccgttccattacttcggataccggatgggagattcttcccggccgggggcttgacatcttccaaaaaatcgttgacggcgattggcttaacccgctgctgcgccatcagcagctccgccgcgtcaaggaatgcaaggtcacgtataggcgaattgaacgatag

SEQ ID NO: 3821 - DNA, 2076 bp, Escherichia coli; identical to SEQ ID NO: 3800

SEQ ID NO: 3822 - DNA, 2085 bp, Salmonella enterica; identical to SEQ ID NO: 3644

SEQ ID NO: 3823 - DNA, 2076 bp, Vibrio cholerae; identical to SEQ ID NO: 3739

SEQ ID NO: 3824 - DNA, 2040 bp, gamma proteobacterium
atggaatccggtaacgaaaaagaactagatcaactgttgaacgagcattttggcggacgcgtggttcgcaaggatctcaccaagctcatcaaagaaggcgccaacgttcctgtctatgtgctggagtatctgttgggcatgtactgcgccaccgacgacccagaagtcatcgagcaaggcctgaataacgtcaaaaccgtcttgacggagaactacgtccgcccggatgaggctgagaaggtcaaatcgctagtgaaagagcgtggtacctacaaggtcatcgaccgggtgacggtgaagctgaatgagcgaaaagataagtatgaggcctccttcagcaatctgggcatcaaggatgctgaaatctcctctggcattgtcaaagagtacgaaaagctgctggtaggcggtatttgggtcattgccaccctgagctattaccacgaagaaggacaaagtggctccccatttggggtgaccttgctcaaacccatccagatgcccaacatgaacatggatgagctattccagggcagagctgcattaaccgccgaccagtggcgggaatgcttgattcggtctgtcggcatggaacctgcggcactcggtgtcgatgtacagtggcatattctggcccggatgattcccttcgtagagaacaactacaacgtctgtgagctaggtccacgcgggacaggcaaaagccatatttacaaggagtgctcgccgaacagcattctggtgtctggtggacaaacgaccgtggcgaacctgttctacaacatgagttcacgccggattggattggtcggtctttgggatctggttgccttcgatgaagtcgccggcatctccttcaaggataaagatggcgtccagatcatgaaggactatatggcgtctggttcttttgctcgcggccgtgaacaaatggaggcctcggcctctatggtgtttgtgggcaacataaatcaaagcgttgagtccttggtgaaaaccagtcacctgttggcgccgttccccgaagccatgatcgattcagctttctttgaccgtttccacgcctacatccctggttgggaaattcccaagatgcggcctgagtttttcaccaaccgctacggcctcattgtggactacctggcagagttttaccgtgagatgcgcaagcgcagctttgccgacgccatcgagaagcactttaagctggggaacaaccttaatcagcgtgacgtcatcgctgtccgaaaaacggtgtccggtctgcttaaattaatgttcccacacgggaaatatgagaaggatgacgtgcgccagtgcctagagtatgcccttcaagttcggcgtcgtgtgaaggaacagctcaagaagatcggtggcatggaattctacgatgtccatttcagctacatcgataatgaaacactggaggagcatttcgtctcagtcaaagagcagggcggcggcggtctgatcccggaaggccctggtaagccgggcttccttcacaccataggcctcagcaataaggggatgccaggcctgtatcggctggagcttcaggttacgaaaggctccggcaagctggcaacatccgggctatggaactccagtgcagccaaagagcaggtgaagattgccttcgactatttcaaggcaaatgcttccagaataagcggaggtgccaaggtgggagagcacgattttcatctacacgctgtagagcttcaaaataccggacctttcacccatcttgccctctctagcctagtggcctttgcttcggggctactgggccgcccagcgcaatctcagatggttgttctgggcgatatgagcttgggtgggtccgttacgccagttgaaagcctcgccgagtgcctgcaagttgcttttgatgcaggggccaagaaggtggcgttgcctatgagcagtgcagcagacatcccgactataccagctgagctattcaccaaattccagactagcttctacgccgatccggtggatgcggtatttaaggcgcttggggtggattaa

SEQ ID NO: 3825 - DNA, 2076 bp, Pseudomonas psychrotolerans
atggataccctggatcagaagctcacatcgacgttcgacggcaaggtagttcgcaaggatctgctgcaccgaatcaagaagggtaccaacgtcccgacctttgtgctggagttcctgctggcgcgcttctgtgccagtgacgatgatgcggagattcaggctggcctggaggcggtgctcgacactctgaatgagaactacgttcggcccaacgaagcaaacgcagctcagtcgaaggtggctacaaagggcaagcaccgcttcatcgacaaggtgcacgtcaactatgtcgaaaaagatcgccgtcactgggcagccttggagaacttcgactcgcgcaaagttgccatcagcgaaaagtactaccgcgaccatgatcgtcttttacagggtggtttgtgggcagaggtggctctggccttcaacgaaatcgaagacgatgactacgccttctatatcgaagatctgcgccctatccagatgagccgcttcgacttcgtgcgttactgcgaagggcgcgagcagttcactcgggacgagtggttggatgtagttttacgctcggtggggttggagccgagcaagctgtctccgcgtgtgaagttgcactttattgcgcgtttggctcctctcattgagcccaactacaacttcatcgagcttgggccgcgaggtaccggtaagtcctatttcttcagtgaattttcgccgtactcgacgttgatcagcggtggtcaagcaaccaaggcgacgctgttctacaacaatcagcgccataagatcgggttagtgggttactgggacacagtcgcttttgacgaggtgggtgggctcaaggtcaaggatcaggacaccatccagatcatgaaggacttcatggccaacgggcgtttctctcggggcgttgaggttattgccgatgcttccatggccttcgttggtaacctcgatctctcggttgagcaggtggtcaactcggaagtccatgatctgttccagccgctgccgaaggagttcgacctggcggtacaggatcgctttgcttgctacctgcctggctgggagatgccgaagaacagcagcgagtttctgaccagccattacggcttcatcacggactatctggccgaagccttccactaccagttgaagcagaccaatcgatacgaggaggtcagcaagcgaatcaagctgggtagggcggttgagggccgggatgaaaagggcattaagaagacggtatgcgcctttttgaagatcctccacccggatggagctccgtctgatcaggagttcgctgaatatgtggcctacgctgtagaggggcgacgtcgggtcaaggagcagatgaataagcgcaagaccgatgacgagtacgcgcggatcaacctttcttacatcgatgcttcaggtaacgatgtggtggtgtactgccctgagtcacgcagtgcacttgcaactcaggagccgattcggaagagcattcatgctggctcgggtgacgagccgctaacggcagtggtaccctctgatcagccggttgtcccagctgaaacggttgtccaacagcctgtcttagcggcaactagcaacgaaacagtgctgcaagagcagcattacaccatccactacggtgatacgggctacagctacgagtcgattttgctcccttacttgcagggagcgaagattgtagaaatcgaagacccttatattcgagctaatcaccagatccataattttgtgcgcttctgcgaggcggtgatcaagtcgcccacggtcagggcaatcaagctgacgaccagctatgaccaagataccgatctcaaggatgtcgctgagcgtctagaggagcttaagcagagccttctagagatggatattgcgttagaaatcaagatcaacgagaacctacatgatcgagagatccggctcgataacggctgggtgatcaagatcggtcgtggtcttgacttcttccagaagcccgatagctggttcggcattggcgcgaatgacctgactctgcggcgttgcttggagactaaagtcgacatcttcaaagctaaggcgtga

SEQ ID NO: 3826 - DNA, 2052 bp, Acetivibrio cellulolyticus
ttggaaaacataaatgagcaagctgttgatttggacaaaaagctaaatacttattttgctggaagagttgtcaggaaagacttgacaaagcttataaaagagggtgcaaatgtacctgtatatgtgctcgaatatcttttggggatgtactgtgctactgatgacgagaagagcatagaagagggtgttgagcgggtaaagaagattctggctgaaaattttgtaagaccggatgaagcagaaaaagtgaaatcgaagattaaagagatgggacattattccataatcgataaagtatctgtggcgttgaatgagaaaaaagaccagtacgaagctgagttttcaaatcttggcttaaaacgtgtgcctatttcagcaagctatgttaaggagtttgacaagctgttggtaggcggtatatggtgcataatgaaaatggattactattttgatgaagaggcaaaaggacaaagcccctttaacattagcagtctaaagccgatacagatgcccaatatggatatcagtgagatttttgaagggagaaagaatttttcaaaggatgaatggatagatgttttaataagatctaccggtatggaaccgacacaattagagaacagggttaaatggcatcttttactaaggttggtgcctttagttgagaataattataatacttgtgaattaggtccaagaggaacaggcaaatcgcatgtttataaagaaatatcgccaaacagcattcttatttccggagggcagtctactgttgctaatcttttttataatatgtccacaagaaaagttggtttggttggtatgtgggataccgttgcatttgacgaggttgctggtatcaacttcaaagacaaagatggtattcagataatgaaggatttcatggcttcaggttcttttgcaagggggaaagaagaaaagaatgcttctgcctctatggttttcgttggaaatatcaatcagagtctggatactttgataaaaacatcacacctttttgcaccattccctgatgagatggcgaatgacagtgccttctttgaccgaatgcactattatattccgggttgggaaattccaaaaatgagacctgaattttttacagatcgttacgggtttattgttgactacatggcggaattctttagagaaatgaggaaaagatcttttgcagattctttggacaagttctttaagcttggcaataatttaaatcaaagggatgtaattgctgtaagaaaaacagtttcaggtcttgtaaaacttctctatcccaatggagaatattcaagtgaagatatcgaagaaatccttaagtatgcactagaaggccgaagaagagttaaggagcaattaaagaaaataggaggaatggaattttatgatgttcatttttcttatataaataaggaaaccttagctgaagaatatgtttcggttccagaacaaggtggaggtaagctcatcccggaaggaatggggaaaccaggccatgtttatactgttggccatggagattctggaatgattggtgtctataagcttgagaatcaagtggtctctggttctggcaaatttgacaaatcaggtgtaggatcgcataggggtgctaaggaagctcttgacactgcgtttagatatttcaccgcaaacagtaaaagtataagtgcttcgataagtaccaagacaaaggattttttgatgcatataagtgaccttcagggcattggattaacggaagagttggctattgcagaattgattggtttgtgttctggagccctagaaagagcaatacaggagagcacagtggtgttgggaaatatgacagtcggaggcactatttcgaaggttgaggagtttgcaaatacattgcaggtgtgtgtggatgcaggtgcaaagaaggtactgattccagcagcttcggttgttgattttcagactgttcctgctgatctattgattaaggttcagccaattttttattctgatcccattgatgctgtgtttaaggctttaggggcgatgtga

SEQ ID NO: 3827 - DNA, 2034 bp, Enterococcus faecium; identical to SEQ ID NO: 3762

SEQ ID NO: 3828 - DNA, 2052 bp, Vibrio cholerae; identical to SEQ ID NO: 3740

SEQ ID NO: 3829 - DNA, 2085 bp, Salmonella enterica; identical to SEQ ID NO: 3644

SEQ ID NO: 3830 - DNA, 2052 bp, Vibrio cholerae; identical to SEQ ID NO: 3740

SEQ ID NO: 3831 - DNA, 2016 bp, Fusobacterium nucleatum
atggatataaatgaaattggaagtaaggtttttgaaggaaaaattgtaagaaaggatttagtttcaaaaataaaaggaggagcaaatgttcctgtctatgttttagaatatttacttggaatgtattgtaatcaaactgatgaagaaagcattgaagagggtatgtcaaaagtaaaaaaaatacttgctgaaaattatgttcgccctgatgaagcagaaaaagtaaaatctaaaataaaagaaattggagtatacaatgttattgataaagtaactgttattttaaatgaaaaaaaagatagatatgagggacatctttcaaatttaggtgttagcaatattgaaattcataaaagctatataaaggattatgaaaaattactgagtggtgggatatggtgtattctgactttatcatatcaatatgatgaatataatgccactgattctccatttaaactaaataaattaaaacctattcaaattgcaagtttagatatgaatgaagtttatgaagctagaaaacattttaccaaggatgagtggataggctttatattaagatcgtctggaatggaatttgaaaattttgataaagatgcaatatggcatttattagctagaatgatgccacttgttgaaaataattataatctttgtgaattaggtccaagaggaacagggaaatcgtatatttataaagaaattagtcctaattctattttgctttcaggaggacaaacaacagtagcaaatcttttttataatatgtcaaaaagacaagtaggtctggttggctattgggatgttgttgcttttgatgaaattgcaggaataaaatttaaagataaagatggcattcaaataatgaaagattttatggcaagtggttcttttgcaagaggtaaagaagaaaaaaatgccaatgcttctatggtctttataggtaatataaatcaaagtgttgatgttttagtaaaaactgcacatcttttagttgattttcctcctgaaatgaataatgattctgcattttttgatagaatgcattgctatataccaggttgggatattccaaaattatctccaaaatcttttaccaaagaatatggcttgattgttgactatatggcagaaatatttagagaacttagaaaaacttcgtatggagatgcattggataggtatttttcacttggtagggacttaaatcaaagagatactattgcagttagaaaaacggtttctgctttaataaaattggtttatccagatggaatatttataaaagaagaagttgaagaaattttaataagagcattggaatatagaagaagaataaaagagcaattaaagaaaatggctggaatggaattttttgcaactaatttttcatatatagataaggaaagtggagaagaaaaatatgttggtttaaaagaacaaggtggaagtaaacttattcctgaaggtcctttaaaagctggagcattatataccattgcaatgtcaactaattctgtaaaaggactatacaaaatagaaagtcaaatatctgctggtaagggaaaaataactgtgtcagataataaatatagaaaaacttttgaaaatgcttttaactatttaaaaataaattctaaaagaataagtggagcaataaatatcagtgaaaaagaattttatttatctgttgctgatgaaaagaatgtaggtaatacagaaactataactttgggtggttttattgctatgtgttctatctctttaaatagacaattaatgcctcaaacagttatattaggtgaaatggctttatcagggtctattaatgcagtttcagatttggctagtacacttcaaattgctagagaagcaggagcaaaaaaagcattgattccaattttaaatgctgttgatatgtcaacactgccacccgatattttaatggatattcagcctattttttatcaagatcctattgatgcaactcaaaaagcattgggacttatgtaa

SEQ ID NO: 3832 - DNA, 2016 bp, Fusobacterium sp.
atggatataaatgaaattggaagtaaagtttttgaaggaaaaattgtaagaaaggatttagtttcaaaaataaaaggaggagcaaatgttcctgtctatgttttagaatatttacttggaatgtattgtaatcaaactgatgaagaaagcattgaagagggtatgtcaaaagtaaaaaaaatacttgctgaaaattatgttcgtcctgatgaagcagaaaaagtaaaatctaaaataaaagaaattggggtatacaatgttattgataaagtaactgttattttaaatgaaaaaaaagatagatatgaaggacatctttcaaatttaggtgttagcaatattgaaattcataaaagttatataaaggattatgaaaaattattgagtggtggaatatggtgtattctgactttatcttatcaatatgatgagtataatgccactgattctccatttaagctaaataaattaaaacctattcaaattgcaagtttagatatgaatgaagtttatgaggctagaaaacatttcaccaaggatgagtggataggctttatattaagatcatctggaatggaatttgaaaattttgataaagatgcaatatggcatttattagctagaatgatgccacttgttgaaaataattataatctttgtgaattaggtccaagaggaacagggaaatcatatatttataaagaaattagtcctaattctattttgctttcaggaggacaaacaacagtagcaaatcttttttataatatgtcaaaaagacaagtaggtctagttggctattgggatgttgttgcttttgatgaaattgcaggaataaaatttaaagataaagatggcattcaaataatgaaagattttatggcaagtggttcttttgcaagaggtaaagaagaaaaaaatgccaatgcttctatggtctttataggtaatataaatcaaagtgttgatgttttagtaaaaactgcacatcttttagttgattttcctcctgaaatgaataatgattctgcattttttgatagaatgcattgctatataccaggttgggatattccaaaattatctcccaaatcttttaccaaagaatatggcttgattgttgactatatggcagaaatattcagagaacttagaaaaacttcgtatggagatgctttggatagatatttttcacttggtagggacttaaatcaaagagatactattgcagttagaaaaacagtttctgctctaataaaattagtttatccagatggaatatttacaaaagaagaagttgaagaaattttaataagagcattggaatatagaagaagaataaaagagcaattaaagaaaatggctggaatggaattttttgcaactaatttttcatatatagataaggaaagtggagaagaaaaatatgttggtttaaaggaacaaggtggaagtaaacttattcctgaaggtcctttaaaagctggagcattatataccattgcaatgtcaactaattctgtaaaaggactatacaaaatagaaagtcaaatatctgctggtaagggaaaagtaactgtgtcagataataaatatagaaaaacttttgaaaatgcttttaactatttaaaaataaattctaaaagaataagtggagcaataaatatcagtgaaaaagaattctatttatctgttgctgatgaaaaaaatgtagggaatacagaagctgcaactttgggtggttttattgctatgtgttctatctctttaaatagacaattaatgtctcaaacagttatattaggtgaaatggctttatcaggatctatcaatgcagtttcagatttggctagtacacttcaaattgctagagaagcaggagcaaaaaaagcattgattccaattttaaatgctgttgatatgtcaatactgccacctgatattttaatggatattcaacctattttttatcaagatcctattgatgcaactcaaaaagcattgggacttatgtaa

SEQ ID NO: 3833 - DNA, 2055 bp, Lactobacillus casei
ttgacatctgatagcgcgcacgaggaaacttctgaaaatgaagcaactttaatcaagttggaacaaaactttcctggacgttttgtccgaaaagatctaacgcaaagaatcaaggaaggcgcaaatgtgccaacttatgttcttgagtttttattggggcagtttgcgaatagttcggatacggagacgattgagcgcggcgttgagaatgtcaaaaaaacgttggcgcataattatgtccgacctgatgaggctgaaaaagtaaaatctaagattcgagaagatggtgcttatacagtcatcgacaagctttcagttcgtttgaatgaaggtgaagatcggtatgaagcgagcttcagcaatcttggcttaacgggcgtgccggttgacgagcattatgtgcaagattatgagcgtttgttgattggaggtatttggtcaattgtgcgcgttagttacgatcacgaaagccttgaccatttctcaattcaaaaactgaatcctattcaagtaccatttgttgatatgcaagaagtctacgccggaagaaaggcattcaccactgaagagtggctggatgttttattgcgaacaacagggatggagccaactcaatttactgagcgcgaaaagtggttgttactttctcgattaatcccctttgttgaaaataattacaattttgtcgaattaggccctcgtggcacaggcaaatcacatgtttataaggagctctcgccggactcaattctgatttcaggtggccagacaacggtcgccaacttgttctataacatgtctagacgtgaagtgggacttgttggcatgtgggatgtcgtggcattcgatgaagtggctggaattcatttcaaagataaagatggcgtgcagattatgaaggattatatggcttcgggatcatttgcacgtgggcgaaatgagattcaagcttcagcaggaatggtgtttgtcgggaatatcaatcagagtgttgatgtccttttgagaacttccaatctctttgaaccttttcctgagatgatgggcaatgatacggctttcttggatagaattcataactacttacctggttgggagatccctaagtatcggcctgagttctttaccaaaggatttggatttatcactgattattttgcagaggtaatgcgcgagctccgtaaaatttcttatgcagatgcgattgacgagtatttttcgtttggtaaacagcttaaccagcgtgacgtgattgcggttcgtaagactgtttctgggcttatcaaattactttatccagacggtgtgtttgaaaaagcagacgttgcgaaaattcttgaatttgctatggaaatgcgtcgtcgagtaaaagaacaactcaaacgaatcgggggcatggaattctatgatgtcaacttttcttatattgataagacgacctttgaggaaacttatgtctcggttccggaaactggatcaagttcgctcattcctgatggtcaagaaaatcccggccatgtttatactgttgcttatgacgagagtaaacggcttagtctgatcaaattagaaacacaggtcgttccaggacttggtagactgagtaaatcgggcgtcggatcaagtacaaaagctaaagaggcaatggacacagcctttaagtatcttgaggccaactataaaggaattgatcaacgaattaatgccaacgcccgtgatttcgtggttagcgcgactaatttgaataattcagttccatctagccatatttctttggcgacatttatcgcgctagtttcgatcgcattagggaaaccgacactagatcgtttagttatcttgggtgatttcacgattggcggaacgatttcacgcatcgatgatcttgccgatacattgcaagtcgccttggacggtggagcaaaacgtgtcttgctgccagctgcagcggccagcgacatcagcggtgtgccaacagatctgatgagttcatttaacttgatcttttataattcggttaaagatgcggcttttaaggccttgggtgtgagctag

SEQ ID NO: 3834 - DNA, 2085 bp, Escherichia coli; identical to SEQ ID NO: 3805

SEQ ID NO: 3835 - DNA, 2040 bp, Acinetobacter sp.; identical to SEQ ID NO: 3648

SEQ ID NO: 3836 - DNA, 2052 bp, Vibrio cholerae; identical to SEQ ID NO: 3740

SEQ ID NO: 3837 - DNA, 2064 bp, Holdemania filiformis
atggaatcaacaactgggggcgaaagttcccgtgaaatcataaaggacaaactgcgccagaactttgatggtaaaattgtccgtaaagacctgacaaagaaaatcaaggaaggtgccaatgtacctgtttacgtccttgagtttctgttggggcaatattgtagctcggatgatgatgaagtcatcgaacagggcgtacagaatgtaaagcggattctggcggataactttgtccgtccggatgaggcacagaaaatactgtccatgcttcgacagcgtggcagccacaccgtcatcgataaaatcacggttagcctgaacatcaaaaaggattgctatgaagcggagttctctaaccttggtttgaagaacattcccatcggtgaggagtatccgacaaagttcgacaggcttctctgcggcggtatctggtgcatcgtgcagctggattatgagtatgtggaggaagataaaaagaacggtacacctatccgcatccgcaagctaacaccaattcagatgccccatgtagacattgatgagttgaaagcaggcagaaaagcattcacaaaagatgagtggatggatgtgcttctccgttccatcggcatggagccggacgaattacagtaccgggagaaatggctgctgctggctcgtatgctgccgcttgtagaaaataatttcaatttgtgtgaattaggacctcgtagtacagggaaatcacacttatttaaagaaatctctccgaacagtattctggtgtccggtgggcagaccacggtagccaacttgttttataacattggaagaaagactgttggtttggttggaatgtgggattgtgttgcctttgacgaggtggcaggcatcaacttcaaagataaagacggcatccaaatcatgaaggactacatggcatccggttcctttgcccgtggcaaggaagaaaaggctgcctcggcttcaatggtgtttgtgggcaatatcaatcagagcgtggatgtgctgctgaagacatccagcctctttgacccgttccctccagagatgggaaccgataccgcattccttgaccgtatgcattgctacataccgggctgggagattccaaagttcagaccggagcatttcacggaagactatggatttatcacggattatctggcggagtttattcgggagctgcgcaaggaacagtatggtgatgccctcgacaaatactatcgtctgggcaagaacctgaaccagcgtgataccattgcggtgcgtaagatggtcggaggcttcctgaagctgatatatccagatggcgtgttcaccaaagaagaactggaggaagtgctgcagctttccttggagatgcgtcgccgtgtcaaggagcagctgaaaaagctgggcggtatggagttctacgatgtgaatttctcctacatcgacaacgagacctttgaggaacactatgtgtccgtgccggagcaagggggtggtaagctgataccggaggggatgtgcaatccgggtcaggtctacacggtatcgcagggcaagtccggcatgataggcgtgttccgcttggagagccaaatactgccgggaagcggcaaatttgagcgcacaggcattggctctgacagggattgcaaggaagcaacgaacacggcattcaatttcctgaaggcaaatgggagtcgtatcagtggctcgattagtacaacgacaaaagattatatcatcaattatcaggatttacagggtatcggaatgaccagtaagctggcattgcctaccctcattgctctttgctccatcgctcttggaaagcctgcgcttgggtcactggctgtactgggtgaaatcagtatcagcggtacgctcatcaaggcggatgagcttgctaactccctgcaggtgtgtttggacagtggtgcaaagaaggtgttgataccagcgacttcgatgattgactttgccatggtgccgccggatttgatgagcgcatttcagctcatcccgtaccagagtgcggaggatgcggtgtttaaggcattgggcgtagaataa

SEQ ID NO: 3838 - DNA, 2034 bp, Enterococcus faecium
gtggaacaacaggaaattttaaagttatctgaattctttcccggaaagattgtcagaaaagatttaacaaagaaaattaaagaaggtgcgaatgtacctgtttatgtattggaatatttacttggtatgtatgcttcgtcattggatgaaacattggttgaaaaaggtgtagaaaatgttaaaaatatacttgctcgaaactatgtgcgtcctgatgaagcagaaaaagtaaaagctaaaattcgtgaattgggtggctatacagttattgataaagtaactgtacatttaaatgaaaagaaagattgctatgaagcagaattctctaacctcggattaaaaaatgttcaaattagtgaagaatatccgaaaaaatttgatcgattattaggtgggggaatctggtgtattgtttcgatggaatattggtatgacgagaatgatcgttggaatagcccttttattgcaaaaaaggttgatccaatccaaatgcctggtttagatattgaggcttacaagatggctcgcaaagagtttactacagatgaatggattgacttacttctacggtccattggtatggaacctacacaatttaataaaagggtaaaatggcttcatttagcaagacttattccattaattgaaaataattttaatctctgtgaactaggaccacgtggtacaggtaaatcgcatgtatataaagaaatttcaccaaactcaatccttgtttcaggtggacaaacaacagtagcaaaccttttttataatatggctagtcgtacaatgggacttgtaggtatgtgggactgtgttgcttttgacgaagttgctgggattaaatttaaggataatgatggcgttcaaatcatgaaagattacatggcttcaggatcttttgctagaggcaaagaagaaaagaatgcttcagcatcaatggcttttgtaggaaatattaatcaaagcgttgatgtaatattgaaaacttcgaatttatttgagccatttccggaggttatggggacggattcagcctttttggatcggatgcattgttatttaccaggttgggaaattcctaaatatcgaccagacttttttacaaatgactatggcttcattacagattatttttctgaagtcatgcgtgagcttcgaaaagttagttttggggatagttttgataaatatttcaaacttggttctcaattaaatcagcgggatactattgcagttcgtcggattgtatctgggatgatgaaactgttgtatcctgatggtagatttgaaaaaagtgatgttgaagaaatactaagatttgctcttgaaatgcgtcgtcgtgtaaaagaacaattaaagaaaattggtggaatggaattttatgatgtcaatttttcatacattgatttagaagaagagcgagaagagtatgtttctgttcctgaacaaggtggaggaactttgattccagaagggttaggaaagccagggcatttgtacacggtatcttatggcaaaactgggcaattaggtacctataaattggaaacgcaaatgacttcgggaaatggtaagtttgaacgtactgggatcaattcagatgctggagcaagagaagcgatggattcggcataccgatatttaagagctaattatggaagtgttagtcagtctattagtttgacgacaaaagactttgtcgtacatgtccaagatatgaatggcattggtatgacaaaaacattatcgttaccaactataatagctttatgttcagtttccttaaacaaacctgtattaccaagtttagttattttaggtgatattacaattggtggatctatgattaaggtagataatttagctaactgtttacaagtagcaaaagatgccggagcgaaaaaagtacttgtacctatgataagcgctgctgatattggaactgtacccccagaattaatgggtacctttaatttgattttttatcaaacgccggaagatgctgtctttaaagcccttggggtggaatag

SEQ ID NO: 3839 - DNA, 2016 bp, Fusobacterium sp.
atggatataaatgaaactggaagtaaagtttttgaaggaaaaattgtaagaaaagatttagtttcaaaaataaaaggaggagcaaatgttcctgtttatgttttagaatatttacttggaatgtattgtaatcaaactgacgaagaaagcattgaagagggaatgtcaaaagtaaaaaaaatacttgctgaaaattatgttcgccctgatgaagcagaaaaagtaaaatctaaaataaaagaaattggagtatacaatgttattgataaagtaacagttgttttaaatgaaaaaaaagatagatatgagggacatctttcaaatttaggtgttagcaatattgaaattcataaaagttatataaaggattatgaaaaattattgagtggtggaatatggtgtattctgactttatcttatcaatatgatgaatataatgccactgattctccatttaagctaaataaattaaaacctattcaaattgcaagtttggatatgaatgaagtttatgaggctagaaaacattttaccaaggatgagtggataggctttttacttagatcatctggaatggaatttgaaaattttgataaagatgcaatatggcacttattagctagaatgatgccacttgttgaaaataattataatctttgtgaattaggtccaagaggaacaggaaaatcatatatttataaagaaattagtcctaattctattttactttcaggaggacagacaacagtagcaaatcttttttataatatgtcaaaaagacaagtaggtctagttggctattgggatgttgttgcttttgatgaaattgcaggaataaaatttaaagataaagatggtattcaaataatgaaagattttatggcaagtggttcttttgcaagaggtaaagaagaaaaaaatgcaaatgcttctatggtctttataggtaatataaatcaaagtgttgatgttttagtaaaaactgcacatcttttggttgattttcctcctgaaatgaataatgattctgcattttttgatagaatgcattgttatataccaggttgggatattccaaaattatctcccaaatcttttaccaaagaatatggcttaattgttgactatatggcagaaatatttagagaacttagaaaaacttcgtatggagatgctttggatagatatttttcacttggtagggacttaaatcaaagagacactattgcagttagaaaaacagtttctgctttgataaaattagtttatccagatggaatatttacaaaagaagaagttgaagaaattttaataagagcattggaatatagaagaagaataaaagagcaattaaagaaaatggctggaatggaattttttgcaactaatttttcatatatagataaggaaagtggagaagaaaaatatgttggtttaaaagaacaaggtggaactaaacttattcctgaaggtcctttaaaagctggagcattatataccattgcaatgtcaactaattctgtaaaaggactatacaaaatagaaagtcaaatatctgctggtaagggaaaaataacagtgtcagataataaatatagaaaaacttttgaaaatgcttttaactatttaaaaataaattctaaaagaataagtggagcaataaatatcagtgaaaaagaattctatttatcagttgctgatgaaaagaatgtagggaatacagaagctataactttgggtggttttattgctatgtgttctatctctttaaacagacagttaatgcctcaaacagttatattaggtgaaatggctttatcaggttctattaatgcagtttcagatttggctagtacacttcaaattgctagagaagcaggagcaaaaaaagcattgattccaattttaaatgctgttgatatgtcaatactgccacctgatattttaatggatattcaacctattttttatcaagatcctattgatgcaactcaaaaagcattgggacttatgtaa

SEQ ID NO: 3840 - DNA, 2031 bp, Clostridium butyricum
atggatgaattaagtataaaacttaaccaaagttttgctggtaaggttgttagaaaagatttaacacaaaaattaaaacaaggtgctaatgttcctatatatgtacttgaatacttacttggaatgtattgtgctactgatgataatgatagcattaacgctggtgttgagagagttaaaaatatattagcagataattttgttagaccagatgaagcagaaaagattaaatctaaaattagagaaatgagtagatatactgttatagataaattaacagttaaacttaatgagaaaaaggatatctatgtagcagagttttctaatttgggcttaaaaaatgttgagataagttcaaagtatgttaaggattttgagaaacttttaggtggagggatatggtgtattgcaaaactacaatacttttatgaagatggagtaatagatcaaaatccatttattatagaatcagtaactccaattcaaatgcctaatatggatatggatgagttaatagaaggaagaaagcagtttaataaagaagagtggatagatatacttattagaagtatagggatggagcctacgcaacttgaaaataaggttaaatggcatatgcttttaagaatggtgcctctatgtgaaaataactataatatgtgtgaattaggaccgaggggaactggtaaatcacatttatataaagaaatatcaccaaactcaatattagtttcaggtggtcaaactacagtagcgaacttattttataatatgtctcaaagaaaaattggacttgtaggaatgtgggatacagtagcctttgatgaagttgcagggataacatttaaagataaagatggaatacaaataatgaaggactatatggcatcaggttcttttgcaagagggaaagaagaaaaggcggcatctgcttctatggtttttgtaggtaatataaatcaaagtgtagatgtgcttttaaaaacatcacacctttttgaaccattcccagaggctatggcttatgatagtgccttctttgatagaatgcattattatttaccaggatgggaagtgcctaaaatgagaccagaacttattactaatagttttggatttataacagactatttggctgaatacttaagaacaatgagaaaaagaacttttggagatactattgataagttctttaaattaggaaataacttaaatcaaagagatgttattgctgtaagaaaaacagtatcaggtttagtaaaattactatatcctcatggtgaatattcaaaagaggatatagaagagatattaagatatgctttagttggtcgtagaagagttaaggagcagttaaagaaaataggaggaatggaattttatgatgtacatttctcttatatagataatgaaacaatggaagaagaatttatatcagtaccagagcaaggtagtggaacattaataccagaaggggtttcaaaatcaggtcatgtttatactattggagttggtgattctggaatgattggtgtgtacaaattagaagtagaagttgttggtggaacaggtaagtttgaaaagactggacttggatatgatagagaggctaaagaaagtatagaaacagcatttagatactttaaggctaatagtaaaagtattagtgcttcaatatcaacaactaataaggactacttaatgcatatacaagatgttaatggggtaggaatgacttctagcctatcattagcagcgattatagcaatgtgttcaggagcgttaaataaaccagtacaaagtcaattagcagtattaggttctgtaagtataggtggaacaataaataaagtagaagatttggcaaatgcattacaagtatgctttgatgcaggtgcaaagaagatattactgccaatggtcaatgcagcagatataccattagtaccaccagagttgtttgctaagttccaaataatgttctatagtggtgctgaagatggtgtgtttaaggcattaggagtatcttaa

SEQ ID NO: 3841 - DNA, 2040 bp, Acinetobacter baumannii
atggaatctgctaacgataaagaactggatcagctgctgaatgaacactttgctgggcgggtggtacgtaaggatctgactaaactgatcaaagaaggggctaacgttcctgtctatgtactcgaatacctgctagggatgtattgtgcctcggatgatcctgagatcattgagcagggactacgtaacgtaaagaccgtgctggcagagaactatgtacgacctgatgaagcggagaaagtaaaatccctggttcgtgaacgtggcagttataaggtcattgatcgggtgaccgtaaagctgaatgagcgtaaagacaaatacgaagcctctttcagtaatctaggtattaaagatgctgagatttcggcaggcatcgtcaaagagtatgaaaaattactcgttggtggtatctgggtgattgcaacactcagttattattttgatgaaggacagtcaaattctccatttggtgtgagcctactcaagccgattcaaatgccgaatatgaatatggatgaactcttcagcggcagagcagcattaagcactgatcagtggcgcgagagtttaatccgttcgattggtatggaaccagcttctttaagagaggacgttcaatggcacctattagcgcgtatggttccgttcgttgaaaataactataacgtttgtgaactgggaccacgcggtactgggaaaagtcatatttataaagaatgttcaccgaatagcattttagtctctggtggacaaacgactgtcgccaacctgttctataacatgagtagtcgccgtattggtctggttggcttatgggatgtggtggcctttgatgaagtcgctggtatttcctttaaggataaagatggcgtacagatcatgaaagactacatggcctcaggatcttttgcacgtggtcgtgaacagatggaggcctcggcttcgatggtttttgtggggaatatcaaccagagtgttgagtccttggtcaaaaccagccatctattggtacctttccctgaagccatgatcgattcagcattcttcgatcgttttcatgcatatattccaggttgggaaattccgaagatgcgcccggagtttttcaccaaccgttatggcctgatcgttgattatctggctgaattcttccgggaaatgcgcaagcgtagctttgccgactcgattgaaaagtacttcaagttgggaaataacctgaatcaacgcgatgtgattgcggttcgtaagactgtatctggtttgatgaagctgctctacccccacgggcagtttaacaaagaagatgtgcgtcaatgtttggaatacgcccttcaggtgcgtcgtcgagtcaaagaacagctgaaaaaaataggtggcatggaattctatgacgtgcatttcagctatatcgacaatgacacacttgaagagcactttgtttcagtaaaagagcagggtggtggggggctgattctcgaaggtcctgctaaaccaggttttctgtataccatcggactcagtaataagggcatgccaggcttataccgcctagaattgcaagtcaccaaaggttcaggaaaattggcaacatctggtttatggaattcaagtagcgcaaaagaacaagttaaaattgcttttgattactttaaagccaatgcaaatcggatatcaggtggaagtaaggtacttgaacatgatttccatctacatgtagttgaattgcaaaatactggtccacttagccatcttgccctcccaagtttagtggcttttgcatctggcttgttaggacgatcggtacaaagccagatggtcgtgctcggtgatatgagtctaggtggttctgtgacaccagtggaaagtattgctgaatgtcttcaggttgcttttgatgctggtgccaagaaggttgctttaccaatgagtagtgcggcagatatccccacgattcctgtagaattgtttaccaagttccagaccagtttctacgcggatcctgtggatgcggtattcaaagctttaggtgtggattga

SEQ ID NO: 3842 - DNA, 2028 bp, Cellvibrio sp.
atgaacgataaagatttagaccagctgctaaacgagcactttggtggcagagtggttcgtaaggatttaactaagcttattaaagaaggtgccaacgtaccggtatatgtgctggagtatttgcttggtatgtactgcgcatccgacgatccgcaagttattgagcaagggctgaacaacgttaaaactgttttggttgaaaactacgtgcgtcccgacgaatctgaaaaagtgaagtcacttgtgcgcgagcgtggcacctacaaagtgattgatcgcgtgaccgttcggttaaatgaaaagaaagataaatacgaagctttctttagtaatttgggcattaatgccgagatttcagcgggcattgttaaagaatacgaaaagcttttagtgggtggtatttgggttatcgctacattgagttactaccacgatgaaggccaatcatcatcgccttttggtgtgacgctgctaaaacccattcaaatgcccaatatgaacatgggggagctgtttgagggccgcgctgcattgactgccgaccaatggcgagagaccctcattaggtctattggaatggagcctgcttcactcgctaaagatgtgcaatggcatttattggcgcgcatggttcctttcgtagaaaacaactacaacgtgtgtgaattaggtccgcgtggcacgggtaaaagtcatatctataaagagtgttcaccaaacagcattttggtttctggtggtcaaaccacggttgccaatttgttttataacatgagttcgcgccgcataggccttgttggcttatgggatgtggtggcattcgatgaagtggccggcatatcgtttaaagataaagacggtgtgcagatcatgaaagatttcatggcatcaggatcttttgcgcgcggccgtgaacaaatggaagcaaatgcgtcaatggtgttcgtgggcaacatcaatcaaagcgttgaatccttagtcaagacgagtcatctgttagcgccattcccagaggcgatgattgactcagcattttttgatcgctttcatgcctacattcccggctgggaaatccccaaaatgcggcccgaattttttactgacaagtacggcttgattgttgattacttggccgagttttatcgtgaaatgcgtaagcgtagtttttcagatgcgatagataagtatttcaagcttggtaataacttaaaccagcgtgatgtcatcgcggttcgaaaaaccgtatctggcttgatcaaattgttgtatccacatggaaaatttgaaaaagaagatgtgcgtgaatgtttagaatacgcattacaagtgcgtcgccgcgttaaagagcagctcaaaaaaatcggtggaatggaattttatgatgtgcatttcagctatatcgataattccaccttcgaggaatattttgtatcggtaaaagagcagggcggtggcggcctaatcccagaaggcccaggtaaacccggtgttattcataccattgggttaagtagcaaaggtatgccaggcttgtacaggctagaactgcaagtcacaaaaggctcaggcaaattggcaacttcaggtttgtggaattccagcgccgcaaaggaacaggtgagaattgcttttgattatttcaaagccaatgcaagccgtattagcggtgccgcaaaagtcatggaccatgatttccacttgcacgcggttgagcttcagaatacggggccatttaatcatttagccttatccagcttagttgcctttgcatcgggcctattaggcaagcctattcaaaaccaaatggtggtgatgggggatatgagtcttggaggtagtgtaactcccgtagaaagcattgcagaatgtttgcaagtcgcattcgatgcaggtgcaaaacgtgttgcattgcccatggcgagcgcgatggatttgccaactattccagctgagttatttacaaaattccaaaccagtttttatgcagaccctgtagatgcggtttttaagggtttgggagttgattag

SEQ ID NO: 3843 - DNA, 2121 bp, Faecalibacterium prausnitzii
atggaaatgatggatatggcggcagatgatacccgtgaagaactgcgccggaagctgcgcagcaactttgacggtcggatcgtccgcaaagacctgacaaagaaaataaaagaaggagcgaatgttccggtctatgtgctggagttcctgctgggtcagtattgtagttcagacgatgagacaatcattgagcagggcgttcagaatgtaaaacgaattctggcagataattttgtccgcccggatgaggctcagaaaattctctcacaactgcgcaagaacggtcaccataccattattgatatggtgaccgtgcatctggacatcaaaaaggattgcttttttgcagagttctctaaccttggtctcaccaatgtgccgattacggatgattatccggaaaaatatgaccggctgctttgcggcggtatctggtgcatcgtgcagctggaatatgagtctgagggagacagcaactttggaatcacggatatagatggacagccgatttcctctaaacagaaaaagcagaaggacatctctcccatcagcatccataagctgactccgattcagatgccccatgtcgacattgaagaagttcgagagggacgcaaggcattcacacaggaagagtggatggatgttatgctgcgttcctgcggatatgagccagaacagttgaacaatcgggaaaagtggctgctgcttgcgcgtatgctgccgttggtggagaacaacttcaatctctgtgaattggggccgcgcagcacaggcaagtcccatatctataaagaaatcagcccgaacagtatcctggtatccggtggtcagacgaccgttgcaaatttgttttacaatatggggcgcaaaaccgtaggtttggtaggcttatgggactgcgttgcctttgatgaggttgccggaatcaagtttaaggacaaagacggcattcaaattatgaaagactatatggcttccggctcctttgcccgcggcaaagaggaaaaggcagcatcggcttctatggtctttgtaggaaacatcaatcagagcgtggatgtgttgcttaagacttcctctctgtttgacccgttcccgccggagatgggaacggacaccgcctttcttgaccgtctgcattgctacattccaggctgggagattccgaagttccgtccggagcattttaccaatgattacggctttatcacggattacttggcagagtttatccgagaactgcggaaagaacagtatggtgatgcgttggataagtatttccgccttggaaagaacctgaaccagcgcgatacgattgctgtccgcaagatcgtaggcggctatgtgaaattgctatatccggatggggagttcacgaaggaacagattgaagaaattcttgtatttgcgctggaaatgcgccgtcgcgtcaaggagcagctgaaaaaactgggtggaatggaattctatgatgtgaacttcagctatattgatcttgatacctttgaagaaaaatttgtttccgtgccagagcagggcggcggcaaactcattcctgatggtatctgcaatcctggacaggtatataccgtaagtcagggtaagtccggtatgatcggtgtattccgcctcgaaagccagatgctgcccggcaacggaaaatttgaacgtactggccttggcagcgatcgtgactgcaaggaatccacgaatacggcgttcaatttcctgaaagctaacggaaatcgcatcagtggcagcatcagtactacgatgcgggattacatcatcaactatcaggatttacaaggcattggcatgactggaaagctggcattgcctacattgattgcactatgcagcatcgctcttggacggcctacagtcagtacacttgccgtgctgggagaaatcagcatcagcggcacgattctgaaagtggacgagcttgccaatagtttgcaggtgtgcctcgatagcggagcaaagaaagtgctgcttccgattaccagtgcagcagaccttggcactgtgccgccggagctggtggggagttttaatctgattttctacagcagtgcggaagatgcggtgtttaaggcgttgggggtagagtaa

SEQ ID NO: 3844 - DNA, 2058 bp, Fulvimarina pelagi
atgtcgttatcgatctcgccttcgctcgcgacttcgactgaggtcgacgatcttgtcgttcggcatttcggcggcaaggtcgttcgcaaggatttgaccaagctcctgaaggaaggcgcgaacgtcccggtctacgtgctcgagtacctgcttggaatgtactgtgcgtccgacgacgaggcgacgatccgtgatggcctggagagtgtgaagcgtattctctccgagaactacgtccggcccgacgaggccgagaagatcaagtcgacgatcaaggagcggggcagtttcaaggtcatcgacaaggtgaccgtgaagctcaacgagaaaaaggaccgctacgaggccctgctgtccaatctcggggtgaaggacgcgttcatcgggagcgcggacgttcgcaagtacgagaagcttctctcgggcggcatatggtgcatcgtgacgatgcactacctctacgaggaaggcgggaagaactctccgttctcaatctcggatctgaagccgatccagatgccgaacatggacatgcaggagcttctcgagggtcgatcgcatttcgccgaagagcaatggctcgacgtcctcctccgctcgaccggcatggagccgtcgaacttcgaggagcgcgtgaagtggcatcttctcacgcgcctgatccccttcgtcgagaacaactacaactgctgcgaacttggtcctcgcggcaccggcaagagtcacgtttacaaggaatgcagcccgaacagcatcctcgtgtccggcggtcagacgacggtcgccaacctcttctacaacatggcgagtcgcgtcgtcggcctggtcggcatgtgggatgtcgtggccttcgatgaggtcgccggcatcaacttcaaggacaaggatggcatccagatcatgaaggacttcatggcctcgggtagcttcgttcgtggccgtgacaccgtcgccggctcggcctcgatggtcttcgtcggcaatatcaaccagtcagtggacaccctcgtgaagacgagccatttgttggccccgttccccgaggcgatgatcgactcggcattcttcgatcgcttccacgcctacatcccgggatgggaaatcccgaagatgcgcccggagtttttcacgaaccggttcggcctgattaccgattacctcgccgagtacatgcgggagatgcgcaagcggaacttctccgacgccatcgaccggtatttcaagctcggaaacaacctgaatcagcgcgacacgatcgctgtccgtcgcaccgtctcgggtcttctgaagcttctctatccgagtgccgactacgacaaggaagccgtccgccgctgcctgcaatacgccctcgagactcgccggcgcgtcaaggagcaattgaagaagatcgggggcatggaattctacgacgtccatttctcgtacatcgacaacgaaaccctcgacgagactttcgtcagcgttcccgagcagggcggcggcaagctgatcccggatagccagatgaaccctggctcgctgcataccatcaccgtcggcacgaacggccaccgtggcctctatcgtctagagacgcagacgacggcaggcggcgggaagttcaccacgtcgggccttgggtcgaaccagaaagctaaggaagcgctcggaatagccttcgatttcctgaaagcgaattccggtcgcgtcagcgcgagtacgaagccgtccgatcacgatttccatattcatacggtcgagatgcacaataccggagcgccatcgacgattacgctcgccggctacgtcgccttgtgttcgggcatcctcaagaagcccgtccaagcccagatggtcgtcctgggtgatatgtcactcggcgggaatgtcgtgcccgttcagaatttcgcggagtcgctccagatggctttcgattccggggcgaagaagatcctcgtcccgatggcgagtgccgccgacatatcgacgatcccgcccgaactgttcacgaagttccagacgtcgttctattcggatcctaccgatgccgttttcaaggcgctcggcctcgattga

SEQ ID NO: 3845 - DNA, 2085 bp, Escherichia coli; identical to SEQ ID NO: 3687

SEQ ID NO: 3846 - DNA, 2031 bp, Delta proteobacterium
atggatgatgcgctggaccggaaagtaacggatatttttgcgggcaaggtggttcgcaaagacctggtacgaaaaatcaaagtgggtgtgaacgtgccggtctttgtcctggaatatctccttggtaaatactgtgccaccgatgatccgatggccatagacgccggcttgcgcgttgtgaacaacaccctggccgaaaactttgcccggcccgaggaagccaacaaagcccaggctctggtcaaggaaaaagagcgtcatacttttatcgacaaggtgaaggtccgttaccttgcccaggatgataagtactgggccgaactggtgaattttggaaacaagtaccttcacgtgccggatcgtttcgtccgggagttcgaccggttgttgatgggcggggtctgggctcaggtggaaattcggcaccagtacgatgaagatgcaaaaggccggcgcagtccgttctggattgatcggatcacgcccatacaattggccagcttcaatctggatgagtatcgcgaggcccgatcccggttcagttccgaggaatgggtggatctgcttatccgcagcatcggtttggagccgacggagtttgatcgcagactgaagctactgttcctgttgaggttggtccccctgagcgaagccaattacaaccttgtggaactggggccgaggagtacgggaaaatcctttgcctatcaggagttgagtccatatgccattctccttacaggcccgacgactgtggccaaccttttctacaatatcgcatccggaaagatgggtttggtcggtctttgggacgctgtgggttttgatgaggtggccgaccttcaaaaaatgcccaaagaagtggtgaccacgctaaaaacctattgcgaatcaggatctttcgccagaggaaaagaatccctgagcgggcaggcatccatcgcaatgttcggcaacacgaaccaacccgtggacgtaatggtccggtcttcgcatcttttcatgcccatgccggacgtgatccgggatgacctggcgttcctggatcgcattcactgctatttgccgggctgggaagtgcccaagatgcgcatggagttttttacggatcattatggactcgtcgtcgattatctggccgaggccatgcgcgaacttcgtcggcacaactacactgaggtggtggaaagatatttttcctttggggatcatcttaacgcccgcgacgtaaaagccgtaaggaaaacggtatccggcctggtgaagctcgtctacccggaagggaatgttgccaaggatgaaatgacggaactgcttggccttgcattggaaagcagacgtcgggtgaaagagcagttaaaaaaaattggggcattcgaatatcaccagacttctttttcctaccgcgacaaggaaaccaccgaagagacctacgtcggagtgcccgaagaagggggccggaatctcatatccaccgacccgcttgcacccggatgtttatatacggcatctgttaattccgaagggaaagtcggcttgtatcgcatcgaggtgggtgtttcctccgggacgggaaaactgaaaatggccggcggcctgcaaagccagatgaaggaatccgtgcagagggcattcgcgtatcttcaagggcaaaaggtccccatgggaatagccggcgtgttcgacacatcggactttcatgtagaagccatcgatctgctcggaaacaaaagcatttgcgaagccggtgtcgccttcatcgtggccatatgttcagcgatcaagaaagcccaggcattgtccggggtgataattcttggtgatctcagcatccagggaaatatcaagcccgtgcagtcactggtggagcctctccaaatggccatggaaaacggagccaagcgcgcccttataccccttgaaaacaaacggaatttcttggaggtgtccggtgaaatcatggaaaaagttgatccaattttttattccgatccgcaaaccgctgcaaagaaagcgttgtctttaaaataa

SEQ ID NO: 3847 - DNA, 2034 bp, Enterococcus faecium; identical to SEQ ID NO: 3762

SEQ ID NO: 3848 - DNA, 2031 bp, Thiothrix nivea
atgagcatgaatgatctggacgggttgttaaaccagcatttcaagggtcgtgtggtgcgcaaagaccttaccaaacggctcaaggaaggcgcgaatgtaccggtctacgtgctggaatacctgctgggcatgtactgcgcctcggatgatgaagaagtcgtgcgcgaagggctggaaaacgtcaaacgcatcctggccgaaaattacgtgcgcccggatgaagccgaaaaggtcaagtcgctgatccgtgaacgcggcagctacaaaatcatcgacaaggtaggcgtgcgcctcaaccagcgcaaggacatctatgaagccgcactttccaacctcggcatcaatgacgccctgatccgccccactaccgtacaggacaatgaaaagctgctgactggcggtatctggtgcatcgtgaccctccagtatttctacgaggaaggccagaaaacctcgccattttcggtcgtaagcctcaaaccgatccagatgccatccatggacatggatgaattgctgaatgccagacagccgttctcgctggaggaatggatggatgtcctgctgcgctctgtcgggatggaacccgccaatctggaacagcgggtgaaatggcacctgctggcgcggatgattcccttcgtcgagaacaactacaacgtctgcgaactggggccacgcggcaccggcaaaagccatgtttacaaggaatgctcccccaacagcctgctgatttccggcgggcaaaccacggtcgccaacctgttctacaacatgagcagccaccgtgtcgggctggtcggcatgtgggatctggtggcgtttgatgaagtggcgggtatccatttcaaggacaaggatggcgtgcagatcatgaaggattacatggcctccggctccttcgcacgtggccgtgattccgtggaagccaaagcctcgatggtgtttatcggcaacatcaaccagagcgtggaaatgctggtcaaaaccagccacctgctcgcgccatttcctgatgccatgatcgacacagcctttttcgaccgcttccatgcctacatccctggctgggaaatcccgaaaatgcgcccggaattcttcaccaacaactacgggctgatcaccgactacctggccgaattcatgcgggaaatgcgcaagcgcagtttcgctgacgccatcgaccgctatttcaaactcggcaacaatcttaaccagcgcgacgtaattgcagtacgccgcacggtttccggcctgctcaaactgctgttcccgcgtgccgattacggcaaggaagatgtccgcacctgtctggtctatgcgctggaactgcgccgccgcatcaaggagcagctgaaaaagttgggtggcatggaattcttcgacgtgcatttcagctaccacgacaacgagacgctggaagaacatttcgtcagcgtgccggaacaaggtggcggcaaactgatcccggaaggcgcattacgtcccggcgtcgtgcatctggtcacgcaaggcggctcagggcaattgggtttgtaccgatttgaaacccagatggtggcaggtacagggaaatactccgttaccggcctgggttccagcaccgccgccaaggaagctatccggatcggtttcgattacttcaagggcaatctggggcgtatcagcgccaatgccagatttgccgagcatgagttccagcttcatgtcgtggagttacacaacactgcccccagcaccaaaaccagtctggcggcattggtggcgttctgctccatcctgatgaacaaacccgtacaggcgcagatggtggtattgggcaatatgaccctcggtggcgtggtgaacccggtcgacgatctggcgggcagcctgcaaatggcgctggatagcggtgctacccgtgtgttgttaccgatggcttcggctatggatattccttccgtgccacctgagttgtttgccaagtttcagatcagcttctttgctgacccggtggatgcggtgtataaggcgttgggggtgcagtga

SEQ ID NO: 3849 - DNA, 2085 bp, Escherichia coli; identical to SEQ ID NO: 3684

SEQ ID NO: 3850 - DNA, 2133 bp, Brevibacterium mcbrellneri
atgactgacaccgcgagccactccggcgaggaacgcaacaccgagtcagccacaccgcagcagagcgatcttgactacaagacaaacctgctgttcgctggctccgtcgtccgcaaagacctcgtgaaggctgtcaagggcaacgcgattgtcccctcttacgtgctggagtacctgcttggccagtacgccgcctccgacgacgaggcaacgatccaggccggtatcgatgcggtgcgcaagattctcgccgaccactacgtgcaccgcaacgagtcggaactggtgaagtccactatccgcgagaagggccgccaccggatcatcgacaaggtgaccgtgacgctgaacgacaagcaggacgtgtaccaggcctcgttcgccaacctcgggctcaatggcgtaatcgtcgaacccgcgacagtgaaggcgaacccgaagctgctggtcagtggcgtgtggtgcatctgcgacatcgagtacttccacagcgacgacgcccgcgtcgtgccctggattctggggagcttgaagccgatccagatgtcgagtttcgactacgagggctatctcgcatcacggaaggagttcaacaccgaagagtggatcgacctgctgctccaatccatcgggttcaaccctgagatgttcggacgacgggcgaagctgctgcagctcgtccgtctcatccccttcgtcgagcggaactacaacctggtcgagctggggccgaagggcaccggcaagtcacacatctactccgagttctcgccccacggcatgctgatctccggtggcgaggtcaccgtcccgaagctcttcgtgaacaacgccaacggtcgcatcggccttgtcggctactgggacgtcgttgcgttcgacgagttcgccggcaagaagaagcgcaccgacaaggcgctcgtcgacatcatgaagaactacatggcgaacaagtcgttctcccgtggcgtcgagaccctcggagctgaagcgtcgatggtattcgtgggcaacacctcccacaacgtgccctacatgctcaagcactcagacctgttcgacgagctgccggaggcataccacgactccgcctacctcgaccgactccacttctacatccccggctgggaggtagacacgatccgcagcgagatgttctcgtccggctacggcttcgtcgtcgactacatcgccgaagtgctgcgatccatgcggaacaccgactactccgaccgctataagcagcacttcacgctcggctccgacatctccacacgagaccgagacggcatccacaagaccttctctggcctgatgaagctcatctacccgggcggcgaggccacgcaagaggagatcgaggaactgctgcgcttcgccatcgaaggacgcaagcgcgtcaaggaccagattcttcggatcgacaacacactggccgccgtcaacttcggctactccgacaagtcgggcacctggcgtggcgtcaccacgcttgaggaggacgagtaccccaactactaccaggctcgcagccccgaggccgagggcgaagtagaggcgtcggcggaggagcgtgggtccgcgcaagcagaggtcgcagttgcggctccagttgctcccgaggtggcggcgcccctgttcgaagggcacagagagttccaggagaaccagcgtggagtctcgtacgagacgctgctcatgccctatttgcacggcgccacggacatcaccatcgtcgatccctacatccggctcccgcaccagggacgcaacctcgtcgatctgctggccctgctagcggcggccaaggaccccgccgacgagatcgcggtaacactggtgaccaaggaagaccgcggcgagtacgcacagcaacacctcctcatgctcaaggacatccaggacagcaccgccaccgtcggcatcaagttcaccgtcacctgggacgaaaccatccacgaccggtcgatccgcaccgaccacggctggaagctcgtcctcgggcgtggtctcgacatcttccagaagggctccggtagccagttcgacctcggctcccgccgccaggagttccgtcaggtgttcgcgttcggcatcacctacattcacgagactgaaaccgacgcgaactga

SEQ ID NO: 3851 - DNA, 2085 bp, Escherichia coli; identical to SEQ ID NO: 3687

SEQ ID NO: 3852 - DNA, 2052 bp, Vibrio cholerae; identical to SEQ ID NO: 3740

SEQ ID NO: 3853 - DNA, 2034 bp, Enterococcus faecium; identical to SEQ ID NO: 3762

SEQ ID NO: 3854 - DNA, 2034 bp, Enterococcus faecium; identical to SEQ ID NO: 3762

SEQ ID NO: 3855 - DNA, 2076 bp, Vibrio cholerae; identical to SEQ ID NO: 3739

SEQ ID NO: 3856 - DNA, 2058 bp, Sporosarcina newyorkensis
atggacgaaagagcagaggaaacaatgacacttgatcttgataaaaaattaaatgaggtttttgctggtcgtgttgtccgcaaagatttgacgaaattaataaaagagggggctaatgttcccgtttatgttctcgaatacctattaggtatgtattgtgcaacagatgatgaagagagcattcgagaaggcgtggaacgggtaaaaaagatcctttccgataattttgttcgtccagatgaagcggaaaagataaaatcacgcattcgggagcttggtcagtattccattattgacaaagtgacggttgcacttaatccgaagattgatacctatgaggctgaattctcgaaccttggattaaaaggagtgccaattgcttcaaactttgtgaaagaatatgacaagcttttagttggcggaatttggtgcatggtgaagattgattacttctatgatgaagaagtaagagtcatgaatcccttcagtgttagtagcctacagccgattcaaatgccgaacatggacatcaatgagatttttgaaggtagaaaacagtttacgaaggatgaatggattgacgttcttatccgttctacagggatggagcctacacaattagaagaaagagtaaagtggcatctacttctacgtctcgttccacttgttgaaaataactacaatatgtgtgaattgggaccaagaggaacagggaaatctcatgtatacaaagaaatttcgccaaattccatcctggtgtcgggcggtcaatctacagtagccaacctcttttacaatatgtccactcgtaaaatcgggcttgttggtatgtgggattgtgtagcgtttgatgaagtagcgggaattcgctttaaggataaagacggcatccaaattatgaaagattacatggcgtcggggtcctttgccagagggaaagaagaaaaaaatgcgagtgcatcaatggtgttcgtggggaatattaaccaaagtgtcgatgtattgctcaaaacatctcatcttttcgccccattccccgaagaaatggcaaatgatacggcgttttttgatcggatgcattattacatgccaggttgggagattcccaagatgaggcctgactttttcactgataagtatggatttatcgtggattacatcgctgaattctttagggaaatgcgaaaacgctcattcgccgattccattgatagatattacaagcttggaaacaatttgaatcaacgagatactgtagccgtaaggaaaacggtgtcaggtatggtgaaactaatttatcctcatggcgaatatacgaaagaagatattgaggaaattttacaatatgccctcgaaggtcgtcgtcgtgtaaaggaacagcttaagaaaatcgggggcatggaattctacgatgtcatgttctcatatcttgataaagaaacaatggaagaagaatacgtctctgtccccgaacaagggggcggtaagctgattcctgaaggtatgggtaagccagggcatgtgtatgttgtcggtcaaagtgattcgggcatgatcggcgtttacaagcttgaaaaccaagtcgtgagcggaacaggtaagtttgataaatcagggcttggctcccatcgaggagcaaaggagagtttggatactgcatttcgcttctttacggcaaatagtaaggctataagcaatacgattagcacaaaaacaaaagattatttaatgcatgtcagtgatttgcaaggaattggtttatcaggggagcttgcgatagctgagttaataggactttgctcaggagctttggacaagcccgtacaagaaagcaccgttgttattggcaacatgaccgtaggaggaaccattgcaaaagttgaagaatttgcgaacgtcttgcaagtatgtgttgatgcaggagcgaagaaagtgttgatcccagcttcttctgttatggatttgcaaacagttccgccagatttgttggttaaagtacagccagttttttatgcggatccgattgatgctgtgtttaaggctttgggggttagttga

SEQ ID NO: 3857 - DNA, 2052 bp, Vibrio cholerae; identical to SEQ ID NO: 3740

SEQ ID NO: 3858 - DNA, 2052 bp, Vibrio cholerae; identical to SEQ ID NO: 3740

SEQ ID NO: 3859 - DNA, 2052 bp, Vibrio cholerae; identical to SEQ ID NO: 3740

SEQ ID NO: 3860 - DNA, 2052 bp, Vibrio cholerae; identical to SEQ ID NO: 3740

SEQ ID NO: 3861 - DNA, 2052 bp, Vibrio cholerae; identical to SEQ ID NO: 3740

SEQ ID NO: 3862 - DNA, 2034 bp, Enterococcus faecium; identical to SEQ ID NO: 3762

SEQ ID NO: 3863 - DNA, 2097 bp, Vibrio shilonii
atgacagaaaattataatcaacaagagcctattgacgttcctagtcaggcagatgaaacccaacatgtcagagatgtcgatctggatgagttgatgacgactcaatttaaaggaagagttgtacgtaaagacctgaccaaacaacttaaggaaggagccaatgttcctgtctatgtcctcgagtatctgttagggatgtattgctcgactgatgatgatgagttgatagaagctggcttgggtcgagtaaaacaaattctgactgataactatgttcgcccagacgaagctgaaaaggtcaaatcactgatccgagaaaaaggcacacataaagttattgataaagtcactgtaaagcttaatcagaaaaaagacgtatacgaggcgagcctatcgaatttaggtatcaaggacgcggtgatctctgccaatgttgttaaagagaatgaaaagctgctgacaggcggtatttggtgcatcattacgctaagctacttctatgaggaaggccaaaagacgtcaccattttctgttgttggcttaaaagcaattcaaatgccttcaatgaacatgcaagaagtgtttgacgctcgacgcaacttcactatggatcaatggctagatatgttattacgctcaattggtatggaacctgccaatctggagcaccgtgctaagtggcatatcttagccagaatgataccgttcgttgaaaataactataacgtctgcgagctaggccctcgcggtacaggtaagtctcacgtttataaagaatgttccccgaactctttattggtatcaggcggtcaaaccaccgtcgctaaccttttctataacatgtcaagccgtcaagtcggtttggttggcatgtgggatattgtcgcttttgatgaagtcgctggtatccgatttaaagacaaagatggcgtgcagataatgaaagactacatggcttcaggttcatttagccgtggtcgtgactccattgaagcgaaggcttcaatggtctttgtcggtaatattgatcaaagtgtcgaaacgctggttaaaacgagtcatctacttgccccattccctccagagatgattgactcagcgttttttgaccgtttccacgcttatattcctggctgggaaattcctaaaatgcgcccagagtttttcacaaaccgttttggtttgatcaccgattaccttgctgaatacatgcgcgaaatgcgcaaacatgcatttgccgatgctatcgacaaattcttcaagctgggaaacaatctcaatcagcgagatgttatcgccgttcgccgtaccacatctggactactaaaacttttagtgccacatagcgagtactctaaagaagatgtacggatttgcttaacctatgcactcgaggttcgccgccgagtaaaagagcagctcaaaaaaattgggggaatggagttcttcgatgttaacttctcttacattgataatgaaacgctcgaagagttctttgtcaacgttccagaacaaggcgggtctaaaatcatccctccaggtagacccaatgcgggagtcgttcatttcgttagccctggcactgcgggtaaacttggtgtcttccgtattgaaactcaaaaaacagcaggtaacggtaaactaacgacatcagggcttggttcggatacagaagcaaaagagcaagtcaaagtcggtttcgagtatttcaaaggaaacctatcacgaatagcagcaaacaatcagtattcggaacatgagttccatttgcattttgttgacctccaggtgtctggtcactcgcatagttctagcctagccgctttgattgctaactgctctgctctacttggaaaaccgatgcaagaatcaatggtggttttggggtcaatgaccctaggaggcgtattgcatccagttcaggacttggcaggttcaatgcaagttgctctcgaagctggcgcaagcaagattctcattcctatggcatctgctacagatattccgacggtaccagctgaaacatttactaagtttcaagttagcttttacagtgaccctgtagatgctgtttacaaggctctcggggttagctga

SEQ ID NO: 3864 - DNA, 2187 bp, Brachybacterium paraconglomeratum
atgacgaacctcgaagacgccctgggtgagatcgatgtcctcgccgctgctgaggcgaccgacgccgccccggagaagtccgcgctcgacgacaagatcaacgagcacttcgctggtgccgtcgttcgtaaggacctcgtcaaggcagtccgcgggaacgccgtggtgccctcatacgtgctcgagtacctgctgggccagtacgctgcgtccgacgacgaggcgacgatccaggccgggatcgacagcgtgcgccagatcctggctacccactacgtcaaccgcaacgagcacatgctcgtgaagtcggagatccgccgcaagggccgccaccgcgtgatcgataaggtgaccgtcacgctcaatgagaagaacgacgtccacgaggcagagttcgagaacctccaggtcaaaggcgtcatcatcgacgacgtcacggtcaagcagaacccgaagctcctcgtaggcggcgtctggtgcatctgcgacatcgagtacttccactccgacgaccagcgcgtcgtgccgtggattctcggcagcctcaagcccatccaagtcgccggcgttgacgtcgatcactactacgaggctcgcgaagcgttcacgaccgaggagtggatcgatctgctcatgcagtcgatcggcctcaaccctgagcagttcaacgagcgcggcaagctcatcgctctgacccgcctgatcccgttcgtcgagcgtaactacaacgtcgtcgaactcgggccgaagggcaccgggaagtcccacacgttcagtgaattctccccgaacggcatcctcctctccggcggtgaggtcaccgttgccaagctgttcgtcaacaacgcgagtggccgcatcggactggtgggctactgggactgcgtcgcgttcgacgagttcgccgctaaccggcgcaccgaccagaaccttgtcaacgtgatgaagaactatctggcgaacaagtcgttctcgcgtggaaccagcatctacggagccgatgcctcgatggcgttcatcggcaacacgacccacaccgtgccgtacatgctcaagaacagcgacctgttcgacgagctgcccgacgcctaccgcgatcccgcctggctcgaccgcatccaccactacattcccggttgggaggtcgcgccgatccgctcggagatgttctcgaatggctacgggttcgtcgtcgactaccttgccgagattctgcgcgcgaagcggtctgaggacttctcggacaagtacacggactacttcaccctcgacacctcgatctcgacgcgcgaccaggatggtatccgcaagaccttctccgggctgatgaagctcgtgcacccaacgggagaggcgaacgagaacgagatccgcgcgctgctggagttcgcgatcgaggggcgcaagcgcgtcaaggactcgatcctgcggatcgacgccacgatgcgtgacaaccctgtccacttcaggtacgccgacaagacgggcgtttggcacgacgtcgccactctcgaagagagccagtacccgcagctgtaccggcgggactgggacgcaaggcccgataccgacgccggatcaggtgaagacgctcctacggcaccccatccgaccctggcgcccgcgcctccagccacttccttggcggctgctccggatgtgccagcggagcccacgcccacgccgctggctgaagggcatcgagactttaacgcgggtcagaagggagtttcctacgagaatctgctcctgccttaccttcgcggagcctccaagatcacgatcacggacccctacatccgcatgcctcaccagggtcgcaacctcgcggacctgctcagcctcctcgccacggccaaggacgacgccgacgagatcgacgtcttgctcgtcaccacagaagaacccaacgctgagttcaagcagcgtcagctactgatgctcaaatccatcaaggacgcctccgacgcggttggcgctcgcctcgcggtgcagctcgacgacacgatccacgaccggcgcatcgagaccaaccacggctggcgcatcgacctcggcaagggtctcgacatctggcagaggccgagtgacaaccctttcgacttcgggcgcaaccgccaagagttccgcatgatcagctcggcgttcaccgtgcactacatgaggatgggattgccgcacgattag

SEQ ID NO: 3865 - DNA, 2085 bp, Salmonella enterica; identical to SEQ ID NO: 3644

SEQ ID NO: 3866 - DNA, 2085 bp, Pseudoalteromonas luteoviolacea
atggaaaatgaacaattagataatagtaacatctcaagtatcgaatcttctcaaattcgaagcgctgaccttgacgatttaatgacgactgaatttaaaggtcgtgttgttcgtaaagatttaacaaagcagttaaaagaaggagcgaacgttccggtttatgtacttgagtatttattgggtatgtactgctcttcagcagaggatgagttaatccaagaagggttgaagaatgttaagaagattctaacagaaaactatgtgcggcctgatgaggctgaaaaagccaagtcgttgatccgagaaaaaggcactcataaagtcattgataaggtaacggtaaaactcaatcagaaaaaagatatctatgaagcgagtttatcaaatattggaattaaagatgccgttgttcctaacaaaattgttaaagaaaacgaaaagttattaaccggtggtatctggtgcattattacggtgagttacttctatgaagaaggtcagaaaacatcgccgttctctgtatttagtttaaaaccaatccaaatgccttcaatgaatatggatgaggtgtatcaagctcgtcgtaagttctcagttgatcaatggatagatttgttacttcgttcaatagggatggagccagctaaccttgaacatagatgcaagtggcacttaatagctcgcatgatcccatttgttgagaataactataacgtatgtgaactcggtcctcgtggaacgggtaagtctcatgtttataaagaatgttctccgaattcattgttagtttcaggcggtcaaactacggtagctaacctgttttataacatgtcttcacgccaaattggtttagttggtatgtgggatgttgttgcctttgatgaagtcgcaggtattcgttttaaagataaagacggcattcagatcatgaaagattacatggcgtctggttctttttctcgtggccgtgattctattgaagcaaaagcctctatggtgtttgttgggaatatcgatcacagcgttgagacattggtaaaaactagtcacttattagcgccatttccagatgaaatgatcgactcagcttattttgatcgcttccatgcttatattccgggctgggaaattcctaaaatgcgcccagagttctttacagaccgatttggactgataacagactacttagcagaatatatgcgtgaaatgcgtaaaaccacgttttcagatgcaatcgataagttctttaagttaggtaacaaccttaatcaacgagatgtaattggtgtaagaagaacaacatcaggtttgcttaagcttctatatccaaatggtgaatatacaaaagaagatgtacgcacatgtttaacttatgctcttgaagtgcgtcgtcgggtaaaagagcaacttaagaaaattggcggtatggaattctttgacgttaattttagttatatcgataacgaaacgcttgaagagttttttgtcaatgtgccagagcaaggtggctcaaatctaatcccagcaggggtcacaaagcccggagtagtgcactttgttgatcatggcgcttctggaaaattaggtgtttatcgtattgaaacacaaatgacaccgggcacaggtaaacattcaacatcgggatttggttcagatacgagtgctaaagaacaagtacgcgttggatttgaatactttaaaggtaacttaaacagaatagccgctaattctcgtttctctgagcatgaatttcacatacattttgtagatttacaaacatcaggaaatagtcaccaagcgagtttaggtgcattagtagcatgttgttcagtattacttaataagcctgtgcaagagcaaatggtggtattaggcagcatcacacttggtggcgtagtaaacccagttcaagatttagcatcaagtatgcagatagcgctggaggcaggtgcaactaaagtgttactgcctatggcatcagctagtgatataccttctgtacctgctgaaacattcaccaagttccaagtaagcttttacagtgatccagtggatgctgtttataaggctcttggggttcagtaa

SEQ ID NO: 3867 - DNA, 2031 bp, Clostridium perfringens
atggatgaattaagtataaagttaaatcaaagttttgcaggcaaagttgtaagaaaagatttaacacaaaaattaaaacaaggagctaatgttccaacatatgtattagaatatcttttaggaatgtattgtgctacagatgatgaggaaagtataaatgaaggggttgaaagagttaaaaatatactatcagataattttgttagacctgatgaagctgaaaagataaagtctaaaattagagaaatgactagatatactgttatagataaattaatagtaaaattaaatgaaaaacgtgatatttatgtgtcagagttttctaatttaggattaaaagatattgaaatatcatctaagtatgttaaggattttgataaacttttaggtggaggaatttggtgtattgtaaagttagaatattattatgatgaaaatgaaaagttatctactccatttattattgaatctgtaactccaattcaaatgcctaatatggatatagatgaacttattaaaggaagaagagattttagcaaagaagaatggattgacatattaattagaagtataggaatggaaccaactcaattagaagaacatgttaagtggcatatgcttttaaggatggttccactttgtgagaataactataatatgtgtgaattaggaccaagaggtactggtaaatcacatttatacaaagaaatatctccaaactcaatactaatatctgggggacagactacagtagctaatttattttataatatggctcgtagaaagattggtttagtaggaatgtgggatactgtagcttttgatgaagtggcaggaataacttttaaagataaagacggtattcagataatgaaagattatatggcttcaggatcttttgcaaggggaaaagaggaaaaagcagcatccgcttctatggtttttgtgggaaacataaatcaaagtgtagatgttcttttgaaaacttctcatttgtttgaaccattcccagaggtaatggcttatgactcagctttttttgatagaatacatttttatcttccaggatgggagattcctaaaatgagaccagaacttcttacaaatagctttggatttataacagattatttagcagagtatttaagagaaatgagaaaaagaacctttggagactctatagataagtattttagattaggaaataacctaaatcaaagagatgttatagctgttaggaagactgtttctggacttattaaaattatatatcctcatggagaatttgaaaaagaggatttagaagagattttaagatatgcgcttgtaggaagaagaagagttaaagaacagttaaaaaagattgggggaatggagttttacgatgtacatttctcttatatagataatgaaactatgagagaagaatttatttctgtgccagaacaaggttcaggttcattaattccagagggactaggaagagctggacatgtttatactataggattaggtgattctggaatgatcggaatatataaaattgaaacagaagttatttcaggatcaggtaagtttgaaaaaacaggtttaggatatagtagggaagctaaggaaagtatagaaactgcatttaggtattttaaggctaacagtagaaatatgagttcttcaatatctactacaactaaagattatttaatgcacatacaagatgttaatggagttggaatgacttcttcactatccttggctgctataatagcaatgtgctcaggagccttaaataggccagtacaaagtcaattagttattttaggttctgtaagtattggaggaacaataaataaggtagaagatcttgcaaacacactacaagtttgttttgatgcaggagctaaaaaaatactacttccaatggtaaatgcaggagatatagctttagttccaccagaactttttgtaaagttccaaataatgttttactcaacagcagaggatgcagtatttaaagctttaggagttcagtaa

SEQ ID NO: 3868 - DNA, 2034 bp, Enterococcus faecium; identical to SEQ ID NO: 3762

SEQ ID NO: 3869 - DNA, 2076 bp, Vibrio cholerae; identical to SEQ ID NO: 3739

SEQ ID NO: 3870 - DNA, 2085 bp, Escherichia coli; identical to SEQ ID NO: 3687

SEQ ID NO: 3871 - DNA, 2052 bp, Vibrio cholerae
atggctgttttgaacgatttagatcacaagctgttagagcactttcgaggctatgtggtaaagaaagacttagtgcgtatggtaaaagttggtgccaacgtaccggtatttgtattggaatatttgattgctaattcttgctctactgatgatgaagaaaaaattaaagtaggcatggaaaacgttaagaaaattcttagcgagcactacgttaaccctgaagaaagttctctaatacattctaaaataagagaaaaaggtcgatttaaaataatcgataaaatttctgtcaaactggattcgaaaaaagatatctattgggctcagcttcaaaatagcaacattaacaacggtaatatccgtgatggccttgtgaaagagcatgagaagatgttgatgggtggtatttgggccattattgacgttgaatatgaccccgacataagaatcggtcaaaacatatatccgtttgtagtgacaaatataaagcctattcaactgtcgacttttgataacagtaagattatccagaaaagaaatgagttttcgagagatgaatggctgaatgtattgctacgtagctgtggatatgagcctgatgctgaagggatgacaacccgcgtaaaaatgctgttacttgcacgtctgctgccaatggttgagagtaattttaactttgtagagttaggtccgcggtcaacaggtaagtcgttcgtttttaaagagcttacaccttatgccgtgcttatatcaggtggtcaaggaacagttgccaagctctttgttcacggttctactggcaaagttggtgccgttggtcaatgggatgcgatatgtttcgatgaggcaacggacaagatcttcaaagaaaaggatgctgttcctttaatgaaggactatatggagtctggctcgttttcgcgagctggtgcaggaggtgaaatcactggtgttgcttcaattatcctaaacggcaatataaatcaaccagttgagacggtattgcaaacatctcacttatttagtcctctttctgatgaagtgaataacgatactgcattccttgatcgtattcatttttatctacctgggtgggaaatgatcaagtttgctccaaaacacttcacatctaattttggtttcagtacagactacttctcagaagcattgaagtcgtttcgtcgcgttacatacactgatgctcttgaaaactttttttcgctaggttcacacttaaaacaacgtgacaccaagccagtaaaaaagacggtatcaggtctgattaaattgcttcacccgaatggtgaatacaccaaggaagatgtgcgtgaatacctcgagatagctcttgaaatgcgacgtcgcgtgaaagaacagttaaagcgaatcggtggaatggagttttgggatacgaatttttcttacatagataaagaaacgcaggaagagcactttgttggcttgcctgaggaaaagggatctcacttaatcgaaaatacgccactgccgcctggtgtttgttacaccagtacaagtgatggtgacaatgtcgcgctcgttcgtattgaagctgttactacctcgggttctgggaaactcaatatttctggtgtaagtaacaccggagtcaaagaaaacatcaagaacacttatcagtatattaaagccaatgaaaaaacaattttaagtgagcagcattcgcttaaaaattacgatatcactatccaagtgaccaatatgctgggggcttcaatatcaacgggaattggctcggctgtttatatcgcaatcgtgtctgctctttacaaaaagaacctaaaagctggccttgcagtgttgggtaatatatccgttggcggtgcgattgaaaggtcaattaactttgctgacaagataacaatgttgtctgagaatggcgcgaagacggttgttgttccaatggataatctagttgagctaacaaatgtaccaccaacagttcttggaaatacggatgttccgttttatcagaataatcagatgcttatgcaaaaaagcatactgcttgactga

SEQ ID NO: 3872 - DNA, 2052 bp, Vibrio cholerae; identical to SEQ ID NO: 3740

SEQ ID NO: 3873 - DNA, 2019 bp, Fusobacterium ulcerans
atggatataataaacgaaattggaaatgaggcttttgaaggaaaaatagtaaagaaagacttagtttctaaaataaaaggtggggccaatgtacctatatatgtattggaatatttattaggaatgtattgcaaccaaatagataaagaaaatatagaaataggtatggaaaaagtaaaaaaaatattggcggaaaactatgttcgtcctgatgaagctgaaaaggtaaaatcaaaaataaaagaaataggaagttatactgtcatagataaagtaaatgtaaaattgaatgaaaaaaaagatagatatgaaggggaactttcaaatctaggagtggggaatatagaaattccaggtgcttatataaaagaatttgaaaaacttttaagcggaggaatatggtgtattcttactctaagttatgaatttgatgaattaagtgtaggagattcaccatttaaattggaaaaattaagacctattcagattgcaaatttaaatatgttagatgtttatgatggaagaaaaaagtttaccaagaatcaatggatcaattttttgttaagatcaacaggaatggaaccagaaatttttgataaagatgcaatttggcatcttttaggaagaatggcccctttagtagaaaataattataacctttgtgagttaggaccaagaggaacaggaaaatcttatatttataaagagatcagtccaaattccattcttctttcaggaggacagaccacagttgccaatttattttataacatgtcaaaaaaacaaattggcttagttggatattgggatgtagtagcttttgatgaaattgcagggattaaatttaaggataaagatggtattcaaataatgaaagattttatggcaagtggctcttttgcaagaggaaaagaagaaaaaaatgctaatgcatcaatggtttttataggaaatataaatcaaagtatagatgttttagtaaaaacagcacatcttcttgtagattttcctccagaaatgaataatgattctgcattttttgataggatgcatagttatatacctggatgggaaataccaaaactttctccacattgttttacaaaagaatatggattgatagtagattatatggcagaagtttttagggaacttaggaagatatcttatggtgatgcaatagataaatactttgttttaggtagagatttaaatcaaagggatacaattgcagtaagaaaaacggtatcagcctttattaaattaatttatccagatggagagtttggcaaggaagaagtagaggagatattagtaagagctttagaatatagaagaagagtcaaagaacaacttaaaaaaatggctggaatggaattttttgcaactaatttctcttatattgataaagaaataggtgaagaaaaatatgttaatttaaaagagcaagggggaggaaaacttataccagagggtcaattaaaagtagggtctctctatacaattgcatcttgtaatagtagtataaaaggactttataaaatagagtgtcaagtatcttctggaaaaggaagagttacagtttcagataataaatatagaaaaacttttgaaaatgcttttagttatttaaaaataaattctagaagaataagtggagctattaatatttcagagaaagaattttatttgtctgtttctgatgaaaaaaatgttggattgtctgataatcttacattaggtggatttatatctatgtgttctaattcacttaatagacaagtattaggacaaactgttatattaggtgaaatggctctttcaggctctgtattagtagtttcagaattagcaaatacccttcaaatagctagagaagctggagctaaaaaagcattaataccaatattaaatgcgaaagatatggggagtcttcctccagatatcttaggagatgtccagcttattttttatcaagatcctattgatgctgttcaaaaagctctaggatttttataa

SEQ ID NO: 3874 - DNA, 2109 bp, Roseobacter sp.
atgagtgatctcgacgccaggatcaatgaacatttcgcgggctttgtcgtgcgcaaggacctggtgaaggcggtcaagggcaacgcgatcgttccgacctatgtgctcgagtatctcctcggccagtattgcgccacagacgacgaggcgtcgatcgcgaccggcatcgagactgtcaaagaaatactgcgcaagcattatgtccaccgcagcgaagcggggctaatccagtcaacgatcaaggaaaagggcggctacaaggtcatcgaccagatcagcgtgtcattgaacgagaagaccgatagctacgaagcgaccttcgacaacctcggcatcaagaaggttgcggtcgacagcggcacgatcaaagcgcacccaaagctgctggtgacgggcgtctggtgcattgcggatgtgcaatacgagttctcggaagatgcgcgcatctcgccgtggatcctcgagaccatcaagcccatccagatcgccaaggtcgactatgagggctaccgcgaggcgcggggcagcttcaatactgacgattggattgacctcctgatgcagagcatcgggttcaacccggaggcctttgggcgtcgggcgaagctcttgcagctgatgcgactgatcccgttcgttgaacgcaattacaacatcatcgagctggggcccaaagggaccggtaagtcgcacatctactcggagttctcgccacacggtcagctgatctcaggtggcgaggtgacgatcccgaagctctttgtgaacaactcgaacggccgcattggccttgtcggctattgggatgtcgtggcctttgatgaattcgccggtcgggaaaagacagcgaacaaggcgctggtcgacatcatgaaaaactatatggccaacaagaccttctcccggggggtgaacccgatgggggccgaggccagtttcgcgtttgtgggcaacaccgaccacaacgtgcccttcatgctgaaaaacagcgacctctttgaggccctgccgccgcagttccatgactcggccttcatcgatcgtctccatgcctatctgcccggctgggaaatcgacgtgatccgcggcgagatgttcaccaagggatatggcttcatagtcgactacctcgccgagatcctgcgccacctgcgccaggaggatttctcgcaccggccggaccagcatttcaagatcagcgagaagatttcgacgcgggatcgggatgccatctacaagacgatgtcgggccttctgaagctgatcttcccgaatggcggcgagacagcagaggatgtcgaggagttactgcgcctagccatggagagccgcaagcgggtcaaggatcaactagcccgcatcgacagcacctatcccgaggttgattttcactaccttggcacggacgggaccaagcgccgtgtgaccacggtagaggaggaagaatacccgcagttctatcatctcaagcctgcgctggatcccaaggagcaggaacagtcagagacgtcagctggtgctggtgagcccacatctgccggtaacgaaggggcatcgacgtcagggtccgcttcggaggctgcgcgccctgtcaaggcagaggcgaagcccattctcgaagaaggccatcatgtcttcacagaggatcgcaagggtatcagctacgatctgctcttcggtccttacattgaaggcgcatcaaagattatcgtgacagacccctatgtccgatacttctatcaaatccgaaacatgatggaattcgttgaaatggtaattcggcggaaatcgcccgaggaccaggtcagcgttcatctcgtgacagggccggatgatggcaatgtcggcaagcaacgagaattgctggactcgatcgtggacgcctgtgtcggctcgggcgtcgaattcacttgggccttcgacggcacaggaacagcgcatgcgcgtgatatcgtaaccgatactggctggaagatcgtgctggatcgtggcctcgatattttccaggcgccgatcaagaaggacgggttttcgctcagtgatcggttgcaggagcaccgtttaatcaagggcttctacgtgacctatttaagtgatgagaaaggttag

SEQ ID NO: 3875 - DNA, 2085 bp, Escherichia coli
atgcaaacccatcatgatttacctgtttcaggcgtatccgcaggggaaattgcctccgagggttacgatctggacgccctgctgaaccagcattttgctggtcgcgtggtgcgtaaagatctcaccaagcaactcaaggaaggggcaaacgtcccggtgtatgtgcttgagtatctgctcggcatgtactgcgcctctgacgatgacgacgtagtcgagcaagggttgcaaaacgttaagcgtattctggctgataactatgtgcgcccggatgaagcagagaaagtgaagtcgctgatccgcgagcgtggttcgtacaaaatcatcgataaagtgtcggtgaaactgaaccagaaaaaagacgtttacgaagcccagctttctaacctcggcatcaaagacgcgctggtgccatcacagatggttaaagacaacgagaagctactgacgggcggtatctggtgcatgattaccgtcaactatttctttgaagaagggcagaagacttcgcccttctcattgatgacgcttaagcctatccagatgccgaatatggatatggaagaagtgttcgatgcgcgtagacactttaaccgtgatcagtggatcgatgtgctgctgcgctcagtgggtatggagcccgccaatattgagcaacgcactaaatggcaccttatcacccgaatgatcccgtttgtggagaacaactataacgtttgcgaactggggccgcgcggcaccggtaaaagccatgtgtataaagagtgttctcctaactccctgttagtttctggcgggcaaacgaccgttgccaacctgttctacaacatggccagtcgccagatcggccttgttggcatgtgggatgtggtagcgttcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagacactcgttaaaaccagccatttgctggcgccatttccggctgcgatgattgataccgcctttttcgaccgctttcatgcctatattcccggttgggaaatccccaaaatgcgcccggaattctttaccaaccgttacgggctgattacggattatctcgctgaatatatgcgcgaaatgcgcaaacgcagtttctctgatgcgattgataaattctttaagctgggtaataaccttaaccagcgtgacgtcattgctgttcgacgtaccgtgtcgggattgttaaaactcatgcatcccgatggcgcgtacagcaaagaagatgtgcgagtctgcctgacctatgcgatggaagttcgtcgccgcgtgaaagagcaacttaaaaaactgggcggcctggagttcttcgatgtgaactttagctacatcgataacgaaacgctggaagagttttttgtgagcgtaccggaacagggcggcagcgaacttattcctgccggaatgccaaagccgggcgttgtgcatctggtcactcaggcagaaagcggcatgaccgggttgtatcgctttgaaacacagatgactgccggtaatggtaagcatagtgtatcgggtctgggttcaaatacctccgcgaaagaagctatccgcgtcggtttcgattacttcaaaggcaatttgaaccgggtaagcgcgaccgcgaaattctccgatcatgaatatcatcttcatgtcgttgaactgcataatactggccctagcaccgcaaccagtcttgctgctcttattgctttatgttcgatattgctggcaaaaccggtgcaggagcagatggtggtgttgggcagtatgacgcttggtggagtaattaacccggtacaagatcttgctgccagtttacagctcgccttcgacagcggcgcaaaacgagttctgttgccgatgtcctcggctatggatattccaacggttccggcagagttatttaccaagtttcaggtgagtttttactcagacccggttgatgcggtttataaggcgctgggagtgaattaa

SEQ ID NO: 3876 - DNA, 2055 bp, Paenibacillus elgii
atggagacagtaagtgatgaacagtcattcgatttagaccgtaagctgaatggtgtcttttcgggcagagttgttcggaaagacctgacgaagcttatgaaagaaggagctaacgttccagtctatgtacttgaatatttattggggatgtatgcggcgacagacgatgaggataacattcgagaaggaatcgaacgtgtaaagaagatcctcgtcgagaactttgtaagacccgatgaggcagagaaggtaaagtcaaggattcgggaactcggtcaatactccgttattgataagattactgtaacgctcaatgagaaaattgattcttatgtagccggattttcaaacctgggtcttaaaggggttcccatatcgccgaactatgtgaaagagtatgacaagctcctagcaggcggcatctggtgcatgttgaaaatggattacttcttcgacgaggaagtgaagaacagcaatccattcagcatcagtagtttgaagcctattcaaatgcctaatatggatttgaatgaagtgtttgaaggcaggaagagcttcacgaaagaggaatggatcgatgtactcattcgttcgacaggtatggagccgacacaacttgaagatcgaatgaaatggcatcttctacttcggcttgtgccgcttgttgaaaacaactataacatgtgtgaattgggtcctcgtggtacgggtaaatcccatgtttataaagagatctcacctaactcaattcttgtatctggtggccaatcaactgtagccaatctgttctacaatatgtccacgaagaaggttggacttgttggactctgggacacagtggcattcgatgaggtagctggcatcacgttcaaggacaaagatggcgtacagatcatgaaggactatatggcatcagggtcatttgcacggggcagagaagagaaggcggcatctgcttccatggttttcgtcggtaacattaaccagagtcttgattcactcattaagacatctcatctgttcgcaccatttcctgaggctatggcgaatgattcggcattctttgatcggatgcattattacctgccaggctgggaaatacctaagatgagacccgacttttttacggacaagtatgggttcatcgttgattacatggctgaatacttcagggagatgcggaaacgttcgtttgcagatgccattgatccatactttaagctaggtaataacctaaatcaacgtgatgtgatcgctgtccgtaaaaccgtctctggatttataaagctcctgtacccgaatggggagtatacacgggaaaacgttgaggagatcttgaaatacgcacttgaaggacgacgcagggtaaaggaacaactaaagaaaatcggaggcatggagttttacgatgttcatttttcctacattgatcgagaaacactgagcgaggaatatgtttctgtaccagagcagggcggtggaaagctgattcctgaaggcatgggaaaacctggtcatgtttattgcgttggtcatggcgattcaggcatgattggggtatataagctggagaatcaagttgtatctggtacaggtaagtttgaaaaatcaggtgtgggtattcatcgaggagctaaggagagcttagatacagcattccgatactttacgtcgaacagcaaaagtatcagtagttcgattagcacaaagacgaaagattatctcatgcatattagtgatttgcaggggatcggcttgacggaagaactggcaatcgccgagctaattggattatgttcaggggcattggaaagacctgttcaggagagcatggttgtacttggaaatatgacagtaggcggtacaattgcaaaggtagaagagttcgccaatacacttcaagtttgcgtggatgcaggggctaagaaggtcttgatccctgccgcttccgttgtggactttcaaacggttccggccgatttgctgataaaggtacaaccagtgttttactcggatccaactgatgcggtatttaaggcactcggagtaagttaa

SEQ ID NO: 3877 - DNA, 2085 bp, Escherichia coli; identical to SEQ ID NO: 3687

SEQ ID NO: 3878 - DNA, 2103 bp, Pseudomonas mandelii
atgagtcagctcgacgacaaaatcaaccagcactttgccggactagtggtgcgcaaagacctggtcaaagcggtgaagggcaacgccattgtgccgtcgtatgtgctggagtacttgctgggccagtactgcgcgaccaatgacgaagcgactatccagaccgggatcgagaccgtcaaggagatcctgcgtaagcactatgtccaccgcaacgaagcagggttggtgcgctcgaccatcaaggagaaggggcggcacaaggttattgaccgtattagcgtctcattaaacgacaaggatgacgtgtacgaggctgagttcgccaacctgggcatcaagaaggtgctgatcgactccaacaccgtcaaggcccaccagaagctgctggtaggtggtgtttggtgcattgcagatgtagagtatgaatacaccgaggacaagtcttcctcaccttggattctggcctcgctaaagccaattcagatttcccgctttgatttcgacggctatctggaggcacgtaagcagttcaccactgatgagtggattgacctgctgatccagagcgtagggttcaatccgcagatgtttggcaagcgcaataagcttgctcagcttatccgccttattccgttctgcgagcgcaactacaacttgatagaactggggccgaagggcactggcaagtcacacgtttattccgagttttcaccccacggcattcttatctccggtggcgaagttacagttcccaagctgttcgtccataacggcacaggtaagctcggtctggtgggttactgggatgtagtggctttcgatgagttcgccggtaagcaaaagcgagtggataaggcgctggtggacatcatgaagaactacatggccaacaagtcgttctcgcggggtgtggaaaccctcggagctgaggccagcatggtgtttgtgggtaataccgatcacaccgtgccctacatgcttaagcacacggacctgttcgacccgctgccggaaaagttccacgattcagcctttctcgaccgcattcacagctacatccccggttgggaagtggatgtcatccgtggcgagatgttctccagtggttacggcttcgtggtggactacctggccgagatcctgcgctcgcttcgcagtcatgactactcagatcgctataagggacagttcacgctatccgacgatatttcgacgcgcgaccgcgatggcatcaacaaaaccttttctggtttgatgaagatcctgtacccgcatggcgaggcgacagacgccgaagtggaagacgtattgcgcactgcaattgaagggcgcaagcgggtgaaggatcagttgctacgcattgacgcgacctatccggcagttcgttttgcctacaaggggggggatgctcaggagcggttggtgcgcactctggaagaggatgagtaccctaatcaataccatcgaaggggagcaactgaagtttctactgcagacttaccccaagtcggtactgaccctttggcgcttatcgaggcagcgccagccatgcaagggccagcttcacgcccaagcaatcctgcgccgatggaaccagtggtgaaggagcagcatttggtcttccacgaaaatcagcgaggactgagttttgacaagttgttcagtccctatctggtaggtgccaagcgcatcatcatcacagacccctatcttcgtatgttccaccagttgcgcaacttgatggagctgatggagaccattagcaagctgcaaggcccggaagatgaggtggtggttcatgtggtgaccgttgaggatgattccaatggtgatcgtcagaccgaaagcctgcagaagatcgctgatgcttgtacgggtgttggcatccagttcagttgggcctacgacactagcggcaccaagcatgatcgagacatcacaaccgacacgggttggaagatagtgcttggtcgtggtttggatgtttttcagcgctttgagctgaatgatgccttcagctttgcgaatcggctccagcagcatcggcagtgcaaagaattcagtgtgacctttgtgcgaattggcccggcagcttgttcgtag

SEQ ID NO: 3879 - DNA, 2076 bp, Vibrio cholerae; identical to SEQ ID NO: 3758

SEQ ID NO: 3880 - DNA, 2052 bp, Vibrio cholerae; identical to SEQ ID NO: 3740

SEQ ID NO: 3881 - DNA, 2052 bp, Vibrio cholerae; identical to SEQ ID NO: 3740

SEQ ID NO: 3882 - DNA, 2076 bp, Escherichia coli
atgcaacagcaggataactcagccagtaacatggaaacggcctctgtgttggctcaggacctggattcattgttgaatcagcactttcgcggtcgcgtggtgcgtaaggatctgactaagcaacttaaagaaggggcgaatgttccggtttacgtactggaatatctactcggtatgtactgtgcctccgatgacgatgaggttgtcgagcaggggctacagtcggttaagcgtattctttctgataactacgtccgcccggatgaagcagaaaaagtgaaatcactaattcgcgagcgtggttcttacaagattatcgataaggtcacggtaaagctaaatcagaagaaagacgtttacgaagcccagctctctaaccttggcattaaagatgccctggtgccgtcgcagatggtgaaagacaacgagaaactgctgactggtggcatctggtgcatgatcaccgtgaactacttttatgaagaggggcaaaaaacgtctcctttctcgctgttcacactgaagccgatccagatgccaaatatggatatggacgaggtatttgaagcccgcaagcagtttgatcgcgaccagtggattgatgtgctgttacgttcggtcgggatggaacctgcaaatattgagcagcgtaccaagtggcatctgattactcgcatgattccctttgtggaaaacaactataacgtctgcgagcttggtccacgtggtacaggtaagagtcatgtttataaagagtgctctcctaactccctgctggtatctggcgggcaaaccacggtggcgaacttgttttacaacatggccagccggcagattggtcttgtgggaatgtgggacgtcgtcgcgtttgatgaagtggcagggatcaccttcaaagacaaagatggcgtgcagatcatgaaggattacatggcatcaggctcattctctcgtggtcgggactccattgaaggcaaagcctccatggtgtttgttggcaacatcaatcagagcgtagatacactggtcaaaaccagccatctgctagcaccgttcccggatgcgatgattgatactgcattttttgaccgcttccatgcctatattcctggttgggaaattcctaagatgcgcccggaatttttcaccaatcgctatggtttgattacggattatctcgctgaatacatgcgcgagatgcgtaaacgtagcttctccgatgcaattgataaattcttcaagctgggaaataacctcaatcagcgtgacgtgattgctgttcgacgtacagtgtcggggttgttaaaactcatgcatcccgatggcgcgtacagcaaagaagatgtacgagtctgcctgacctatgcgatggaagttcgtcgtcgagtgaaagagcaacttaaaaaactgggcggcctggagttcttcgatgtgaactttagctacatcgataacgaaacgctggaagagttttttgtaagcgtaccggaacagggcggcagcgaactaattcctgccggaatgccaaagccgggcgttgtgcatttggtcactcaggcagaaagcggtatgaccgggctgtatcgttttgaaacgcagatgactgccggtaatggtaagcatagtgtatcgggcctgggttcaaatacctccgcgaaagaagctatccgcgtcggtttcgattacttcaaaggcaatttgaatcgggtaagcgcggcagcgaaattctccgatcatgaatatcaccttcatgtcgttgaactgcataatactggccctagcaccgcaaccagtcttgctgcgcttatcgctttatgttcgatattgctggcaaagccggtgcaggaacagatggtggtgttgggcagtatgacccttggtggagtaattaacccggtgcaggatcttgccgccagtttacagctcgccttcgacagcggcgcaaaacgggttctgttgccgatgtcctcggctatggatattccaacggttccggcagagttatttaccaagtttcaggtgagtttttactcagacccggttgatgcggtttataaggcgctgggtgtgaattaa

SEQ ID NO: 3883 - DNA, 2085 bp, Salmonella enterica; identical to SEQ ID NO: 3644

SEQ ID NO: 3884 - DNA, 2184 bp, Collinsella stercoris
atggattcaagtttcggcacctgcggcgtgcccgcatatgaagcagatgagctcgaccgcaagatcatcgagcatttccccggcaagatcgtgcgcaaggacctcacctccctcatgaagcgcagcgcgggcatccccacgtacgtgctggagtacctgctgggcatgtattgcgccaccgatgacgaggcggcgatcgccgatggcatggcgcgtatccgaaaaatcctcgccgagaactacgttcgccccgaggaaagcgagaagatcaagagccgcatccgcgagctggggcaatacaccgtgatcgataaggtgagcgcccgcctggacgaataccgcgatctctacatcgcgcagttcaccaatctcaacatcgagccgttcgtcatgcccgacgaatacgtccgccagcacacaaagatcctcacgggtggcatatggtgcatcatgcgcatccaatacctgcggcccgaggacatcgcggaggacccgcttgccgatatcttcggcgatgaccccgccgaacagcgcgggcgggcgcgcaaagggcgaacctcgggcaagggcaagcgcgggcccgaggactcccctttcaaaatcgcgagcctcacacccatccagatgcccagcctcgacctgcccgagttcgtgagccatcgagaggcgttcagcaccgacgagtggattgcgctgctgctccgctcggccggatatgaaccgtccgccctcacgccgcgcgagcgcatgcacttcctcacgcgcatggtgccgcttgtggagctcaactacaacctgtgcgagctggggccccgcgggacgggcaagtcccacatctacaccgaggtctcgccctactcctacctgctctccggcgggcagaccaccacggcaaagctcttcgccaacaacgcggcgcgcgcggggcagcgcatcgggctggtggggcattgggattgcatcgcgttcgacgaggtcgcgggcatgaactttcgcgatcaaaacgccatccagatcatgaagggctacatggcgaacggcaccttcggccgcggcaccgagtcgtttaacgccgaggcgtccatggtgttcgagggcaacatcaacgactccgtggcaaacgtgctcaagaccacacacctgttcgacccgttcccgcccgagttcaacaacgacagcgcgttcttcgaccgcatccactgctacctacccggctgggaggtgcccaagatgcgctcggacctcatctgcgagcgctacagcctcatcaccgattgcctgggcgaattcctccacgccatgcgcaggcgcgacttcacgcaccacatcgaccgatacttccgcctgaacagcgatttcaaccgccgcgacgagatcggggtgcgcaagacctttagcgggctcgccaagctcattttccccgacggcaaaatggatcgtgaggacgtgcgcatgctgctggaatacgccatcgaggggcgcagacgcgttaaagaacagctcaagaccatggcgggcatcgagttcatcgatgtgaagctgggatatacggatgtggagaaccccgtggagatgcacgtagttggcgtgctggaacaaaccgacgacgcgctcattcccgacaccacgccgcaggcaggccacgtctttggcgtgggtcgctcggttgccgacgagatggccatatacaagctcgaaaacaaggccgtgagcggcaacgccgcgtttaggatggagggcgttgggccgaaccgcgaggtgcgtgatgcgctgaatgccgcgttcgagcaattcaagaactgcgctccgtggctggcagccggcatgcacgtgacaagcagggattatctgctcttctgcaacgacctgcaggcgaagggaccctctgcggaggtgtcgctggccgagttcatcggtctgtgctccgccgcatcgggacgccccgtgatagcgggactggtgattcccggcatcctgcgcctctctgggtcactggagcccatcagcaacttagcggatgtcctgcgcgtcgcgaagaacgcaggcgccaagcgcatcctgctgccgatgagctccatcgcggacctgcagggcgtcgcccccgagctgatcggagccgtgagccccgagttctacgagaccggcgacgccgtggctgcggcgcggcgagcccttggactgtaa

SEQ ID NO: 3885 - DNA, 2034 bp, Enterococcus faecalis; identical to SEQ ID NO: 3786

SEQ ID NO: 3886 - DNA, 2064 bp, Pseudoalteromonas flavipulchra
atgaataaacttaaccaaaaaatatgtgatgaatttgcaggtcttgttgttagaaaagacttggtaaaaaccgtaaaaggtaacgctattgttccatcttatgtacttgaatacttgctaggtcagtattgtgcgacaagtgatgaggcaagcattgaatcaggtatacaaacggttaaagaaattttagctaagcattatgtgcatcgtaatgaagctgggttaattcgctccaccattcgtgagaaaggtcgccataaagttattgataaagtgagtgtatcactcaatgacaagaaagacgtgtatgagacggagttctcgaatcttggcattaaaaaggttctgattgattctggtacggtaaagaaacacccgaaattactggttggtggcgtatgggttattgccgatattgagtacgaccatactgaagataaagacgccagcccttggattttaagtaccattaagcccatccaaatgtctcattttgattatgatggttatatcagtgctagaaacaagtttgatttagatgagtggattgatgtgctggtacaaagcattggctttaatccagagttttttggacgaagaagtaaacttactcagttggttcgcctgatcccattttgtgaacgtaactacaacttaatagaacttggccccaaaggtacgggtaaatcgcatatctactctgaattctcgccgcatggtattttgatatctggtggtgaagtaacagtacctaagttatttgtaaacaactctagcggcaaattaggtttggttggttactgggataccgtcgcttttgatgaatttgcaggtaagcaaaaacgagtcgacaaagcgctcgttgatatcatgaaaaactacatggcaaacaagtcgttctctcgtggtgtcgaaaccttgggcgctgatgcatcaatggcttttgtggggaatactgagcatagcttgccttacatgttgaagcattccgatttatttgatgccttgcctgaaaagttctatgactcggcatttttagaccgtcttcatttctatattccgggctgggaagtcgacattatccgtggtgaaatgttctctagcggatatggctttgttgtagattatttggcggaggttttgcgccatttaagaaaccaagattactcagatcgataccaagagtatttcaagctttcttctcaaatttcaacccgtgacagggatgcaatacataaaacgtttagcggtttgatgaaaatattgttcccgcaaggcggagcaacagaagcagaaattgaagaaattcttaagtttgcaatggaaggtcgtaaacgagttaaagatcaactgttccgaatagatagtacttatgtagacgttaactttgcatatagtaataaagctggacaagaattggctgttcaaaccctagaagaactgcaatatccgaattattttaatcagaccgttggtgaagtttcggatattggtatgccagagcctgatattgagcctgtaggtgtcagttctgcgcaacagccatcacaggcagtgtccgcgccttgttctgaattgaaagagcatcacgtaacatatgctgaaaatcaacgtggtgtgagttatgacaagctttttgggccatatttaaaaggcgctaagcacatcacgattaccgacccttatattcgaatgttctatcaagctaaaaacctaatggagttgcttgaaacgatagtgaaattaaaagaggaaggtgaagaagttgtcgttagcctagtaaccgttgaagatgagtcaaaaggtgaagctcagcgagactttttcgaacagatccaaagtacaatgttttcggttgggataaagtttgcgtattcatttgataactcaggaactcaacatgctcggcatattgttaccgatcatggttggaagatatcgctcgatagaggattagatatatttcagcaatatgactctaatgatgcttttagtttatctacccgcttgcaaactcatcgagccgtaaaagcattcgaagtgacttatattaaagtcgactag

SEQ ID NO: 3887 - DNA, 2085 bp, Escherichia coli
atgcaaacccatcatgatttacctgtttcaggcgtatccgcaggggaaattgcctccgagggttacgatctggacgccctgctgaaccagcattttgctggtcgtgtggtgcgtaaagatctcaccaagcaactcaaggaaggggcaaacgtcccggtgtatgtgctggagtatctgctcggcatgtactgcgcctctgacgatgacgacgtggtcgagcaagggttgcaaaacgttaagcgtattctggctgataactatgtgcgcccggatgaagcagagaaagtgaagtcgctgatccgcgagcgtggttcgtacaaaatcatcgataaagtgtcggtgaagctaaaccagaaaaaagacgtttacgaagcccagctttctaacctcggcatcaaagacgcgctggtgccatcgcagatggttaaagacaacgagaagctactgacgggcggtatctggtgcatgattaccgttaactatttctttgaagaagggcagaagacctcacccttctcattgatgacgctcaagcctatccagatgccgaatatggatatggaagaagtgttcgatgcgcgtaaacactttaaccgtgaccagtggatcgatgtgctgctgcgctcggtgggtatggagcccgccaatattgagcaacgcaccaaatggcaccttatcacccgtatgatcccgttcgtggagaacaactataacgtttgcgagctggggccgcgtggcaccggtaaaagccatgtgtataaagagtgttctcctaactccctgttagtttctggcgggcaaacgaccgttgccaacctgttctacaacatggccagtcgccagatcggccttgttggcatgtgggatgtggtagcgtttgacgaagtcgcggggatcactttcaaagataaagatggcgtgcaaatcatgaaagattacatggcgtcaggatctttctctcgcggcagagattcgattgaaggtaaagcgtcgatggttttcgtcggcaacatcaatcaaagcgtagagacactcgttaaaaccagccatttgctggcgccatttccggctgcgatgattgatactgcatttttcgaccgctttcatgcctatattcccggttgggaaatccccaaaatgcgcccggaattctttaccaaccgttacgggctgattacggattatctcgctgaatatatgcgcgaaatgcgcaaacgcagtttctctgatgcgattgataaattctttaagctgggtaacaacctcaaccagcgtgacgttattgccgttcgacgtaccgtgtcggggttgttaaaactcatgcatcccgatggcgcgtacagcaaagaagatgtgcgagtctgcctgacctatgcgatggaagttcgccgccgcgtgaaagagcaacttaaaaaactgggcggtctggagttcttcgatgtgaactttagctacatcgataacgaaacgctggaagagttttttgtaagcgtaccggaacagggcggcagcgaacttattcctgccggaatgccaaagccgggtgttgtgcatctggtcactcaggcagaaagcggcatgaccgggttgtatcgtttcgaaacgcagatgactgccggtaatggtaagcatagtgtatcgggtctgggttcaaatacctccgcgaaagaagctatccgcgtcggtttcgattacttcaaaggcaatttgaatcgggtaagcgcggccgcgaaattctccgatcatgaatatcaccttcatgtcgttgaactgcataatactggcccaagcaccgcaaccagtcttgctgcgcttatcgctttatgttcgatattgctggcaaaaccagtacaggaacagatggtggtgttgggcagtatgacgcttggtggagtaattaacccggtacaagatcttgctgccagtttacagctcgccttcgacagcggcgcaaaacgagttctgttgccgatgtcctcggctatggatattccaacggttccggcagagttatttaccaagttccaggtgagtttttactcagacccggttgatgctgtttataaggcgctgggtgtgaattaa

SEQ ID NO: 3888 - DNA, 2121 bp, Johnsonella ignava
atggaaatgatggatatggcggcagacgatactcgtgaagaactgtgcaggaaactgcgcagcaactttgacggtcgaatcgtccgcaaagacctgacaaagaaaataagagaaggggcaaatgttccggtctatgtgctggagttcctgctggggcagtattgcagttcagacgatgagacaatcattgagcagggcgttcagaatgtgaaacgcattctggcagacaattttgttcgcccagatgaggctcagaaaattctctcccagctgcgcaagaacgggagccatagcattattgatatggtgacagtacatctggacattaaaaaggactgcttttttgcggagttctctaaccttggacttaccaatgtgccgattacggatgattatccggaaaaatatgaacggctgctttgcggcggtatctggtgcatcgtgcagctggaatatgagtctgagggagacagcggctttggaatcacagatatagatggacagcctatttcctctaaacagaaaaagcagaagaatatctcacccataagcatacataagctgactccgatccagatgccccatatcgacatcgaagaagtccgcgagggacgcaaggcgttcacacaggaagagtggatgaatgttatgctgcgttcctgcggatatgagccggaacagctgaacaatcgggaaaagtggctgctgtttgcacgtatgctgccgttggtggagaacaacttcaatctctgtgagctggggccgcgcagcaccggtaaatctcatatttataaagaaatcagcccaaacagtatccttgtgtccggtggtcagacgaccgttgcaaatctgttttacaacatggggcgcaaaaccgtgggtttagtgggcttatgggactgcgttgcctttgatgaggttgccggaatcaagtttaaagacaaagacggcattcagattatgaaagactatatggcttccggctcctttgcccgtggcaaagaggaaaaggcagcatcggcttctatggtctttgtgggaaacatcaatcagagcgtagatgtactgctcaaaacttcctccctgtttgatccgtttccgccggagatgggaacggacacggcctttcttgatcgtctgcattgctacattccaggctgggagattccgaagttccgtccggaacattttaccaacgactacggctttatcacagattacttggcagagtttattcgagaactgcggaaagaacagtatggcgatgcgttggataagtatttccggcttggaaagaacctgaaccagcgtgatacgattgctgtccgcaagattgtgggcggctatgtaaaattgctgtatccggatggtgagttcacaaaagaacagatcgaagaaatcctagtatttgcgctggagatgcgccgccgcatcaaggaacagctgaaaaaactgggtggaatggagttctatgatgtgaatttcagctatatcgaccttgatacctttgaagaaaaattcgtctctgtgccggagcagggcggcggcaaactcatccccgatggcatctgcaatcctggacaggtatataccgtaagtcagggcaagtccggtatgatcggcgtattccgccttgaaagccagatgctgcccggtaacggaaaatttgagcgcactggccttggcagcgaccgtgactgcaaggaatccacgaatacggcgtttaatttcctgaaagctaacggaaatcgaatcagtggcagcataagcaccacgatgcgggattacatcatcaactatcaggatttacagggtattggcatgaccggaaagctggcattgcctacattgattgcgctatgcagcatcgctcttggacggcctacggtcaatacacttgccgtgctgggagaaatcagtatcagcggcacgattcttaaagtggacgagcttgctaatagtttacaggtatgccttgatagcggagcaaagaaagtgttgcttccgattaccagtgcagcagaccttggcaccgttccaccggagttggtgggcagttttaatctgattttctacagcagtgcggaggatgcggtgtttaaggcgttgggggtagagtaa

SEQ ID NO: 3889 - DNA, 2052 bp, Vibrio cholerae; identical to SEQ ID NO: 3740

SEQ ID NO: 3890 - DNA, 2052 bp, Vibrio cholerae; identical to SEQ ID NO: 3740

SEQ ID NO: 3891 - DNA, 2085 bp, Enterobacter sp.
atgcaaacccatcatgacttacccgttccagccgtctccgaaggggaactcgtcgcagaaggttacgatctggacgccttactgaatcagcattttcgtggtcgggtggtgcgtaaagatctaaccaagcagctcaaggaaggggctaacgtcccggtctatgtgcttgagtatctgctcggtatgtactgcgcttccgacgataaccagatagttgagcaagggttgcagaacgttaagcgcattctggccgataactacgtccgccctgatgaagcagagaaggtgaaatcgctcattcgtgagcgaggatcctacaagatcatcgataaagtgtcggtaaagctcaatcagaagaaagacgtttacgaagcccagctctccaacctaggcattaaagatgcactggttccgccgcagatggtcaaggacaacgagaagctgttgaccggtggcatctggtgcatgatcaccgtgaactacttctttgaggaaggacagaaaacgtcccccttctctctgatgacgctcaaacctatccagatgcccaatatggacatggaagaggtatttaccgcacgtacgcacttcaaccgcgaccagtggattgacgtcctgctacgttccgtgggtatggaacctgctaacattgagcagcgaaccaagtggcacctgatcacccgtatgatccctttcgtggaaaacaactataacgtctgcgaactgggcccacgcggcaccggtaaaagtcacgtctataaagagtgttcgccaaactcgctattagtttccggcgggcaaaccacggtagcaaacctgttttacaacatggccagccgccagattggcctggtcggtatgtgggatgtggtcgcgtttgatgaagtagctgggatcaccttcaaagacaaagacggcgtgcaaatcatgaaagattacatggcgtctggctcgttttcccgcggcagagattcgattgaaggcaaagcatcaatggtgttcgtcggcaacatcaatcagagcgttgagacgctagtcaagaccagccatctgttagctcccttccctgccgcgatgatcgatacggcgtttttcgaccgcttccatgcctatatccccggctgggaaatcccgaaaatgcgcccggaattctttaccaatcgctacggccttatcacagattacctcgccgaatacatgcgggaaatgcgtaagcgcagcttctccgacgcgatcgataagttctataagctgggtaataacctcaaccagcgagatgttatcgcggtaaggcgcacggtttctggtctattgaaacttcttcatcccaatggctcttacagcaaagaggacgtccgtgtttgcctgacttacgccatggaagcccgtcgtcgagtcaaggaacagcttaaaaagctgggcggtctggagttcttcgatgtgaatttcagctacatcgataacgagacgctggaagaattcttcgtcagcgtaccagaacagggcggcagcgaattaattcctgctggcatgccaaagccaggcgtagtgcatttagtgacgcaagcggaaagtggcatgacgggtctgtaccgcttcgaaactcagatgaccgcaggcaacggtaagcatagcgtttccggtctgggatcaagcacctcggcaaaggaagctatccgggttggatttgactatttcaaaggcaacctcagccgcgttagcgcaacagcaaaattttctgaacatgagtaccacctgcacgtagtcgaattgcataatactggaccaagtaccgcgaccagtctggcggcacttattgccctttgttccgttttactggcgaaacccgttcaggaacaaatggtcgtcttaggtagcatgacgctcggtggagtaatcaaccctgttcaggatctggcggctagcttacaacttgctttcgatagcggcgcgaaaaaagtccttctgccgatgtcttctgcggtagatattccgactgtgccagccgagttgtttaccaaattccaggtcagtttttactctgaacctgtagatgcggtttataaggcgctgggtgtcaattag

SEQ ID NO: 3892 - DNA, 2034 bp, Enterococcus faecium; identical to SEQ ID NO: 3762

SEQ ID NO: 3893 - DNA, 2052 bp, Vibrio cholerae; identical to SEQ ID NO: 3740

SEQ ID NO: 3894 - DNA, 2037 bp, Bacillus cereus
atggagatggaggatttaaatataaagttaaacgctcattttgcaggaaaagtagtacgcaaagacttaacaaagaaaattaaagaaggtgcgaatgtacctgtatatgtacttgagtacttacttggtatgtattgtgcaacggatgatgaaaagagtatgaatgatggcgtgcaaatggtcaaaaagattttatcggataatttcgtacgtccagatgaagcagagaaagtaaagtcgaaagttaaggagcttggcaagtatactgtcattgataaaattggcgtaaaattaaatgataaaaaagacatatatgaagctgagttttctaatcttggattaaatggggttccgatttcttcacattatgtaaaagaatttgataagctccttgcaggtggtatatggtgtattgtgaaaatggaatattattttgatgaagaatcaaaaggtacaagcccatttagcattgagagcgttacaccaattcaaatgcctaatatggatttagaagagatgtttgaacaaagaagacaattttcaaaagaagaatggattgatgtacttattcgttcaactggtatggaaccaactcaattagaggacacagtaaagtggcatttacttgaaagaatggtaccactcgtagagaataattacaatttatgtgaacttggaccgagggggacagggaaatcacatatctataaagagatttcccctaattcgattctagtatcaggtggccaaacaacggttgcgaatttattttacaatatgtcgactagaaaaataggcttagttggtatgtgggatacagtagcatttgatgaagttgcaggaattacgtttaaagataaagatggcatccaaattatgaaagattatatggcttcaggttcctttgcccgaggccgcgaagaaaaaaatgctaacgcatctatggtttttgtaggaaatattaatcaaagtgtagatgtattattgaaaacttcacacttgtttgatccgttcccagaagcaatggcatatgattctgcattctttgaccgaatgcactactatttaccgggatgggaaattcctaaaatgaggcctgaattcttcacaaatgaatatggtttcattacagattatttggcagaatttttacgagaaatgcgaaaacgctctttctcagatgcgattgataaatatttcagattaggaaataatttaaatcaacgtgatgtaatcgcagtgcgtaaaactgtttcgggtttgattaagttgttatatccgaacggtgaatatataaaagaagatgtggaagaagtactacgttacgctctaataggacgcagacgtgtgaaggaacaattaaagaaaattggcggtatggagttttatgatgttaatttctcttatattgataatgaatcaatgaatgaagagtttgtatcggttccagaacaaggtggaggaactttaattccagaggggatgaacaagccagggcatatttatacagttgctcgtggaaagactggaatgattggtacttataaattagaaacagaagtcgtgagtggtaatggtaagtttgaaaaaacaggattaaattcagatcgagatgctaaagaaagtatagataccgcctttagattctttaaagcaaataataaaaatataagtggcactattagtacaacaacaaaagactacttaatgcatattcaagatattcacggagttggattaactggtgagttatcgcttgcagcatttatcgcattatgttcaggtgcattaaataaaccagtacaaagtcaaatggttgtattagggtctattagtataagtggaacgattaataaagtagaagaattagccaatgtattacaagtttgttttgattcaggggcgaaaaaaatacttttaccgatggcatcggctgtagacatacccatcgtaccacctgaactgtttgctaagtttcaaataggtttttatcaaagtgcagaagatgcagtatttaaagctttaggggtcgaataa

SEQ ID NO: 3895 - DNA, 2034 bp, Enterococcus faecium; identical to SEQ ID NO: 3762

SEQ ID NO: 3896 - DNA, 2085 bp, Salmonella enterica; identical to SEQ ID NO: 3644

SEQ ID NO: 3897 - DNA, 2052 bp, Vibrio cholerae; identical to SEQ ID NO: 3740

SEQ ID NO: 3898 - DNA, 2052 bp, Vibrio cholerae; identical to SEQ ID NO: 3740

SEQ ID NO: 3899 - DNA, 1665 bp, Escherichia coli
atggttaaagacaacgagaagctactgacgggcggtatctggtgcatgattaccgtcaactatttctttgaagaagggcagaagacctcacccttctcattgatgacgcttaagcctatccagatgccgaatatggatatggaagaagtattcgatgcgcgtaaacactttaaccgtgaccagtggatcgatgtgctgctgcgctcggtgggtatggagcccgccaatattgagcaacgcaccaaatggcaccttatcacccgtatgatcccgttcgtggagaacaactataacgtttgcgagctggggccgcgcggcaccggtaaaagccatgtgtataaagagtgttctcctaactccctgttagtttccggcgggcaaacgaccgttgccaacctgttctacaacatggccagtcgccagatcggtctggttggcatgtgggatgtggtagcattcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagacgctcgttaaaaccagccatttgctggcgccatttccggctgcgatgattgataccgcctttttcgaccgctttcatgcctatattcccggttgggaaatccccaaaatgcgcccggaattctttaccaaccgttacgggctgattacggattatctcgctgaatatatgcgcgaaatgcgcaaacgcagtttctctgatgcgattgataaattctttaagctgggtaataaccttaaccagcgtgacgtcattgctgttcgacgtaccgtgtcgggattgttaaaactcatgcatcccgatggcgcgtacagcaaagaagatgtgcgagtctgcctgacctatgcgatggaagttcgtcgccgggtgaaagagcaacttaaaaaactgggcggtctggagttcttcgatgtgaactttagctacatcgataacgaaacgctggaagagttttttgtgagcgtaccggaacagggcggcagcgaacttattcctgccggaatgccaaagccgggcgttgtgcatctggtcactcaggcagaaagcggcatgaccgggttgtatcgctttgaaacgcagatgactgccggtaatggtaagcatagtgtatcgggtctgggttcaaatacctccgcgaaagaagctatccgcgtcggtttcgattacttcaaaggcaatttgaatcgggtaagcgcggccgcgaaattctccgatcatgaatatcaccttcatgtcgttgaactgcataatactggcccaagcaccgcaaccagtcttgctgcgcttatcgctttatgttcgatattgctggcaaaaccagtgcaggaacagatggtggtgttgggcagtatgacgcttggtggagtaattaacccggtgcaggatcttgccgccagtttacagctcgccttcgacagcggcgcaaaacgagttctgttgccgatgtcctcggctatggatattccaacggttccggcagagttatttaccaagtttcaggtgagtttttactcagacccggttgatgcggtttataaggcgctgggtgtgaattaa

SEQ ID NO: 3900 - DNA, 2085 bp, Salmonella enterica; identical to SEQ ID NO: 3644

SEQ ID NO: 3901 - DNA, 2028 bp, Haloarcula japonica
atgacgactgaggacgtagatcggaaggccctggatgtcttctccgggcgcgtcgtccggaaagaccttgttcaggacatcaaatccggggtaaacgtccctacctacgttctcgaatatctgattggacagtactgtgcgactgatgacgaggaatctctggaagagggcctcgaaaaggtcaaagagatcctgtcgaagcactacgttcgtcccgacgaagccgaattcgtcaagagcgaggttcgagaacgaggacgctatcgcgtcattgataaggtcaccgtcaggctcgatgagcaacaggatgcctacatcggttcgttcgtcaatctcggtttgagcgatgtcgagattaacgaacatctcgtcagcaagcatccaaagctcctcggtggtggcgtctgggctatcatcgacttggaatatctccccgataatgcgaacagtccaaagagcctcttcggcatcgactcgttcaaacccattcaggtatcgaatcttgaccttgaccaactgaaagatcgacgtaaagatttcacgcgcgacgaatggatggaccttctccttcagactgtcggctacgacccctcttcatttagcgaccgcgagaaattcctcttcttggctcggtgtatcccactcgtcgagtcgaattacaactacgtcgaattgggaccacgtgggacgggaaagagctatctctaccgcgaaatcagtccccattcaatcctcatctctggcggtaaaaccaccgtagcaaagctcttcttgaacctgaatacgggacgaatcggcctcgtcggtcgctgggatgtcgttgcattcgacgaggtcgggggactccagttcagcgattcggaagccgtccagatgctcaaagactacatggagtccggaagcttctctcgtgggactgaagagctgactgcccaagcctcgatggtctacgtcggaaacattgacctcgacgttgaaggcgttctcaagagttcacacctctttgaaccgttccccgaggatatgcaggatctcgcgctcatcgaccgattccactactaccttccagggtgggaagtcccgaagatgcggtccgagttctttggcgaccagtttggattcatcgtcgactacttcgctgaattcgtccgcgaacttcgcaaggagtcgtacggtgacgcgattaacgaggagttcgcgtttggtgaccatctgaaccaacgagacgaaaaggcagtacgaaagacagtctctggtctactcaagctacttcacccacatggccactacacgaaagaagagctccgagagtatctcgaattcgctatggaaggtcgtcgtcgagtcaaggagcaattgaagcggattggcggtatggaatatcgcgccgtcgaattctcctaccttgacctggagacgaaagaggagatctatgtctcagtacccgaagaagcagacgagtcactcattcccccaggaacacagcaggcaggaacggtctacacaataggtgagagcgaaggacgccacgcacccttccgaatcgagacacagacgctcccggggtcaggcaagacgaacatttctggcacacccggaaaacggatgaaagagtcgttcgaaaccgcctgtgactatctccaggcgaatatgcgggaactcagtcgtgaagagaccctagatgaatacgacatcaatgtccaggttctcaacccctctgatgcaaatgagggtggtgaaacgagcgtcgggctactcgtaggtattgtttcgggaattcttgaccggccagttcggccacaaacggttgtactgggatcgatgagtttgatgggcgaattagtctccgtgagttcgttgatcgataaactccagctgtctgcggattctggagccaaaacggtgctccttccagcgaagaacaaagaagacttgccgaaaatccccgacgaactcctcgaccagctccaactcgtgttctacactaatccccttgatgcggctagtaaggcgattgaactagagtga

SEQ ID NO: 3902 - DNA, 2055 bp, Lactobacillus rhamnosus
ttgacatctgatgacacgcaagctgattccgtaaaaagtgatgaagtgttggtcaagttggaacaaaactttcccggacgattcgtacgaaaggacttgactcagagaattaaggaaggggctaatgtaccaacctacgttctcgagtttttgcttggtcaattcgctaatagttcagatgaggagacgatcgagcgcggcgttgaaaatgttaagaagaccttagcgcataattatgttcgcccagatgaagccgagaaggttaagtcaaagattcgagaagatggcgcatacacagtcattgataaactcactgtccgtttgaatgaaggtgaggatcgatatgaggctagtttcagcaatctgggattaaccggtgtgcctgttgatgaacgttatgtacaagattacgaacgtctgttaatcggcggtatatggtcaattgtgcgcgttagctatgatcatgaaagtctcgatcatttttcaattcagaaattgaacccaattcaagtaccgtttgtggatatgaaagaagtttatgcgggacggaaagcttttaacactgatgaatggctggacgttttgttgcgaacaaccggtatggagccgactcagttcacagaacgcgagaaatggctgttattgtcacgtttaattccgtttgtggaaaataattataactttgttgagttaggacctcgtggaactggtaagtcacacgtttacaaagaactctctccggattccattcttgtatcaggcggacaaacgacagttgcaaatctgttttacaatatgtcgcggcgagaggttggtttggtcggcatgtgggacgttgttgcattcgatgaagtggcgggaattcacttcaaagataaagatggtgtccagatcatgaaagactatatggcttctggatcatttgccagaggaagaaacgaaattcaagcttcggcaggtatggtttttgttgggaatatcaatcaaagtgttgatgttttgctgcgaacttcaaatctgtttggaccatttccagagatgatgggtaacgatactgcttttcttgatcgaatccataattacctacctggttgggaaattccaaagtatcgtccggagttctttacaaaaggctttggcttcatcaccgattactttgcagaggttatgcgtgagttacggaagatttcatatgctgacgccattgatgaatacttttcatttggaaaacagttgaaccagcgtgatgttatcgctgttaggaagacggtttcgggactagtgaagcttttatttcctgatggcgtctttacaaaagatgatgtcgccaaaattcttgaatttgcgatggagatgcgaagacgcgttaaagagcagctgaaacgaattggcggcatggaattctacgatgttaacttttcatatattgataaagtatcgtttgaggagaagtatgtttccgttcctgagtcaggctcaagttcacttattccggaagggcaagagaatccggggcatgtttatacagtggcctacgatgatagcaagcgattaagcttaattaaattagaaacgcaggcagtaccgggacttggaaggctaaatcgctcaggtgttggctctagtacaagagcaaaagaagccatgaataccgcctttaattatcttgaagccaattacaaatcaattgaccaaagaattaatgccgatgcacgggatttcttcgtcagtgcgacgaatctaaacaattcagcaccttctagtcacatttcactagcaacactgattgcacttgtttccatcgctttagggaaaccaactcttgatggacttgtcattctaggggatttcacgatcggtggaacaatttcgcggattgatgacttggcagacaccctgcaagtagctttagacagtggtgctaagcgagttttgttgccagctgcagcagctagtgacatcagcagtgtgccaactgatctcatgagttcgtttaatctaatcttttacaattctgtgaaggatgcagcgtttaaggcgctgggggttggctga

SEQ ID NO: 3903 - DNA, 2085 bp, Salmonella enterica; identical to SEQ ID NO: 3644

SEQ ID NO: 3904 - DNA, 2040 bp, Vibrio tubiashii
atggaatccgctaacgataaagaattagatcaactgctgaatgagcactttgcgggtcgtgtggttcgcaaggatctcaccaagctcattaaagaaggggcgaatgtccctgtctatgtgctcgaatacctgcttggcatgtactgcgcgtctgatgatccagacatcattgagcaagggctgaacaacgtcaaaaccgtgttggcagagaattacgtgcgcccggatgaggctgagaaggttaagtccctggtgaaggagcgcggaacctataaggtcatcgaccgggttaccgtgaagctgaatgaacgcaaggataaatatgaggcctccttcagcaatctgggtatcaaggacgctgaaatttcctctggtatcgtcaaagagtacgagaagctgctggtgggtggtatctgggtcattgccactttgagttattaccacgaggaagggcagaccggttcgcctttcggagtaacgctgctcaagccaatccagatgccgaacatgaatatggacgaactcttccaggggagagctgctttgacaacggaccagtggcgtgagtgtttgatacggtcagttggtatggagccagcggcgttaggtgtcgatgtgcaatggcacattctggcccggatgattccattcgttgagaacaactataacgtctgtgagttgggtccacgcgggacaggtaaaagccatatttacaaggaatgctcccccaacagcattttggtgtctggcggccaaacgaccgtggccaacctgttttacaacatgagttcacgccgaattggtctggtcgggctttgggacttggttgccttcgatgaggtggccgggatctccttcaaggacaaagatggtgtccagatcatgaaggactatatggcttctggttcctttgcccgtggccgtgaacagatggaagcttccgcctctatggtgtttgtaggcaacatcaaccagagcgttgagtccttagtgaaaacaagtcatctgctggcaccattcccggatgccatgatcgactccgctttctttgaccgtttccatgcctacatcccaggctgggaaatccccaagatgcgcccagagtttttcaccaaccgttacggcttgattgttgactacctggcagagttttatcgggagatgcgcaagcgcagcttcgcagatgctatcgagaaatactttaagctggggaacaacctgaaccagcgtgatgtgatcgcggtacgcaagacagtttctggcctactgaaactactattcccgcatggacagttcgataaagaggatgtgcgccagtgcctggagtatgcccttcaggttcgacgcagggtgaaggaacaactcaagaagattggtggcatggagttctacgatgtccacttcagttacatcgacaatgattcgctggaagagcatttcgtatcagtcaaagagcagggtggcggtggcctgatcccagaaggccctggtaagcccggattccttcacaccattggtctcagcaacaaagggatgcctggcttataccggctggaacttcaggttaccaagggctccggcaagttggccacatcagggctatggaactccagtgcagctaaagagcaggtgaagattgcctttgattacttcaaggctaacgcatccaggatcagcggtgggagtaaagtgggagaacatgacttccatttgcacgcagttgagcttcagaacaccgggccattcagtcacctggcgctctccagtcttgttgcctttgcgtcaggcctccttggtaagcctcttcagaaccagatggtggtgctgggggatatgagtctgggcggttccgttacgccggtagaaagccttgctgagtgcctccaggtcgcttttgatgcaggggccaagaaagtggccttgccgatgagcagtgcagcagacataccaacgattccggctgaactgtttaccaagttccagacaagtttttacgccgatccggttgatgcggtgtttaaggctcttggggtggattaa

SEQ ID NO: 3905 - DNA, 2052 bp, Vibrio cholerae; identical to SEQ ID NO: 3740

SEQ ID NO: 3906 - DNA, 2052 bp, Vibrio cholerae; identical to SEQ ID NO: 3740

SEQ ID NO: 3907 - DNA, 2085 bp, Salmonella enterica; identical to SEQ ID NO: 3644

SEQ ID NO: 3908 - DNA, 2085 bp, Escherichia coli; identical to SEQ ID NO: 3687

SEQ ID NO: 3909 - DNA, 2052 bp, Vibrio cholerae; identical to SEQ ID NO: 3740

SEQ ID NO: 3910 - DNA, 2052 bp, Vibrio cholerae; identical to SEQ ID NO: 3740

SEQ ID NO: 3911 - DNA, 2085 bp, Escherichia coli; identical to SEQ ID NO: 3684

SEQ ID NO: 3912 - DNA, 2034 bp, Enterococcus faecium; identical to SEQ ID NO: 3762

SEQ ID NO: 3913 - DNA, 2052 bp, Vibrio cholerae; identical to SEQ ID NO: 3740

SEQ ID NO: 3914 - DNA, 2085 bp, Escherichia coli; identical to SEQ ID NO: 3687

SEQ ID NO: 3915 - DNA, 2079 bp, Sphingobium indicum
atgaccgcacttgatgacaagatcaacgaacgcttccccggccttgtggtccgcaaggacctggtgaaggcggtcaagggcaatgcgatcgttccgacctacgtgttggaatatctgctcggccaatattgtgcgaccaacgatgaggcgtcgatccaatcaggcatcgagacagttcgggagatcctgcgaaagcactacgtccatcgcaatgaggctggactcatcaagtccaatatccgcgaaaaaggtcgctggaaaatcattgatcggatcagcgttgccctcaatgaaaagagcgatacctacgaagcaagctttgccaatcttggcatatccaaggtcctgatcgattccggaaccgtaaagacccatcccaagcttctggttggtggggtctggtgcatcgccgacatcgagtacgactacaccgaagacaagaatgtgaccccctggatcttaggcacgatgaagcccatccagctgtcgcattttgattacgaagcatatctggaagcccgcaaaggcttcacaaccgatgaatggattgaccttctcttccagaccgtcggcttcgacccggagatgttcggtcgtcggtccaagctaatccagttgatgcgtctgatcccgttcgttgaacgcaattacaacctgatcgagctgggcccgaagggcaccggcaaatcgcacatctactcagaattctcaccgcacgggatcctgatctcggggggcgaggttacggtgccgaagctgttcgttagcaacagttccggcaagttgggccttgtcggctactgggatgtggtggctctcgacgagttcgcgggcaagcagaagaaggtcgacaaagcactggtcgacatcctcaagaactacatggctaacaagaccttctctcgcggtgttgaaccgctgggtgccgaggcctccatggtctttgtcgggaacaccaaacacacggttccctacatgctcaagaacaccgatctgttcgacgagttacccgacaagtactacgattccgccttcattgaccgactgcacacctacatccctggctgggaggtcggtgtgatccgcggcgagatgttttccaacggatacggctttgtcgtcgattaccttgccgagatccttcgccatctgcgcaacgacgactattcggaccgctaccggtcgaactttgagttgtcgtcggatatctcgacccgcgatcgggatggggttcacaagaccttttccggcctgatgaagatcctcttcccaactggtgaagcgacgccggatgaaatggaggagattctcaagctcgccttggaaggtcgcaagcgggtcaaagatcagctcatgcggctcgacgccacctacccggacgtggatttctcattttcgcgcaagaatggcgaaaaggtgaaagtggcaacgctcgaggaaaacgagtttccgagcttttactaccggcgcgctggagggcttggcctcccaataaccgagcctacaggcgatgacgcgtctgaagcagcagcagcgccccagctcgacgcaggcgcaacagcagtcacctcggtttcagagggcccgaagactggccatttcacatacaacgaaaaccaaagaggcgtgaccttcgacaatctgttcggcccctatctggtcggagttcagaagatcacgatcaccgatccttacatccgagcctttcatcaggttcgaaatgtgatggagttcatcgaaacgcttgcgaaagccaagtcacccgcagatgaggtcgaggtacacctcgtcacatgcgtggacgggatacgtcccgaaaagcaaaccgagaaccttggtgcgatcgccgcatcttgcgaaggcgtcggcatcacgttcacttgggagtttgacgagaccaacacgatccacgcgcgccacatcgtgaccgacactggttggaaaattgccctcgatcggggtttggacattttccaacagtacgagctcaatgatgccttcagcttcgccaatcggctgcagcaattccgttctgtaaaggctttcgaagttatctacctgaagaataactctgtttga

SEQ ID NO: 3916 - DNA, 2052 bp, Vibrio cholerae; identical to SEQ ID NO: 3740

SEQ ID NO: 3917 - DNA, 2052 bp, Vibrio cholerae; identical to SEQ ID NO: 3740

SEQ ID NO: 3918 - DNA, 2085 bp, Escherichia coli; identical to SEQ ID NO: 3760

SEQ ID NO: 3919 - DNA, 2031 bp, Sporolactobacillus vineae
atggatgatctggatcagaaattatatgaagcatttccaggaaaagtcgttcgcaaggacctgacgaagaagattaaagaaggcgctaatgtgccggtgtacgtgctggaatacctgcttggcatgtactgcgcgacagacgacgaagaaggcattgaggacggtgtgaggcaagtgaaaaagatccttgccgagaactatgtccggcctgatgaggcggagaaagtaaagtcgcggatccgcgagctggggcattataccgtgatcgatcgaattactgcccggcttgatgagcggaatgacctttataaggcagagttctcgaatctggggctctccgatgtcgtgatttcctctaaatatgtcaaggacttcgacaaattgctgaccggcgggatctggtgcattatccagatggcttatttcttcgatgaaaatgataaagcatcaagcccgtttacgattgaaaaactgaccccgattcagatgccgagtatggacttgaaggaactttttgctgcccggaaacggtttcataaagatgaatggatcgacattttgattcgttcgatcgggatggagccgacacaatttgaaccggccgtcaagtggcaccttcttgagcggctggtaccgctggtcgaaaacaattacaatctttgtgaactgggccctcggggtacaggcaaatcccatgtctataaagaaatttcgccgaattccattcttgtttccggcgggcagacgactgttgccaatctgttttttaatatggcgacgcatcagatcggccttgtcggcatgtgggatacggtcgcttttgatgaagtggccggcatcaaattcaaggatcaggacggcattcagattatgaaagattatatggcttccggttcattcgcccgtggccgtgaggagaaaacggctgcggcatcgatggttttcgttggcaacattaatcagagcgtcgatgtgctgttgaagacatccaatctttttgaaccctttcctgaggtgatggctgcggattcagccttcttcgatcggatgcacttctatctgccggggtgggagattcccaaaatgaggccggaatattttacgaataattatggttttatcaccgactacctctccgggttcatgcgtgagatgcgcaaacgctcgttctccgatgccattgatcacttttatcatctcgggaacaatctgaatcagcgcgatgtcattgccgtgcgcaaaaccgtttccggtttgatcaaactcgtgtatcctgacggtgtgtttaataaagaagaaatagaagaaattcttcgctatgcactggtcggccgccggcgcgtaaaggaacagctgaagaagatcagcgggatggagttttatgatgtcaacttctcctatatcgataatgactcgatggaagaacagttcgtctcggttccggaacaaggcggaggaaagatcattcctgaagggctggggaaaccgggtcatgtttataccgtttgccgtgggaagaccgggatgattggggcctacaagattgagacagagatgacgtcaggcaacggaaagtttgagcgtgccggatttggctcagattcagccgccaaagaaagtgttgatacggcatttcatttttttaagtcgaatggcaagtcgatcagcggcaagatcagtacacagaagaaggattatctgctgcagattcaggatatccatggcgtcggtctgaatgatcagttatccttggcggcactcgttgcgttgtgttctgcagctgtcggtcggcccgttcagagtcagctcgtgatcctcggatccatatcgatcagtggaaccatccaaagagtagacgacctggctagtgtcctgcagatctgtctcgattccggcggtaagaaagtcttgctcccgatgtcggctgctgcagatctgggtacggttccaccggaaatcttcgccaagtttcagatcattttctatcaaagtgctgaagacgctgtgttcaaagcactgggcgtgtcgtaa

SEQ ID NO: 3920 - DNA, 2052 bp, Vibrio cholerae; identical to SEQ ID NO: 3740

SEQ ID NO: 3921 - DNA, 2136 bp, Streptomyces sp.
atgagcgaagtgagtgaggtcagcccggtggaaccggtcggcccagacgcgccggccgatgcagatcccaggccgagcgagctggaccgcaagatcaaccgactcttcccgggcgccgtcgtgcgcaaggacttggtcaaggccgtcaagggcaacgccatcgtgccgtcctacgtgctggagtacctgctcgggcagtacgcggcctctgatgacgcggccaccatccaggcaggcatcgacacggtgcgcaggatcttggccgaccactacgtgcaccggaaccagtccgagctggtgaaatccacgatccgcgagcgcgggcggcaccggatcatcgacaaggtcacggccacgctcaatgagaagaacgacgtctacgaggccgagttcgcaaacctcggcatcaagggcgtgctcgtcgagcccgccacgatcaaggcgcacccgaaactgctcgtcggaggagtctggtgcatctgcgacatcgagtacttccacagtgctgacccgcgggtcgtgccgtggattctcgggtcgattaagcccatccagttgtcgaacttcgacgtagagggctacctggtggctcggcgcgagttcaccaccgacgagtggatcgacctgctcgtgcagtccatcgggttcaatcccgagttgttcgggaggagggccaagctcatccagctcgtgcggctcatcccgttcgtcgaacgtaactacaacctcgtcgagcttggccccaagggcaccggcaagtcccatatcttctcagagttctcgccccacggcatgctcatctccggtggagaggtcaccgtgccgaagttgttcgtcaacaacgccaacgggcgcatcggcctggtcggctactgggatgttgtcgcgttcgatgagttcgccggcaagaagaagcgcaccgacagggcgctcgtcgacatcatgaagaactacatggcgaacaagtcgttctcacgcggtgttgagacgctcggtgctgaggcgtcgatggtattcgtcggtaacacctcgcataccgtgccgtacatgctcaagcacgccgacctgttcgacgagctgcccgagagctaccacgactccgcctatctcgaccggctgcaccactacatccctgggtgggaggttgacaccatccgcggggagatgttctcggacggctacgggttcgtcgtcgactacatcgccgaagtgctcaagtcgatgcgctcccaggactactcggaccgctaccagcaacacttctcgctctcgtcggacatctcgacgcgtgaccgagacgggatccacaagacgttctccgggctgatgaagatcctctacccgcacggggaggcagcgcccgaggagatcgaggagatcctgcggttcgcgatcgaggggcgcaagcgcgtcaaggaccagatcctgcggatcgactcgacgatggccgacgtcaagttcggttacctggacaggagcggagcctggcacgcggtctcgaccctggaggaggacgaatacccggcttactaccaccgcgagcgtcccggggctgctgatagcgcgatcgagccgtcggcgggcgcggcggtgcccaccgttcaggatgggactccgggtgagcacgcgcaggtggtggcgccgctgttcgaggggcaccgtgagttccaggagaaccagcgcggcgtctcgttcgacacgctgctcaccccgtacctgcgcagagccgggcaaattacgattacagacccctacattcgccagttccaccaggcccgcaacctcatggaactcatcgaggggatcgccgccgtcaaggacgccgccgacgaggttaacgtcaagctcatcaccacagagagcaacggcggcgaggacaaggtccgcaagcaacttgagctcctgctcaaggttaagcagggcgcagcagccggcggcgtcaacctcgacgtctcgttcaccaacacgatccatgaccgctcgatcgtcaccgacactggctggaagatcgtgctcggccgcggcctcgacatcttccagtacgtcaccggtgatgcattcgacctcgccaccaggctccaggaataccgtcaggtcaaggcgttcggggtgacctacattcgcgagggaaagtga

SEQ ID NO: 3922 - DNA, 2085 bp, Salmonella enterica; identical to SEQ ID NO: 3644

SEQ ID NO: 3923 - DNA, 2034 bp, Enterococcus faecium; identical to SEQ ID NO: 3762

SEQ ID NO: 3924 - DNA, 2085 bp, Escherichia coli; identical to SEQ ID NO: 3687

SEQ ID NO: 3925 - DNA, 2139 bp, Bacteroides xylanisolvens
atggatgctttagatataaaattgaatgaggcttttcctggaaaagttgtcagaaaagatttgttgcatgaaatcaaacgtgcagtgaatgttccttcgtttgttttggaatttctgctttcacgttattgtgcgagtgaagatcctgaagagatagaagagggtaaaaaagctgtgcttcaaacaatagagaaatgctatgtaagaccagatgaatccaacaaagcacaagctattgttgagcagaagaagcgtcataagttcattgataaaatacatgtcaagtatgtagaacgagaaaagcgctattgggcagagatggaaaactttgcttccaaacgtattgccatcaatcccaatttctatcaagagaacgaaaagttattggagagcggcatttgggcagaagtgacattagcttataatgaaatccaagaggatgattatgctttctttattgaggacttacgtccgatacagattgcccattttgatgagcagaagttctttaaaggtagagaacactttactactgatgaatggatagatgtgcttatacgtagcattggtatcaatcctgattggttagcagaacgttcccgtaaattattgggtgacaaaaatggacgaagattaaaatttcatattctatcacgattccttccattggttcaaagtaattacaatagcatagaactgggaggaagaagtaccggtaaatcttacttctattctgaattttcaccctactcaactttgctttcaggtggtcaagcttctacagccacattgctatacaacaatcaacgtaaacaagttggtgctgtcggcttttgggacaatgtcgcatttgatgaagtagccaagatgaaaattaaagatgcagatacagtccaaatcatgaaagactatatggctaatggacgtttttcgcgtggtcgtgaagtaacaggctatgccagtttctcttttgtgggtaactttgacctaaacatcccacgaatcgtgaatagttatgatcatgatttacttgtaacacttcctgaagcttttgacttagctgttattgaccgcatctacaattatattccaggctgggaaattccaaagattgatgatagtgcatacaacaacaactttggtttgattaccgactacatgtctgaagcccttcattatctatttgtacatgatagtgactatgttggtgttgtaaattcaagattaaagaagggtgacaacattgaaggacgagataataaagctctacaaaaaactgtttcaggttttatcaagctactcttccctacaggccaacccacagacgaggagtttgatgaaatcgtagaatatgccattgaaggtcgccgccgtgtaaaagaacaattgaataagcgtaaaccagatgaagagtatgctcgaatcaatatgtcttacataaataaagacgggaacaaagttgtagtatactgtcctgaaagcaaatattcggaagcaactcaaaatccacgtaaggatttgaatgtggaagtccttacaaaacctatagtggaagaagtcaaaccggttgtggatcaaagcatagttttgcctattcattctgctatagcaccaattgttgatagtagtccaaaagaaaagactattgacattcaatatggagacattggttatggatatgatgacctctttgcagagtatttaaagggggcttcaatcgtaatgcttgaagaaccttatttgggcaacggattccagattgtcaaccttgttcgttttatagagttattggtcaaaattggcgattgtaaagcattccgtctgattacaaagccgggggaaacaccggaagaatcggcatctatcagtgacaatctgaaacgaataaaagaaacgttaggtgaaatggatggtaacatcatgtcttttgaatatgagtttgatgaaaactctcatgatcgttacatccgtacaagtaataattgggacattactttaggccgtggattgcatttctatcagaacatgaacccgaataaagatagtcgcaatttcttccaaatggggacttacgatttgtcattgcgaccttgtttaaaagctcgatttacgtttatgaaaagggatgctcaagaataa

SEQ ID NO: 3926 - DNA, 2085 bp, Escherichia coli
atgcaaacccatcatgatttacctgtttcaggcgtatccgcaggggaaattgcctccgagggttacgatctggacgccctgctgaaccagcattttgctggtcgcgtggtgcgtaaagatctcaccaagcaactcaaggaaggggcaaacgtcccggtgtatgtgctggagtatctgctcggcatgtactgcgcctctgacgatgacgacgtggtcgagcaagggttgcaaaacgttaagcgtattctggctgataactatgtgcgcccggatgaagcagagaaagtgaagtcgctgatccgcgagcgtggttcgtacaaaatcatcgataaagtgtcggtgaaactgaaccagaaaaaagacgtttacgaagcccagctttctaacctcggcatcaaagacgcgctggtgccatcacagatggttaaagacaacgagaagctactgacgggcggtatctggtgcatgattaccgtcaactatttctttgaagaagggcagaagacttcgcccttctcattgatgacgcttaagcctatccagatgccgaatatggatatggaagaagtgttcgatgcgcgtagacactttaaccgtgatcagtggatcgatgtgctgctgcgctcagtgggtatggagcccgccaatattgagcaacgcactaaatggcaccttatcacccgaatgatcccgtttgtggagaacaactataacgtttgcgaactggggccgcgcggcaccggtaaaagccatgtgtataaagagtgttctcctaactccctgttagtttctggcgggcaaacgaccgttgccaacctgttctacaacatggccagtcgccagatcggccttgttggcatgtgggatgtggtagcgttcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagacactcgttaaaaccagccatttgctggcgccatttccggctgcgatgattgataccgcctttttcgaccgctttcatgcctatattcccggttgggaaatccccaaaatgcgcccggaattctttaccaaccgttacgggctgattacggattatctcgctgaatatatgcgcgaaatgcgcaaacgcagtttctctgatgcgattgataaattctttaagctgggtaataaccttaaccagcgtgacgtcattgctgttcgacgtaccgtgtcgggattgttaaaactcatgcatcccgatggcgcgtacagcaaagaagatgtgcgagtctgcctgacctatgcgatggaagttcgtcgccgcgtgaaagagcaacttaaaaaactgggcggcctggagttcttcgatgtgaactttagctacatcgataacgaaacgctggaagagttttttgtgagcgtaccggaacagggcggcagcgaacttattcctgccggaatgccaaagccgggcgttgtgcatctggtcactcaggcagaaagcggcatgaccgggttgtatcgctttgaaacacagatgactgccggtaatggtaagcatagtgtatcgggtctgggttcaaatacctccgcgaaagaagctatccgcgtcggtttcgattacttcaaaggcaatttgaaccgggtaagcgcggccgcgaaattctccgatcatgaatatcatcttcatgtcgttgaactgcataatactggccctagcaccgcaaccagtcttgctgctcttattgctttatgttcgatattgctggcaaaaccggtgcaggagcagatggtggtgttgggcagtatgacgcttggtggagtaattaacccggtacaagatcttgctgccagtttacagctcgccttcgacagcggcgcaaaacgagttctgttgccgatgtcctcggctatggatattccaacggttccggcagagttatttaccaagtttcaggtgagtttttactcagacccggttgatgcggtttataaggcgctgggagtgaattaa

SEQ ID NO: 3927 - DNA, 2085 bp, Salmonella enterica; identical to SEQ ID NO: 3644

SEQ ID NO: 3928 - DNA, 2139 bp, Bacteroides sp.; identical to SEQ ID NO: 3925

SEQ ID NO: 3929 - DNA, 2055 bp, Opitutaceae bacterium
atgcccgacgcccccatcgaactcgacgcccttgacctcctggccaacgaagcttttcccggcatggttgtgcgcaaggacctgcttcggcgcatgcgcacctcgttcggcgtgccggccttcgtgatcgagttcctgctcggtaaatactgcgcctccaccgacgaccgcgaaatcaatgaggggttggagttcgtgcgtgaaacgctcgcgtccaaatacgtgaagccagaccaaagggagtcggtgaagtcgtcgatcaagcaacactccacttacgaatttatcgacaaggtgtcggtgaagctagtcgaggtgcacgataagtattgggcgagtctctccaacctgaacctcgacttcatcaacatcgacgaacgtctggtcaaagagcatgagcggctactgatgggcggcgtgtgggcggagattaccatccgctacgacgagacctatatcttcaagaaccagaaccgcccgttcttcatcgagtccatccgcccgatccagatttccaatcgcaacatggaaggtttccgcgccagccgtaagcggttcacccgcgaccaatggctcgacttgctcatgcgttcgatgggctacgagcccgaccatccctactacaccaagcgccggaagctccactgcatgctgcgcttggtgccgttcgtggagcggaatttcaattcggtcgaactagggcctcgtggcaccggcaagagttttgtttatcagcagatgagtccctattgtcacctcgtctcgggcggacaaacgacgacggcacagatgttcgtgaacctatccagtgggcaacgtggcttggtgtgtatgtgggacgtggtggcgttcgatgaagcggcgggaatcaatttctccgacaagagcggcgtcaacataatgaagggctacatggaggacggagccttcagccgtggccgcgacatcatcaccgccgagggctcgatcgttttcgtgggcaacatcgacggtgaaatcgccactatcgttcgcacctcgcacctgttttacccgatgcccaaggagatggacacggccttttacgaccgcattcacgcctacatcccaggctgggaattccagaagacccacgacgacgcttacaccaaccatttcggcctcgtcaccgacttcctcgccgaggttttccgcgaggtgcgtaagtccagctacaccgactacgccgagcgccatttcaagtttggcagtcacctcggcggtcgtgaccagaaagccgtccgtaagatcgtgtccggtctcatcaagcttcttcatcccgacggcgaagtcactaaggtcgagttggcagaatacgttgaatacgcgctggagatgcgtcgtcgggtaaaagagcagctcaaaaaaatgggtgggctcgaatactggaataccagttttagttacatcgaccgcgagagcggccaagagacctttgtcaacgtgcccgaaatgggcggcggcagcttgatccccgagggccagcaagctcccggaagcgtttacaccatcggcaccgatgccagcgacagccgcctcgcgctgttcctgctccaagcccaagtcaacccgggctcaggtcgcatcattcccctcggtaatctctctaaaagcatgaaggaggcgatcaaaaccgccgacgcctacctacgcggcaacctgaagaatctcggtatcacccgagacatcgacagctacgatttcagcctccaagcgatcaatctgaatcaggcaaaagacggcagcgaaacagccgtggctttcttcatctccctcgtttccgcgatcctcgaaaagtcggtcttggagcgcaccgtcgtccttggcgaaatgagtgtccagggactgctcctcaaagtgaattcactccccgagcgcatgcagcttgccgttgaggccggtgcaaaacgcatccttatccctagcgaaaacaagcgtgatctcgcggacgtaccagatactattattacagcaattcagtggcatttctacgattccccgatcaaagctgctactatagcaatgggattagcttga

SEQ ID NO: 3930 - DNA, 2151 bp, Bacteroides coprophilus
atggacagactagatataaaactcaacgaatacttccccggaaaggtagtacgtaaggatttactgcatgaaatcaaacagacagtaaatgtaccttcattcgtactcgaatttctcttgtcgcgctattgtgcttcagacgacccggatgaaattgaggaagggaaaaaggccgtgctgcaaatcatcgaaaagaactatgtcaaacccgatgaaagcaacaaggctcaggctattgtggaacaaaagaagcgccacaaatttattgacaagatccatgtgaaatatgtggaacgagaaaagcgttattgggccgaaatggaaaatttcggttccaaacgtatcgccatcaatccgcagttttatcagaaaaacgagaagctgcttgaaagtggcatctgggcagaagttacattggcttacaatgaagtgcaagaggatgactatgccttctatgtagaagatttacgtcctatacaaatcgcacgttttgatgaacaaaaactgtttgaaggccgtaaaggattcactacggatgagtggattgacgttttaatacgcagcatcggtatcaatccggattggttggcagaacgtagccgctcattaaagggagacaaagatggcaaacgactgaaattccatatcttgtcgagattcatcccattggtacaaaacaattataacagcatagaactgggaggtagaagtaccggtaaatcgtacttctactcggagttctctccctattccaccttgctgtccggtggtcaagccagtactgcgactttgctgtacaacaatcagcgcaagcaagttggtgctgtgggattttgggataatgtggcttttgacgaagtagccaatatgaagattaaagatgccgataccatccaaatcatgaaagactatatggcaaatggacgcttcagccgaggacaggaagtgaccgggcaggcaagttttgcttttgtcggcaactttgacctgaacatacctactatagtcaacagctatgatcatgacttgttggccactttgcccaaggcattcgactttgctgtcatcgaccggttctacaattatataccaggctgggaaatacccaagattgacgattctgcctacaataacaactatggaatgatttctgactacctgtcggaagtcatgcactacctctttgaccacaacagtgactatctgcccatattgaataaatacctcaaagtaggtgacaatgtagaaggtcgtgatagtcgtgcgcttcaaaagactgtattgggcttcttaaaactcatttaccccataggtgaacctactccagaggagtttgatgagattgtagcgtatgccctggaaggtcgtcgacgcgtgaaagagcaattgaataagcgtaagccagatgaagaatacgcacgcatcaacatgtcgtatatcaacaaagatggagaaaaagttgtggtatggtgtccggaaagtaaagattcaatagccacacaggatcctagaaagaccggggatgtggaaatcgctactgagcaacagccggcagcctctctacctcgtaaagctaagggcaaagaaaaagaagcggtaagccagaacgaatgtttgcaagattcttcaccagtacaagcaacagctacacctgatgaaatcatagacaatggtcctaaacccaaatcgcttgccattcggtatggagatacaggctacagctacgataagctatttgctgattatctggaaggggcaaaggttatcgaactgcaagagccctacctgtcacatggatatcaaatgcagaatctaactcgctttattgaatctattgtaaaaataggtgattgcaagaagattatacttaccaccaaaatgggtgaatccattgatgaaacacaaaagattcaagatgggcttgaacagctcaaagcggctttgcaagatgctgggatagattttgaattcacattctcagatttaattcatgcaaggtacatcataaccaacaacggatggaatatctcccttgaccgcggcttgcatatctatcaaaacattggccgcaacttttatcttatgggctattatgatttggatttacgcccttgcttggaaacgaaaattgtatatactaaagttgaataa

SEQ ID NO: 3931 - DNA, 2037 bp, Bacteroides sp.
atggaactgcaacaaaaaatattagacgccttcatcgggaaagtagtaagaaaagatctggcatttcttgtcaaaggcaacctacctgtaccgacttatgtgctcgaatatctgttaggacaatactgtgcaagtgatgatacggttattattgaagaagggctcgaaaaggtaaaggatgtcattcgtaataactatgttcatcgggctgatgccgaagaagtaaaaggcaaaatacgagaagccggaaaatatcgtattatcgataagatatcagtcattctcaatgacagggcagacgaatatgatgctacttttgccaatctcggacttgccaatatccctattcctgcagaatttgtaaagaagaatcccaaacttctttcaggcaatggtgtgtggtgtatcgttactatcggatatatcagcggagaagacattaagatgcgatgggatattcagagtttgaaacccatccaaatatccaatatagatattaatgaatacattacacaaagagaaaaattcactactgatgagtggattgattttcttattcatactgtcgggctaaaaccggaaaatttgaaccgtcgggaaaaatttatagttctttcccgattacttccacacgttgaaaataacttcaactttatggaattaggccccaaagggacaggtaaatcacacgtttttcaggaattatccccttatggtgtacttgtcagtggcggagatgttacttccgcccggttgttcgtgaagattagtggaaatagggaactacttggacttgttggatattgggatgtagttgcctgggatgaatacgaacagcaaaaaggaaaatcagtagatcctgttctgatagacacgatgcagaactacttagcaaacaaatcattcaaccgtggtaaaggttctcatgaagcttcggcatcaatgagttttgtcggcaacacgaaacataccgtttcatacatgctaaagaattcacacctcttcgagtctattcctacagcattcatcaaaggggctttccttgaccggattcatctttacaatccgggatgggaaataaagatgctcaaaaaagatagtttcagtaatggatatggattaatcaccgattatattgccgcagtgcttcatgctttacgtaataaagacttttcaagcgagctaaagaattatgtaagattcagtggaacactttctgaacgcgaccatctggctattcgcaaaacattctccggcatgattaaattactttatccggacggaaaatatacgggtgaagaagcactcgaaatcattgaatttgcagcagaatgccgtaaacgtgtaaaagatcaactctatatcattgacgagacatttagagcagaacctgccaagtttgaatatctaatcctcaaaaccggtgaaaccaaacaagtcgagacacttgaacgaattgaaaatcctgtaatggaagaagaaattcagacagaagaacctacaaaagaagatgtttccgagccatcgatatcatctccccgccttacgccacgtccacgcattgttcagcttgcttctaaacaaatagaaatccgtctcaatcaacgcggtgtatcatacaaatcccttttcggagattatatacgtacagctaagaaaataacaataaccgatccattcatccgattaggtcatcagattgataacctaatagaattcatacaaatggctcgtgaaacatgtatgacacccgaagagctggaaatcgaactacacactcaaaatgaagaagaaaagattcctgaaatgattgatatattcaatgacctacaagaggaactattatcttatggaattactttcaatttcatgtttgatgcagaacatgaccggaaaatagaattggataatggttggaccattaatttaggacgtggtctggacatattcgaaaagttctcccgcttttcattaagcaatattcgtcaagagaatcgtcgttgcaaagaattcacagtgatctatatgcataaataa

SEQ ID NO: 3932 - DNA, 2085 bp, Escherichia coli; identical to SEQ ID NO: 3926

SEQ ID NO: 3933 - DNA, 2085 bp, Escherichia coli; identical to SEQ ID NO: 3926

SEQ ID NO: 3934 - DNA, 2085 bp, Escherichia coli; identical to SEQ ID NO: 3760

SEQ ID NO: 3935 - DNA, 2088 bp, Thiorhodovibrio sp.
atggatgcacttgacacgaaattgaccggtgtctttgacggcaaggtggtgcgcaaagatctgctccaccgcattaagaaaggcaccaatgtcccgaccttcgtgctggagtttttgctggcgcgcttctgtgccagtgatgacgatgacgagatccaggccggtctggaggcggtgctcgacaccttgcaggacaattatgtgcgtcccaacgaggccaatatggcgcaatcgaaggtggccaccaaggggaaataccggttcatcgacaaggtgcatgtcaactatgtggagaaggataaacgccactgggcagcgctggaaaatttcgactcgcgccgggtggccattggagagaagttttaccgggataacgatcgcctgctccaaggcggcctgtgggcggaaatcgccattgcctacaacgaaattgaagacgacgattacaccttttatatcgaagacctgcgccccattcaactaagccgctttgactatgccgcctattgcgagggccgcagtcagttcagtcgagaggaatggctggatgtcatcctgcgctccatgggtctggaacccgccaaactgacgcaccgggtcaagctgcatttcatcgcccgcctgctgcccctggtcgagcccaactacaactttattgaactggggccacggggaaccggcaagtcgtatttctttagtgaattttccccttattccaccctgatcagtggcggccaggcgaccaaggcgacgctcttctataacaaccagcgcaagaagatcggcctggtgggcttctgggacacggtggcctttgatgaggtgggcggcatcaagatcaaagaccccgacaccattcagatcatgaaggacttcatggccaatggccgcttctcacgcggcgtcgaggtcatcgccgatgcctccatggcctttgtcggcaatctcgatctgtccgtgtcgcagatcgtcaattccgaggtctacgatctgtttcaaccgctgcccaaggaattcgacctggcgatcatggaccgcttcgccgcttacttgcccggctgggaaatgcccaagaacagcagcgaatttctcaccggcaattacggcttcatcaccgattacctggcggaagccttccatcaccagttaaagcataccaaccgctatgaggaagtcagccagcggatcaaactcggccaagccgttgaaggccgtgatgagaagggcatcaagaagaccgtcgcggccttgctcaagatattgcatccgtctggcccacccgatgatgacgaattcgatgaatacgtcgcttatgcgactgaatgccggcggcgcgtcaaggagcagatgaacaagcgcaagtcagacgatgaatttgcgctgatcaatttatccttcatcaacagcaagggacaagacaccattgtcttctgcccggaatccaaatcagcgatcgcaacccaggaacccgcgcggaagaacattcatcatccaacgggtgagagtgatcaaaaaagcgcacgaccatcggtgccttcagtgaaaacagaagcggaaacaccggccccggaatcatcgtgtgccgatttgcaggaagcgattgaacccatcatccccgtccttaaagaacagcatttcaccatccagtacggcgcgacaggtttcagctacgaatcgctcatgagtccctatttggttaatgcgaaagccgtcctgatcgaagatccctatatccgcgccaatcaccagatccaaaatttcgttcgcttctgcgagacccttgtcaagcaagcgaccatcagaaaaatcaccttggtcacgtcctatgatgacaaaacagacctgaaagaaatggcaagccggctcgatgaactcaaacaaagcctgttggaaatggatattcaacttgaaattaaagtcaacgagaatttacatgatcgagaaatccgcatcgacaatggctggatcatcaagattggccgaggcttggatttctaccaaaagccagatagctggtatggcattggatcaaccgatttaagcttaagacgatgcctggaaacaaaagtcgacatctaccaaggataa

SEQ ID NO: 3936 - DNA, 2037 bp, Cylindrospermopsis raciborskii
gtgggaggaaccgctttgaacaacctggatcaaaagataaatgcccattttcctggacttgtggtgcgaaaagacctggttaagacagtcaaaggtaacgcgatcgttccttcctatgtactggaataccttctcggtcagtattgtgccaccaatgacgaagccactattaacacggggattgaaacagttaaggaaatattacgtaaacactatgtccatcgcaacgaagcggggctgattcgctctaatattagggaaaagggacgttataaggtcatagataagatcagcgtcgagttgaacgaaaaggcggatgtgtatgaagccgagtttggcaatctgggcattaagaaggtgttagttgattctagcacagtcaagagccaccccaaactcctagtgagtggagtgtggtgtattgcagacctagaatacgaatttagcgaagataagaattctagtccctggattctggcctccctaaaacccattcaactatcttactttgattttgatagttacgtgcaggcccgccaagcattcaccacagaagaatggattgacttactagtccagagtattggttttaaccccgagatgtttggtaggcgaagcaagctacttcagctcatccgtctgattccattttgtgagcgcaactataacctaattgagcttggacccaaggggactggcaaatcccacattttttccgaattctccccccatggcattctcatctccggtggcgaagtaaccgtagccaaattatttgtcaataattccactggtaggattggtttagttggttattgggatgtggtggcctttgatgaatttgctggtaagcaaaagagtgtgaataaatctcttgtagacatcatgaagaactacatggccaacaaatccttttcccgaggtatagaaacccttggagctgaagcctccatggtatttgtgggtaacactaagcatacagtcccctatatgcttaagcactctgatctttttgaagaacttcccgacaaattccatgattccgccttcctggatcgcattcatttttacattcccggatgggaagtggacatcatccggggggaaatgttctgcaatggctatggttttgtcgtagactacctagcggaaattctccgagccatgcgtaaccttgattactcagattactatcatacttacttttccctttctcctgatatttccacccgcgatcgcgatggtattcaaaagaccttttccggtttaatgaaactcctttttccccagggtagtgggacagagtccgaggtagaggaaatgttacaaattgccatagaggggcgcaagcgggttaaagatcagctattgcgcatagattctacctataggaaagttaactttgcctacgaaaatagaaagggcacctgtaaaactgtcaccaccctggaagaagaagagtatgccagcttctaccaccagatcctgaccgaagagaaagagagaccatcattatgggaagaggagagagaagtttttccacaggaagcgcacctgacctttaaagagaatcagcgaggggtttcatttgacaccctgttaggtccctatttagagggtgcaaaggagattaccattaccgatccctacatccgagtttttcaccaggcctgcaacttaatggacttgatagaaaccgtaatcaagttaaagcccaacagagacgaagtaaagattaatttaattacaaccctagatgaattaaaaggggagcaacaggttgagtatttagtgaagatacaagattcctgtagtattgctgggattgatttcaagtgggaatttgatggtacttctaccattcatgctcgacacatagtgacagatacaggctggaagatattattagacaggggattagacatatttcagcactacgacctaaaagatgtgttctcgattccaaaccgattgcaggagttccgggggtgtaaagcttttgaggtcacatttctccgttgtgaccctgtcgattaa

SEQ ID NO: 3937 - DNA, 2052 bp, Vibrio cholerae; identical to SEQ ID NO: 3740

SEQ ID NO: 3938 - DNA, 2052 bp, Vibrio cholerae; identical to SEQ ID NO: 3740

SEQ ID NO: 3939 - DNA, 2070 bp, Enterobacter hormaechei
atgcaacagcaggataactcggcgaccaacatggaaatggcctctgttcaggacctggattcattattgaatcagcactttcgtggccgcgtggtgcgtaaagacctgactaaacaacttaaagaaggggcgaatgttccggtctatgtactggaatatttgctcggtatgtactgtgcatccgatgacgatgaggttgtcgatcaggggcttcagtctgttaaacgtattctttctgataactacgtccgcccggatgaagcagaaaaaataaaatcgctgattcgtgaacgcggctcctacaaaatcatcgataaagtcacggtgaagctaaaccaaaagaaagacgtttacgaagctcagctatctaacctcggcattaaagatgccctagttccatctcaaatggtgaaagataacgagaaactgctgaccggcggcatctggtgcatgattacggtgaactacttttacgaagaagggcaaaaaacatcccctttttcattgttcacactgaagcctattcagatgccgaatatggacatggatgaagtctttgaggcacgtaaacaatttgatcgcgaccagtggattgacgtgctgctgcgctctgtagggatggaacctgctaatattgagccgcgcaccaaatggcatctgattgcccgcatgatcccgtttgttgagaataattataacgtctgcgaactcgggccacgcggtaccggtaaaagccacgtctataaggaatgctcaccaaattcattgctggtttcaggtgggcagaccaccgtggctaatctgttctacaacatggccagccgccagattggtttagtcggcatgtgggacgtggtggcgtttgatgaagtggcgggaattactttcaaagacaaagacggcgtgcaaattatgaaggattacatggcgtcaggctcgttctctcgcggacgtgactccattgaaggaaaagcctccatggtgtttgtcggcaacattaatcagagcgtggatacgcttgtaaaaactagccatttgctcgcgccattcccggatgcaatgatcgataccgcattttttgatcgtttccacgcctatattcctggctgggaaattcccaaaatgcgtccggaatttttcaccaaccgctacggtttaatcactgattatctcgccgagtacatgcgtgaaatgcgtaaacgtagcttctcagacgcgattgataaattcttcaagctgggaaacaacctcaaccagcgtgatgtgattgctgtacgccgcactgtatctggcctgttaaagctaatgcatccggatggggcctacgataaagaagatgtacgcgtgtgtctgacctatgcattagaggttcgtcgtcgtgtgaaagaacagcttaagaaactcggcggtctcgagttttttgatgtgaacttcagctatatcgataacgacagcctggaagaatttttcgtcagtgtgccagaacaaggcgggagcgaactgattccggcaggaatgcaaaaacctggtgtagtacatttggttactcaggcagactcagggatgactggcctataccggtttgaaacccaaatgatggcgggaaatggtaaacatgccgtttcaggcttgggatcgaatactgcagcgaaagaagctgttcgagttggtttcgactatttcaaaggcaacttgagccgtatcagtgcagcagcaaaattctctgaacatgaatatcatctgcatgtggtagaacttcacaacaccgggccaagtacaaccaccagccttgcatcgttgattgccttttgctctatgctgctggctaagcccgtacaggaacaaatggtcgtcctgggtagcatgacactgggaggcgtgattaaaccagtgcaggatctggcagcatgtctacaggtagcattcgatagtggagctaagcgcgtactgctgccgatggcatcagctatggatatcccaacagtaccgacggaattatttaccaagtttcaggtaagcttttatgcagacccggtggacgctgtttataaagctttaggcgtcaactaa

SEQ ID NO: 3940 - DNA, 2076 bp, Marinobacter sp.
gtgagctcactggatgcgaagattaaccaacattttcctggcgtggttgtccgcaaggatctggtgaaggcggttaagggcaacgccattgttccctcatacgtgttggagtacttgcttgggcaatactgtgccacggatgacgaagcgaccattgaaaccgggataagtacggttaaggaaattctggccaagcactatgttcatcgcaacgaggccggcctgattcgctccaatatcaaagagaaagggcgttacaaggttatcgataaggtgactgtgtcgctaaatgacagccgagatgtgtatgaggctgagttcgaaaaccttggtatcaaaaaggtactggttgattcgggcacgatcaagaagcacccaaagctattggtgggtggtgtttggtgcatttgtgatattgagtatgatttcagcgaggatggccaatccaccccgtgggttctcttatccttaaaaccgatccagctttcgagtcttgattacgatgcttacctggaagggcgcaagcagttcactaccagtgagtggattgatgtactgatgcaaagcatcgggctgaatcccgaagcgtttggtcgccgtagcaagctgattcaattggtgcgtcttattcctttctgtgaaaggaattacaatttgattgagttgggcccgaagggaactggtaaatcccatgtgtactctgagttttcaccccacggaactctggtttccgggggagaagctaccctggcaaaactgttcatcaataataccacgggcaaaattgggctggttggttattgggatgtggttgctatggatgagtttgctggcagtggcaaaaaacctgatataaagctcattgatacgctgaagaattacatggccaacaaatcctttaaccgcggtactggcccgcagggtgcagaggcgtccatggtcttcattggtaacacctcacacaatgtcccgtacatgctcaaacacgagcatctgttcatggatttgccagaaacctatagaaacagcgacggccaagccattctggatcgccttcattgctttttacctggctgggaaatggacaatctgcgcaatgatatgttctcgaccggttttggctttgttgtggactatcttgctgaggtacttcgctccctgcgcagctatgatttttctgatcgctatcaggatcgtttcactctctcgtcagatatttcaacccgtgaccgggatggtatcaacaagaccttttctggcctgatgaagatcctttttccccatggtggggagactgaggaggaggttgaggaaatactgcgtttttcaatggaaggccgcaagcgcgtaaaagatcaattgatgcgcgtggactcaacctacgccacggttaacttttcttatcaaagcgccggtggtgaaaatcagcaggtgacaacgctggaagaggaagaatacccggcctattatcacaaaaagatcaatgatgaggatgatgtcaaagatgttgacctagcggccccagagggttttgccgcagttaagtcgcagcctgtcgccagtgccccccaggtcattctggaagagaagcacattacctttcaagagaaccaaaaaggtgtgtcgtatgagcttctgttcggcccttatctgaaagatgccacgaaaatcaccattacagacccgtacattcgactgttttatcagatccgaaatctgatggaattgttggagctgatcgtcaaaaccaaggccgaagaagacgaaatatcggttcatctggtcaccagccgcgacgaattcaaaggtgaattacaagacgaaagttttgagaagatgcggagttctgctgataccgtcggaatcaactttacctgggaattcgatgaaactggcacaatccacgcccgccacatcgttactgacaccggatggaagatatctcttgataggggattggacattttccaacactacgagatgaacgacgtatttgcgtttgctaatcgtctgcaaaaatatcgatcgtcaaaggcgtttgaggcaacttttatccggtacggtgggaatcagtaa

SEQ ID NO: 3941 - DNA, 2085 bp, Escherichia coli; identical to SEQ ID NO: 3760

SEQ ID NO: 3942 - DNA, 2085 bp, Salmonella enterica
atgcaaacccatcatgacttacccgttccagccgtatccgaaggggaactcgtcgcagaaggttacgatctggacgccttactgaatcagcattttcgtggtcgggtggtgcgtaaagatctaaccaagcagctcaaggaaggggctaacgtcccggtctatgtgctggagtatctgctcggtatgtactgcgcttccgacgatgaccagatcgtcgagcaagggttgcaaaacgttaagcgcattctggctgataactacgttcgccctgatgaagcggagaaggtgaaatcgctcattcgtgagcgaggatcctacaagatcatcgataaagtgtcggtaaagctcaatcagaagaaagacgtttacgaagcccagctctccaacctcggcattaaagatgcactggttccgccgcagatggtcaaggacaacgagaagctgttgaccggcggcatctggtgcatgatcaccgtgaactacttctttgaggaaggacagaaaacctcgcccttctccctgatgacgcttaaacctatccagatgcctaatatggatatggaagaggtgtttaccgcacgaacgcacttcaaccgcgaccagtggattgacgtcctgctacgttccgtgggtatggaaccggccaacattgaacagcgaaccaagtggcacctgatcacccgcatgatccctttcgtggaaaacaactataacgtctgcgaactaggcccacgcggtaccggtaaaagccacgtctataaagagtgttcgccaaactcgctgctagtttccggcggacaaaccacggtagccaacctgttttacaacatggccagccgacagattggcttagtaggtatgtgggatgtagtggcgtttgatgaagtggcggggatcactttcaaagacaaagacggcgtgcaaatcatgaaggattacatggcgtctggctcgttttcccgcggcagagattcgattgaaggcaaagcgtcgatggtgttcgtcggcaacatcaatcagagcgttgagacgttagtcaaaaccagccatctgttagctcccttccctgccgcgatgatcgacacggcgtttttcgaccgcttccatgcctatatccccggctgggaaatcccgaaaatgcgcccggaattctttaccaaccgctacggccttatcacagattatctcgccgaatacatgcgggaaatgcgtaagcgcagcttctccgacgcaatcgataagttctacaagctgggtaataacctcaaccagcgagacgttatcgctgtaaggcgcacggtttctggtctattgaaacttcttcatcccaatggctcttacagcaaagaggacatccgagtttgcctgacctacgccatggaagcccgacgtcgtgtcaaagaacagcttaaaaagctgggcggactggaatttttcgatgtgaatttcagttacatcgataatgagacgctggaagaattcttcgtcagcgtgccagaacaaggcggcagcgaattaattcctgctggcatgcccaaacctggtgtagtgcatttggttacgcaagcggaaagtggcatgacgggtctgtatcgcttcgaaacgcagatgaccgcaggcaatggtaagcatagcgtttccggtctgggatcaagtacctcggctaaggaagccatccgggttggatttgactatttcaaaggcaacctgagccgcgttagcgcaacagcgaaattttctgaacatgaataccacctgcacgtagtcgaattgcataataccggaccaagtaccgcgaccagtcttgccgcgctgattgccctttgttccgttttactggcgaaacccgttcaggaacaaatggtcgtgttaggtagcatgacgctcggtggtgtgatcaatcctgttcaggatctggcggctagcttacaactcgcctttgacagcggcgcaaaaaaggtccttctgccgatgtcttccgcagtagatattccgactgtgccagccgaattgtttaccaaattccaggtcagtttttactctgaacctgtggacgcggtttataaggcgttgggggtaaattaa

SEQ ID NO: 3943 - DNA, 2130 bp, Lactobacillus casei
ttgacatctgataacaagcaagaggaagaaaagttgcgagcgaagagtgacggcgacgtggcggtgccagcggaacccatcgctcaggagcaagcggcagaaaatgtgcaaacagacttgctggacaagctggaggcctttttccccgggcgcttcgtgcgcaaggatctgacgcaaaagatcaaggagggggcgaacgtccctacctacgtgctggagttcctgctggggcagtatgccaacagctcggatccggtgattattgaacggggcgtggaaaacgtcaagaagacgctggctaataactacgtgcggccagacgaggcggaaaaggtgaagtctcggattcgggaagagggagcgtatacggtcatcgacaagatcaccgtgactttgaactcggataaggaccgatacgaggcggcgtttggcaacttggggatcaccggtgtgccggtggatgagcgctacgtccaggactatgagcggctgttggtgggcggcatttggtccatcgtacgggtgcggtacgaccataccagcgatgaccattttctcattgatcagctgaccccggttcaggtgccgtctgtgaacatgcaggaagtttatgatgcccgggagaaattcacgaccgacgagtggattgacttgttactgcggacaattggcatggagccgacacaatttgacgatcgggtgaaatggctcatggtatcgcggctgatcccgtttgtcgagaataactataacttcgtggagctcgggccccggggtactgggaagtcccacgtctacaaagaattatcgcccaattcgattctggtttctggcggtcagacgacagtggccaacctgttcttcaatatggcgcggcatgaagtggggctagtaggcatgtgggacgtcgtggcctttgacgaagtggccggcatcaagttcaaggacaacgatggcgtgcagatcatgaaggactacatggcctctgcctcctttgctcggggccgggacgaaatccaggcgtcggccgggatggtctttgttgggaatatcaatcagccggtggacgtggtgatgcggacgtccaatctgtttgatccgtttcccgctgtcatggctaacgacacggcgtttttggaccggattcacaactacttgcctggctgggagattccgaagtatcggccgaatttctttacgaacggctatggcctgatcacggactatttcgcggaggtcatgcgggccctacggaagatttcttacggcgatgctttcgacaagtacttcaccctgggtaatcagctgaaccagcgggatacgattgcggtacgcaagacagtgtctgggatggtgaagctgctgtatccagatggtaagttcacgaaggacgacattgcccagattttggcgtttgcgctggagatgcgccggcgggtgaaagaacaattgaagaaaattggcggcatggagttttacgatgttaacttttcttacatcgacaaggaaacgtttgacgaacatttcgtttcggtgccagagcagggttcgacaggcttgattcctgagaatgagggtaagcctggccaagtttacaccgttgcttatgatgcggatgaacggttgagtttgataaaattggagtcgcagatgacggccggcaacgggaagacgagttggaccgggattcagtccaatcggttggcgaaggaagaaatggatacggcgtttaattacctcaaggccaatttttcccaggttagtcagaatattgcgccggcgcagcatgactatatcgtcaacgcgactaacctgaataatggcgccatggcgacggaattgtcgttggcgacttatgtagccctggtttctatttcggtgggcaagccggtcatcggcggattagccatcctgggggatttctccattggcgggactatcaaaaagatggatagtctggcagatcggctacaggtcgccctggatagcggggcgaaggcggtcttgattccatccagtgccacgagtgaattgggtacggtgccgggagatttgattgcggctttctcgctgaagttctacaacacgattgaggatgcggtgatgaaggcattgggtgtgcagcagtag

SEQ ID NO: 3944 - DNA, 2034 bp, Enterococcus faecium; identical to SEQ ID NO: 3762

SEQ ID NO: 3945 - DNA, 2052 bp, Glaciecola lipolytica
atggccgttttgaacgatttagatcacaagctgttagagcactttcgaggctatgtggtaaagaaagacttagtgcgtatggtaaaagttggtgccaacgtaccggtgtttgtattggaatatttaattgctaattcctgctctaccgatgatgaagaaaagattaaagaaggcatggaaaacgttaagaagattcttagcgagcactatgttaatccggaagaaagttctctaatacattctaaaataagagaaaaaggtcgatttaaaataatcgataaaatttctgtcaaactggattcgaaaaaagatatctattgggctcagcttcaaaatagcaacattaacaacggtaatatccgtgatggccttgtgaaagagcatgagaagatgttgatgggtggtatttgggccattattgacgtcgaatatgaccccgacataagaatcggtcaaaacatatatccgtttgtagtgacaaatataaagcctattcaactgtcgacttttgataacagtaagattatccagaaaagaaatgagttttcgagagatgaatggctgaatgtattgctacgtagctgtggatatgagccagatgctgaagggatgacaacccgcgtaaaaatgctgttacttgcacgtctgctgccaatggttgagagtaattttaactttgtagagttaggtccgcggtcaacaggtaagtcgttcgtttttaaagagcttacaccttatgccgtgcttatatcaggtggtcaaggaacagttgccaagctctttgttcacggttctactggcaaagttggtgccgttggtcaatgggatgcgatatgtttcgatgaggcaacggacaagatctttaaagaaaaggatgctgttcctttaatgaaggactatatggagtctggctcgttttcgcgagctggtgcaggaggtgaaatcactggtgttgcttcaataatcctaaacggcaatataaatcaaccagttgagacggtattgcaaacatctcacttatttagtcctctttctgatgaagtgaataacgatactgcattccttgatcgtattcatttttatctacctgggtgggaaatgatcaagtttgctcctaaacacttcacatctaattttggtttcagtacagactacttctcagaagcattgaagtcgtttcgtcgcgttacatacactgatgctcttgaaaactttttttcgctaggttcacacttgaaacaacgtgacaccaagccagtaaaaaagacggtatcaggtctgattaaattgcttcacccgaatggtgaatacaccaaggaagatgtgcgtgaatacctcgagatagctcttgaaatgcgacgtcgcgtgaaagaacagttaaagcgaatcggtggaatggagttttgggatacgaatttttcttacatagataaagaaacgcaggaagagcactttgttggcttgcctgaggaaaagggatctcacttaatcgaaaatacgccactgccgcctggtgtttgttacaccagtactagtgatggtgacaatgtcgcgctcgtgcgtattgaagctgttactacctcgggttctgggaaactcaatatttctggtgtaagtaacaccggagtaaaagaaaatatcaagaatacctaccagtatattaaagctaatgaaaaaacaattttaagtgaacagcactcgcttaaaaattacgatatgactatccaagtaaccaatatgctgggggcttcaatatcaacgggaattggctcagcggtttatatcgcaatcgtgtctgctctgtacaaaaagaacctaaaggctggccttgcagtgttgggtaatatatccgttggcggtgcgattgaaaggtcgattaactttgctgacaagataacaatgttgtctgagaatggcgcgaagacggttgttgttccaatggataatctagttgagctaacaaatgtaccaccaacagttcttggcaatacagatgttccattttatcagaataatcagatgcttatgcaaaaaagcatactgcttgactga

SEQ ID NO: 3946 - DNA, 2118 bp, Oribacterium sp.
atgccggattttatggagaacagcgatactcatgctgtaattaaagaaaaattgcgtcggaattttgacggtaagattgtccgtaaagatctgacaaaaaagattaaagagggggcaaatgtcccggtatatgtcctggaattcttgctgggacagtactgtagctctgatgatccggatgttatcgaagaaggcgtaaacagtgtaaaacacatactttccgataacttcgtccgtcctgatgaagcacagaagattttgtctgtacttcgaaagaagggtagtcataccgtcattgacatgattaccgttcgattggatattaaaaaggattgttactttgcagagttttccaatctcggattaagcaatattccaatttcagatgattatccggaaaagtttgatcgtcttctctgcggtggcatctggtgtattgtgcagctggactatgagatggagggagattctaatttcggcattgtagattctgatagatatgaaatgaaatcccaacagaaaaagcagaaggatatctcacccatcagcattcgcaagttgacaccaattcagatgcctcacattgatatcaatgaactgaaagaaggacgtaaggcatttactaaggatgagtggattgatgtgatgctccgttccatcggtatggagccggatacattgtctaatcgtgaaaagtggttgcttctgactagaatgattcctttggttgaaaataacttcaatctatgtgagttaggaccgagaagtaccggtaaatcacacttatacaaggaaatttcaccgaacagtattctggtttctggtggtcagactacggttgccaatcttttttataacatgggcagaaagtccgttggacttgtcgggctatgggactgcgttgctttcgatgaggtggccggcatccgtttcaaggataaagacgggatccagatcatgaaggattacatggcatctggctcttttgcacgtggaaaagaagaaaaagctgctagtgcatctatggtatttgtgggtaacatcaatcagagcgttgatgttctattaaaaacatccagtctattcgatccattcccatctgaaatgggaacagatactgcctttttagatcgtatgcattgctacattccgggatgggagatacctaagttacgtccggagcattttacagatgactatggttttatctccgattatcttgcggagtttattcgtgaacttcgaaaagagcagtatggagatgcattggacaaatatttccgtcttggaaagaacttgaatcagagagataccattgctgttagaaaaatggttggtggatatgtaaagatactttatccggatggcaattttacaaaagatgatctggaagaaattctcaagattgcattagagatgcgccgtcgcgtcaaagaacagcttaagaaattaggtggtatggaattctatgatgtcaatttttcatacatagataatgaaagctttgaggaacattatgtttctgtaccggagcagagcggtggaaagttgattccggatggaatctgtaatccggggcaggtctataccgtctcacaaggtaaatctggaatgattggcgtgttccgtcttgagagccagatgcttcctggcaacggaaagtttgagagaactggaattggaacagatagagatgcaaaggaggcttccaatactgcattcaactatttgaaggccaatggaagcagaattagtggatcaatcagtacaacaacaaaagactatatcgtgaattatcaggatctgcagggaattggaatgaccggaaagctagcacttcctacattgattgcgttgtgttctattgcactgggaagaccgactgtgggaaatctgcttgtattgggtgatattagtattagcggtactctgattaaagtcgatgagcttgcaaatgtactacaggtttgtctggatagtggggcgaagagagtgctgattccgagcacgtcattcgtggactttgcaactgttccaccgggactgatgagtgcattccagctgattccttatcagagtgcagaggatgcggtgtttaaagcactgggggtagagtaa

SEQ ID NO: 3947 - DNA, 2052 bp, Vibrio cholerae; identical to SEQ ID NO: 3740

SEQ ID NO: 3948 - DNA, 2085 bp, Escherichia coli; identical to SEQ ID NO: 3687

SEQ ID NO: 3949 - DNA, 2085 bp, Escherichia coli; identical to SEQ ID NO: 3772

SEQ ID NO: 3950 - DNA, 2052 bp, Vibrio cholerae
atggccgttttgaacgatttagatcacaagctgttagagcactttcgaggctatgtggtaaagaaagacttagtgcgcatggtaaaagttggtgccaacgtaccggtgtttgtattggaatatttaattgctaattcctgctctactgatgatgaagaaaaaattaaagtaggcatggaaaacgttaagaaaattcttggcgagcactacgttaaccctgaagaaagttctctaatacattctaaaataagagaaaaaggtcgatttaaaataatcgataaaatttccgtcaaactggattcgaaaaaagatatctattgggctcagcttcaaaatagcaacattaacaacggtaatatccgtgatggtcttgtgaaagagcatgagaagatgttgatgggtggtatctgggccattattgacgtcgaatatgaccccgacataagaatcggtcaaaacatatatccgtttgtagtgaccaatataaagcctattcaactgtcgacttttgataacagtaagattatccagaaaaggaatgagttttcgagagatgaatggctgaatgtattgctacgtagctgtggatatgagcctgatgctgaagggatgacgacccgcgtaaaaatgctgttacttgcacgtctgctgccaatggtcgagagtaattttaactttgtagagttaggtccgcggtcaacaggtaagtcgttcgtttttaaagagcttacaccttatgccgtacttatatctggtgggcaagggacagttgccaagctgtttgttcacggttctactggcaaagttggtgctgttggtcaatgggatgcgatatgtttcgatgaggcaacggacaagatcttcaaagaaaaggatgctgttcctttaatgaaggactatatggagtctggctcgttttcgcgagctggtgcaggaggtgaaatcactggtgttgcttcaataatcctaaacggcaatataaatcaaccagttgagacggtattgcaaacatctcacttatttagtcctctttctgatgaagtgaataacgatactgcattccttgatcgtattcatttttatctacctgggtgggaaatgatcaagtttgctcctaagcacttcacatctaattttggtttcagtaccgattacttttcagaagcattgaagtcgtttcgtcgcgttacatacactgatgctcttgaaaactttttttcactaggttcacacttgaaacaacgtgacaccaagccagtgaaaaagacggtatcgggtctgattaaactgctacacccgaatggtgaatacaccaaggaagatgtacgcgaatacctcgagattgctcttgaaatgcgacgtcgcgtgaaagaacagttaaagcgaatcggtggaatggaattttgggacacgaatttttcttatatagacaaagaaacgcaggaagagcactttgttggcttgcctgaggaaaaaggatctcacttaatcgaaaatacgcctctgccgcctggcgtttgttacaccagtacaagtgatggtgacaatgtcgcgctcgtgcgtattgaagctgttactacctcgggttctgggaaactcaatatttctggtgtaagtaacaccggagtcaaagaaaacatcaagaacacttatcagtatattaaagctaatgaaaaaacaattttaagtgagcagcattcgcttaaaaattacgatatcactatccaagtgaccaatatgctgggggcttcaatatcaacgggaattggctcggctgtttatatcgcaatcgtgtctgctctgtacaaaaagaacctaaaggctggccttgctgtgttgggtaatatatccgttggcggtgcgattgaaaggtcaattaactttgctgacaagataacaatgttgtctgagaacggcgcgaagacggttgttgttccaatggataatctagttgagctaacaaatgtaccaccaacagttcttggcaatacagatgttcctttttaccagaataatcagatgcttatgcaaaaaagcatactgcttgactga

SEQ ID NO: 3951 - DNA, 2043 bp, Methanoplanus limicola
atgaccgggccagaatcaacaaaggaaacagacaacaaactgaataaatatttctccggaagagtagtcagaaaagaccttacaaagaagctgaaaggcagtgacaacgttcctgtatatgttcttgaatacctgcttggttcaaactgtgctaccgatgacgaagaactcattaaaaagggtgtaagcagagtaaaaaagatactctcagacaattatgtacgccccgatgaagccgaactcatcaaatcaaggataaaagagaccggatactatacaataatagacaaaataacagtcaggctcaatgagagaagggacatatacgaagccgaattctcatcacttggaataagagagattgagatcgactccgagactgttaaaaaatatgacaaacttctcggcggcggcatctggtgcatagtcaagatggagtacatgccggaatcctcaccaagaaccccctttgtcatctccggcttaaaacccattcagatcccaaatatggatataaacgagatcatcgggagaagaaaagagttcacaaaggatgaatggatagacatacttctcagaacaaccggaatagaaccgtcaaaattaaaatatcctgccaaatggcatctccttgagaggcttgttccgcttgctgaaaacaactataacctctgtgaattagggccgagaagcacaggcaaatcacatatctacaaggaaatttcaccaaatacaattctcatatcaggagggcagacaaccgttgcaaacctcttttacaacctcagctccagacaggttggccttgtaggactctgggatgttgtagcctttgatgaggtcgccggaataagattcaaggacaaagacggcattcagatcctcaaagactatatggcatccggatcttttgccaggggaaaggatcagatcaatgcaaacgcctcaattgtctttgtcggaaacgtaaaccagagcataccatcactgctaaagaccgctcatctctttgcaccgtttccggatgcgataaacagcgacagcgcattctttgacaggattcattattacctgcccggatgggaggtgccgaaattcagaccggagcatttcactgacggttacggattcatagtggattatcttgccgagtacctgagagagatgagaaagagatcatttgccgatcatatcgggaactatttcagacttgggaataatctcaaccagagggatgtaatagcagtaagaaagacctactccggactcatgaagctcatatatccggatggcagcatcacaaaagaagaagcacgtgagatacttgaatatgcccttacaggaagaagaagagttaaggagcagcttaaaaagatcggcggcattgagttttatgatgtcaatttctcatatatcgaccttgaagagaactctgaacattttgtaactgttcctgaaagcggtggcagcaaattaattccggaagggatgggcaggcccggacaggtttttgcagtgaacagaaacgactccggcaaaatcggggtttacaggatggagcttcaggttgttccgggaacaggcagatatgaaaaatcagggcttggctcagattcaaaggcaaaagaggcagttcagacagcattcagttatttcaaagccaatgcaaaatcagtaagtcagagcatatccacaaaggagaaggattatcagcttcatgtgcaggacctgaacggtgccggcatgactgacggacttgcactggcagcctttatcagcctctgctcaggtgcacttgaaaagccggtacatgagcagacagcagttcttggaagcttcacaatcggaggttcagtcagttcgattgataacctctctgaccttcttcaggtctgccttgatgccggagcaaagaaggtgctgatacccatatcatctgccagaaagatatctgccgttccgccggaactcttcagcaaattccagatttctttctatgaagatccggttgacgccgtttataaggcacttgtgctgaactga

SEQ ID NO: 3952 - DNA, 2052 bp, Methanoplanus limicola
atgtcttttgaacttgactcccttgatgaaaagaccacagacctttttgagggctatgtagtcagaaaagaccttgcaagagagtttgcagaaaaatatccggttccaaattacgtagcagagttcttaatcggaaaattctgtgcgacaacagatgaagatgagattgctgaaggtctggagatagttcataaacagcttagggataaagttgtaaaagccggagaacaggaactgtttaaggcaagggccaaagacaaagggactgtaaaggttattgacttaatcacggcaagacttgatgcaagatcagacaatttctttgccgcaattccctctcttctcatcaatgatgcctttatcccgtctgaatttgtctatgagcatgaaaggatgctcaccggaggtttttatgcggaaattgaggttgaatacggggctacgcagacagaagggcagagatcatatccttttactgtgaaaaatctccggcctatccagctttcaaaaagaaatgtactcgatgaccttgctgccggcagggaaaagatgacaacagaagagtggaaggattttctctgccggagtgtcgggcttgaaccttctgtattatccgagcgtgcaaaagccgttctttttctccggatgataccctttgttgaaaagaattataattttattgaacttggtccgagaggaacgggtaaaagttacttattccagcagataagtccttattcccatctggtttccggcggaaaagcaaccgttgcaaagatgtttgtcaataattcatccggacagagagggcttgtctgtcagtatgatatagtctgttttgatgaggtctcaggaatcagctttgatcagaaagacggcgttaatatcatgaaaggctatatggagagcggggagttttccagaggcaaggagaatataagggcagaaggcggcattgcaatgcttggtaactttgatgttgatgttgagcatcaacagagaatcgggcatttatttggtccgcttccaaaagagatcagggatgatactgcgtttatggacagaattcacagttacatccccggatgggactatccaaaagtccaccctgaccttctgactgagcattacggctttgtcagtgatttccttgcggaatcatggaaccgactcagaggtgagagcaggctgcataaaattaatggcagggtcttctttggtgatgcactaagcggcagggacaggcgtgcagtcaacaaaaccattgacgggttgttaaaactgctctatccttcttcagatatggacattgaagaagaggatattgaatgggctgtaagaactgcacttgagtgcagaagaagggttaaggaacagcagaagagaataggttctgccgaattcagaaatactatgtttagctaccggcttggtgttgacggtattgagcagtatgtttccaccccggaattacacagtgaaaatgagatcagttcagatcctcttcctccaggacaggtatgggggatcgggccgggagatcagaatgagggaagtggtctttataaaattgaagtcaccacaacacccggttcaacaatccggctgataaatgtcaaggctccgtcagggttaagagagagtgtaaagactgctgaacaggtcttatatacacagaacagaattctgattggcgatcacaatcctaaagaggctgaattctccattcaggtgagatctctgacttcagcaaagggcggaagctcgataagtatgccgattcttctggctttatgctcggcatcaattggaaagagccttaagggtggaatagttattgtcggtggtatgagtgttggcggtacaattgagccggtttacaatgcacttgatatggcagaacttgctgctgagaacggagccgttgcaatacttcttccggttgccagcaggaagcagcttattgatatgtcagatgatcttgcttcccggcttatggtgatttattataaagatccaagggatgctctgtttaaagttttaggggagtga

SEQ ID NO: 3953 - DNA, 2052 bp, Vibrio cholerae; identical to SEQ ID NO: 3740

SEQ ID NO: 3954 - DNA, 2085 bp, Escherichia coli; identical to SEQ ID NO: 3687

SEQ ID NO: 3955 - DNA, 2052 bp, Vibrio cholerae; identical to SEQ ID NO: 3740

SEQ ID NO: 3956 - DNA, 2052 bp, Vibrio cholerae; identical to SEQ ID NO: 3740

SEQ ID NO: 3957 - DNA, 2031 bp, Bacillus cereus
atggaggatttaaatataaagttaaacgcacattttgcaggaaaagtagtacgtaaagatttaacaaaaaaaattaaagaaggtgcgaatgtaccagtatatgtacttgagtacttgcttggtatgtattgtgcaacggacgatgaaaagagtatgaatgatggcgtacaaatggtcaaaaagattttatcggataatttcgtacgcccagatgaagcagagaaagtaaagtcgaaagttaaggagcttggcaagtatacggtcattgataaaattggcgtaaaattaaatgataaaaaagacatatatgaagcagagttttctaatcttggactaaatggggttccgatttcttcacattatgtaaaagaatttgataagctccttgcaggtggtatatggtgcattgtaaaaatggaatattattttgatgaagaatcaaaaggtacaagtccatttagcattgagagcgttacaccaattcaaatgcctaatatggatttagaagagatgtttgaacaaagaaggcaattttccaaagaagaatggatcgatgttcttattcgttcaactggtatggaaccaactcaattagaagacacagtaaagtggcatttgcttgaaagaatggtaccactcgtagagaataattacaatttatgtgaacttgggccgagggggacagggaaatcacatatctataaagagatttcacctaattcgattctagtatcgggtggtcaaacaacggttgcgaatttattttataatatgtcgactagaaaaataggattagttggcatgtgggatacggtagcatttgatgaagttgcaggaattacatttaaagataaagatggtatccagattatgaaagattatatggcttcaggttcttttgcccgaggccgtgaagaaaaaaatgctagcgcttctatggtttttgtaggaaatattaatcaaagtgtagatgtattattgaaaacctcacacttgtttgacccgttcccagaagcaatggcatatgattcggcatttttcgatcgaatgcattactatttacctgggtgggaaattcctaaaatgagacccgagtttttcacaaatgaatatggcttcataacagattatttagcagagtttttaagggaaatgcgaaaacgttctttctcagatgcgatcgataaatattttagattaggaaataatttaaatcaacgagatgtaatcgcagtgcgtaaaactgtttcgggtttgattaagttgttatatccgaacggtgaatatataaaagaagatgtggaagaagtactacgttacgctctaatagggcgcagacgtgtgaaggaacaattaaagaaaattggtggcatggagttttatgatgtcaatttctcttatattgataatgaatcaatgaatgaagagtttgtatcggttccagaacaaggtggaggaactttaatcccagaggggatgaacaaaccagggcatatttatacagttgctcgtggaaagactggaatgattggtacttataaattggaaacagaagttgtgagtggtaatggtaagtttgaaaaaacgggattaaattcagatcgagatgctaaagaaagtatagataccgcctttcgattctttaaagcaaataataaaaatataagtggtactattagtacaacaacaaaagactacttaatgcatattcaagatattcatggagttggattaactggtgagttatcgcttgcagcatttatcgcattatgttcaggtgcattgaataaaccagtacaaagtcaaatggttgtattaggatctattagtataagtggaacaattaataaagtagaagaattagccaatgtattacaagtttgttttgattcaggggcgaaaaaaatacttttaccgatggtatcggctgtagatataccaactgtaccacccgaattgtttgctaaatttcaaataggtttttatcaaagtgcagaagatgcggtgtttaaagctttaggggtagaataa

SEQ ID NO: 3958 - DNA, 2052 bp, Vibrio cholerae; identical to SEQ ID NO: 3740

SEQ ID NO: 3959 - DNA, 2232 bp, Salmonella enterica
atgccacatgatgagataaatccgactgaaggtgagtttgtaggaaaggaaaccgcacaagagccagcggtgaatgtcacacatatcacgaacaatgtagtaatccagcagatggacgtttacacggagaagcttgcccagccgagcggaactactgttgatgaggcttctatgctcagcattgacgatgagttatctcagcatgccagcatggatcttgatgcccgtctgaatcgttactttaagggtaaagttgtccgtaaggatttgaccaaacagctaaaagaaggggctaatgtccctgtctatgtactggaatatctgctcggtatgtactgtgcttcagacgatgatgaagtggtacgcgaaggtctggaaaacgtcaaaaaaatcctcgctgagaactatgttcgcccggatgaggctgagaaagtaaaatctctgattcgtgagcgtggtagctttaaagtgatcgataagatcggagtaaagctcaaccagaagaaagatgtatacgaggctcagctttcgaacctaggtatcaaagatgccgtgatccccgccaacattgttaaagctaacgagaagctgctcaccggggggatctggtgtatcgttactcttaactatttttatgaagaagggcaaagaatttcgcccttctcaattttcaaccttaagcctatccagatgccctccatggatatggaagagctttttgccgcccgggctaatttctcaacagaccaatggctggataccctgatccgctctataggcatggagccaaccaatctgaagcaacgggtgaaatggcacctgttgacgcggatgatcccctttgttgagaacaactataacgtctgcgaactcggcccacgtggtaccggtaaaagccacgtctataaagagtgctcgcctaattcattactagtctcaggtggccagacgacagtcgccaatctgttttacaacatgagttcccggcaggttgggctggtaggcatgtgggatgtggtagcttttgacgaagtggctggtattaccttcaaagataaagatggtgtccagatcatgaaggattacatggcatcgggctctttttcccgtggccgtgattctatcgaagccaaagcatccatggtatttgtcggcaacataaaccaaagcgtagaaacgttagtcaaaaccagtcacctgctggcacctttcccggaagcgatgatcgatacagccttctttgaccgtttccatgcctatatcccaggctgggatatccctaagatgcggcctgaattttttaccaataactacggtctgatcaccgactatctggccgaatatatgcgagaaatgcgcaagcgtagcttctctgatgctattgaccgcttctttaaactcgggaacaacctcaaccaacgtgatgtaatcgcagtacgccgcacggtctcaggtttgctcaaattactgtatcctcatggtgtgtttggtaaagaggaggtacgtccttgtctcacctacgcattagagttacgtcgtagaatcaaagagcagttgaaaaaactaggcggcatggagttttttgatgtgcatttcagctatctcgacaacgaaactcttgaagagtttttcgtcaatgtacctgagcaaggcgggagccagttgatccccgaaggtctgggtaaaccgggagttgtgcacatggttaccaagggtgtcacaggccaactgggcctgtatcgcttcgagactcagatgacccccggtaatggtaaacacacgacatctggcctaggctccaatacaccagcaaaagaagcaatccgtataggttttgattatttcaaaggcaacctaaatcgcatcagtgctaccgcaaaattttccgagcatgaataccatctacatgccgttgagttacataactcaggccctagtaccaaaaccagccttgccgccttggtagccttctgttccattttgatgggcaaaccagtgcaagaacagatggtcgtgctcggagatatgacacttggtggtgtggtgaatccggtcgaagatctggcgggtagtttgcaactggcaatggatagtgggggcaaacgtgtgctgctgccgatggcatcggcttctgatatcccgacagtgcctgctgaaattttttccaaattccaaatcagtttctatgcagatccggtggatgctgtgtataaagcactaggtgttcaataa

SEQ ID NO: 3960 - DNA, 2052 bp, Vibrio cholerae; identical to SEQ ID NO: 3950

SEQ ID NO: 3961 - DNA, 2367 bp, Collinsella aerofaciens
atgtttgatagcaatgacgacaatctgtgggaagttccctcgattgatgtggatgtgccggtggagggtgtggtgcctgcggaggccgcgcctgctgcggaggccccggcgactgaggctgttgcgcctgccccggagccggttgctgccgcgcccgttgaggctgcggcgaccaccaaggacgaatcctcgaccgatggctatgaccaggccgcggccgaggcccccgaggacgacggctacgatatggatggccttgacggcaagctgcttgagcactttgctggcaagatcgtgcgtaaggacctgacggcccttatgaagcgtggcgccaacgtgccaacctttgtgctggagtacctgctgggcatgtactgctcaaccgatgacgaggaagccgtggcggagggccttgaccgcattcgcaggattcttaccgataactacgtgcgccccgacgagtccgagcgcattaagtccaagatccgcgagctgggtcgttttaccatcatcgacaaggtgacggccaagctcgacgagtacaaagatatctacgtggcgtcgtttgccaacctgaccatcgagccgtttgtgatgccggccgagtacgtgcgcgactattccaagattctgcagggcggcatttggtgcattatgagcatcgagtatcgtcatcccgtggatgaggaagacgagtttggcatggaggtctttggcgacgatgcgccgcgccgctccaaggccaagcgcaaaaagcgcggacccgaggactctccgtttagcgtggcgtcgctcacgcccattcagatgcccaatctggacctggatgccatgatcgacgagcgccagtactttacgcgcgacgagtggctcaatatgctgctgcgctcggctggctacgaacccagcgagctttccgagaaagagcgcctccactttatcgagcgcatggtgccgcttatcgagcgcaactacaacctgtgcgaattgggtccccgcggcaccggcaagagccatatctacaaagaggtctcgccttacgccatcttgctttcgggcggtcagaccaccacggccaacctgttcggccgtatgaactccatgcgcgccgatcgcgtgggcctggtgggccactgggattgcgtgacgttcgacgaggtcgccggcatgcggtttaaggacaccaacgccgtgcagatcatgaaggactacatggcgagcggcagttacgcacgcggccgcgaccagattaacgccgacgcctccatggtctttgagggcaacatcaacgacaccgtgcaaaatgtccttaagaccacgcacctgtttgatccgttcccgccggagtttaacaacgattcggccttcttcgaccgtatccattactacctgccgggctgggagattcccaagatgcgctcgagcctgctgaccgggcattatggcctgattaccgactgcctgtcggagttttgcaaggagatgcgccgcaaagactttacgcaccatatcgaccggtatttccgctttaacagtgactttaacaagcgtgacgagatcgccgtgcgcaagacctttagcggccttgccaagctgctgttccccgacgaggccatggacaaggacgacgtgcgctggctgttggattacgccatcgagggccgtcgccgcgtaaaggagcagctcaagattatggcgggcgtcgagtttatcgacgtcaacctgggctatatggatgccgacaacccgcaggacgtgcacgtggtgcgcgtgcccgagcagagcgaggacacgctgattcccgacgggccgctgctgtccggccacgtgtttggcgtgggcaggtcgcagggcggcgaggttgccgtgtacaagcttgagaacaaggccgttgccggcgagtgcaagtttaagcacgagggcgtggcctttaacaagccggtgcgcgatacgctggaggccgcgttcgacaactttgtgaatctggcgaaccgcgtggcgccgggcatgcacattggctccaaggattacctgctgttctacaacgacctgcagagcaaggggctgtccgaggaggtttcgctcgccgagtttgtgggactttgctccgcggcgtgcaaccgcccggtgatgcccgcgctggcgattccgggaatcttgcgcatgtcgggctctatggacgagatccgcgggctcgaggacattatgcgcgtggccaaaaacgccggcgccaagcgcgtgattttgccgctgagcgccatcgcgggcctgcagagtgtttcgtccgagattatctcggggctgagcccggtgttctacatggatggcgatcccgtcgacgccgcgaagaaggcgctggatctgtag

SEQ ID NO: 3962 - DNA, 2034 bp, Enterococcus faecium; identical to SEQ ID NO: 3762

SEQ ID NO: 3963 - DNA, 2052 bp, Vibrio cholerae; identical to SEQ ID NO: 3740

SEQ ID NO: 3964 - DNA, 2094 bp, Bacteroides sp.; identical to SEQ ID NO: 3799

SEQ ID NO: 3965 - DNA, 2031 bp, Vibrio cholerae
atgcaaagcgccgatttagacgcattgctcaaccaatattttaaaggccgtgtcgttcgaaaagatctgacaaagcaattgaaagaaggcgctaacgtccctgtttacgtgctggagtatttactagggatgtattgtgcgtccgatgacgacgaagttgtaatgcaaggccttgaaaatgtgaaaaaaatcttggctgagaactatgtccgacctgatgaagcggagaaagtgaagtcactgatccgtgaacgcggcacgtttaaaatcatcgacaaagtaagcgttaagctcaatcagaaaaaagacgtctatgaagctgcgttgtctaacctggggatcaaggatgcccttgtaccgaccaaaattgtacaagacaacgaaaaattattaactggtggtatctggtgcattattaccgtccagtatttctttgaggaaggtcagaagacatcacctttctccattatgagtttaaaaccgatacaaatgccgtccatgaacatggatgaggtgttttcaaccagaagacattttagtaccgatcagtggatggatgtgttgcttcgttccgtgggtatggagccaaccaacttagagcatcgggtgaaatggcatcttatcactcgtatgatcccattcgttgaaaacaactacaacgtttgtgagctcggaccaagagggacaggtaaaagccatgtctacaaagagtgctcaccaaactcattgcttgtctcgggcggacaaacaactgtggcgaacttgttctataacatgagctcgcgccaagttggtttggttggtatgtgggatgttgtcgcatttgatgaagtagcgggtattacctttaaagacaaagacggcgttcagatcatgaaagactatatgtcgtcgggttcattttctcgtggccgtgattcaatcgaagcgaaggcttccatggtattcgtcggtaatatcaatcaaagcgttgagacactggtgaagaccagtcatctgttagcaccttttcctaatgccatgattgacactgctttttttgaccgtttccattcctatattcctggatgggaaataccgaagatgcgtcctgagtttttcaccaatagttacggattaatcacagactaccttgctgaatacatgcgtgaaatgcgcaaaagaagttttgcggatgctatcgataagttcttcaaactcggtaataaccttaatcagcgtgatgtaattgctgtacgaagaactgtttcgggcttattaaagctattacaccccgacgcacagtacacaaaagatgatgtaagagcctgcctgacctatgcgctggaaactagacgtagagtcaaagagcaattgaaaaagcttggcggaatggaatttttcgatgttcattttagctatatcgataacgaatcattagaagaattcttcgtcaatgtaccggaacaaggtggcagcaagctaattcctgagggcttacctcgcgctggtgttgtacatttggttactcagggaagcacagggcaactaggtttataccgttacgaaacccagatgatggctggttctggtaagcactcagtgtctggccttggttcaaataccgcagcgaaagaagctgtgcgtgttggctttgattatttcaaaggtaacctgaatagaataagtgcgtcggcgaagttttctgatcatgagtatcacctccatgttgttgagctccacaatacggggccaagtacaaagtcatcgctcgctgcattaattgcgttctgttcaattctgatgaaccgaccgattcaagagcagatggttgttttgggtgagatgactttaggtggtgttgtaaatcctgttcaagatcttgcaggcagtcttcagttagctatggacagtggcgcaaagcgtattttgctcccaatggcctcagcctcagatattccaacggttcctgctgagttgttttcaaaattccagatcagcttttatgcagatcccgtcgatgccgtgtttaaggcgcttggggttaattaa

SEQ ID NO: 3966 - DNA, 2076 bp, Vibrio cholerae; identical to SEQ ID NO: 3758

SEQ ID NO: 3967 - DNA, 2052 bp, Vibrio cholerae; identical to SEQ ID NO: 3740

SEQ ID NO: 3968 - DNA, 2034 bp, Enterococcus faecium; identical to SEQ ID NO: 3762

SEQ ID NO: 3969 - DNA, 2016 bp, Fusobacterium sp.
atggatataaatgagattggaagtaaagtttttgagggtaagattgtaagaaaagatttagtttcaaaaataaaaggtggagcaaatgttcctgtctatgttttagaatatttacttggaatgtattgtaatcagactgatgaagatagcattgaagaaggtatgttaaaggtaaaaaaaatacttgctgaaaattatgttcgtcctgatgaagcagaaaaagtaaagtctaaaataagagaaatcggagtatataatgttattgataaggtaactgttgtcttaaatgaaaaaaaagatagatatgagggtcatctttcaaatttaggtgtcagtaatattgaaattcataaaaactatataaaagattatgaaaaattattaagtggaggaatatggtgtatactaactctatcatatcaatatgatgaacttaatatcagtgaatcgccatttaaacttaataaattaaagccaattcaaattgcaagtttagatatgaatgaagtttttgaagccagaaaacattttactaaagatgagtggataggcttcttgcttagatcatctggaatggaatttgaaaattttgataaagatgctatatggcatttgttagctagaatgatgcctcttgttgaaaacaattacaacctttgtgaattaggtcctagaggaactgggaaatcatatatctataaagagataagtcctaattccattctcctttcaggagggcaaacaacagtagcaaatcttttttacaatatgtcaaaaagacaagtaggtttggtaggttattgggatgttgttgcatttgatgaaattgcaggaataaaatttaaagataaagatggtatacaaataatgaaagattttatggcaagtggttcttttgcaagagggaaggaagaaaagaatgctaatgcctctatggtctttataggtaatattaatcaaagtgtggatgttttattaaaaacagctcatcttttagttgattttccacctgaaatgaataatgactctgctttctttgacagaatgcattgctatatacctggttgggacattccaaaattatctccaaaatcttttactaaggaatatggattaattgttgactatatggcagaaatatttagagagcttagaaaaacttcatatggagatgctttagataagtatttttcacttggtagagatttaaatcaaagagatactattgctgttagaaaaactgtctctgctctaattaaattggtctatccagatggagtatttacaaaggaagaagttgaagaaattttagtaagagccttagaatatagaagaagaattaaagagcaattaaagaaaatggcaggaatggaattttttgcaactaatttttcatatatagataaagaaagtggagaagaaaaatatgttggtttaaaagaacaaggaggaagtaagcttattccagaaggtcctttaaaagctggaagcctatatactattgcaatttcagctaactctgtaaaaggtctatataaagtagaaagtcaaatatctgctgggaaagggaaaataactgtatcagataacaaatatagaaaaacttttgagaatgcttttaactatttaaagataaattctaagagaataagtggagcaataaatataagtgaaaaagaattttacctgtctgttgctgatgaaaaaaatgttggtaatacagaagctataactttaggaggctttattgctatgtgttctatagctttaaatagacaacttatgccacaaacagttgttctaggggaaatggctttatcaggatctattaatgcagtttcagatttagttagcatgcttcaaattgctagagaagctggagctaaaaaagcattgattccaattttaaatgctgttgatatgtcaacattgcctcctgatatcttaatggatattcaacctattttttatcaagatcctattgatgcaactcaaaaagcattgggacttatttag

SEQ ID NO: 3970 - DNA, 2052 bp, Vibrio cholerae; identical to SEQ ID NO: 3950

SEQ ID NO: 3971 - DNA, 2061 bp, Aurantimonas manganoxydans
atgtcattatcgatctcgccatcgcccgcgacttcgactgaggtcgacgaactcgtcgttcggcatttcggtggcaaggtcgtccgcaaggatctgaccaagctcctgaaggaaggtgcgaacgtcccggtctatgtgctcgagtacctgctcggcatgtactgcgcgtccgacgacgaggcgacgatccgcgatggcctggagagcgtgaagcgtatcctttcggagaactacgtccgcccggacgaggccgaaaagatcaaatcgacgatcaaggagcggggcagcttcaaggtcatcgacaaggtgaccgtcaagctcaacgagaagaaggaccggtacgaagcactgctctcgaatctcggagtgaaggacgccttcatctccagcgccgacgtccgcagatacgaaaagctcctctcgggcgggatctggtgcatcgtgaccatgcactacctctacgaggagggctcaaagtcctcgccgttctcgatctcggatctgaagccgatccagatgccgaacatggatatgccggagcttcttgagggacgctctcacttctctgaggagcagtggctcgacgtcctcttgcgatcgacgggcatggagccatcgaacttcgataaccgggtgaaatggcacctcctttcccgtctcataccgttcgtcgaaaataactacaattgctgcgaactgggccctcgcggcaccggcaagagccacgtctataaggaatgcagcccgaacagcattctggtgtcgggcggccagacgaccgttgcgaaccttttctataacatggccagccgggtcgtggggctcgtcggcatgtgggacgtcgtcgcgttcgacgaggttgccggcatcagcttcaaggacaaggatggcgtccagatcatgaaggacttcatggcgtcgggcagttttgtccgcgggcgagagtcagtggccggttcggcgtcgatggtcttcgtcggcaacatcaaccagcccgtcgatacgctggtgaagaccagccacctcctggcgccgttccccgaggcaatgatcgattccgcgttcttcgatcgcttccacgcctatatccccggctgggagattccgaagatgcgcccggaattcttcaccaaccggttcggcctcatcaccgattacctggctgagtacatgagggagatgcggaagaggaacttctccgacgcgatcgaccactatttcaagctcggcaacaatctgaaccagcgggacacgattgctgtccgtcgcacggtttcgggactcctgaagcttctccatcccagcgccgactacgacaaggaagctgtccgccgctgcctcgaatatgccctcgaagcccgccggagggtaaaggagcagctgaagaagatcggcggcatggagttctacgacgttcacttctcctatctcgataacgagacgctggaggagactttcgtgagcgtgcccgaacagggtggcgggaagctgatcccggaaagccaaatgaatcccgggacgctccacacgatcgccgctggggcgaagtcgggccaccgtagcctgtatcgcctggaggtgcagacaacgaccggcagcgggaagttcaccgtgtccggcctgggatcaaaccagaaagccaaggaggcgctcgggattgcctttgatttcttcaaggcgaatgcgggtcggatcagcgcgagcactcggccgagtgaccacgatgtccacgtccacaccgtggagctacacaatgcaggggccccgacggctatcaccctcgcgggattcgtggccctctgctcgggcatcctgaagaagccggtgcaaggtcagatggtgatcctgggcgatatgagtctcggcggcagcgtagtgccggttcaggatctcgccgaatcgctccagatggcttttgacagcggggcaaagaaaatcctgatcccgatggccagtgctgcagacatcccaacgatcccagcggaattgttcaccaaattccagacgtcgttcttttcggatccggtcgacgccgccttcaaagcattggggctgaattga

SEQ ID NO: 3972 - DNA, 2067 bp, Sinorhizobium meliloti
atgacaacgctggatgataagatcaatgaacgcttcccgggcctcgtggttcgcaaggacctagtcaaggcggtaaagggcaatgccattgtcccgtcctacgtgttggagttcctgctcggccaatactgcgccaccaatgacgagagctcaatccaatcagggatcgagaccgttaaggaaatccttcgcaagcactacgttcatcgcaatgaggcggggctgatccgatcgaacatccgggaaaagggccgatggaaagtgatcgacaaagtcagcgttgatctcaacactgacaaagatgcctatgaggcgaccttcgccaacctgggcatcaagaaggtcatcatcgactccgacaccgtgaaggctcatcccaagctgctggttagcggcgtctggtgtattgccgacgtcgagtacgagcacagcgaagacaagaacgtcgaaccttggattctagggagcatcaagccgatccagctttcaaagtttgactatgaggcatttctcggcgcgcgcgcgggatttacgaccgatgagtggatcgacctgttgttccagacggtcggctttgatcccgagatgttcggtcgccgtagcaagctcctgcaactgacgcgcctcgtgcccttcgtcgagcgaaactacaatctgatcgagctcggaccgaagggcaccggcaagtcgcatatcttttccgagttctcgccgcacggcatcttgatttcagggggcgaagtgacagtgcccaagctgtttgtcaacaacagctcgggaaagattggattggtcggctattgggatgtcgtcgctttcgacgagtttgccggtcggcagaagcgtgtcgacaaggcacttgtcgacatcatgaaaaactacatggccaacaagagcttctcgcgaggagtggagacgctcggcgccgaggcgtcgatggtgtttgtcgggaacaccaagcacaacgttccgtacatgctgaagcacaccgacttatttgaggagcttcccgagaagtactatgattctgcctttatcgaccggcttcacacctatgtcccgggctgggagatcgacgttatccgtggggagatgtttgcctccggttacggttttgtggttgactacctcgccgaaatccttcggcacatgcgtaatgacgactactccaatcgctatcggaatctttttacgctttcagcggacatttcgactcgtgatcgcgacggggtgaataagaccttttcgggcatgatgaaactgctctttccagcagacaatgcaaccgaggttgaagtcgaagagatcctgcacttggctgtggaagggcggaaacgggtgaaggatcaacttcttcggatagacagcacatacccggagacggacttctcattcatggcgcaagatggacggaaggtcgtcgtcaagacgctcgaagagacagagtacccacaatattatcacaagcgtgcggcggggcacgacggttcaacgcccgagggcgcaggttatgtcgaaggtgggtccaccacaaacgtcgtgcagcacgcaggtgaagcagaaacaaatgtcgttggtccgcatgagggacacaaggttttcaatgaaaatcagaaagggatcacgttcgccgatctcttctggccgtggctgaagggagccacgaatattgtactcaccgatccctacatccgcatgtttcatcagttgcggaatttgatggaattcatagaaatgatcgctcagcacaaagcaccagaagatgaactgacggttcacctggtaacctgtgcggacgaggcttatccggaaaagcaacaatctaatttaatggccattgaggcagcagcgggcgcggcaggtatcaaactcacttgggagttcgatgggaccaacacaattcacgctcggcatcttgtgacggatcgaggttggaagatcagcttagatcgcggcctcgatatatttcagaaatttgagatgaacgatgcgtttagtcttgcgaaccgattgcaaacctatcggcaagtaaaggcgttcgagattacttatctacggtccgtatga

SEQ ID NO: 3973 - DNA, 2082 bp, Sphingobium yanoikuyae
atgtcgacccttgatgacaagatcaatgagcattttgccggtttcgtggtccgtaaggacctggtgaaggccgtgaaagggaacgccattgtccccacttatgtgctcgaataccttctcggccagtattgcgcgaccgatgacgaagcctcgattgcgacaggcattgaaacggtcaaggacatcctgcgcaagcactacgtccatcgttccgaagctgggttggtacaatcaacgatcaaggagcgtggccgctacaaggtcatcgatcaggttagcgtggcgctgaatgaaaagaccgatgcctatgaggcggtctttgaaaacctcggtatcaagcgggttgccatcgacagcgccacggtaaaggcgcacccgaaactgctggttacgggtatttggtgcatcgccgatgtgcagtacgaattctcggaagacagccggatctctccttggatcatcgacacgctgaagccgatccagatcgcccgtgtcgactatgatggttatcgcgagacgcgggacaagttcaccaccgaggaatggatcgatctcctgatgcagagcatcggctttgacccgtcactgttcgggcgccggtcaaaacttctgcaactgttgcgcttggtcccatttgttgagcgcaactacaacctcatcgagcttggtcccaaggggacgggaaaatctcatatctattccgagttttcgccacatggtcagctgatctcgggcggtgaaatcacggttcccaagcttttcgtgaacaattccaatggccggatcggattggtcgggttttgggatgtcgtggcctttgacgaatttgccggccgcgagaagacggccaacaaggcgcttgtcgatatcatgaagaactacatggcgaacaagcagttctctcgtggtgtaaatccgatgggcgctgaggccagcttcgcctttgtcggcaacacggaccataacgtgccttggatgctgaagaatacggacctgttcgaggctctgccgccgcagtttcacgacagcgcctttattgatcgattgcatgcctatctgcccggatgggaggtcgacatcatccggggtgagatgttcacatctggctatgggttcattgtcgactatctcgccgaaatcctgcgccatctgcgtgcggaggacttctcgcaccggccagatcgctatttcaccattccggttcagacccatatccgggaccgcgccgcgatcaacaagaccatgtcaggcctgctgaagctgatcttcccgaatggaggcgagacagaagccgaagttgaagagctgctgcggtttgcgattgaatgccgcaagcgggtgaaggaccagctcctgcggatcgacagcacctttgaggcagcagatttccattacatcgcctctgatggcgcaaagcgcgccgtaaccacgctcgaggaagaggagttcccccagttctaccaccgtcgatcaaccgacgatggaagtgacggtgtgaatcaacaagagattgggtcggtaccggcagagccggtctcaacggcggctgcttccgcagcgcctaccgttaccgctgccccgcacttccccccaactcccggacatgtcgttttcacagaaaaccgcaagggcatcagtttcgacaagatctttggtccttggacggatggcgcgacgcggatcatcatcacagacccctatatccggaagttccatcaggcgcgcaacgtgatggaactgatcgagatgctgatcaggcgcaaacagcctgaagatcagatcgctgtgcatcttgtcacggctccggacgatgggaacattcaggagcagcgagagtgcctggacgggattgctgaagcctgcacaggcacgggcgtcgatttcacatgggccttcgatgggagcggcactctccatgcacgcgacatcacgacggatactggctggaagatggttctggatcgcggattggatattttccagccaacgcctcgcaagatgaacggtttctcgctgggagaacggatgcaggagcaccggatggtccgtggtttctacgtgacttatgtcgagaacctttag

SEQ ID NO: 3974 - DNA, 2040 bp, Pseudomonas fragi
atggaaacccaagtggataaagatctcgatcagttgcttaacgagcattttgccggtcgcgtggtgcgcaaggatctgaccaagctgataaaggaaggcgcgaacgtaccagtttacgtgcttgagtacttgctgggtatgtactgcgcgtccgatgactcagaggtgatcgaacaaggcctgaagaacgtcaagaaaattttagcggagaactatgttcgaccggatgaagccgagaaggtcaaatctctagttcgcgagcgcggcacgtacaaggtgatcgaccgagtcaccgtgcgactgaatgaaaaaaaagaccgctacgaagcctctttcagcaacctcggcatcaaggacgctgagatctctgctggcatcgttaaagaatacgaaaagctccttgtgggcggcatctgggtgatcgcaacgctgagctactaccacgaggaaggccaatcgggatctccttttggcgtcactctgctcaagccaatccagatgcctaacatgaacatgcaggagctgttcgaagggcgcgcagcactgagtaccgtaaactggcgcgagacactgattcgctccatcggcatggagccatcgacgttggatgagtccgtacagtggcatttgctagcccggatggttcccttcgtggagaacaactacaacgtttgcgagctcggcccccgcggcaccggaaagagtcacatctacaaggaatgctcaccaaacagcatgcttgtgtctggtggccaaaccaccgtcgctaacctgttctacaacatgagcagtcgccgtatcggtctggtcggtctttgggatgtagtggcattcgatgaggtggcaggcatcaacttcaaggacagggacggcgtgcaaatcatgaaggacttcatggcctccggctccttcggtcgtggccgtgagcagatggaagcctccgcttccatggtcttcgtcggaaacatcaatcagagcgtcgagtcgctggtgaaaaccagtcacctgttggcccccttccctgagcagatgatcgacgccgcctttttcgaccgatttcacgcttacattcctggctgggaaatcccaaaaatgcgcccggaatttttcaccaatagatacggactgatcgtcgattacctggctgagtttttccgcgaaatgcgcaaacacagctttgcggacgccatagacaaacacttcaaattgggtaacaaccttaatcaacgtgatgtgatcgcagtacgcaaaactgtatccggtctgctcaagctgctctacccgcacgatgtgttcaccaaagaagacgtgcgccagtgcctcgaatatgcacttcaggtccgccgccgcgtgaaagaacaactaaagaagatcggtggaatggagttctacgatgttcactttagctacatcgacaacgaaaccctcgaagagcacttcgtcaccgtgaaagagcaaggcggtggtggtctgatccctgaagggccaggaaagcccggttttatccacactataggcttgagcggcaaaggcatgcctgggctatataggattgaactgcaggtgaccaagggtactggcaagctggctacttcaggtctatggaattccagctctgccaaagaacaggtgaaaattgcctttgactacttcaaggccaacgcctcgcgcatcagcgcttcggctaaggtgctggagcacgactttcatttacatgtcgttgaactgcaaaacaccggccctcttactcatatggcactacccagcttagtagcttttgcttcaggcctaatgggcaggcctgcgcaaggtcaaatggtcgtgctcggtgatatgagcttgggcggcagcatcacgccagttgaaagtatcgccgagtgcctgcaagtggctttcgacgcgggaggaaagcgcgttgcgcttcctatgagcagtgccaaggacatccccagcatcccagccgaactgtttaccaagtttcagaccagcttttatggcgaaccagtagaggctgtatttaaggcaatgggagtggattga

SEQ ID NO: 3975 - DNA, 2052 bp, Vibrio cholerae; identical to SEQ ID NO: 3740

SEQ ID NO: 3976 - DNA, 2118 bp, Faecalibacterium prausnitzii
atggagccgaatgcggaaaacagctgccgccgagacgaaatcaaggaaaagttacggcagaactttgacggaaagatcgttcgcaaggacctgaccaaaaagatcaaggaaggtgcgaacgttccggtttatgtgctagagtttttattaggccagtactgcagttcagatgacgaagccattattgagaaaggcgtacaaaatgtaaaacggattctggcggacaattttgttcgtccggatgaggcacagaaaattctgtcacagctgcgaaaaaagggaagccatactgttattgatatgatcacggtcaatcttgacattaagaagaactgcttctttgccagtttctctaatttgggattggacaaggtgcccattgcggatgaatatccggaaaaatatgatcggctgctctgcggaggcatctggtgcattgtacagctggattatgaagtagagggtgacaataattttggccttgttgatctgggcggtgaaccgttgcagtccagccagaaaaagcagaagaaccttactccaatcagtatccgtaaactaacaccgatccagatgccgcatatcgatatcgacgaattaaagcgtggccataaagcttttacaaaggatgagtggctggatatccttctgcgttctatcggcatggaaccggacgaattcacggaaagagaaaaatggctcctgctcacacgaatgattccactggtggagaacaatttcaacctctgtgaacttggtccccgcagtacgggaaaatcgcatctttataaagaaatctcgcccaacagcattttgatttctggtggacagacgaccgttgcaaacctgttctacaatatggggcgcaaatcggttggcttggttggtctttgggactgtgtggcttttgatgaggttgccggaatcaagttcaaggataaagacggcatccagatcatgaaggactatatggcatccgggtcctttgcccgtggtaaagaggaaaaggcagcctcggcctcgatggtctttgtaggaaatatcaaccagagcgtggatgtgctactgaaaacctccagcttgtttgacccattcccgcccgaaatgggaacggacactgcatttctggatcgtatccattgctatttgcccggctgggagatcccgaaatttcgacccgaacattttacgaatgactatggtttcatcagcgattatctggctgagtttatccgggaactgcggaaagaacagtatggtgatgcgctggatcattatttccgattgggcaaaaatttgaatcagcgtgataccattgctgtacggcgtatggtggatggttatctgaaactgatgtacccagatggagtgtttgataaatctgaactggaagaagttctgcagatttcattggagatgcgtcgccgcgtaaaagaacagttgaaaaagctgggcgggatggaattctacgatgtgaatttctcctatatcgacttggaagacatgtcggagcattatgtgtcggttcctgaacagggcggtggcaagttgattccagacggtatgtgcaatccaggacaggtctacacagtatctcgcggaaaaagtggcatgattggtgtattccgtttggaaagtcagatgttgcctggtagcggaaagtttgagcgcacaggtcttggcagtgaccgtgactgcaaagagtcaacgaatacggcgttcaatttcctaaaagcaaatggaaaacgcatcagcggaggcatcagcactgcatctaaagactacatcatcaattatcaggatctgcaaggtattggcatgacaggaaaattagcattgcctacgctgattgcgctgtgcagtattgcgcttggacggccaacagtcagtacccttgctgttctgggtgaaattagtatcagtggtacaattctaaaggtagacgagcttgcaaacagcttgcaggtatgtcttgacagcggagcgaagaaagttctgctgccgattacaagcgctgcagattttggaactgtacctcccgaattagtgggaagttttaatttaatcttttatagtagcgcagaggatgcagtgttcaaagcattgggtgttgaataa

SEQ ID NO: 3977 - DNA, 2040 bp, Acinetobacter sp.; identical to SEQ ID NO: 3794

SEQ ID NO: 3978 - DNA, 2082 bp, Bacteroides sp.
atgacactacaacagaaaataatgaatgctttcttaggtaaagtggttcgtaaagatttggcttttcttgtaaagggagggctccctgtacctacatacgtattggagtatctgcttgggcagtattgcgcctgtgatgacgaagcaaccatagaagaaggtttggaaaaagtgagacaagtgatccaagataattatgtgcatcgcgcggagtcagaagtcattaagggtaaaatccgtgagcagggttgccatcgtatcattgataaggtgactgttactctcaatgagaaagcggacgaataccaagctcattttgctaacttaggtcttactaatgtgcctattggcactcaatatgtgacaaacaatcccaagctcttatctggaaatggtgtttggtgtatcgtcactattggctatatatcaggcgaagatattaaagtgcgctgggaaattcaaaccctgaagcctgtacaaatatccaatgtggatgttcaagattatatagataaacgcaagaactttaccacggaggagtggttggacttcatgatgcataccgttgggttgaaccccgacaccttaaatcgtcgtgagaagtttattacgttagctcgtctactccctcatgttgagaataattttaactttatggaattaggacctaaaggaaccggtaagagtcatgtctttcaggaactgtcaccatacggtgttttagtgagtggtggtgatgtaaccagtccccgactgtttgtcaagatgagtggtaataaagagattttaggattggtaggctattgggacgtagtggcttgggatgaatttgagcagcaaaaaggccgcgccgtagatgcggtattgattgataccatgcaaaattatctggccaataagtcattcaaccgcggtaagggtacgcatgaggcttccgcttctatttgctttgtgggtaatacgaagcacacggttccttatatgctaaagaatagccatctttttgaatcaattcctacctcgtttatcaagggagcttttttagatcgtatccacctctacaacccgggttgggagattaggatgctgaagaaagatagcttctcaaaaggatacggtctgattaccgattacatagcagccattatgcacgaactgcgcaataaagatttgaccgcattattgaaggattatgctaagtttgatggttccctgtctgaacgtgatcacttggccatccggaaaacattttccggtatggtgaagttgatttatccggatggtaacatgacggacgaagaggcatttgagttgatagactttgctgccgaaagccgtaagcgtgtcaaagaccagttatatattgtggatgagacatttaatgcagagcctgccaagttcagatacgtgcgtgagaaagatggtgtagaaattaatgtggagactctagagaaggtgagtaatgcacttatcatccctaacaatattcaccaagaatctactattatggcaaatttggatgatagcgatattccgcttttccaagaaggaactgaaacaacaatgcaagtagagccttcttcagaacgacagtctcgcaaaagattcattcctttacaggaaaagaatcagttcttccgtttaggacagactggggtcacttatcagtctctctttgccgaatatcttaaggatgcaactgaaatcacgattgaagacccgttcatccgaacaagttggcaagtaaagaatctcatggagtttctgacgatgctcattgatacccgcgacgtagatgaccttaaagtgcatctggtgaccaatgaagaagaagataagttacctgatctcatagataaactggatgacataaaaaacgatatgattggctatggcattgagtttgattataatttccgtgaatttcacgatcgttgtatcaaggccgacaatggttgggtaatttcaatggggcgtggacttgatatatacgagaagtatagtccgtattctgttgcagccactcggccggataaacgtaaatgcaaagagtttatggttacattcactaaggataaatag

SEQ ID NO: 3979 - DNA, 2241 bp, Proteus mirabilis
atgaacggtaacaacgacaaagatttgattgaccatcaaggccaatccgaagagtggattggtgcagagcatgaaactcccgcaaatgttacgcagaacatatatgttgccaatatgcaagtgaacgtagatgaggctggtgtcgaaccagaagcgcctagtgaggttattccctcagatatttccatgtctgaaagggagattcgtgacatgaaaaattcagatctcgatgggttgctaaatctgcactttaaaggccgtgtcgttcgaaaagatctgacaaagcaattgaaagaaggcgctaacgtccctgtttacgtgctggagtatttactagggatgtattgtgcgtccgatgacgacgaagttgtaatgcaaggccttgagaatgtgaaaaaaatcttggctgagaactatgtccgacctgatgaagcggagaaagtgaagtcacttatccgtgaacgcggcacgtttaaaatcatcgacaaagtaagcgttaagcttaatcagaaaaaagacgtctatgaagctgcgttgtctaacctggggatcaaggatgcccttgtaccgaccaaaattgtacaagacaacgaaaaattattaactggcggtatctggtgcattattaccgtgcagtatttctttgaggaaggtcagaagacatcacctttctccattatgagtttaaaaccgatacaaatgccgtccatgaacatggatgaggtgttttcaaccagaagacattttagtaccgatcagtggatggatgtgttgcttcgttccgtgggtatggagccaaccaacttagagcatcgggtgaagtggcatcttattactcgcatgatcccattcgttgaaaacaactacaacgtttgtgagctcggaccaagagggacaggtaaaagccatgtctacaaagagtgctcgccaaactcattgcttatctcgggtggacaaacaacggtggcgaacttgttctataacatgagctcgcgccaagttgggttggtcggaatgtgggatgttgtcgcctttgatgaagtagcgggtattcactttaaagacaaagacggcgtccaaataatgaaagattatatggcgtcagggtcttttgcccgtggccgtgattcaatcgaagcgaaggcttccatggtattcgtcggtaacatcaatcaaagcgttgagacactggtgaagaccagtcatctgttggcaccttttcctgatgccatgattgacactgctttttttgaccgtttccattcctatattcctggatgggaaataccgaagatgcgtcctgagtttttcaccaatagttacggattaatcacagactatcttgctgaatacatgcgtgaaatgcgcaaaagaagttttgcggatgcgatcgataagttcttcaaactcggtaataaccttaatcagcgtgatgtcattgctgtacgcagaacggtttcgggcttgttaaagctactacaccccgacgcacagtacacaaaagatgatgtaagagcctgcctgacctatgcgctggaaactagacgtagagtcaaagagcaattgaaaaagcttggcggaatggaattttttgatgtgcactttagctacatcgataatgagtcattagaagaattcttcgtcaatgtaccagaacaaggtggtagcaagctaattcctgaaggcttacctcgcgctggtgttgtgcacttagttactcagggaagcacggggcagcttgggttatatcgctatgaaacccagatgatggctggttctggtaaacactcagtgtctggccttggttcgaataccgcagcgaaagaagctgtgcgtgttggctttgattatttcaaaggtaacctgaatagaatcagtgcgtcggcgaagttttctgatcatgagtatcaccttcatgttgttgagctccacaatacggggccaagtacaaagtcatcgctcgttgcattgattgcgttctgttcaattctgatgaaccgaccgattcaagagcagatggttgttttgggtgagatgactttaggtggtgttataaatcctgttcaagatcttgcaggcagtcttcagttagctatggacagtggtgcaaagcgtattttgctcccaatggcctcagcctcagatattccaacagttcctgctgagttgttttcaaaattccagatcagcttttatgcagatcccgtcgatgccgtgtttaaggcgcttggggttaattga

SEQ ID NO: 3980 - DNA, 2037 bp, Bacteroides sp.
atgttggaattagataaaaaattactggaccagtttcagggatatgtagttcggaaagacgtagttcgttctgtaaaaggtggtgctaatgtaccggtttttgtattggaatatttgcttgccaattcatgcagtacggatgatgaacagaaaattaaggaaggggttgagaatgtgaagaatgttctccgtaaacattatgtcaatccggatgaagctaatctgatacaggcaaagataagggaagaaggtacttacaaagtgatagataagatttctgtccgtctggatgcttctaaggataaatattgggcagaactttctaacctgaatattcgagatgcaaatattgatgacagggttgtgacggaacatgaaaagatgatgatgggtggaatatgggctatagtggatataacgtatgattccactatggctattggcagtaagctgtatccgttcgtagtatctaaagttcgccctattcagttatcgaactttgatatgtccagaataagtagcaacagaaagaattttaccaatgaagagtggttgaatgtgttgttgcgtagcggtggttatgaaccggagtcggaaggtatgacgcagcgaatgaagatgctccttctttcacgttttatacctatggtagaagctaattttaatatggctgaactcggtccgagaagttccggtaaatcatacgtgttcaaggagttgtcaccatattctatgctggtttccggaggacaaggtacggcagcctctctttttgtgaataattccaatgggcagatcggagcaatgggtaaatgggatgccgtatgttttgatgaatctacagatgaattgtttaaagaccgtgaagtagtgccattgatgaaggactatatggaatcgggttctttctcaagggccggaaaatcaggtgagaaatcggccaatgcttctattatcctgaatggtaacatcaatcagccagtagaaacagtattacagaccagtcatttattcagtcctttctctgacaaaatatcggatgatacggcatttcttgaccgtataggatttttcttgccgggatgggaaataatgaaatttgcacctaccaatttcactaatcattttggtttcagtacggactttttcagtgaaatgcttcatgctttaagaaaggacaattatacgaacgccatagatgagtatttcacgttaggctcacaaatgcgtcagcgtgatacgaaaccggttcgtaagacggtttcaggacttatcaaactgttgcatccggatggaaagtacaccaaggaagatgtacgtgtttatctggaatgggcgatagaaatgcgtagaagggtaaaagagcagttgaaacgtattggcgggatggagttctgggataccaatttctcttatatagataaggaaacacaggaagagacttttgttccagtgccggaagaaagaggtagtgggctgattggtgattctccattgcctcctggtacctgttattctgctacttcggatggagataaggttgccttggtaaagatagaagtaatcacaatggcaggtaatggaaagttaaatatcagcggaactaattctgctaccgtaaaggaggatattaagaatacatataactatatgagggcgaatgagaagatgttgctttctcaacaacgttcgtttgccaatatggatgtaacggttcaggtaacagctttattaggttctgctgtacagagtggcatcggtggagctgtctttgctgctataatttcatcggtattcagcaagaacttgaagcctgctttgggtattatcggcaatatatctatcggtggtgccatcgaacgtgctatcaatttcagtgacaaggtttcaatcttgtcggagaatggagcgaagactgtgcttgtacctatggataatctcatagaactttctactttgccgactacggttttgggtaagactgatgttcctttttatgccaatacacaaatgattattcagaagatgatgttgtaa

SEQ ID NO: 3981 - DNA, 2085 bp, Salmonella enterica; identical to SEQ ID NO: 3644

SEQ ID NO: 3982 - DNA, 2040 bp, Pseudomonas fuscovaginae
atggacacctatcaggacaaagacctggatcagcttctcaatgaacacttcgccgggcgtgtggtgcgcaaggacctgaccaagctgattaaggagggcgctaacgtccccgtgtatgtgcttgaatacctgctgggtatgtattgcgcatcggatgacaccgaggtaatcgcgcagggcctgaagaacgtcaagaccgtgctggccgaaaactatgtacgccctgacgaggccgagaaagttaaatctcttgtgcgcgagcgcggtacctacaaggtgatcgaccgggtaaccgtgcgactcaatgagcgcaaggaccgttacgaggcctctttcagcaatttgggcatcaaggatgctgagatttctgccggcatcgtcaaggaatacgagaagctgctggtcggcgggatctgggtaattgccaccttgagttactaccacgaggagggccagaacggctctcccttcggcgtgacgctactcaagccgatccagatgccgaacatgaacatgcaggagcttttctcaggccgggcggcattaaccactgagcagtggcgtgaggctctgattcgctccatcggaatggaaccctcgaccttggatgggtccgtgcaatggcatttgctggctcgcatggttcccttcgtcgagaacaactacaacgtctgcgagttggggccgcgtggcaccggtaagagccatatttacaaggagtgctcgcccaatagcatgttggtgtccggtgggcagaccacggtggccaacctgttctacaacatgagcagccggcggattggcttggtcggtctgtgggatgttgtcgccttcgatgaagtggccggtatcaacttcaaggacaaggatggtgtccaaataatgaaggacttcatggcctccggatcatttggccgagggcgtgagcagatggaagcttcggcctctatggtgttcgttggcaacatcaaccagagtgtcgagtccttggtgaagaccagccacctgctggctcccttcccagagcagatgatcgacgcagccttcttcgaccgcttccatgcctacattccaggttgggagatccctaagatgcgcccagagtacttcaccaacaggtacggcctaatcgtggactacctggcagagtttttccgcgagatgcgcaagcgcagcttcgccgatgccatcgataaatacttcaagcttggcaataatctcaaccaacgcgatgtgatcgcggtacgaaagaccgtttccgggctactcaagctgctgtatccacatgaccaattcaccaaggaagacgtgcggtgttgcttggactacgccttgcaggtgcgtcgccgcgtcaaggagcaactgaagaaaattggtgggatggagttctacgatgtccatttcagctacatcgacaatgaaactctagaggagcacttcgtaacggtgaaggaacaaggaggagggacgctgatccccgaaggtcagagcaagcctggattcattcacaccatcggcttgagcggcaagggtatgccagggctataccgcctcgagcttcaggtaaccaaaggctctgggaagcttgccacctctggcctctggaactccagcattgcaaaagagcaggtgaagatcgcctttgactacttcaaggcaaacgcctcgcgcatcagtgcctcggccagggtcctagagcatgattttcaccttcatgtggtggagttacaaaacacggggccgctgacccacatggcgctcgcgagcttggtagcttttgcctcaggcttattgggtcgctctgctcaggggcagatggtagtgcttggcgatatgagcctgggtggcaacatcgctccggtagaaagcatcgctgaatgtctgcaggtagctttcgacgctggcggcaagcgtgtagctttgccaatgagcagcgccttggatctaccgaccattcccccagaactgttcaccaagttccagactagtttttacgcagaccccgtcgatgcagttataaaggcattaggagtggattga

SEQ ID NO: 3983 - DNA, 2052 bp, Vibrio cholerae; identical to SEQ ID NO: 3740

SEQ ID NO: 3984 - DNA, 2121 bp, Roseburia inulinivorans; identical to SEQ ID NO: 3843

SEQ ID NO: 3985 - DNA, 2085 bp, Salmonella enterica
atgcaaacccatcatgacttacccgttccagctgtatccgaaggggaactcgtcgcagaaggttacgatctggacgccttgctgaatcagcattttcgtggtcgggtagtacgtaaggacctgactaaacagctcaaggaaggggcaaatgtcccggtctatgtgctggagtatctgctcggtatgtactgcgcttccgacgatgaccagatcgtcgagcaagggttgcagaacgttaagcgtattctggctgataactacgtccgccctgatgaagcggagaaggtgaaatcgctcattcgtgagcgaggatcctacaagatcattgataaagtatcggtaaagctcaatcagaagaaagacgtttacgaagcccagctctccaacctcggcattaaagatgcactggttccgccgcagatggtcaaggacaacgagaagctgttgaccggcggcatctggtgcatgatcaccgtgaactacttctttgaggaaggacaaaaaacgtcgcccttctcgctgatgacgcttaaacctatccagatgcccaatatggacatggaagaggtatttaccgcacgcacgcacttcagccgcgaccagtggattgatgtcctgctgcgctccgtgggtatggaacctgctaatattgagcagcgaaccaagtggcacctgatcacccgcatgatccctttcgtggaaaataactataacgtctgcgaactgggcccacgcggtaccggtaaaagccacgtctataaagagtgttcgccaaactcactgttagtttccggcgggcaaaccacggtagcaaacctgttttacaacatggccagccgccagattggcctggttggcatgtgggatgtcgtcgcgtttgatgaagtggcggggatcacttttaaagacaaagacggcgtgcaaatcatgaaagattacatggcgtctggctcgttttcccgcggcagagattcgattgaaggcaaagcatcaatggtgttcgtcggcaacatcaatcagagcgttgagacattagtcaaaaccagccatttgttagcacccttccctgccgcaatgatcgatacagcgtttttcgaccgctttcacgcctatatacccggttgggaaatcccgaaaatgcgcccggaattctttaccaatcgctacggccttatcacagattatctcgccgaatacatgcgggaaatgcgtaagcgcagcttctccgacgcgattgataagttctataagctgggtaataacctcaaccagcgcgacgttatcgcggtaaggcgcacggtttctggtctactgaaacttcttcaccccaatggttcttacagcaaagaggacgtccgggtttgcctgacctacgccatggaagcccgacgtcgcgtcaaagaacagcttaaaaagctgggcggactggagttcttcgatgtgaattttagttacatcgataatgagacgctggaagaattcttcgtcagcgtgccggaacagggcggcagcgaattaattcctgctggcatgccaaagccaggcgtagtgcatttggttacgcaagcggaaagtggcatgacgggtctgtatcgcttcgaaactcagatgaccgcaggcaatggtaagcatagcgtttccggtctgggatcaagcacctcggctaaggaagccatccgggttggatttgactatttcaaaggcaacctcagccgcgttagcgcaacagcaaaattttctgaacatgagtaccacctgcacgtagtcgaattgcacaatactggaccaagcaccgcgaccagtcttgccgcgctgattgcgctgtgttccgtattactggcgaaacccgttcaggaacaaatggttgtgttaggcagcatgacgctcggtggagtgatcaacccggttcaggatctggcggctagcttacaacttgctttcgatagcggcgcgaaaaaggtccttctgccgatgtcttccgcggtagatattccgactgtgccagccgagttgtttaccaaattccaggtcagtttttactctgaacctgtagatgcggtttataaggcgttgggagtaaactga

SEQ ID NO: 3986 - DNA, 2076 bp, Acidovorax sp.
atgacacaagaactgaacccctctatcgccgcgccgccatccgaagcattggagtccgctgcagacgcgagccttgacgatctgctcaacacgcacttcgctggaaaggtcgtccgcaaggatctgaccaagctcatcaaggaaggtgccaatgtgccggtgtacgtgctggagtacctgctgggcatgtactgcgcgagcaacgacgaggccaccattcagaatgggctgcagatggtcaagcgcgtgctggctgaaaactatgtgcgcgctgacgaggcagaaaaggttaaatcgaaggtgcgcgaaagcggcacgtacaaagtgatcgacaagatcaccgtcaagctcaatgagaagcgggacctatacgaagcgctgctgtccaacctgggcgtgaagaacgccgagatttctgactcgtatgtgcgccagttcgagaaactgctggtgggcggtatctggtgcatcgtcacgctgaagtaccactttgaggaagaccagcgcggctcgcctttcaccgtgacggagctcaagccaatacagatgcccaacatggacatgcaggcactgtttgaggcgcgcaaggccttcaccgatgcgcagtggatcgatgcgctgatccgctccacgggcatggagcccacctgcttcaaagagcgtgaaaagtggcacctgctggcgcgcatggtgccgctggtggaaaacaactacaacttctgcgagctgggaccgcgtggcaccggcaagagccacatctacaaagagatcagccccaacagcattctggtgtcgggcgggcagaccacggtggccaacctgttctacaacatgagtgcgcgcaaggtggggttggtgggcttgtgggacgtggtggcctttgacgaagtggcaggtatcaacttcaaggaccacgacggcgtgcagatcatgaaggactatatggcctcgggctcgttcagccggggccgtgagtccatcaatgccagtgctgccatggtgttcgtgggcaacatcaaccagagcgtggagtcgctggtcaagacctcgcacctgctggcccctttccccgaagccatgatcgactcggccttttttgaccgcttccatgcctatgtgccgggctgggaaatccccaagatgcggcccgagttcttcaccaaccagtacggcctgatcgtggactacctggcggagtacctgcgcgagatgcgcaaatacagctttgccgatgccatcgacaaatggttcaagctgggcaacaacttgaaccagcgtgacaccattgccgtgcgccgcactacgtcgggcttactcaagctggtgtgccctaatggcgagtacaccaaggagtcagtgcgcaagtgcctggaatatgcgctggaaactagacgccgcgtgaaggagcagctcaagaagatcggcggcatggagttttacgacgtgcatttcagctacatcgatttggaagacggtgtggagcgctttgtgacagtgcctgaacagtcgggcggtgcattggtgccggaggggcgcctgcagccaggcaccttgcacaccatcagcatgggtgcctcagaaatgccgggtatctaccggctggagatccagtcgattccaggcggcggcaaggtcaacgtgtccggggcagcgccacgggaggcagtcaaggtggcgtttgactacttcaaagccaactcatcgcgggtgagtgcctccatcaagccgggcgagcgggattttcatacccacctggtggagctgcaaaatagtggtgccccccaagcgctgacgctggccagcttcattgcgctgtgctcggcagcccttgctaagccggtgcagtcgcagttggcagtgctgggagatatgagcctgggcggcacgattgttcaggtgcgtaacttggctgaaagcatgcaagtcgctttcgatgcgggcgcgaagcgcatcttgctgccaatgtcgagcgtgacggacattccgtctgtgccgggcgagttgtttgcaaagttccagaccagcttctattccgacccggtggatgctgcgttcaaggctttaggagttgagtga

SEQ ID NO: 3987 - DNA, 2046 bp, Desulfonatronospira thiodismutans
atggaacttgactatctggacaagaaggcttcccaggtccttgatggatacttggtacgcaaagatctggtgcgtactttcagcaggcagtttccagtgcccacctatgtggtggagtttctgctggggcgttattgcgccagtgtggaatgggaagagatagaggaaggcctggaaattgtccagaagcagctcaaatcaaggaccgttaaggccggcgaggaagaacttttcaaggccagggccaaggaggctggacaggtcaagattattgactccataaccgcaaggttggatgccagaacagattcttatataactgcactgcccagcctgaggctgacagatgtgcgcattgatcccgagctggtgataaagaatgaaagaatgcttaccggcggcttctacgcagaaattaccctgagctatgacccgtatattgcccaggaaaaaaacggacggcctttcggagtcgaggccctgcgagagatccagctctcccagagggacgtattggaccatctggctgaagccagaaaacatttcagcacggaagaatggaaagactttctgctgcgctccattggtttagaggcctccaccctctccccgagacaaaaaaacgcctttatgctcaggatggttccctttgtggaacgcaactacaatatggtggagctgggtcccaggggcacaggaaaaagccacctttttcagcaggtatcgccctatgcccatcttatttccgggggcaaggccacagtggccaggatgttcgtccatatgggcactggtcagcgaggcctggtatgccagtacgatgtggtctgctttgatgaaatctccggcatctcctttgatcaaaaggacggagtaaacatcatgaaggggtacatggagtccggggagttcagtcgcggcagggacagcatcagggctgacggctccattgtcatggtgggtaattttgaagtggatgttgaacaccagcagcgtatcgggcacctgtttggtcccatgccccaggaaatgcgggacgacacggcctttatggatcgcctgcacgcctatctgcccggctgggatattcccaaaatcagcaaaaaatatcttaccgaccatttcggcctggtaagcgattttctgtctgaatgctggagcagacttcgggatgaaagccgggtcaaccttttgcagaacagagtgtttttcgggggagccctttccggacgggacagcaatgctgtcaacaagaccataagcggattactcaagctcctgtacccccaggatcctttggaaatccccgatgaggagctggagtgggccactcagatagccctggagagcaggcgcaggatcaaggaacaacaaaaacgcattggtgctgccgaatacagaaatacccatttcagctacaccatcggaactgatggagtggaaaaatttgtgtctactccggaactgcacagcgaaaacagtatcggggccgatcccttggagcccggacaggtctgggccataagcccgggaatagaaaatgaaaatccaggcctttacagggtagaagtcaactccggtcctggatccgggattaaaattctaaacaagccagtaccgcctgcattcaaggaaagcatgggctatgcagagcagaacctgtattccagagccgcccagctggttggggacaaggaccccagaagccatgagtatactgtgcagctaagggcctttgatgctgccaggtccggagcgaagctgggcgtaccggccctgattgccctgtgcacttctctggtaagaaaaagtgtccggggaggactggtcatatgcggcgaaattaatctcggcggatctatagagcccatacacaatgctgtatccatggccgaaattgcagtggaaaagggggctgtggccctgctcatgcctgtatcctgccgccgtcagctcatcgacctctcagacgacatggccaccaaaatagacattcaattttactctgacgccagggatgcttttatgaaggctattgcggattaa

SEQ ID NO: 3988 - DNA, 2061 bp, Oribacterium sp.; identical to SEQ ID NO: 3771

SEQ ID NO: 3989 - DNA, 2028 bp, Magnetospirillum sp.
atgagcgacagccttgatgatctgttgaacgcccacttcgcgggcagggtggttcgcaaagacctgaccaagctggtgaaggaaggggcgaacgtccccgtctacgtccttgaataccttctgggcatgtattgtgcgtccaacgacgacgtgaccatccgcgaggggctggaatcggtcaaaaagattcttgccgagaattacgtccgccccgatgaagccgagaaggtcaaatcgaagatcagggaacgcggcagctacaaggtcatcgacaaggtaactgtccacctgaacgaaaaacggaacgtctaccaagccctactgtccaacctcggcgtcaaggatgccgagatgccggaccattatgttcggcagtacgagaagttactggtcggcggcatatggtgcatcgtcaccatccagttctaccacgaggaaggtcagaagggttcgccgttcatcgtcagcgacctcaagccgatccagatgcccaacatggacatggaggagttgttcgaggggcggaaggcattcagcgaatcgcagtggatcgacgtgctggtgcggtcgagcggcatggaacccaccaccctgagtgagcgggtgaagtggcatctgctggctcgcatggttccgttggtcgagaacaattataacgtctgcgaactcggacctcgcggtaccggcaagagccacatctacaaggaaatcagccccaacagcatcctgatctcgggcggtcaaaccacggtcgccaacctgttctacaatctgggccgcagaaccgttgggctggtcgggctgtgggattgcgttgcctttgacgaggtggcgggcatcacgttcaaggagaaggacggggtgcagatcatgaaggattacatggcgtcaggctctttcgcccgtgggaaggatgccgtcagtgcctatgccagcatggtcttcgtcgggaacatcaaccagcccgtcgataccctggtgaaaaccagccatctactcgcaccgttccctgacgccatgatcgattccgcgttcttcgaccgcttccacgcctacatccctggctgggaaattccgaagatgcgtcccgaatttttcacgaaccagtacggcctgatcgtggactatcttgcggaattcttccgtgagatgcggaaacgcacctttggcgatgcaatcgacaagttcttcaaactcgggaacaacctgaaccaacgcgacaccatcgccgtccgtcgcaccgtgtctgggttgctgaaactgctctatccccatgagggatacgacaaggacgccgtgcgtcggtgcctggaatacgccctggaaactcggcgtcgggtgaaggagcagttgaagaagatcggcggcatggaattctacgatgtccacttctcctacatcgaccaggaatccatggaggagaagtggatcagcgttcccgagcagggtggcggcaagatcattcccgaaggaccgttgaagcccggtgtcctgcatacggtggcaaccggtgccgccgcccacctcggactctatcggtttgaaacccaggtcacagcaggcaacggcaagctgaccacctcggggttgggatcgaactcgggtgcgaaggaagcggtgaaggtcgccttcgattatttcaaagccaacctcacgcgggtcagcggcatatcgaaggctggtgaccacgatttccacctgcacaccgtcgaactccacaacacgggtgccgccaaggcgatgaccctggcaagcttcgtggcgttttgctcggcaatcatccagaagccattgcagtcgcagatggtggtgctgggcgacatgagccttggcggcagcgtggtgccggtcgagaaccttgccgaatgccttcaggtcgccttcgattcgggggcaaaacgcatcctgatcccgatgtcttcggcggcggacatcccgaccattcccgccgaattgttcgccaagttccagaccagtttttacagcgatcccgtggacgctgtgttcaaggctttgggggtggactga

SEQ ID NO: 3990 - DNA, 2085 bp, Escherichia coli; identical to SEQ ID NO: 3687

SEQ ID NO: 3991 - DNA, 2052 bp, Vibrio cholerae; identical to SEQ ID NO: 3740

SEQ ID NO: 3992 - DNA, 2040 bp, Acinetobacter baumannii
atggaatctgctaacgataaagaactggatcagctgctgaatgaacactttgctgggcgggtggtacgtaaggatctaactaaactgatcaaagaaggggccaatgtcccggtctatgtactcgaatacctgctagggatgtactgtgcctcggatgatccagagatcattgagcagggactacgtaacgtaaagaccgtgctggcagagaactatgtacgacctgatgaagctgagaaggtgaaatccctggttcgtgagcgtggcagttataaggtcattgatcgggtgaccgtaaagcttaatgagcgtaaggacaaatacgaagcatcatttagtaatctgggcatcaaagatgccgaaatctcggcaggcatcgtcaaagagtatgaaaaattacttgttggtggtatctgggtcattgctacgctcagttattattttgaagaaggacagactagttctccatttggggtgagcttactcaagccgattcaaatgccgaatatgaatatggatgaactcttcagtggcagagcagcattaagcacggatcagtggcgcgagagtttaatccgttccatcggcatggaaccggcttcgttaaaagaggacgtgcaatggcacctattagcgcgtatggttccgttcgttgaaaataactataacgtttgtgaactgggaccacgcggtaccgggaaaagccatatttacaaagagtgttcaccgaatagtattttagtctctggtggacaaacgactgtcgccaacctgttctataacatgagtagccgccgtattggtctggtgggcttatgggatgtggtagcttttgatgaagtcgccggtatttcctttaaggacaaagatggcgtacagatcatgaaagactacatggcctcaggatcttttgcccgtggtcgtgaacagatggaagcctcagcttcgatggtttttgtgggtaatattaaccaaagtgttgaatccttggtgaagactagccacttattggctccttttcctgaagcaatgatcgactcggcattctttgatcgttttcatgcttatatccctggttgggaaattccgaagatgcgcccggaattctttaccaaccgttatggtctaatcgttgattatctagctgaattcttccgggaaatgcgtaagcgtagttttgctgatgcaattgagaagtacttcaagctagggaataatctgaatcagcgtgatgtgatagcagtacgcaagaccgtatctggtttgatgaagttactctatccacacggtcggtttaataaagaagatgtacgtcaatgtcttgaatatgccctacaggtgcgccgtcgggtcaaagaacagctgaaaaaaattggtggcatggaattctatgatgtgcatttcagctacatcgataatgacacgcttgaagagcactttgtttcagtcaaagagcaaggtggtggcggactcattcccgaaggtcctgctaaaccaggttttctctataccattgggctcagtaataaaggcatgccaggcttataccgcttagaacttcaagtgaccaaaggttcaggaaaattggcgacatccggcttatggaattcaagtagtgccaaagaacaggtcaagattgctttcgattacttcaaggccaatgcatcccggatctcggggggtagtaaggtgctggaacatgacttccacttacatgtggtcgaattacagaatactggtcccctcagccatcttgctctgccaagtttagtggctttcgcctctggcctattaggacgtccagtacagaatcagatggtagtactgggggatatgagtctaggtggttctgttacaccggtagaaagtattgccgaatgtcttcaggtggcttttgatgcaggtgctaagaaggttgcattgccaatgagtagtgctgcagatattcccacaattccagttgaactgtttaccaagttccagaccagtttctacgcggatcctgtggatgcggtattcaaagctttgggtgtggattga

SEQ ID NO: 3993 - DNA, 2040 bp, Acinetobacter baumannii; identical to SEQ ID NO: 3648

SEQ ID NO: 3994 - DNA, 1980 bp, Magnetospirillum sp.
gtggtacggaaagacctgaccaagctggtgaaggaaggggcgaatgtccccgtttacgtcctggaatacctgctgggcatgtattgtgcgtcgaatgacgaggtgaccattcgcgagggcctggagtcggtcaaaaaaatcctggccgaaaactatgttcgccctgatgaagccgagaaggtcaaatcgaagatcagggaacgcggcagctacaaggtcatcgacaaggtgaccgttcacctgaatgagaagcggaacgtctaccaagctttgctgtccaacctcggcgtcaaggatgccgagatgccagaccattatgttcggcagtacgaaaagctgctggtcggcggtatctggtgcatcgtcaccatccagttctaccacgaggaaaaccagaagggttccccgttcatcgtcagtgatctgaagccgatccagatgcccaacatggacatggaggagctatttgaagggcggaaggctttcgatgaggcccaatggatcgacgtgctggtgcggtcgagcggcatggagccaaccacccttagcgaacgggtgaaatggcacctgttggcccgcatggttccgctggtggagaacaattacaacgtctgcgaactcggtccccgtggcacgggcaagagccacatctacaaggaaatcagccccaacagcatcctgatctcgggtggtcaaaccacggtcgccaacctgttttacaacatgggccgcagaaccgtggggctggtcggtttgtgggattgtgtcgcctttgacgaagtggctggcatcacgttcaaggaaaaggacggggtgcagatcatgaaggactacatggcatccggctccttcgcccgtggcaaggattcggtcagtgcctatgccagcatggttttcgtcggcaacatcaatcagccggtcgataccctggtgaagaccagccaccttctcgcaccgttccctgaagccatgatcgattcagcgttcttcgacagattccacgcctacatccctggttgggaaattccgaagatgcgtcctgagtttttcaccaaccagtacgggctgatcgtggactatcttgcggagttcttccgtgaaatgcggaagcggaccttcggcgatgccatcgataaattcttcaagctcgggaacaacctgaatcaacgcgacaccatcgccgttcgtcgcactgtgtctgggctgctgaagctgctctatccccatgaaggctacgacaaggacgctgtgcgtcgctgcctggaatacgccctggaaacgcggcgtcgggtgaaggagcagttgaagaagatcggcggcatggagttctacgatgtgcatttttcgtacatcgacatggagtcgatggaagagaagtggatcagcgttcccgagcaggggggaggcaagatcattcccgaaggaccgttgaagccgggtgtcctgcacaccgtggcaaccggtgccgccgcccatcttggcttgtatcgatttgaaacccaggtcacggcggggaatggcaagctgaccacctcggggctgggatcaagttctggtgccaaggaagcggtgaaggtcgccttcgactatttcaaagccaacctcacgcgggtcagtggcgtgtcgaaggctggcgatcatgatttccacctgcacactgtcgaacttcacaacacgggtgccgccaaggcgatgaccctggcaagcttcgtggcgttctgctcggcgatcatccagaaaccgttgcagtctcagatggtggtgctgggtgatatgagcctgggtggcagcgtggtgccggtggagaaccttgccgaatgcctccaggtggcctttgattcaggggcaaaacgcatcctgatcccgatgtcttcagcagcggatattccaaccattcccgctgaattgttcgccaagttccagaccagtttctacagcgatcccgtggacgcggtgttcaaggctttgggggtagactga

SEQ ID NO: 3995 - DNA, 2085 bp, Escherichia coli; identical to SEQ ID NO: 3687

SEQ ID NO: 3996 - DNA, 2052 bp, Vibrio cholerae; identical to SEQ ID NO: 3740

SEQ ID NO: 3997 - DNA, 2139 bp, Bacteroides sp.; identical to SEQ ID NO: 3925

SEQ ID NO: 3998 - DNA, 2052 bp, Vibrio cholerae; identical to SEQ ID NO: 3740

SEQ ID NO: 3999 - DNA, 2085 bp, Escherichia coli; identical to SEQ ID NO: 3687

SEQ ID NO: 4000 - DNA, 2052 bp, Vibrio cholerae; identical to SEQ ID NO: 3950

SEQ ID NO: 4001 - DNA, 2055 bp, Methylophaga aminisulfidivorans
atgaatcaactggataaaaaaatcaatgaacagtttcctggcctggttgttcgtaaagatctagtaaaaacggtcaaggggaatgccattgttccatcctatgtgcttgagtatctgctgggacagtattgtgcaaccagcgatgaagctaccatcgaaactggtatagagacggttaaggagattctggcaaagcattatgttcatcgtaatgaggccgggttgataaggtctacaattcgtgagaaaggccgacacaaagtcatcgataaaatcagcgttgctttgaatgataaaaaggatgtctatgaagctgagttttcaaaccttggtataaaaaaggttttgattgattcagacaccataaaaagacatccaaaactgcttgtgggtggtgtttggtgcattgctgacattgaatatgagcatactgaggataaggatgcgagtccttggattctagctagcctcaaacccatccagatgtctcatttcgattacgaaagttatatcgacgcccgcaagaaattcagcttagatgagtggattgatgtacttatccagagtgtaggttttaaccctgagtattttggacgtcgaagtaagttaattcagctgatacgtctaatccctttctgtgagcgtaattacaatcttatagagctaggtccgaaaggcacaggtaagtcccatatatattctgagttttcaccacacggcattttgatttctggtggtgaggttactgtacctaagctgtttgtgaataattcttcaggtaagattggcttagtgggttattgggattgtgtggcttttgacgagttcgcgggcaagaagaagcgtgttgataaggcacttgtcgacatcatgaaaaactatatggcgaataagtcattttctcgtggtgttgagaccttgggtgctgatgcttcaatggtttttgtcggtaacactgaacacagcgtgccttacatgttgaagcactctgacttgttcgatgcgttaccagaaaaattctatgactcagcctttctggatcgtctgcacttctacattccaggttgggaggttgatattatccgtggagagatgttctccaatggatatgggtttgtggtagattatctcgcagagattcttcgtcacctgcgtaaccaggacttttcagatcagtacaaagagcatttcaccctatcaagtgacatatctactcgtgaccgtgatgccatcaacaaaaccttctctggcctcatgaagatcttattcccgcatggtggggcaacccaagaaaatattgaagagattctcaccttggctatggagggaagaaagcgggttaaagaccagctattaagaattgatacgacatatgccgatgtcgattttagctatcaaagtcagacaggtaagaaaattcgagttcgaacccttgaggaaaaagaataccccaactatttccaccacaccgttgctgagggggatgatggtgatttagaagaatatcagttccaagacgggacgtcatctggtcaaacacaaactaatactactacagatccagcacctgaagaaaaacatctgacatttgaagagaatcagaaaggcctgtcatacgattctttgtttggtgcttatctccggggcgcaacagatattacgataactgatccttacatcagggctttttatcaaattcgtaacgttatggaactcctcgaaactatcgtgaaattcaaatctgatgatgaagaggtagcagttcacttaattaccgttgaagatgacttcaaaggtgagcagcaaaaagagcattttgagaagatgaaagaggctagtgcaatgttgggtattagcttctcatgggatttcgacaattctggggctcagcatgctaggcatatcgtgacagatcatggatggaagatttccttagatcgaggcttagatatttttcagcattacgaaatgggtgatgcctttagttttgcaaaccgaatgcagaagtatcgacaatgtagggcttttgaagtgacgtacataaagcaacattaa

SEQ ID NO: 4002 - DNA, 2085 bp, Escherichia coli; identical to SEQ ID NO: 3687

SEQ ID NO: 4003 - DNA, 2052 bp, Vibrio cholerae; identical to SEQ ID NO: 3740

SEQ ID NO: 4004 - DNA, 2091 bp, Photobacterium sp.
gtgggtaaacaaatgaacgaactcaatcaaaaaatttgtagtgaatttgcaggccttgttgtaagaaaggatctggttaagaccgtaaaaggcaatgcaattgtcccttcatatgttttggaatacttacttgggcagtattgtgcaactagcgatgaagcaagtattgagtccggcatccaaacagttaaggaaattttagctaaacattatgttcaccgtaatgaagctgggttaattcgttctaccattcgtgaaaagggtcgtcataaagtcattgataaggtaagtgtctctttaaatgacaaaaaagatgtctatgaaacagagttctcaaatcttggtattaaaaaagttctgattgactctggaacagtaaaaaagcatcccaagctattggtcggtggtgtttgggttattgcagacgtagagtatgatcatactgaagataaagatgctagcccttggattctgagcaccatcaaaccaattcaaatgtctcatttggattatgacagttatatcggcgctcgtagtaagtttagtcttgatgagtggattgatgtactggtgcagagcattggcttcaacccagagttttttggtcgcagaagcaaactgatgcagttagtgcgcttaatccctttttgtgagcgtaatttcaacttaatagaactaggccctaaaggtactggtaaatcgcatattttctctgagttttcgcctcacggtattttaatatctggtggtgaagtaacagttcccaaactattcgtgaataactctagtggaaagttaggcttagtcggttactgggatactgttgcatttgatgaatttgcaggaaaacaaaagaaagtagataaagctttagtcgatatcatgaaaaactatatggcgaacaagtctttttctcgtggtgttgaaatgttgggtgcagatgcatcaatggcatttattggtaatactgaacacagcgtaccctatatgttgaagcactcagacctattcgacgcattgcctgaaaaattctatgattcagcctttttagatcgtcttcatttttacattccgggctgggaaatagatattattcgtggtgaaatgttctcaagcagctatgggtttgtggttgattaccttgctgaggtgcttcgtcatttaaggaaccaagactattcagatcactatagtgaatactttaaaatatcaccgcagatatctactcgtgatagggatgcgattcataaaactttttcaggcttaatgaagatattattcccgcaagggggggcttctgaagaagaaattgaagagatcttaaagttttcaatggaaggtagaaagcgggtcaaagatcagctgtttagaattgatagcacctatgctgatgttaactttgcttacacagataaagcaggcaacgagacaccggttcaaactcttgaagagctgcaataccctaactacttcaacaaaactgtaggtgatgtaactgatatagggatgcctgaacctgaaataccttcttatcaggagtcagatcataaggttcagccaattgctggtgcttcctcagcaacggttagtgatgagcctaccttaaaagagcagcatctaacattttctgagaatcaacgaggggtcagttatgactccttaattgggccttacttgaaaggtgcaaagcacattacaattactgatccctatattcgtattttctatcaagcaaaaaacttgatggaattacttgagacgatcgttaagcaaaaagcagaggaagatgaagttgttgtcagtttagtcactgttgaggatgaatttaaaggcgaacagcaacgtgaatactttgataaaatccaaagctcaatgtttgcagtaggtatcaagttcgcgtattcatttgacacatcaggtagtcagcacgcaagacacatagtgaccgatattggctggaaagtgtccctagatcgtggcttagacattttccaacattatgatgtaaatgatgcttttagcttatcaacaagattacagaaacaccgctcttgtaagcagtttgaagttacgtttataaaagttgaatag

SEQ ID NO: 4005 - DNA, 2052 bp, Vibrio cholerae; identical to SEQ ID NO: 3740

SEQ ID NO: 4006 - DNA, 2016 bp, Fusobacterium sp.
atggatataaatgaaattggaagtaaagtttttgaaggaaaaattgtaagaaaagatttagtttcaaaaataaaaggaggagcaaatgttcctgtttatgttttagaatatttacttggaatgtattgtaatcaaactgacgaagaaagcattgaagagggaatgtcaaaagtaaaaaaaatacttgctgaaaattatgttcgccctgatgaagcagaaaaagtaaaatctaaaataaaagaaattggagtatacaatgttattgataaagtaacagttgttttaaatgaaaaaaaagatagatatgagggacatctttcaaatttaggtgttagcaatattgaaattcataaaagttatataaaggattatgaaaaattattgagtggtggaatatggtgtattctgactttatcttatcaatatgatgaatataatgccactgattctccatttaagctaaataaattaaaacctattcaaattgcaagtttagatatgaatgaagtttatgaggctagaaaacattttaccaaggatgagtggataggctttttacttagatcatctggaatggaatttgaaaattttgataaagatgcaatatggcacttattagctagaatgatgccacttgttgaaaataattataatctttgtgaattaggtccaagaggaacaggaaaatcatatatttataaagaaattagtcctaattctattttactttcaggaggacagacaacagtagcaaatcttttttataatatgtcaaaaagacaagtaggtctagttggctattgggatgttgttgcttttgatgaaattgcaggaataaaatttaaagataaagatggtattcaaataatgaaagattttatggcaagtggttcttttgcaagaggtaaagaagaaaaaaatgcaaatgcttctatggtctttataggtaatataaatcaaagtgttgatgttttagtaaaaactgcacatcttttggttgattttcctcctgaaatgaataatgattctgcattttttgatagaatgcattgttatataccaggttgggatattccaaaattatctcccaaatcttttaccaaagaatatggcttaattgttgactatatggcagaaatatttagagaacttagaaaaacttcgtatggagatgctttggatagatatttttcacttggtagggacttaaatcaaagagacactattgcagttagaaaaacagtttctgctttgataaaattagtttatccagatggaatatttacaaaagaagaagttgaagaaattttaataagagcattggaatatagaagaagaataaaagagcaattaaagaaaatggctggaatggaattttttgcaactaatttttcatatatagataaggaaagtggagaagaaaaatatgttggtttaaaagaacaaggtggaactaaacttattcctgaaggtcctttaaaagctggagcattatataccattgcaatgtcaactaattctgtaaaaggactatacaaaatagaaagtcaaatatctgctggtaagggaaaaataacagtgtcagataataaatatagaaaaacttttgaaaatgcttttaactatttaaaaataaattctaaaagaataagtggagcaataaatatcagtgaaaaagaattctatttatcagttgctgatgaaaagaatgtagggaatacagaaactataactttgggtggttttattgctatgtgttctatctctttaaatagacagttaatgcctcaaacagttatattaggtgaaatggctttatcaggttctattaatgcagtttcagatttggctagtacacttcaaattgctagagaagcaggagcaaaaaaagcattgattccaattttaaatgctgttgatatgtcaatactgccacctgatattttaatggatattcaacctattttttatcaagatcctattgatgcaactcaaaaagcattgggacttatgtaa

SEQ ID NO: 4007 - DNA, 2031 bp, Clostridium perfringens
atggatgaattaagtataaagttaaatcaaagttttgcaggcaaagttgtaagaaaagatttaacacaaaaattaaaacaaggagctaatgttcccacatatgtattagaatatcttttaggaatgtattgtgctacagatgatgaggaaagcataaatgaaggtgttgaaagagttaaaaatatactatcagataattttgttagacctgatgaagctgaaaagataaagtctaaaattagagaaatgactagatatactgttatagataaattaacagtaaaattaaatgaaaaacgtgatatttatgtggcagagttttctaatttaggattaaaagatattgaaatatcatctaattatgttaaggattttgataaacttttaggtggaggaatttggtgtattgtaaagttagaatattattatgatgaaaatgaaaagttatctactccatttattattgaatctgtaactccaattcaaatgcctaacatggatatagatgaacttattaaaggaagaagagattttagcaaagaagaatggattgacatattaattagaagtataggaatggaaccaactcaattagaggagaatgttaaatggcatatgcttttaagaatggttccactttgtgagaataactataatatgtgtgaattaggaccaagaggtactggtaaatcacatttatataaagaaatatctccaaactcaatactaatatctggaggacagactacggtagctaatttattttataatatggctcgtagaaagattggcttagtaggaatgtgggatactgtagcttttgatgaggtggcaggaataacttttaaagataaagacggtattcagataatgaaggattatatggcttcaggatcttttgcaaggggaaaagaggaaaaagcagcatccgcttctatggtttttgtgggaaatataaatcaaagtgtagatgttcttttgaaaacttctcatttgtttgagccattcccagaggtaatggcttatgactcagctttctttgatagaatgcatttttatcttccaggatgggagattccaaaaatgagaccagaacttcttacaaatagttttggatttataacagattatttagcagaatatttaagagaaatgagaaaaagaacctttggagattctatagataagtattttagattaggaaataacctaaatcaaagagatgttatagctgttaggaagactgtttctggacttattaaaattatatatcctcatggagaatttgaaaaagaggatttagaagaaattttaagatatgctcttgtaggaagaagaagagttaaggaacagctaaaaaaaattgggggaatggagttttacgatgtacatttttcttatatggacaatgaaactatgagagaagaatttatttctgtgccagaacaaggttcaggttcattaattccagagggactaggaagagctggacatgtttatactataggaataggtgattctggaatgattggaatatataaaattgaaacagaagttatttcaggatcaggtaagtttgaaaaaacaggtttaggatatagtagggaagctaaggaaagtatagaaactgcatttaggtattttaaggctaacagtagaaatatgagttcttcaatatctactacaactaaagattatttaatgcacatacaagatgttaatggagttggaatgacttcttcattatccttagctgctataatagcaatgtgctcaggagccttaaataagccagtacaaagtcaattagttattttaggttctgtaagtattggaggaacaataaacaaggtagaagatcttgcaaacacattacaagtttgttttgatgcaggagctaaaaaaatactacttccaatggtaaacgcaggagatatagctttagttccgccagagctttttgcaaagtttcaaataatgttttactcaacagcagaggatgcagtatttaaagctttaggagttcagtaa

SEQ ID NO: 4008 - DNA, 2181 bp, Actinomyces neuii
atgagcgaacgcaaccagctagaagcaaaggcagccgaatactttcccggctacatagtgcgcaaagacctggtgcaacaggtcaaaggcaacgcggttgtgcccacctacgtgctggagtttctgctcgcccagtactgcgcaagcaccaatgaggccgagatcgctgcgggcgtggaatcggtgcgcaagatcctagcgaaacactacgtgaaccgcggcgaatcggaactgatcaagtcgcgcattcgcgagcagcgcggataccggataatcgacaaggtctctgtgagcctggacgaacgcaaagacaggtatgtggccgccttcgagaacctgggggtacgcgacgcgctagtatctgaccagaccgtgcagggcaacgaccggctacttaccggcggcgtctggtgcatggccgacataacctacacggcagacgtagcggttgggggcaaacctaaagaggggccgtggacggtaaccaacctgaatgcgatccagctgccgttctttgaccgggatgggtatgtggccgcgcgggagcagtttgacactgcagagtggatcgacctgctaatcgcctcgatcgggttcaacccggaaaagctcagccggcgcgcaaaactgttgcagcttaccaggctaatcccctacgttgagcgcaactacaacctggtcgagttagggccaaaaggtacgggcaaatcgcacatctattcggagctttccccgcacggcatgctagtttcgggtggcgaggtgacgctggcgaaactattcatcaacaacaccaccaggcagattgggctggtcggtttttgggacgtggtggccttcgacgagttcgccggcaagaaaaaggtaaagcaaaacctggtggacacgatgaagaactacctggcgaacaagtcgttctcacgaggggattcgccggtgaccgcggaagcgtccatggtgttcgtaggcaacacgtcgaacaccgtgcccgccatgttggccaactcggacctgtttgagtctctcccggaggcctaccacgacaccgcctatatggatcgcatccactactacattcccggctgggaagtggacgtgatccggcccgaactgttcaaccgcggttacgggtttgtggtcgactacttggccgaagctctgcgggcgtttagggccgaagactattcggggcgttttgcgcaatattttgatttggacagggaaatgtctacgcgcgaccgggacgcggtgcgcaagaccttctcggggctgatgaaactggtgcaccccagcgggcaggcgagcgagcacgaggttgaggacctgctgcggtacgcgatcgaagggcgcaggcgcgtaaaagaacagatcctgcgcctggatgcgaccatgcgcgagtcagggctgcacttctcgtatgcgccggcctcgggcgggaatccgcgcgaggtggtcacccaggaagagctagactacccggagctatttggccgcgacgcgcaggacgggctggccgaggcggcgagcggcgaggcagctagcggcgagcgagcaaagccggctgcggctgaatcggcaaaggtggccgcgaccgggccggctaaggttgaaggcgctggcccagcaagttgcgccggcagtgccgggaacggcggtagtggcaaacaggcggctgcgggccctagggagcgccggcttgaggtgcccgagaataagctgggggtcagtttgcagcggctgctagtggactacctagtgggagccgcgaaggtggaaattgttgacccgtacgttcgcatgccctaccaggtagaaaacctatacgaagttctagcaactattttggcggtcaaaccccgtggagagactgtcgatgtcaagctacttactggctgcgacagggagcatttggagtgggtcgataatcagcgggacatgctggaacagctgcagaacaatttcgctaaatacgggctgaatttcagcttcgagattggcaaggctggccacgaccgcaaaataaccaccgacaccgggtggagcatcgacttggggcgcgggctggacatctaccagccgtggacgtcggatggcgccttcgacccgcgccgacgcgtaacccactaccgccggaccaaagcattcaccttcaccgccagcaggcaggagcgtgagaactag

SEQ ID NO: 4009 - DNA, 2034 bp, Enterococcus faecium; identical to SEQ ID NO: 3762

SEQ ID NO: 4010 - DNA, 2085 bp, Escherichia coli
atgcaaacccatcatgatttacctgtttcaggcgtatccgcaggggaaattgcctccgagggttacgatctggacgccctgctgaaccagcattttgctggtcgcgtggtgcgtaaagatctcaccaagcaactcaaggaaggggcaaacgtcccggtgtatgtgcttgagtatctgctcggcatgtactgcgcctctgacgatgacgatgtggtcgagcaagggttgcaaaacgttaagcgtattctggctgataactatgtgcgcccggatgaagcggagaaagtgaagtcgctgatccgcgagcgtggttcgtacaaaatcatcgataaagtgtcggtgaaactgaaccagaaaaaagacgtttacgaagcccagctttctaacctcggcatcaaagacgcgctggtgccctcgcagatggttaaagacaacgagaagctactgacgggcggtatctggtgcatgattaccgtcaactatttctttgaagaagggcagaagacctcacccttctcattgatgacgctcaagcctatccagatgccgaatatggatatggaagaggtgttcgatgcgcgtaaacactttaaccgtgaccagtggatcgatgtgctgctgcgctcggtgggtatggagcccgccaatattgagcaacgcaccaaatggcaccttatcacccgtatgatcccgttcgtggagaacaactataacgtttgcgagctggggccgcgtggcaccggtaaaagccatgtgtataaagagtgttctcctaactccctgttagtttccggcgggcaaacgaccgttgccaacttgttctacaacatggccagtcgccagatcggcctggttggcatgtgggatgtggtagcgttcgacgaagtcgcggggatcactttcaaagataaagacggcgtgcaaatcatgaaagattacatggcgtcaggatctttctctcgcggcagagattcgattgaaggtaaagcgtcgatggttttcgtcggcaacatcaatcaaagcgtagagactctcgttaaaaccagccatttgctggcaccatttccgactgcgatgattgatacagcatttttcgaccgctttcatgcctatattcccggttgggaaatccccaaaatgcgcccggaattctttaccaaccgttacgggctgattacggattatctcgctgaatatatgcgcgaaatgcgcaaacgcagtttctctgatgcgattgataaattctttaagctgggtaacaacctcaaccagcgtgacgttattgccgttcgacgtaccgtgtcggggttgttaaaactcatgcatcccgatggcgcgtacagcaaagaagatgtgcgagtctgcctgacctatgcgatggaagttcgccgccgcgtgaaagagcaacttaaaaaactgggcggtctggagttcttcgatgtgaactttagctacatcgacaacgaaacgctggaagagttttttgtgagcgtaccggaacagggcggcagcgaacttattcctgccggaatgccaaagccgggtgttgtgcatctggtcactcaggcagaaagcggcatgaccgggctgtatcgttttgaaacacagatgactgccggtaatggtaagcatagtgtatcgggtctgggttcaaatacctccgcgaaagaagctatccgcgtcggtttcgattacttcaaaggcaatttgaatcgggtaagcgcggccgcgaaattctccgatcatgaatatcaccttcatgtcgttgaactgcataatactggcccaagcaccgcaaccagtcttgctgcgcttatcgctttatgttcgatattgctggcaaaaccggtgcaggaacagatggtggtgttgggcagtatgacgcttggtggggtaattaacccggtgcaggatcttgccgccagtttgcagctcgccttcgacagcggtgcaaaacgggttctgttgccgatgtcctcggctatggatattccaacggttccggcagagttatttaccaagtttcaggtgagtttttactcagacccggttgatgctgtttataaggcgctgggtgtgaattaa

SEQ ID NO: 4011 - DNA, 2052 bp, Vibrio cholerae; identical to SEQ ID NO: 3740

SEQ ID NO: 4012 - DNA, 2052 bp, Vibrio cholerae; identical to SEQ ID NO: 3740

SEQ ID NO: 4013 - DNA, 2052 bp, Vibrio cholerae; identical to SEQ ID NO: 3740

SEQ ID NO: 4014 - DNA, 2049 bp, Xanthomonas vesicatoria
atggttgaacttgatcagatagacaggaaagccgcctcggagctggacgggtatctagtccgcaaagacttggtgcgcaccttcagtcggcaatttcccgtgccgacctacgttgtcgagttcatgcttgggcgatattgcgccagcatcgatcaagaggagatcgacgaagggctggagattgttcaacgtcagctgaaatccaggacggtgcgagccggcgaagaagaactgttcaaggccagggcgcttgaaactggcgaggtgaagatcatcgatcttgtgacggcacgcgtggacaacaaaggcgagtacgtcgccagcctgccgagcctgcgcctgacggatgtgcggattagcagcgagttggtcaaccaacacgaacgcatgctcacagggggcttctatgccgagctgggcgtgacattcgatgtagcgatcgcacaggaagccaaggggcgtccgtttgggatcacctcgcttcgggaaattcagctgtccaagcgtgacgtgctggacaccctggccaaggcgcgtcagtcgttcaccaccgaagaatggaagtgttttctgctccgatccatcggcattgagtcaggtgggctgagcgaccgcgagcgaaatgcccttttcctgcgcatggtgcctttcgtagaacggaactacaacctggttgaactcgggccacgcggcacgggcaagagccatctgttccagcaggtttcgccctacgcccacctcatctcaggtggcaaagccactgtcgccaagatgttcgtggagaacaccgccaagggccgtcgaggcttggtgtgccagtacgacgtggtctgcttcgacgaggtgtcaggcatctctttcgatcagaaggacggcgtgaatatcatgaagggctacatggagtccggtgagttcagtcgaggcaaagagagcattcgcgccgatggcagcatcgtgatggtcggcaacttcgatgtcgatgtagagtaccagcagcgcatcggccacctttttgggccgatgccgccagaaatgcgggatgacaccgcgttcatggatcgcatccacgcgttcttacctgggtgggacgtacctaagatcaacaaggagttggtgaccaaccactttggcttggtcagcgatttcctttccgagtgctggagccagctgcgtagtcaaagtcgcgtgagcgaattgcagagccgcgttttctttggcggcgccttgtctggccgcgatacgaatgcgatcaacaagacggtcagcggcttgctcaagctgctgtacccgagcgctgatgtcccggtccccgacgaggatcttgagtgggccgttcgcatcgcgatggaggttcggcgccgagtcaaagagcagcaaaagcgtgtgggcgctgccgagtttcgcaatacgcacttcagctacatcatggacgcggacggggtcgagaagttcgtctctacgccggagctgcaaagtgaaaacagcatcggcggcgatccgctggagccaggtcaggtttggacaatcagtccgggcggcggcgaggaaggctccggcctctaccgcattgaggttaacgaaggtcctgggtcaggtgtgaaggtgctcaacaagcccattccgcctgcgttccgcgagagcattggtttcgccgagcagaacctgtacgccagatccatgcagctggtcggcgacaaagatccaagacagcacgagtttactgtccagctgcgggcttttgatgcagcgaagtccggggcgaagcttggcgtggcttctctggttgccttgtgcacgtcgctcttgaagcgaaacgtgcggggcggtttgatcatcgttggcgagatcaaccttggaggatcgctcgaacctgtccacaacgccgtcacgattgccgagatcgcggtcgagaaaggcgcagcatcgctgctgatgccggtggcgtgtcgacgccaattggtcgacttgtcagacgacatggcgaccaagatcgacatccagttctactccgatgcccgcgatgcgctgatgaaggctacggcggattag

SEQ ID NO: 4015 - DNA, 2064 bp, Lactobacillus zeae
ttgacatctgatgagcataatgatcgtagtcaggctgaccctcaagttgatccgactgttgctaagttagaacaaagctttccgggacgttttgtgcgaaaagatcttacccaacgaattaaagaaggtgctaatgttccgatttatgtgttggagtttttactgggacaatacgccaattcgtcagatccacaactgatcgaagatggtgttgagcgggttaagaaaactttggcgcataattatgttcgccctgatgaagctgagatggttaaatctaagattcgtgaaaacggagcatacactgttatagacaagttgacagtgcagttgaatgaacgcgcagaccgttatgaagctttcttcagtaacctaggactaacgaacgtacccgttgatgaacgttatgttcaggattatgagcggcttttaattggcggtatttggtcaattgtgcgcgtggagtatcagcacgataatgaagaccactttacaattgaaaaattgacgccaattcaagtgccgtttgtcgatatgaaagaggtttatgaaggtcgcaaagcatttacgaccgatgaatggctggatgtattgttgagaactaccggcatggagccgacacaatttacagaacgcgaaaagtggttattgttatcgcgactaattccgtttgtcgaaaataactataactttgttgaattgggacctcgcggaactggtaaatcacatgtgtacaaagagctatcacctgattcgattttagtatcaggaggccaaacgacggttgctaatcttttttacaatatggctcgccgtgaagttggcttagttggcatgtgggatgttgtcgcttttgacgaagtggcagggattaagtttaaagacaacgatggcgtacagattatgaaagactatatggcgtcagggtcttttgcgcgtggccgcgatcaaattcaagcatccgcaagcatggtatttgttggaaatattaaccaaagtgtggatgtcttgctgcgcacgtcaaacttgtttgagccatttccagaagtgatgggtactgatacggcttttcttgatcggattcacaactatttacccggttgggagatcccaaagtacaggccagaattttttacaaagggatttggatttataacggattacttttccgaagtgatgcgcgaattgcgtaagacttcgtatggagatgcaatcgatccatactttaacttcggcaaacagcttaatcaacgtgatgtgatcgctgttcgcaaaacagtatctggaatgatcaagttactttatccgaatggtatatttaataaggccgaggttgccaaagttcttgaatttgctttagaaatgcgccgtcgagttaaagagcaattaaagcggattggtggcatggagttttatgacgtcaatttttcgtatatagacaaagagacgtttgaggagaaattcgtttcagtgcctgagtcagggtcgagttcactaattcctgtgggacaagaaaatcctgggcacgtttatactgtggcatatgatgatagtgagcgacttagcctgatcaaacttgaaacgcaagtggttcctggtagtggcaagcttagtaagactggtgttggttcaagtgggaaggctaaagaagcgatggatacagcatttaagtacctgaaggccaactataaatccattgatcaacgcattgcagctgaagcccgcgacttcgtagtcagcgaaacgaacttaaataatacagtgccatcaagtcatatttctttggctacgtttgttgctttggtttcgattgctttgggacggccaacgcttgatcaacttgtgatcttgggcgattttacaataggaggaacgatttctcgtattgacaacttgccagatgttttacaagtggcacaggatagcggcgcaaaacgtgttttgattccaacatcgtctgcttctgagatcagcgcggtacctgcagatctaatgagttcgtttaatttgaatttttatagttcggttgaagacgcagcgtttaaagctttaggcgcaaactga

SEQ ID NO: 4016 - DNA, 2139 bp, Bacteroides ovatus; identical to SEQ ID NO: 3925

SEQ ID NO: 4017 - DNA, 2085 bp, Escherichia coli; identical to SEQ ID NO: 3926

SEQ ID NO: 4018 - DNA, 2085 bp, Escherichia coli; identical to SEQ ID NO: 3926

SEQ ID NO: 4019 - DNA, 2052 bp, Coprobacillus sp.
ttggaagaatctatatcaaatagagaagaaattaaagaaaaacttagaaaatactttgatggcaaaatagtacgtaaagatttaactaagaaaatcaaagagggtgctaatgttccagtatatgttttagaatttttattagggcaatattgtagcagtgatgatgaagatataatcattgcaggagtagataaagtaaaaaagatactatctgataattttgtacgtcctgatgaagctcaaaagatattatcgttgcttagacaaaaaggtagctatgctgttattgataaaatgactgtcagacttgatgttaaaaaagatacttatttaggagagttttctaatttaggtattaaagatattcctttgtcagaagattatccaactaaatatgatcgattactttgtggtggaatatggtgtatggtcacattagattatgaatttatagaagaagataaaaaatcaaatcctattaaaataagaaatcttaaacctattcaaatgccacatgttgatatcgaagaattaaaaacgaatagagaaatgtttaacaaagatgaatggattgatattttattacgttcaataggaatggaaccagacgaactaacaaatagagagaagtggttattacttttgaggatggttccactagtagaaaataattttaacttatgtgaattaggaccaagaagtacaggtaaatcacatttatacaaagaaatatctcccaatagtattcttgtatctgggggacaaacaacagttgctaatcttttctacaacatgggtagaaaaacagtcggtttagttggtttatgggattgtgttgcttttgatgaagttgcaggcattaacttcaaagataaagacggtattcaaattatgaaagattacatggcttcaggttcatttgcacgtggtaaagaagaaaaagctgcaagtgcttctatggtgtttgtcggtaatattaatcaaagtgttgatgtattattgaaaacatcatcattatttgatccatttcctccggaaatgggtactgatacagcttttctggaccgtatgcattgctatttaccaggttgggaagtaccaaagtttagaccaaatcattttacagatgattatggttttattacagattatcttgctgaatttatccgagaacttcgtaaagataaccaaggtgatgcattagataaatattttagattgggtaaaaatttaaatcaaagagatacgattgcagttagaaaaatggtatcaggattaatcaaactgatttatcctgattcaaaatataataaagatgacttagaagaaatcttgaaaatttcactagaaatgcgtagaagagtaaaagaacagttaaaaaaattaggtggaatggaattttatgatgttaatttctcctatgtagataatgatacttttgaagaaaaatatgtatccgtaccagaacagggtgtaggaactctaattccagaaggaatactaaatccaggacaagtttataccgtagggcaaggtaaatcaggaatgctaggtgtatttagattagaaagtcaaatgctaccaggtaatggcaaatttgaaaagagtggattaggttcagatactaaatacaaagagtcagccaatgcagcatataactttttaaaagctaatgctaatagaataagtggttctattagtactacatcaaaagattacattattaattatcaagacttacaaggaatcggtatgactgataaattggctttatccactttagtagcaatatgttctattgcattaggtaagccagttataagtagctctgttattctaggtgagataagtgttgcaggatcaattatgaaagttgatgaacttgcaaattccttacaagtatgtttagatagtggtgcaaagaaggtattgttaccaataacttctgctggtgatttgagcatggtaccaccagatttaataggacactttaatttggtgttttatcaaagtgctgaggatgcggtgtttaaagcgttaggtgtggaatag

SEQ ID NO: 4020 - DNA, 2121 bp, Eubacterium saburreum
atggaaatgatggatatggcggcagacgatacgcgtgaagaactgcgccggaagctgcgcagtaactttgacgggcggatcgtccgcaaagacctgacaaagaaaataaaagaaggggcaaatgttccggtctatgtgctggagttcctgctggggcagtattgcagttcagacgatgagacaatcattgagcagggcgttcagaatgtgaaacgcattctggcagacaattttgtccgcccggatgaggctcagaaaattctctcccagctgcgcaagaacggaaaccataccattattgatatggtgacagtgcatctggacattaaaaaggactgcttttttgcggagttctctaaccttggcctcaccaatgtgccgattacggatgattatccggaaaaatatgatcggctgctttgcggcggtacctggtgcattgtgcagctggaatatgagtctgagggagacagcggctttggaatcacagatatagatggacagccgatttcctctaaacagaaaaagcagaaggatatctctcccatcagtatccataagctgactccgatccagatgccacatatcgacatcgaagaagtgcgcgagggacgtaaggcattcacacaggaagagtggatggatgttatgctgcgttcctgcggatatgagccggaacagctgaacaatcggggaaagtggctgctgtttgcacgtatgctgccgttggtggagaacaacttcaatctctgtgagctggggccgcgcagcaccggtaaatctcatatttataaagaaatcagcccaaacagtatccttgtgtccggtggtcagacgaccgttgcaaatctgttttacaatatggggcgcaaaaccgtgggtttggtgggcttatgggactgcgttgcctttgatgaggttgtcggaatcaagtttaaggacaaagacggcattcagattatgaaagactatatggcttccggctcctttgcccgtggcaaagaggaaaaggcagcatcggcatctatggtctttgtaggaaacatcaatcagagtgtggatgtgttgctcaagacttcttctctgtttgatccgtttccgccggagatgggaacggacacggcctttcttgatcgtctgcattgctacattccaggctgggagattccgaagttccgtccggagcattttaccaacgactacggctttatcacggattacttggcggagtttattcgagaactgagaaaagaacagtatggcgatgcgttggataagtatttccggcttggaaagaacctgaaccagcgtgatacgattgctgtccgcaagattgtgggcggctatgtaaaattgctgtatccggatggtgggttcacgaaggaacagattgaagaaattcttatatttgcgctggagatgcgccgccgcatcaaggaacagctgaaaaaactgggtggaatggagttctatgatgtgaatttcagctatatcgaccttgatacctttgaagaaaaattcgtctctgtgccggagcagggcggcggcaaactcatccccgatggcatctgcaattccaggcaggtatataccgtaagtcagggcaagtccggtatgattggcgtatttcgtctggaaagccagatgctgcccggtaacggaaaatttgagcgcactggccttggcagcgaccgtgactgcaaggaatccacgaatacggcgtttaatttcctgaaagctaacgggaagcgaatcagtggcagcataagcaccacgatgcgggattacatcatcaactatcaggatttacagggtattggcatgaccggaaagctggcattgcctacattgattgcgctatgcagcatcgctcttggacggcctacggtcagtacacttgccgtgctgggagaaatcagtatcagcggcacgattcttaaagtggacgagcttgccaatagtttgcaggtgtgcctcgatagcggagcaaagaaagtgctgcttccgattaccagtgcagcagaccttggcaccgtgccgccggagctggtaggtagttttaatttgattttttacagcagtgcagaagatgcaatgtttaaggcgttggaggtagagtaa

SEQ ID NO: 4021 - DNA, 2034 bp, Enterococcus faecium; identical to SEQ ID NO: 3762

SEQ ID NO: 4022 - DNA, 2052 bp, Vibrio cholerae; identical to SEQ ID NO: 3740

SEQ ID NO: 4023 - DNA, 2040 bp, Acinetobacter lwoffii
atggaatctgctaacgataaagaactggatcagctgctgaatgaacactttgctgggcgggtggtacgtaaggatctaactaaactgatcaaagaaggggccaatgtcccggtctatgtactcgaatacctgctagggatgtactgtgcctcggatgatccagagatcattgagcagggactacgtaacgtaaagaccgtgctggcagagaactatgtacgacctgatgaagctgagaaggtgaaatccctggttcgtgagcgtggcagttataaggtcattgatcgggtgaccgtaaagcttaatgagcgtaaggacaaatacgaagcatcatttagtaatctgggcatcaaagatgccgaaatctcggcaggcatcgtcaaagagtatgaaaaattacttgttggtggtatctgggtcattgctacgcttagttattattttgaagaaggacagactagttctccatttggggtgagcttactcaagccgattcaaatgccgaatatgaatatggatgaactcttcagtggcagagcagcattaagcacggatcagtggcgcgagagtttaatccgttccatcggcatggaaccggcttcgttaaaagaggacgtgcaatggcacctattagcgcgtatggttccgttcgttgaaaataactataacgtttgtgaactgggaccacgcggtaccgggaaaagccatatttacaaagagtgttcaccgaatagtattttagtctctggtgggcaaacgactgtcgccaacctgttctataacatgagtagccgccgtattggtctggtgggcttatgggatgtggtagcttttgatgaagtcgccggtatttcctttaaggacaaagatggtgtacagatcatgaaagattacatggcctcaggatcttttgctcgtggtcgtgaacagatggaagcctcagcttcgatggtttttgtgggtaatattaaccaaagtgttgaatccttggtgaagactagccacttattggctccttttcctgaagcaatgatcgattcagcattctttgatcgctttcatgcctatatcccgggttgggaaattccaaaaatgcgtccggaattctttaccaaccgttatggtctaatcgttgattatctggctgaattcttccgggaaatgcgtaagcgtagttttgcggatgccatggagaagtacttcaagctagggaataacctgaatcagcgtgatgtgatcgccgttcgcaagacggtttctggattgatgaagctgctctacccacatggtcagtttaacaaagaagatgtacggcaatgcctggaatatgcactgcaggtgcgccgtcgggtcaaagaacagctgaagaaaattggagggatggaattctatgatgtgcattttagctatatcgacaatgacaccctagaagagcattttgtttcggtaaaagagcagggtggaggtggacttattcccgaaggtcctgctaaaccaggtttcctgtataccattggcctcagtaataagggcatgccaggcttataccgcttagaacttcaagtcactaaaggttcaggaaagttggcgacatctggtttatggaattcaagcagtgccaaagaacaggtcaagattgcttttgactacttcaaggccaatgcatcccggatctcggggggcagtaaggtgctggaacatgacttccacttacatgtggtggaattacagaataccgggccgctcagccatcttgccttgccaagtttagtggctttcgcttcaggcctgttaggacgatcggtacaaagtcagatggtggtactgggtgatatgagcttgggtggttcagtgacaccggtggaaagtattgccgaatgtctgcaagttgcttttgatgcgggtgccaagaaggttgctttaccaatgagtagtgcggcagatatcccaacgattcctgtggaactgtttaccaagttccagaccagcttctatgcagatccggtggatgcggtgtttaaagggttaggggtggattaa

SEQ ID NO: 4024 - DNA, 1272 bp, Eubacterium saburreum
atggaaatgatggatatggcggcagacgatacccgtgaagaactgcgtcagaagctgcgcagcaactttgacggtcggatcgtccgcaaagacctgacaaagaaaataaaagaaggagcgaatgttccggtctatgtgctggagttcctgctgggtcagtattgtagttcagacgatgagacaatcattgagcagggcgttcagaatgtgaaacgcattctggcagacaattttgtccgcccggatgaggctcagaaaattctctcccagctgcgcaagaacgggagccataccattattgatatggtgaccgtgcatctggacatcaaaaaggattgcttttttgcagagttctctaaccttggtctcaccaatgtgccgattacggatgattatccggaaaaatatgaccggctgctttgcggcggtatctggtgcatcgtgcagctggaatatgaatccgagggagacagcagctttggaatcacggatatagatggacagccgatttcttctaaacagaaaaagcagaaggatatctctcccatcagcatccataagctgactccgattcagatgccccatatcgacattgaagaagttcgagagggacgcaaggcattcacacaggaagagtggatggatgttatgttgcgttcctgcggatatgagccggaacagttgaacaatcgggaaaaatggctgctgcttgcgcgtatgctgccgttggtggagaacaacttcaatctctgtgagttggggccgcgcagcacaggcaagtcccatatctataaagaaatcagcccgaacagtatcctggtatccgggggtcagacgaccgttgcaaatctgttttacaatatgggacgcaaaaccgtagggttggtaggcttatgggactgcgttgcctttgatgaggttgccggaatcaagtttaaggacaaagacggcattcaaattatgaaagactatatggcttccggctcctttgcccgcggcaaagaggaaaaggcagcatcggcttctatggtctttgtaggaaacatcaatcagagcgtggatgtgttgcttaagacttcctctctgtttgacccgttcccgccggagatgggaacggacaccgcctttcttgaccgtctgcattgctacattccaggctgggagattccgaagttccgtccggagcattttaccaatgattacggctttatcacggattatctggcagattttatacacctatttttttatattttttatactgttaaatag

SEQ ID NO: 4025 - DNA, 2061 bp, Glaciecola punicea
atgagtgaacttaatcagaaaatttgtgaagaatttgcgggccttgttgttagaaaagatttggtaaaaacagtcaaaggcaacgcgatagtgccgtcttacgtgctggagtaccttcttggccaatactgcgcaacgagtgatgaagcaagtattgaatctggcatccaaacggttaaagaaattctagcaaagcattatgttcatcgaaatgaagcagggttgatccgttcaactattcgtgaaaaaggtcgtcataaagttattgataaagtgagtgttgcactcaacgataagaaagatgtatacgaaactgaattttcaaacctcggcattaaaaaagtcctaatagattcaggcacagttaagcagcatccaaagcttcttgttggtggcgtttgggtaattgctgatatcgaatatgatcatacagaagataaagatgccagtccttggatcttaagcacgattaaacctattcaaatgtctcattttgactatgaaggctacattagtgctcgtaagcagtttagccttgatgagtggattgatgtgctggtacaaagtattggtttcaatcctgagttttttggccgcagaagcaagctgatgcagctaatgcgcctgatccctttttgcgagcgaaattttaacttgatagagcttggaccaaaaggtacaggtaaatcgcacatctattctgaattttcaccccatgggattttaatttcgggtggtgaggtgactgtaccgaaattatttgttaacaattctagcggtaagttagggttggtgggttattgggatacagtagcattcgatgagtttgctggtaagcaaaaacgtgttgataaagcactcgttgatataatgaaaaactacatggctaacaagtcattttcgagaggtgttgagacattaggtgctgatgcatcaatggcatttattggcaacaccgaacatagtttgccttatatgctaaagcattgtgatttattcgatgctttacctgagaaattttatgattcggctttcttagatcgtcttcatttttatatacccggttgggaagtggacattattagaggggaaatgttttcagagggctatggtttcgtggtcgattatttagctgaagtccttcgtcatttaagaaaccaagattactcagaccgttaccaagactattttcagctttcccctcaaatatcgactcgtgaccgcgatgcgattcataaaacgtttagcgggttgatgaaaatcttatttccgcagggcggcgcgacagaagctgaaatagaagagattctgaaatttgctatggaaggtcgtaagcgagtcaaggaccaactatttagaattgataatacatatgcagaagtaaactttgcttataaagacaaagctggtaaagacgtccctgttaatacacttgaagagttacagtaccctaactatttcaatcaaacagtgggtgaagttactgatattggcttacctgagccaagcccattgtcggtagcgcctgagcataaaaagtctgaacctgctccttctagagagccggagttgaaagaacaacacttaacgtttgcagaaaatcagcgtgggataagttatgacaatctttttggtccatatcttgatggcgctaaacaagtaacgattacggacccttatattcgtttattctatcaagccaaaaacttgatggagttgttagaaactatcattaagcaaaaagctgaagaggatgaggtaatcgttagcttggtgaccgtagaagatgagaatagaagtgagcaacaacgtgaatttcttgaaaaaatccaaagttcaatgttcgcagtcggtattaagtttgagtattcatttgaaaactcgacctctcagcacgcgaggcatattgttactgatacaggatggaaaatatctttagatcgaggacttgatatctatcagcaatatgatgtaaacgatgcattaagtctcgctactcgtttgcaaaaacaacgcacattaaaggcgtttgaggttacttttataaaaattgagaattaa

SEQ ID NO: 4026 - DNA, 2121 bp, Lachnospiraceae bacterium
atggaaaggttggatatggcggcagacgatatgcgtgaagaactgcgccggaagctgcgcagcaactttgacggtcgcatcgtccggaaagacctgacaaagaaaatcaaagaaggagcaaatgttcctgtctatgtgctggagttcctgttggggcagtattgcagttcggacgatgagacaatcattgagcagggggttcagaatgtgaaacgcattctggcagacaattttgtccgcccggatgaggcgcagaaaattctttctcagctgcgcaagaacgggagccataccattattgatatggtgacagtccgtctggacatcaaaagggattgtttttttgcggagttctctaaccttggccttaccaatgtgccgattacggatgagtatccggaaaaatacgataggcttctctgcggcggaatctggtgcatcgtgcagctggaatatgaagccgagggagacagcagcttcggaatcacagatatggacggacagccgatttcctccaaacagaaaaaacagaaggaaatctcccccatcagcattcataagttgacgccgattcagatgccgcatatcgacatcgaagaagtccgcgagggacgaggggcgttcacacaggaagagtggatggatgtgatgctgcgttcctgcggatatgagccggaacagcttggcaagcgggaaaagtggttgctgcttgcccgtatgctgccgctggtggagaacaacttcaatctctgtgagctggggccgcgcagcaccggtaagtcccatatctacaaagaaatcagtccaaacagcattcttgtatccggcggtcagacgaccgttgctaatctgttttacaatatggggcgcaagagtgttggcttggtcggcctctgggactgtgttgcttttgatgaggttgccgggatcaagttcaaggacaaagacggcattcagatcatgaaagactatatggcgtccggctcctttgcccgcgggaaagaggaaaaggcggcatcggcatccatggtttttgtgggaaacatcaaccagagcgtggatgtgttgctaaagacttcctccctgtttgacccgttcccgccggagatgggaacggacacggcctttcttgaccgcctgcattgctatattccggggtgggagattccgaagttccgcccggagcattttaccgatgattacggatttatcacggattatctggcggagtttatccgggaattgcggaaagagcagtggggagatgcgttggatcggtatttccgcctcggaaagaatctgaatcagcgtgatacgattgctgtccgcaagattgtgggcgggtatgtaaaattgctgtacccgaacggcgtgttcacaaaagagcaggttgaagaaatccttgtatttgcgctggaaatgcgtcggcgcgtcaaggagcagctgaaaaagctgggcggaatggagttctacgatgtgaacttcagctatattgatctggatacctttgaagagaaatttgtttccgtgccggagcaaggcggcggcaaactcattcccgacggcagctgcaattccgggcaggtatataccgtaagtcagggcaagtccggtatgatcggtgtattccgcctggagagccagatgcttccggggaacggaaaatttgagcgcaccggtcttggcagcgaccgtgactgcaaggaatccaccaatacagcgtttaacttcctgaaagccaacggacatcggatcagtagcggtatcagcaccacgatgcgggattacatcatcaattatcaggatttacagggcattggaatgaccggtaagctggccttacccacattgattgcactgtgcagcattgcacttggacggcccacggtcagtacacttgccgtgctgggagaaatcagcatcagcggaacgattttgaaagtggacgagcttgcgaacagtttacaggtgtgtctcgatagcggagcaaagaaagtgctgcttccgatcaccagtgcggcggaccttggcaccgtgcccccggagttggtggggagcttcaatctgattttctacagcagtgcggaggatgcggtttttaaggcgctgggggtggagtaa

SEQ ID NO: 4027 - DNA, 2055 bp, Lactobacillus rhamnosus; identical to SEQ ID NO: 3902

SEQ ID NO: 4028 - protein, 706 aa, Eubacterium saburreum
MEMMDMAADDTREELRRKLRSNFDGRIVRKDLTKKIKEGANVPVYVLEFLLGQYCSSDDETIIEQGVQNVKRILADNFVRPDEAQKILSQLRKNGNHTIIDMVTVHLDIKKDCFFAEFSNLGLTNVPITDDYPEKYDRLLCGGTWCIVQLEYESEGDSGFGITDIDGQPISSKQKKQKDISPISIHKLTPIQMPHIDIEEVREGRKAFTQEEWMDVMLRSCGYEPEQLNNRGKWLLFARMLPLVENNFNLCELGPRSTGKSHIYKEISPNSILVSGGQTTVANLFYNMGRKTVGLVGLWDCVAFDEVVGIKFKDKDGIQIMKDYMASGSFARGKEEKAASASMVFVGNINQSVDVLLKTSSLFDPFPPEMGTDTAFLDRLHCYIPGWEIPKFRPEHFTNDYGFITDYLAEFIRELRKEQYGDALDKYFRLGKNLNQRDTIAVRKIVGGYVKLLYPDGGFTKEQIEEILIFALEMRRRIKEQLKKLGGMEFYDVNFSYIDLDTFEEKFVSVPEQGGGKLIPDGICNSRQVYTVSQGKSGMIGVFRLESQMLPGNGKFERTGLGSDRDCKESTNTAFNFLKANGKRISGSISTTMRDYIINYQDLQGIGMTGKLALPTLIALCSIALGRPTVSTLAVLGEISISGTILKVDELANSLQVCLDSGAKKVLLPITSAADLGTVPPELVGSFNLIFYSSAEDAMFKALEVE

SEQ ID NO: 4029 - protein, 683 aa, Vibrio cholerae
MAVLNDLDHKLLEHFRGYVVKKDLVRMVKVGANVPVFVLEYLIANSCSTDDEEKIKVGMENVKKILSEHYVNPEESSLIHSKIREKGRFKIIDKISVKLDSKKDIYWAQLQNSNINNGNIRDGLVKEHEKMLMGGIWAIIDVEYDPDIRIGQNIYPFVVTNIKPIQLSTFDNSKIIQKRNEFSRDEWLNVLLRSCGYEPDAEGMTTRVKMLLLARLLPMVESNFNFVELGPRSTGKSFVFKELTPYAVLISGGQGTVAKLFVHGSTGKVGAVGQWDAICFDEATDKIFKEKDAVPLMKDYMESGSFSRAGAGGEITGVASIILNGNINQPVETVLQTSHLFSPLSDEVNNDTAFLDRIHFYLPGWEMIKFAPKHFTSNFGFSTDYFSEALKSFRRVTYTDALENFFSLGSHLKQRDTKPVKKTVSGLIKLLHPNGEYTKEDVREYLEIALEMRRRVKEQLKRIGGMEFWDTNFSYIDKETQEEHFVGLPEEKGSHLIENTPLPPGVCYTSTSDGDNVALVRIEAVTTSGSGKLNISGVSNTGVKENIKNTYQYIKANEKTILSEQHSLKNYDITIQVTNMLGASISTGIGSAVYIAIVSALYKKNLKAGLAVLGNISVGGAIERSINFADKITMLSENGAKTVVVPMDNLVELTNVPPTVLGNTDVPFYQNNQMLMQKSILLD

SEQ ID NO: 4030 - protein, 677 aa, Enterococcus faecium
MEQQEILKLSEFFPGKIVRKDLTKKIKEGANVPVYVLEYLLGMYASSLDETLVEKGVENVKNILARNYVRPDEAEKVKAKIRELGGYTVIDKVTVHLNEKKDCYEAEFSNLGLKNVQISEEYPKKFDRLLGGGIWCIVSMEYWYDENDRWNSPFIAKKVDPIQMPGLDIEAYKMARKEFTTNEWIDLLLRSIGMEPTQFNKRVKWLHLARLIPLIENNFNLCELGPRGTGKSHVYKEISPNSILVSGGQTTVANLFYNMASRTMGLVGMWDCVAFDEVAGIKFKDNDGVQIMKDYMASGSFARGKEEKNASASMAFVGNINQSVDVILKTSNLFEPFPEVMGTDSAFLDRMHCYLPGWEIPKYRPDFFTNDYGFITDYFSEVMRELRKVSFGDSFDKYFKLGSQLNQRDTIAVRRIVSGMMKLLYPDGRFEKSDVEEILRFALEMRRRVKEQLKKIGGMEFYDVNFSYIDLEEEREEYVSVPEQGGGTLIPEGLGKPGHLYTVSYGKTGQLGTYKLETQMTSGNGKFERTGINSDAGAREAMDSAYRYLRANYGSVSQSISLTTKDFVVHVQDMNGIGMTKTLSLSTIIALCSVSLNKPVLPSLVILGDITIGGSMIKVDNLANCLQVAKDAGAKKVLVPMISAADIGTVPPELMGTFNLIFYQTPEDAVFKALGVE

SEQ ID NO: 4031 - protein, 679 aa, Acinetobacter lwoffii
MESANDKELDQLLNEHFAGRVVRKDLTKLIKEGANVPVYVLEYLLGMYCASDDPEIIEQGLRNVKTVLAENYVRPDEAEKVKSLVRERGSYKVIDRVTVKLNERKDKYEASFSNLGIKDAEISAGIVKEYEKLLVGGIWVIATLSYYFEEGQTSSPFGVSLLKPIQMPNMNMDELFSGRAALSTDQWRESLIRSIGMEPASLKEDVQWHLLARMVPFVENNYNVCELGPRGTGKSHIYKECSPNSILVSGGQTTVANLFYNMSSRRIGLVGLWDVVAFDEVAGISFKDKDGVQIMKDYMASGSFARGREQMEASASMVFVGNINQSVESLVKTSHLLAPFPEAMIDSAFFDRFHAYIPGWEIPKMRPEFFTNRYGLIVDYLAEFFREMRKRSFADAMEKYFKLGNNLNQRDVIAVRKTVSGLMKLLYPHGQFNKEDVRQCLEYALQVRRRVKEQLKKIGGMEFYDVHFSYIDNDTLEEHFVSVKEQGGGGLIPEGPAKPGFLYTIGLSNKGMPGLYRLELQVTKGSGKLATSGLWNSSSAKEQVKIAFDYFKANASRISGGSKVLEHDFHLHVVELQNTGPLSHLALPSLVAFASGLLGRSVQSQMVVLGDMSLGGSVTPVESIAECLQVAFDAGAKKVALPMSSAADIPTIPVELFTKFQTSFYADPVDAVFKGLGVD

SEQ ID NO: 4032 - protein, 423 aa, Eubacterium saburreum
MEMMDMAADDTREELRQKLRSNFDGRIVRKDLTKKIKEGANVPVYVLEFLLGQYCSSDDETIIEQGVQNVKRILADNFVRPDEAQKILSQLRKNGSHTIIDMVTVHLDIKKDCFFAEFSNLGLTNVPITDDYPEKYDRLLCGGIWCIVQLEYESEGDSSFGITDIDGQPISSKQKKQKDISPISIHKLTPIQMPHIDIEEVREGRKAFTQEEWMDVMLRSCGYEPEQLNNREKWLLLARMLPLVENNFNLCELGPRSTGKSHIYKEISPNSILVSGGQTTVANLFYNMGRKTVGLVGLWDCVAFDEVAGIKFKDKDGIQIMKDYMASGSFARGKEEKAASASMVFVGNINQSVDVLLKTSSLFDPFPPEMGTDTAFLDRLHCYIPGWEIPKFRPEHFTNDYGFITDYLADFIHLFFYIFYTVK

SEQ ID NO: 4033 - protein, 686 aa, Glaciecola punicea
MSELNQKICEEFAGLVVRKDLVKTVKGNAIVPSYVLEYLLGQYCATSDEASIESGIQTVKEILAKHYVHRNEAGLIRSTIREKGRHKVIDKVSVALNDKKDVYETEFSNLGIKKVLIDSGTVKQHPKLLVGGVWVIADIEYDHTEDKDASPWILSTIKPIQMSHFDYEGYISARKQFSLDEWIDVLVQSIGFNPEFFGRRSKLMQLMRLIPFCERNFNLIELGPKGTGKSHIYSEFSPHGILISGGEVTVPKLFVNNSSGKLGLVGYWDTVAFDEFAGKQKRVDKALVDIMKNYMANKSFSRGVETLGADASMAFIGNTEHSLPYMLKHCDLFDALPEKFYDSAFLDRLHFYIPGWEVDIIRGEMFSEGYGFVVDYLAEVLRHLRNQDYSDRYQDYFQLSPQISTRDRDAIHKTFSGLMKILFPQGGATEAEIEEILKFAMEGRKRVKDQLFRIDNTYAEVNFAYKDKAGKDVPVNTLEELQYPNYFNQTVGEVTDIGLPEPSPLSVAPEHKKSEPAPSREPELKEQHLTFAENQRGISYDNLFGPYLDGAKQVTITDPYIRLFYQAKNLMELLETIIKQKAEEDEVIVSLVTVEDENRSEQQREFLEKIQSSMFAVGIKFEYSFENSTSQHARHIVTDTGWKISLDRGLDIYQQYDVNDALSLATRLQKQRTLKAFEVTFIKIEN

SEQ ID NO: 4034 - protein, 706 aa, Stomatobaculum longum
MERLDMAADDMREELRRKLRSNFDGRIVRKDLTKKIKEGANVPVYVLEFLLGQYCSSDDETIIEQGVQNVKRILADNFVRPDEAQKILSQLRKNGSHTIIDMVTVRLDIKRDCFFAEFSNLGLTNVPITDEYPEKYDRLLCGGIWCIVQLEYEAEGDSSFGITDMDGQPISSKQKKQKEISPISIHKLTPIQMPHIDIEEVREGRGAFTQEEWMDVMLRSCGYEPEQLGKREKWLLLARMLPLVENNFNLCELGPRSTGKSHIYKEISPNSILVSGGQTTVANLFYNMGRKSVGLVGLWDCVAFDEVAGIKFKDKDGIQIMKDYMASGSFARGKEEKAASASMVFVGNINQSVDVLLKTSSLFDPFPPEMGTDTAFLDRLHCYIPGWEIPKFRPEHFTDDYGFITDYLAEFIRELRKEQWGDALDRYFRLGKNLNQRDTIAVRKIVGGYVKLLYPNGVFTKEQVEEILVFALEMRRRVKEQLKKLGGMEFYDVNFSYIDLDTFEEKFVSVPEQGGGKLIPDGSCNSGQVYTVSQGKSGMIGVFRLESQMLPGNGKFERTGLGSDRDCKESTNTAFNFLKANGHRISSGISTTMRDYIINYQDLQGIGMTGKLALPTLIALCSIALGRPTVSTLAVLGEISISGTILKVDELANSLQVCLDSGAKKVLLPITSAADLGTVPPELVGSFNLIFYSSAEDAVFKALGVE

SEQ ID NO: 4035 - protein, 684 aa, Lactobacillus rhamnosus
MTSDDTQADSVKSDEVLVKLEQNFPGRFVRKDLTQRIKEGANVPTYVLEFLLGQFANSSDEETIERGVENVKKTLAHNYVRPDEAEKVKSKIREDGAYTVIDKLTVRLNEGEDRYEASFSNLGLTGVPVDERYVQDYERLLIGGIWSIVRVSYDHESLDHFSIQKLNPIQVPFVDMKEVYAGRKAFNTDEWLDVLLRTTGMEPTQFTEREKWLLLSRLIPFVENNYNFVELGPRGTGKSHVYKELSPDSILVSGGQTTVANLFYNMSRREVGLVGMWDVVAFDEVAGIHFKDKDGVQIMKDYMASGSFARGRNEIQASAGMVFVGNINQSVDVLLRTSNLFGPFPEMMGNDTAFLDRIHNYLPGWEIPKYRPEFFTKGFGFITDYFAEVMRELRKISYADAIDEYFSFGKQLNQRDVIAVRKTVSGLVKLLFPDGVFTKDDVAKILEFAMEMRRRVKEQLKRIGGMEFYDVNFSYIDKVSFEEKYVSVPESGSSSLIPEGQENPGHVYTVAYDDSKRLSLIKLETQAVPGLGRLNRSGVGSSTRAKEAMNTAFNYLEANYKSIDQRINADARDFFVSATNLNNSAPSSHISLATLIALVSIALGKPTLDGLVILGDFTIGGTISRIDDLADTLQVALDSGAKRVLLPAAAASDISSVPTDLMSSFNLIFYNSVKDAAFKALGVG

SEQ ID NO: 4036 - protein, 738 aa, Actinomyces sp.
MSISPEEALEREDSPASSLIGGSEGGKLAEYEEIAARAYDGFVVRKDLVGQVKGNAIVPSYVLEFLLAQYCATTSEAAIVEGVESVRRILAKHYVNRGDSELIKSRIREEGQYRIIDKVSVNLDETHDRYNASFENLGVTNALVSDETVRENDRLLTGGVWCLAEMSYVPMGDSGAKASSPWIVSRLQAIQLPRFDFGRYCTGRASFSTDQWIDLLVASVGLDPDKLSRRSKLFQLTRLIPYVERNYNLVELGPKGTGKSHIYSEFSPHGILVSGGEVTLAKLFVNNATRRIGLVGYWDVVAFDEFAGHKRVERSLVDTLKNYLANKSFSRGDSTITAEASMVFVGNTTRTVPAMLASADLFEALPEAYHDTAYMDRVHYYLPGWEVDIVRPELFSRGYGLIVDYLAEALRHLRTLDYSGDLDTLATLDPAMSKRDQDAVRKTFSGLAKLIFPARDGEPEELEELLRFAIEGRKRVKDQIIRLDDTMAASGSHFTYMLGRVDQDHYNASSARSVPTQEELDYPQYFTSHGDADERGSGQWDAGELSDGLPKSDVVVDARGDNKPASPVFDRRALLKARAIPKRYKIEPSMGNSMPDILLPYLFDAAEIRIRDPYLRQTHQVRNVHEILLQLIQNADVAKLPHIVIETCASDEDIYRLRQEETFKQLQQSWEPFGIVIDWSIVDYFHDRCITTDTGWVIDLGRGLDVYDAYTPLSQFDPRYAIPHLRRTKEITINISRE

SEQ ID NO: 4037 - protein, 691 aa, Vibrio cholerae
MITDFSQDHKDEKNQMQSADLDALLNQYFKGRVVRKDLTKQLKEGANVPVYVLEYLLGMYCASDDDEVVMQGLDNVKKILAENYVRPDEAEKVKSLIRERGTFKIIDKVSVKLNQKKDVYEAALSNLGIKDALVPTKIVQDNEKLLTGGIWCIITVQYFFEEGQKTSPFSIMSLKPIQMPSMNMDEVFSTRRHFSTDQWMDVLLRSVGMEPTNLEHRVKWHLITRMIPFVENNYNVCELGPRGTGKSHVYKECSPNSLLVSGGQTTVANLFYNMSSRQVGLVGMWDVVAFDEVAGINFKDKDGVQIMKDYMASGSFARGRDSIEAKASMVFVGNINQTVETLVKTSHLLAPFPDAMIDTAFFDRFHSYIPGWEIPKMRPEYFTNSYGLITDYLAEYMREMRKRSFADAIDKFFKLGNNLNQRDVIAVRRTVSGLLKLLHPDAQYTKDDVRACLTYALETRRRVKEQLKKLGGMEFFDVHFSYIDNDSLEEFFVNVPEQGGSKLIPEGLPRAGVVHLVTQGSTGQLGLYRFETQMMAGSGKHSVSGLGSNTAAKEAVRVGFDYFKGNLNRISASAKFSDHEYHLHVVELHNTGPSTKSSLAALIAFCSILMNRPIQEQMVVLGEMTLGGVVNPVQDLAGSLQLAMDSGAKRILLPMASASDIPTVPAELFSKFQISFYADPVDAVFKALGVN

SEQ ID NO: 4038 - protein, 698 aa, Vibrio harveyi
MTENYNQQEPIDVPSQADETQHVRDVDLDELMTAQFKGRVVRKDLTKQLKEGANVPVYVLEYLLGMYCSTDDDELIEAGLGRVKQILTDNYVRPDEAEKVKSLIREKGTHKVIDKVTVKLNQKKDVYEASLSNLGIKDAVISANVVKENEKLLTGGIWCIITLSYFYEEGQKTSPFSVVGLKAIQMPSMNMQEVFDARRNFTMDQWLDMLLRSIGMEPANLEQRAKWHILARMIPFVENNYNVCELGPRGTGKSHVYKECSPNSLLVSGGQTTVANLFYNMSSRQVGLVGMWDIVAFDEVAGIRFKDKDGVQIMKDYMASGSFSRGRDSIEAKASMVFVGNIDQSVETLVKTSHLLAPFPPEMIDSAFFDRFHAYIPGWEIPKMRPEFFTNRFGLITDYLAEYMREMRKHAFADAIDKFFKLGNNLNQRDVIAVRRTTSGLLKLLVPHGEYSKEDVRICLTYALEVRRRVKEQLKKIGGMEFFDVNFSYIDNETLEEFFVNVPEQGGSQIIPPGMPNAGVVHFVSHGTAGKLGVFRIETQKTAGNGKLTTSGLGSDTEAKEQVKVGFEYFKGNLSRIAANNQYSEHEFHLHFVDLQMSGHSHSSSLAALIANCSALLGKPMQESMVVLGSMTLGGVLHPVQDLAGSMQVALEAGATKILIPMASATDIPTVPAETFTKFQVSFYSDPVDAVYKALGVS

SEQ ID NO: 4039 - protein, 694 aa, Escherichia coli
MQTHHDLPVSGVSAGEIASEGYDLDALLNQHFAGRVVRKDLTKQLKEGANVPVYVLEYLLGMYCASDDDDVVEQGLQNVKRILADNYVRPDEAEKVKSLIRERGSYKIIDKVSVKLNQKKDVYEAQLSNLGIKDALVPSQMVKDNEKLLTGGIWCMITVNYFFEEGQKTSPFSLMTLKPIQMPNMDMEEVFDARKHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFFKLGNNLNQRDVIAVRRTVSGLLKLMHPDGAYSKEDVRVCLTYAMEVRRRVKEQLKKLGGLEFFDVNFSYIDNETLEEFFVSVPEQGGSELIPAGMPKPGVVHLVTQAESGMTGLYRFETQMTAGNGKHSVSGLGSNTSAKEAIRVGFDYFKGNLNRVSAAAKFSDHEYHLHVVELHNTGPSTATSLAALIALCSILLAKPVQEQMVVLGSMTLGGVINPVQDLAASLQLAFDSGAKRVLLPMSSAMDIPTVPAELFTKFQVSFYSDPVDAVYKALGVN

SEQ ID NO: 4040 - protein, 708 aa, Coprobacillus sp.
MPDLDEKYNEFSRELSQSVSPETEPTKENICDERSYDERLKDIFQGKIVRKDLTKKIKEGANVPVYVLEFLLGQYCSSDDPEIIERGVETVKHILSDNFVRPDEAQKILSRLRSRGSHTVIDMITVHLDMRKNTYLAEFSNLGIKDIPIADGYPEKYDRLLCGGIWCIVQLSYEFIEEEKNAAPIRIDKLTPIQMPHIDLPELQQGRKAFTKEEWMELMLRSAGYEPESLTVREQWLLLTRMIPLVENNFNLCELGPRSTGKSHLYKEISPNSILVSGGQTTVANLFYNMGRKTVGLVGLWDCVAFDEVAGIRFKDKDGVQIMKDYMASGSFARGKEEKAASASMVFVGNINQSVDVLLKTSSLFDPFPPEMGTDTAFLDRIHCYLPGWEIPKFRPEHFTNSYGFISDYLAEFIRELRKVQYGDALDKYFRLGKNLNQRDTIAVRRMVDGYLKLMYPNGEFTKDELEEVLRLSLEMRRRVKEQLKKLGGMEFYDVNFSYIDNETFEEKYVSVPEQGGDTLIPEGLGTPGQVYTVSHGKSGMIGAFRLESQMLPGNGKFDKTGLGSDAKAKDAVNIAFNFLKANARRISGSISTTDKDYIINYQDLQGIGMTDKLALPTVISLCSIAIGRPTLSSLAVLGDISIGGTLIKVDELANTLQACVDCGAKKVLLPAVSMIDFATVPADLMSAFQLIPYQSAEDAVFKALGVE

SEQ ID NO: 4041 - protein, 677 aa, Enterococcus faecium; identical to SEQ ID NO: 4030

SEQ ID NO: 4042 - protein, 683 aa, Vibrio cholerae; identical to SEQ ID NO: 4029

SEQ ID NO: 4043 - protein, 694 aa, Escherichia coli
MQTHHDLPVSGVSAGEIASEGYDLDALLNQHFAGRVVRKDLTKQLKEGANVPVYVLEYLLGMYCASDDDDVVEQGLQNVKRILADNYVRPDEAEKVKSLIRERGSYKIIDKVSVKLNQKKDVYEAQLSNLGIKDALVPSQMVKDNEKLLTGGIWCMITVNYFFEEGQKTSPFSLMTLKPIQMPNMDMEEVFDARKHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPTAMIDTAFFDRFHAYIPGWEIPKMRPEFFTNRYGLITDYLAEYMREMRKRSFSDAIDKFFKLGNNLNQRDVIAVRRTVSGLLKLMHPDGAYSKEDVRVCLTYAMEVRRRVKEQLKKLGGLEFFDVNFSYIDNETLEEFFVSVPEQGGSELIPAGMPKPGVVHLVTQAESGMTGLYRFETQMTAGNGKHSVSGLGSNTSAKEAIRVGFDYFKGNLNRVSAAAKFSDHEYHLHVVELHNTGPSTATSLAALIALCSILLAKPVQEQMVVLGSMTLGGVINPVQDLAASLQLAFDSGAKRVLLPMSSAMDIPTVPAELFTKFQVSFYSDPVDAVYKALGVN

SEQ ID NO: 4044 - protein, 694 aa, Salmonella enterica
MQTHHDLPVPAVSEGELVAEGYDLDALLNQHFRGRVVRKDLTKQLKEGANVPVYVLEYLLGMYCASDDDQIVEQGLQNVKRILADNYVRPDEAEKVKSLIRERGSYKIIDKVSVKLNQKKDVYEAQLSNLGIKDALVLPQMVKDNEKLLTGGIWCMITVNYFFEEGQKTSPFSLMTLKPIQMPNMDMEEVFTARTHFSRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFYKLGNNLNQRDVIAVRRTVSGLLKLLHPNGSYSKEDVRVCLTYAMEARRRVKEQLKKLGGLEFFDVNFSYIDNETLEEFFVSVPEQGGSELIPAGMPKPGVVHLVTQAESGMTGLYRFETQMTAGNGKHSVSGLGSSTSAKEAIRVGFDYFKGNLSRVSATAKFSEHEYHLHVVELHNTGPSTATSLAALIALCSVLLAKPVQEQMVVLGSMTLGGVINPVQDLAASLQLAFDSGAKKVLLPMSSAVDIPTVPAELFTKFQVSFYSEPVDAVYKALGVN

SEQ ID NO: 4045 - protein, 691 aa, Pectobacterium wasabiae
MQQQDNSANNMEMASALAQDLDSLLNQHFRGRVVRKDLTKQLKEGANVPVYVLEYLLGMYCASDDDEVVEQGLQSVKRILSDNYVRPDEAEKVKSLIRERGSYKIIDKVTVKLNQKKDVYEAQLSNLGIKDALVPSQMVKDNEKLLTGGIWCMITVNYFYEEGQKTSPFSLFTLKPIQMPNMDMDEVFEARKQFDRDQWIDVLLRSVGMEPANIEQRTKWHLITRMIPFVENNYNVCELGPRGTGKSHVYKECSPNSLLVSGGQTTVANLFYNMASRQVGLVGMWDVVAFDEVAGITFKDKDGVQIMKDYMASGSFSRGRDSIEGKASMVFVGNINQSVDTLVKTSHLLAPFPDAMIDTAFFDRFHAYIPGWEIPKMRPEFFTNRYGLITDYLAEYMREMRKRSFSDAIDKFFKLGNNLNQRDVIAVRRTVSGLLKLMHPDGAYDKEDVRVCLTYALEVRRRVKEQLKKLGGLEFFDVNFSYIDNESLEEFFVSVPEQGGSELIPAGMSKPGVVHLVTQADLGMTGLYRFETQMTAGNGKHAVSGLGSNTSAKEAIRVGFDYFKGNLSRISAAAKFSEHEYHLHVVELHSTGPSITTSLAALIAFCSVLLAKPVQEQMVVLGNMTLGGVINPVQDLAVCLQVAFDSGAKRVLLPMASAMDIPTVPTELFTKFQVSFYADPVDAVYKALGVS

SEQ ID NO: 4046 - protein, 694 aa, Escherichia coli; identical to SEQ ID NO: 4039

SEQ ID NO: 4047 - protein, 689 aa, Ruminococcaceae bacterium
MSEFIETVSQEDANAVIDSKLRKVFDGRIVRKDLTKKIKEGANVPVYVLEFLLGQYCSSDDEDVIETGVANVKRILAENYVRPDEAQKILSVLRQRGSYTVIDKITVNLNIKTDSYEAEFSNLGIKAIPISEDYPTKYDRLLCGGIWCIVQLEYEYVEEDKRRSPILIHKLTPIQMPHVDIEELKQGRKAFTQEEWIKILLRSIGMEPDKLNDRERWLLLARMLPLVENNFNLCELGPRSTGKSHIYKEISPNSILVSGGQTTVANLFYNMGRKTVGLVGLWDCVAFDEVAGINFKDKDGIQIMKDYMASGSFARGKEEKAATASMVFVGNINQSVDVLLKTSSLFDPFPPEMGTDTAFLDRMHCYIPGWEIPKFRPEHFTNDYGFITDYLAEFIRELRKEQYGDALDKYFRLGKNLNQRDTIAVRKMVGGMIKLLYPDGEFTKEQLEEILKFALEMRRRVKEQLKKLGGMEFYDVNFSYIDNDTFEEHFVSVPEQGGGKLIPEGMCNPGQVYTVSQGKSGMIGVFRLESQMLPGNGKFERTGLNSDGKCKEAANTAFNYLKANGNRISGTISTTTKDYIINYQDLQGIGMTEKLALPTLIALCSIALGKPTLSSLAVLGEISIAGTMLKVDELANALQVCLDSGAKKVLLPITSAADLGTAPADLIGCFNLIFYQSAEDAVYKALGVE

SEQ ID NO: 4048 - protein, 679 aa, Holophaga foetida
MTSETDTSLDHLLNQSFGGRVVRKDLTKRLKEGANVPVYVLEYLLGSHCASDDEAVIEDGMQSVKKILAENYVRPDEAEKVKSKIRERGSMKVIDKVTVVLNEKRDVYEAFLSNLGTKGVEVPSGLVKKFEKLLAGGIWCIVTLDYLYEEGQKSSPFVLQDLKPIQMPNMDMEAFLEGRKAFTESQWIDVLIRSTGMEPTHFTERVKWHLLARMIPLVENNYNVCELGPRGTGKSHIYKEISPNSILISGGQTTVANLFYNMARRTVGLVGLWDTVAFDEVAGISFKEKDGVQIMKDYMASGSFARGKDAVAAYASMVFVGNINQSVDTLVKTSHLLAPFPEAMIDSAFFDRFHTYIPGWEIPKMRPEFFTNQYGLITDYLAEFMREMRKRNFADAIGKHFKLGRDLNQRDTIAVKHTVSGLLKLLYPAEDYSKEAVQKCLEYALEGRRRVKEQLKKIGGMEFFDVHFSYLDLEAGEEHYISVLEQGGGSLIPDGPLSPGCLHTVANGSSGHLGLYRIETQVTSGSGALKTSGLGSNGAAKEAVKVGFDYFKAHAGHISASAKAGDHDYHLHFVELHNTGPTESMTLASFVALCSGILAKPIQSQMVVLGSMSLGGNIIPVENLAETLQVAFDAGAKRILIPMSSVRDIPTIPGELFAKFQTAFYADPQDAVFKALGVQ

SEQ ID NO: 4049 - protein, 694 aa, Escherichia coli; identical to SEQ ID NO: 4039

SEQ ID NO: 4050 - protein, 686 aa, Oribacterium sp.
MSEFLETDDKRIVLKNKLRQYFDGKIVRKDLTKKIKEGANVPVYVLEFLLGQYCSSDDPGVIEEGVENVKRILADNFVRPDEVQKILSVLRQRGSHTVIDMITVNLDIKHDCYVSDFSNLGLKGIPIDEEYPTKYDRLLCGGIWCIVQLDYEFVEEEKKGTPIHIRKLTPIQMPHVDIDELKLGRKAFTKDEWIEVLLRSIGMEPDELQYREKWLLLTRMLPLIENNFNLCELGPRSTGKSHLFKEISPNSILVSGGQTTVANLFYNMSRKQVGLVGLWDCVAFDEVAGIRFKDKDGVQIMKDYMASGSFARGKEEKAASASMVFVGNINQSVDVLLKTSSLFDPFPPEMGTDTAFLDRMHCYIPGWEIPKFRPEHFTDHYGFITDYLSEFLRELRKEQYGDALDKYFRLGKNLNQRDTIAVRKMVDAYVKLLYPDGIFDKEQIEEILSIALEMRRRVKEQLKKLGGMEFYDVNFSYIDNETFEEHYGSVPEQGGGKLIPDGTCNPGQVYTISHGKSGMLGVFRLESQMLLGNGKFDRTGLGSDRECREASNTAFSFLKANGNRISASISTNTKDYIVNYQDLQGIGMTNKLALPTLIALSSIALNKQTISSLAVLGEISISGTIIKVDELANALQVCLDSGAKKVLLPITSAGDLGAVPAELVGCFNLIFYNSAEDAVYKALGVE

SEQ ID NO: 4051 - protein, 694 aa, Escherichia coli; identical to SEQ ID NO: 4039

SEQ ID NO: 4052 - protein, 679 aa, Acinetobacter johnsonii
MESANDKELDQLLNEHFAGRVVRKDLTKLIKEGANVPVYVLEYLLGMYCASDDPEIIEQGLRNVKTVLAENYVRPDEAEKVKSLVRERGSYKVIDRVTVKLNERKDKYEASFSNLGIKDAEISAGIVKEYEKLLVGGIWVIATLSYYFEEGQTSSPFGVSLLKPIQMPNMNMEELFNGRAALSTDQWRESLIRSIGMEPASLKEDVQWHLLARMVPFVENNYNVCELGPRGTGKSHIYKECSPNSILVSGGQTTVANLFYNMSSRRIGLVGLWDVVAFDEVAGISFKDKDGVQIMKDYMASGSFARGREQMEASASMVFVGNINQSVESLVKTSHLLAPFPEAMIDSAFFDRFHAYIPGWEIPKMRPEFFTNRYGLIVDYLAEFFREMRKRSFADSIEKYFKLGNNLNQRDVIAVRKTVSGLMKLLYPHGQFNKEDVRQCLEYALQVRRRVKEQLKKIGGMEFYDVHFSYIDNDTLEEHFVSVKEQGGVGLIPEGPAKPGFLYTIGLSNKGMPGLYRLELQVTKGSGKLATSGLWNSSSAKEQVKIAFDYFKANASRISGGSKVLEHDFHLHVVELQNTGPLSHLALPSLVAFASGLLGRSVQSQMVVLGDMSLGGSVTPVESIAECLQVAFDAGAKKVALPMSSAADIPTIPVELFTKFQTSFYADPVDAVFKGLGVD

SEQ ID NO: 4053 - protein, 679 aa, Acinetobacter junii
MESANDKELDQLLNEHFAGRVVRKDLTKLIKEGANVPVYVLEYLLGMYCASDDPEIIEQGLRNVKTVLAENYVRPDEAEKVKSLVRERGSYKVIDRVTVKLNERKDKYEASFSNLGIKDAEISAGIVKEYEKLLVGGIWVIATLSYYFEEGQTNSPFGVSLLKPIQMPNMNMDELFSGRAALSTDQWRESLIRSIGMEPASLKEDVQWHLLARMVPFVENNYNVCELGPRGTGKSHIYKECSPNSILVSGGQTTVANLFYNMSSRRIGLVGLWDVVAFDEVAGISFKDKDGVQIMKDYMASGSFARGREQMEASASMVFVGNINQSVESLVKTSHLLAPFPEAMIDSAFFDRFHAYIPGWEIPKMRPEFFTNRYGLIVDYLAEFFREMRKRSFADAIEKYFKLGNNLNQRDVIAVRKTVSGLMKLLYPHGQFNKEDVRLCLEYALQVRRRVKEQLKKIGGMEFYDVHFSYIDNDTLEEHFVSVKEQGGGGLIPDGPAKPGFLYTIGLSNKGMPGLYRLELQVTKGSGKLATSGLWNSSSAKEQVKIAFDYFKANASRISGGSKVMEHDFHLHVVELQNTGPLSHLALPSLVAFASGLLGRSVQNQMVVLGDMSLGGNVTPVESIAECLQVAFDAGAKKVALPMSSAADIPTIPVELFTKFQTSFYADPVDAVFKGLGVD

SEQ ID NO: 4054 - protein, 746 aa, Shewanella baltica
MNGNNGKDVAEHQMEQGEWVGADTTNSSFIQNVYVANMQVNLSTTADGAAEEHTAEHTRQSLASEQEIADLRSTDLDSLLNRFFKGKVVRKDLTKQLKEGANVPVYVLEYLLGMYCASDDDEVVLEGLENVKKILAENYVRPDEAEKIKSLIRERGSFKVIDKVGVKLNQKKDVYEAQLSNLGIKDAVIPASIVKQNEKLLMGGIWCIITLNYFYEEGQKTSPFSVSMLKPIQMPSMDMEELFVARANFSTDQWLDVLIRSIGMEPTNLKQRVKWHLLARMIPFVENNYNVCELGPRGTGKSHVYKECSPNSLLVSGGQTTVANLFYNMSSRQVGLVGMWDVVAFDEVAGITFKDKDGVQIMKDYMASGSFSRGRDSIEAKASMVFVGNINQSVETLVKTSHLLAPFPEAMIDTAFFDRFHAYIPGWDIPKMRPEFFTNSYGLITDYLAEYMREMRKRSFSDAIDRYFKLGNNLNQRDVIAVRRTVSGLLKLLHPHDVFDKEDVRRCLTYALELRRRIKEQLKKLGGMEFFDVHFSYLDNQTLEEFFVNVPEQGGSQLIPEGQGKPGVVHMVTKGATSQLGLYRFETQMMPGNGKHSTSGLGSNTPAKEAIRVGFDYFKGNLNRISATAKFSEHEYHLHVVELHNSGPSTKTSLAALVAFCSILMGKPVQDQMVVLGDMTLGGVVNPVEDLAGSLQLAMDSGGKRVLLPMASASDIPTVPAEIFSKFQISFYADPVDAVYKALGVN

SEQ ID NO: 4055 - protein, 683 aa, Vibrio cholerae; identical to SEQ ID NO: 4029

SEQ ID NO: 4056 - protein, 694 aa, Escherichia coli
MQTHHDLPVSGVSAGEIASEGYDLDALLNQHFAGRVVRKDLTKQLKEGANVPVYVLEYLLGMYCASDDDDVVEQGLQNVKRILADNYVRPDEAEKVKSLIRERGSYKIIDKVSVKLNQKKDVYEAQLSNLGIKDALVPSQMVKDNEKLLTGGIWCMITVNYFFEEGQKTSPFSLMTLKPIQMPNMDMEEVFDARRHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFFKLGNNLNQRDVIAVRRTVSGLLKLMHPDGAYSKEDVRVCLTYAMEVRRRVKEQLKKLGGLEFFDVNFSYIDNETLEEFFVSVPEQGGSELIPAGMPKPGVVHLVTQAESGMTGLYRFETQMTAGNGKHSVSGLGSNTSAKEAIRVGFDYFKGNLNRVSAAAKFSDHEYHLHVVELHNTGPSTATSLAALIALCSILLAKPVQEQMVVLGSMTLGGVINPVQDLAASLQLAFDSGAKRVLLPMSSAMDIPTVPAELFTKFQVSFYSDPVDAVYKALGVN

SEQ ID NO: 4057 - protein, 694 aa, Halomonas sp.
MDFEPSSATQMTDSLHDADLDTLLNSHFAGRVVRKDLTQRVKEGANVPVYVLEYLLGMYCASDDAEVIAKGLENVKAILTNNYVRPDEAEKVKSIVRERGSFKVIDRVTVRLNEKKDRYEAAFSNLGIKDAEISAGIVKENEKLLVGGIWVIATLSYFHEEGQTTSPFGVSLLKPIQMPHMNMDELFEGRRGFTNSQWREVLIRSIGMEPAELDESVQWHLLARMIPFVENNYNVCELGPRGTGKSHIYKECSPNSILVSGGQTTVANLFYNMSSRRIGLVGMWDLVAFDEVAGISFKDKDGVQIMKDYMASGSFARGREQMEASASMVFIGNINQSVESMVKTSHLLTPFPDAMIDAAFFDRFHAYIPGWEIPKMRPSFFTQRYGFIVDYLAEFFREMRKRSFADAIDRYFSLGDNLNQRDVIAVRKTVSGLLKLMFPHGGGSQGLAKEDVRECLEYAMQVRRRVKEQLKKIGGMEFYDVHFSYIDKETLEEHFVSVKEQGGGGLIPEGQGKPGVVHTIGLSDKGMPGVYRIEMQVTAGSGKLAMSGLWNSTAAKEQVKMAFDYFKANASRISGARKVMEHDFHLHVVDLQNSGVLRDLSLASLVAFSSGLVSKPTQSQMVVLGDMSLGGSLKPVQNLAECLQVAFDAGGKRVTLPMSSAMDIPTIPGELFTKFQTSFYAEPIDAVVKALGVD

SEQ ID NO: 4058 - protein, 735 aa, Bifidobacterium angulatum
MNEQGMSQNGWIESPEHNADGNSLSALDVKTTDLFPGVTVRKDLVNKVKGNALVPSYVLEFLLSAYATNTDQASIESGVDRVRTILANNYVHREEANLIQSKIREKGSHRIIDRVQVALNEKTDLYEATFSNLGISQVIVDPSLVKAYPKLLVTGIWCMCQIGYAYSGDPREVPWQLLQLKPVQMSRDDRENYMQQRSQFTDSEWIDLLMQSIGFNPDLFSDRAKLLHLVRMVPFVERNYNLVELGPKGTGKSHIYSEFSPHGMLISGGEVTVAKLFVNNSNGHLGLVGYWDTVAFDEFAGKAKKAGRDLVDIMKNYMANKSFSRGVETFQGEASMAFVGNTSHNVPYMLKNSDLFEELPKQYHDPAFLDRIHFYLPGWEFEQIRSEMFTSGFGFVVDYLAEILHNLRDADYSDRFEKYFELSSTLSTRDKDGIKKTFSGLMKLIYPGGNASPEQMEPLLRCAIEGRKRVKDQLCRIDSTMEEVEFTYKRASDGEVVAVQTLEELDYPQLYWRGRVAENSEDKGEAEAPVADDAVAIEGNEGEAGASENANALPVARQQETAAMTPVERLAAKADGKQWELVENQRGITYYKLFGPYLAGAKKIVVEDAYVRKPYQLRNLAEFLEMLLRCKKSDEDVAVHLVTGHNDPGFVEAQLNGLNELASTFSQLGVNLTYEFRDTLHDRSITSDTGWEILPGRGLDIFQKFVDGDWLNPLLRHQQLRRVKECKVTYRRIER

SEQ ID NO: 4059 - protein, 683 aa, Vibrio cholerae; identical to SEQ ID NO: 4029

SEQ ID NO: 4060 - protein, 683 aa, Alcanivorax pacificus
MSTLDQKINEHFPGLVVRKDLVKTVKGNAIVPSYVLEYLLGQYCATNDEATIQTGIETVKEILAKHYVHRNEAGLVRSNIKEKGRYKVIDKISVALNEKTDAYEAQFSNLGIKKVLVDSGTVKAHPKLLVSGVWCIADIEYVFSEDQNVSPWILSTLKPIQLSHFDYDAYVAARQQFSTDEWIDLLIQSIGFNPEMFGRRSKLTQLVRLIPFCERNYNLIELGPKGTGKSHVYSEFSPHGILVSGGEVTVPKLFVNNSSGKIGLVGYWDCVAFDEFAGKQKRVDKALVDIMKNYMANKSFSRGVETLGAGASMVFVGNTRHTVPYMLKHSDLFDELPDKFYDSAFLDRIHFYIPGWEVDIIRGEMFSDGYGFVVDYLAEILRSMRNYDYSDQYREYFTLSSDISTRDRDGINKTFSGLMKILFPQGGATRDEVEEVLRFAIEGRKRVKDQLQRIDTTYGEVRFSYQDQQGQEILVTTLEEEEYPGYYHQTVSTPDEGGLETEPAADVKGGEPKAPRASEPVLEEKHLTFQENQKGISFDGLFGAYLKGASKITVTDPYIRLFYQIRNFMEFLEAVVKNKAEEDEVAVHLITVRDEFKGDLQDESFEKIQASARTVGIDFTWEFDDSGTIHARHIVTDHGWKISLDRGLDIFQHYEMNEAFAFANRLQQFRSSKAFEVTFIKQS

SEQ ID NO: 4061 - protein, 683 aa, Vibrio cholerae; identical to SEQ ID NO: 4029

SEQ ID NO: 4062 - protein, 683 aa, Vibrio cholerae; identical to SEQ ID NO: 4029

SEQ ID NO: 4063 - protein, 687 aa, gamma proteobacterium
MTDLNAKINDIFPGLVVRKDLVKTVKGNAIVPSYVLEYLLGQYCATNDEDSIQSGIQTVKEILAKHYVHRNEAGLVRSTIREKGRYKVIDKVTVALNDKKDCYETEFSNLGIKKVLIDSGTVKKHPKLLVGGVWVIADIEYEHTEDKDAVPWILGTLKPIQMSHFDYEGYLEARKQFTLDEWIDVLVQSIGFNPEYFGERSKLTQLVRLIPFCERNYNLIELGPKGTGKSHIYSEFSPHGILISGGEVTVPKLFVNNSSGKIGLVGYWDTVAFDEFAGKEKKVDKALVDIMKNYMANKSFSRGVETLGADASMAFVGNTEHSLAYMLKHSDLFDALPAKFYDSAFLDRLHFYIPGWEVDIIRGEMFSSGYGFVVDYLAEVLRHLRNQDYSDQYKGIFELDPSLSTRDRDGINKTFSGLMKILFPQGGATHEEIEKILKLAMEGRKRVKDQLMRIDTTYASVKFNYSDEAGKQASVSTLEELQYPKYFHHEVEVDTGELPEPIPANNASPSTPSAPVAPQSAKPELKEQHIVVMENQRGVSYEQLFGPYLKGATHITITDPYIRLFYQARNLMELLESVVKAKSEEDEVVVSLITVEDEFKGEQQREWLSQIQSSMLTVGIKFAFSFDNSGRQHARHIVTDTGWKISLDRGLDIFQQYDMNDAFQLTNRLQSQRPCKAFEVTYIRVGE

SEQ ID NO: 4064 - protein, 694 aa, Escherichia coli
MQTHHDLPVSGVSTGEIASEGYDLDALLNQHFAGRVVRKDLTKQLKEGANVPVYVLEYLLGMYCASDDDDVVEQGLQNVKRILADNYVRPDEAEKVKSLIRERGSYKIIDKVSVKLNQKKDVYEAQLSNLGIKDALVPSQMVKDNEKLLTGGIWCMITVNYFFEEGQKTSPFSLMTLKPIQMPNMDMEEVFDARKHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFFKLGNNLNQRDVIAVRRTVSGLLKLMHPDGAYSKEDVRVCLTYAMEVRRRVKEQLKKLGGLEFFDVNFSYIDNETLEEFFVSVPEQGGSELIPAGMPKPGVVHLVTQAESGMTGLYRFETQMTAGNGKHSVSGLGSNTSAKEAIRVGFDYFKGNLNRVSAAAKFSDHEYHLHVVELHNTGPSTATSLAALIALCSILLAKPVQEQMVVLGSMTLGGVINPVQDLAASLQLAFDSGAKRVLLPMSSAMDIPTVPAELFTKFQVSFYSDPVDAVYKALGVN

SEQ ID NO: 4065 - protein, 677 aa, Enterococcus faecalis
MDQVILDKLVANFPGKIVRKDLTKKIKEGANVPVYVLEYLLGMYASSLDENLVIKGVENVKNILVRNYVRPDEAEKVKAKIRENGGYTVIDKVSVSLNERRDQYEAEFSNLGLSGVRIGDEYPKKYDRLLGGGIWCIVQMEYWYDETDQRNSPFIAKKVDPIQMPGLDIEEVRRGRAAFTEKEWIDVVLRSVGMEPTRFTERVKWLHLARLVPLIENNFNLCELGPRGTGKSHVYKEISPNSILVSGGQTTVANLFYNMAQRSMGLVGMWDTVAFDEVAGINVKDGDLVQIMKDYMASGSFARGKEEKNASASMVFVGNINQSVDVILKTSNLFEPFPEKMRSDSAFLDRMHCYLPGWEIPKYRPDFFTNDYGFITDYYSEVMRELRKTTYSDAIDNYFKLGSQLNQRDTIAVKKMFSGLIKLVYPHGEFGKEEVEKVLKFSIEMRRRVKEQLKKIGGMEFFDVNLSYIDLEENREEYVSVPEQGSGTLIPEGIGKPGHVHAVSGGASGRVGVFKFETQMISGNGKFKATGLGSDSAAKEKTYSAYKYLSANAASISASISIASHDFVFNTQDLNGVGNPESLTLPTMIALCSVALNKPVISSIAVFGDITIGGTLVRVTNLADMMQVARDAGAKKALVPMANAADLATVPPELMSTFNIVFYNSPEDAVFKALGVE

SEQ ID NO: 4066 - protein, 679 aa, Pseudomonas syringae
MDIELNKDLDHLLNEHFAGRVVRKDLTKLIKEGANVPVYVLEYLLGMYCASDDAEVIAQGLKNVKTVLAENYVRPDEAEKVKSLVRERGTYKVIDRVTVRLNERKDRYEASFSNLGIKDAEISAGIVKEYEKLLVGGIWVIATLSYYHEEGQSGSPFGVTLLKPIQMPNMNMQELFTGRSALTTLQWRETLIRSIGMEPSTLDESVQWHLLARMVPFVENNYNVCELGPRGTGKSHIYKECSPNSMLVSGGQTTVANLFYNMSSRRIGLVGLWDVVAFDEVAGINFKDNDGVQIMKDYMASGSFGRGREQMEASASMVFVGNINQSVESLVKTSHLLAPFPEQMIDSAFFDRFHAYIPGWEIPKMRPEFFTNKYGLIVDYLAEFFREMRKRSFADAIDKHFKLGNNLNQRDVIAVRKTVSGLLKLLYPHDVFSKEDVRQCLEYALQVRRRVKEQLKKIGGMEFYDVHFSYIDNESLEEHFVTVKEQGGGGLIPEGPGKPGFIHTIGLSSKGMPGLYRIELQVTKGSGKLVTSGLWNSTQAKEQVKIAFDYFKANASRISASAKVLEHDFHLHVVELQNTGPLTHMALASLVAFASGLMGRPAQGQMVVLGDMSLGGSITPVESIAECLQVAFDAGGKRVCLPMSSAMDIPTIPAELFTKFQTSFYGEPVEAVFKALGVD

SEQ ID NO: 4067 - protein, 694 aa, Escherichia coli
MQTHHDLPVSGVSAGEIASEGYDLDALLNQHFAGRVVRKDLTKQLKEGANVPVYVLEYLLGMYCASDDDDVVEQGLQNVKRILADNYVRPDEAEKVKSLIRERGSYKIIDKVSVKLNQKKDVYEAQLSNLGIKDALVPSQMVKDNEKLLTGGIWCMITVNYFFEEGQKTSPFSLMTLKPIQMPNMDMEEVFDARRHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFFKLGNNLNQRDVIAVRRTVSGLLKLMHPDGAYSKEDVRVCLTYAMEVRRRVKEQLKKLGGLEFFDVNFSYIDNETLEEFFVSVPEQGGSELIPAGMPKPGVVHLVTQAESGMTGLYRFETQMTAGNGKHSVSGLGSNTSAKEAIRVGFDYFKGNLNRVSAATKFSDHEYHLHVVELHNTGPSTATSLAALIALCSILLAKPVQEQMVVLGSMTLGGVINPVQDLAASLQLAFDSGAKRVLLPMSSAMDIPTVPAELFTKFQVSFYSDPVDAVYKALGVN

SEQ ID NO: 4068 - protein, 691 aa, Pseudanabaena biceps
MNALDQKINTHFAGLVVRKDLVKTVKGNAIVPSYVLEYLLGQYCATSDEATIATGIETVKEILGKHYVHRNEAGLVRSNIKEKGRYKVIDKISVSLNDRADIYEAEFANLGINKVLVDSGTIKTHPKLLVSGVWSIADIEYQFVEDKNISPWVLASLKPIQLSHFNFDSYIAARRQFSTNEWIDLLIQSIGFNPAMFSDRHKLSQLIRLIPFCERNYNLIELGPKGTGKSHIYSEFSPHGILLSGGEVTVPKLFVNNSSGKIGLVGYWDVVAFDEFASKQKRIDKSLVDILKNYMANKTFSRGIETLGAEASMVFVGNTKNTVPHMLKHSDLFEELPPKFYDSAFLDRLHFYIAGWEADIIRGEMFSNGYGFVVDYLAEILRSMRNYDYSQHYKESFALSSDISTRDRDAIDKTFSGLMKLIFPHREATNTEIEELLKFAIEGRKRVKDQLMRIDATYSAVQFVYFDKLDKTEQPNQVKCLEEEEYPDYYYQTAISQTNRESTNNESGESSITSLLESPELLNSSLKEQHLTFIENQQGVSFDALFGAYLAEAKQITITDPYIRIFYQVRNLMDFLETVVRYKPDDCSINIHLVTTEDDFKGTQQQEYFEAIKQSCLNVGIEFTWEFDESRTIHARHIQTDHGWKILLDRGLDIFQQYDMGNTFSFASRLQQYRYCKAFEITYIRAIAPTL

SEQ ID NO: 4069 - protein, 683 aa, Vibrio cholerae; identical to SEQ ID NO: 4029

SEQ ID NO: 4070 - protein, 683 aa, Vibrio cholerae; identical to SEQ ID NO: 4029

SEQ ID NO: 4071 - protein, 694 aa, Escherichia coli; identical to SEQ ID NO: 4056

SEQ ID NO: 4072 - protein, 698 aa, Actinomyces sp.
MTRELTPVEAKASNAFAGYIVRKDLVHQVKGNAVVPSYVLEFLLAQYCATTNEEEIRSGVESVRKILAAHYVNRGESELIKSRIREQGGYRIIDKVSVSLDEANDRYVASFENLGVANALVSDQTVRDNDRLLTGGVWCMADMSYFPALEGAKTAPWNVSRLQAIQLPRFSFEEYADARGQFTTQEWIDLLVASVGLDPSKLSERAKMLQVLRLVPYVERNYNLVELGPKGTGKSHIYSEFSPHGILVSGGEVTLAKLFVNNATHRIGLVGFWDVVAFDEFAGRKRVEQNLVDTMKNYLANKSFSRGDSPTTAQASMVFVGNTMRTVPAMLATSDLFEALPDAYHDTAYMDRIHYYLPGWEVDVIRPELFTSGYGFIVDYLAEALRHLRTLDFSGDLSGHFELDSHMSTRDRDAVRKTFSGLVKLIHPDRDGTPAELESLLRLAMEGRKRVKDQIIRLDETMRESGSHFLYTVSASGGERAIRTQEEIDYPEYFTADDDRPAGEPPTTGGTHPQPPVGGAAQETAPRPADRLDTLRSRAIPKREEVEARIGVSLPKMLLPYLVDAQKITIVDPYLRKRHQIANIHDILIHMVQAVGLAAPPRVHLATGRAEPDRATEQMQLLNDLCQTWGHFGVEIDYEFVADIHDRVIKTDTGWVIDLGRGLDVYERFQALSRFDPRFDLMELRRTKGFTFNAQRTE

SEQ ID NO: 4073 - protein, 679 aa, Acinetobacter radioresistens
MESANDKELDQLLNEHFAGRVVRKDLTKLIKEGANVPVYVLEYLLGMYCASDDPEIIEQGLRNVKTVLAENYVRPDEAEKVKSLVRERGSYKVIDRVTVKLNERKDKYEASFSNLGIKDAEISAGIVKEYEKLLVGGIWVIATLSYYFEEGQTSSPFGVSLLKPIQMPNMNMDELFSGRAALSTDQWRESLIRSIGMEPASLKEDVQWHLLARMVPFVENNYNVCELGPRGTGKSHIYKECSPNSILVSGGQTTVANLFYNMSSRRIGLVGLWDVVAFDEVAGISFKDKDGVQIMKDYMASGSFARGREQMEASASMVFVGNINQSVESLVKTSHLLAPFPEAMIDSAFFDRFHAYIPGWEIPKMRPEFFTNRYGLIVDYLAEFFREMRKRSFADAIEKYFKLGNNLNQRDVIAVRKTVSGLMKLLYPHGQFNKEDVRQCLEYALQVRRRVKEQLKKIGGMEFYDVHFSYIDNDTLEEHFVSVKEQGGGGLIPEGPAKPGFLYTIGLSNKGMPGLYRLELQVTKGSGKLATSGLWNSSSAKEQVKIAFDYFKANASRISGGSKVLEHDFHLHVVELQNTGPLSHLALPSLVAFASGLLGRSVQSQMVVLGDMSLGGSVTPVESIAECLQVAFDAGAKKVALPMSSAADIPTIPVELFTKFQTSFYADPVDAVFKGLGVD

SEQ ID NO: 4074 - protein, 683 aa, Vibrio cholerae; identical to SEQ ID NO: 4029

SEQ ID NO: 4075 - protein, 735 aa, Bifidobacterium bifidum
MNEQDMSQNGWIESPEHNADGNSLSALDVKITDLFPGVTVRKDLVNRVKGNALVPSYVLEFLLSAYATNTDQASIESGVDRVRAILANNYVHREEANLIQSKIREKGSHRIIDRVQVALNDKTDLYEATFSNLGISQVIVDPSLVKAYPKLLVTGIWCMCQIGYAYSGDPREVPWQLLQLKPVQMSRDDRANYMQQRSQFTDGEWIDLLMQSIGFNSDLFSDRAKLLHLVRMVPFVERNYNLVELGPKGTGKSHIYSEFSPHGMLISGGEVTVAKLFVNNSNGHLGLVGYWDTVAFDEFAGKAKKAGRDLVDIMKNYMANKSFSRGVETFQGEASMAFVGNTSHNVPYMLKNSDLFEELPKQYHDPAFLDRIHFYLPGWEFEQIRSEMFTSGFGFVVDYLAEILHNLRDADYSDRFEKYFELSSTLSTRDKDGIKKTFSGLMKLIYPDGKATPEQMEPLLRCAIEGRKRVKDQLCRIDSTMEEVEFTYKRASDGEVVAVQTLEELDYPQLYWRGRVVENSEDESEAESFVAGDDVAIAGSEGEAGASENANALPVARQQETAAMTPVERLAAKADGKQWELVENQRGITYYKLFGPYLAGAKKIVVEDAYVRKPYQLRNLAEFLEMLLRCKNSDEDVAVHLVTGHNDPEFVEAQLNGLNELASTFSQLGVNLTYEFRDTLHDRSITSDTGWEILPGRGLDIFQKIVDGDWLNPLLRHQQLRRVKECKVTYRRIER

SEQ ID NO: 4076 - protein, 697 aa, Bacteroides ovatus
MDSQQKVLNAFIGKVVRKDLAFLVKGGLPVPTYVLEYLLGQYCASDDEEIINEGLEKVKDVIKNNYVHRAEAESVKGLIREHGKHRIIDKVTVVLNEKNDEYQATFANLGLSGVPIGTDYVRKNPKLLSGNGVWCIVTIGYISGEDVKVRWEIQTLKPIQISNIDLQEYIEQRKNFTTEEWIDLLMHTVGLNPDTMNRREKFITLARLLPHVENNFNFMELGPKGTGKSHVFQELSPYGVLVSGGDVTSARLFVRMSGKREELGLVGYWDVVAWDEFEQQKGRAVDAVLIDTMQNYLANKSFNRGKGTHEASASMVFVGNTKHTVPFMLKNTHLFESIPTSFIKGAFLDRIHLYNPGWEIKMLKKDSFSKGYGLITDYIAAVLHAMRNDDRTAVLKDYAKFDGSLSERDHLAIRKTFSGMMKLLYPDGKMTDQEAYELVDFAAESRKRVKDQLYVIDETFKAEPAHFKYINLRTGIEMNVETLEKVSNPFIIPINSTTGTATGELTDADAQPLNEEISGKCSVEEGTTAGQTAKRPRIHILQEKSMTFRMGQTGVSYEKLFASYMANANEITVEDPYIRAPWQIKNFMEFALMLINTRPVDDLKLNLITNEEDDKLPELIDRLDDIKDDLATYGIDFEYKFRDFHDRCIKTDTGWTISLGRGLDMFEKYNTFSIASSRQDMRKCKEFTVTFMKTKNA

SEQ ID NO: 4077 - protein, 683 aa, Vibrio cholerae; identical to SEQ ID NO: 4029

SEQ ID NO: 4078 - protein, 697 aa, Parabacteroides sp.
MDSQQKVLNAFIGKVVRKDLAFLVKGGLPVPTYVLEYLLGQYCASDDEEIINEGLEKVKDVIKNNYVHRAEAESVKGLIREHGKHRIIDKVTVVLNEKNDEYQATFTNLGLSGVPIGTDYVRKNPKLLSGNGVWCIVTIGYISGEDVKVRWEIQTLKPIQISNIDLQEYIEQRKNFTTEEWIDLLMHTVGLNPDTMNRREKFITLARLLPHVENNFNFMELGPKGTGKSHVFQELSPYGVLVSGGDVTSARLFVRMSGKREELGLVGYWDVVAWDEFEQQKGRAVDAVLIDTMQNYLANKSFNRGKGTHEASASMVFVGNTKHTVPFMLKNTHLFESIPTSFIKGAFLDRIHLYNPGWEIKMLKKDSFSKGYGLITDYIAAVLHAMRNDDRTAVLKDYAKFDGSLSERDHLAIRKTFSGMMKLLYPDGKMTDQEAYELVDFAAESRKRVKDQLYVIDETFKAEPAHFKYINLRTGIEMNVETLEKVSNPLIIPINSMTGTATGELTDADAQPLNEEISGKCSVEEGTTAGQTAKRPRIHILQEKSMTFRMGQTGVSYEKLFASYMANANEITVEDPYIRAPWQIKNFMEFALMLINTRPVDDLKLNLITNEEDDKLPELIDRLDDIKDDLATYGIDFEYKFRDFHDRCIKTDTGWTISLGRGLDMFEKYNTFSIASSRQDMRKCKEFTVTFMKTKNA

SEQ ID NO: 4079 - protein, 691 aa, Escherichia coli
MQQQDNSASNMETASVLAQDLDSLLNQHFRGRVVRKDLTKQLKEGANVPVYVLEYLLGMYCASDDDEVVEQGLQSVKRILSDNYVRPDEAEKVKSLIRERGSYKIIDKVTVKLNQKKDVYEAQLSNLGIKDALVPSQMVKDNEKLLTGGIWCMITVNYFYEEGQKTSPFSLFTLKPIQMPNMDMDEVFEARKQFDRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVDTLVKTSHLLAPFPDAMIDTAFFDRFHAYIPGWEIPKMRPEFFTNRYGLITDYLAEYMREMRKRSFSDAIDKFFKLGNNLNQRDVIAVRRTVSGLLKLMHPDGAYSKEDVRVCLTYAMEVRRRVKEQLKKLGGLEFFDVNFSYIDNETLEEFFVSVPEQGGSELIPAGMPKPGVVHLVTQAESGMTGLYRFETQMTAGNGKHSVSGLGSNTSAKEAIRVGFDYFKGNLNRVSAAAKFSDHEYHLHVVELHNTGPSTATSLAALIALCSILLAKPVQEQMVVLGSMTLGGVINPVQDLAASLQLAFDSGAKRVLLPMSSAMDIPTVPAELFTKFQVSFYSDPVDAVYKALGVN

SEQ ID NO: 4080 - protein, 683 aa, Vibrio cholerae; identical to SEQ ID NO: 4029

SEQ ID NO: 4081 - protein, 699 aa, Bacteroides ovatus
MIKFFDMTLQQKIMNAFLGKVVRKDLAFLVKGGLPVPTYVLEYLLGQYCACDDEATIEEGLEKVRQVIQNNYVHRAESEVVKGKIREQGCHRIIDKVTVTLNEKADEYQAHFANLGLTNVPIGTQYVTNNPKLLSGNGVWCIVTIGYISGEDIKVRWEIQTLKPVQISNVDVQDYIDKRKDFTTEEWLDFMMHTVGLNPDTLNRREKFITLARLLPHVENNFNFMELGPKGTGKSHVFQELSPYGVLVSGGDVTSPRLFVKMSGNKEILGLVGYWDVVAWDEFEQQKGRAVDAVLIDTMQNYLANKSFNRGKGTHEASASICFVGNTKHTVPYMLKNSHLFESIPTSFIKGAFLDRIHLYNPGWEIRMLKKDSFSKGYGLITDYIAAIMHELRNKDLTALLKDYAKFDGSLSERDHLAIRKTFSGMVKLIYPDGNMTDEEAFELIDFAAESRKRVKDQLYIVDETFNAEPAKFRYVREKDGVEINVETLEKVSNALIIPNNIHQESTIMANLDDSDIPLFQEGTETTMQVEPSSERQSRKRFIPLQEKNQFFRLGQTGVTYQSLFAEYLKDATEITIEDPFIRTSWQVKNLMEFLTMLIDTRDVDDLKVHLVTNEEEDKLPDLIDKLDDIKNDMIGYGIEFDYNFREFHDRCIKADNGWVISMGRGLDIYEKYSPYSVAATRPDKRKCKEFMVTFTKDK

SEQ ID NO: 4082 - protein, 691 aa, Yersinia ruckeri
MQQQDNSANNMEMASALAQDLDSLLNQHFRGRVVRKDLTKQLKEGANVPVYVLEYLLGMYCASDDDEVIEQGLQSVKRILSDNYVRPDEAEKIKSLIRERGSYKIIDKVTVKLNQKKDVYEAQLSNLGIKDALVPSQMVKDNEKLLMGGIWCMITVNYFYEEGQRTSPFSLMTLKPIQMPNMDMDEVFEARKQFSRDQWIDLLLRSVGMEPANIEQRTKWHLIARMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVDTLVKTSHLLAPFPDAMIDTAFFDRFHAYIPGWEIPKMRPEFFTNRYGLITDYLAEYMREMRKRSFSDAIDKFFKLGDNLNQRDVIAVRRTVSGLLKLMHPDGAYDKEDVRACLSYAMEVRRRVKEQLKKLGGLEFFDVNFSYIDNESLEEFFVSVLEQGGSELIPVGTPKPGVVHLVTQADSGMTGLYRFETQMMAGNGKHAVSGLGSNTAAKEAVRVGFDYFKGNLSRISAAAKFSEHEYHLHVVELHNTGPSTTTSLASLIAFCSMLLAKPVQEQMVVLGSMTLGGVIKPVQDLAACLQVAFDSGAKRVLLPMASAMDIPTVPTELFTKFQVSFYSDPVDAVYKALGVN

SEQ ID NO: 4083 - protein, 691 aa, Pantoea sp.
MQQRDNSATDMEMASAQSQDLDSMLNQHFRGRVVRKDLTKQLKEGANVPVYVLEYLLGMYCASDDNEVVEQGLQSVKRILSDNYVRPDEAEKVKSLIRERGSYKIIDKVTVKLNQKKDVYEAQLSNLGIKDALVPSQMVKDNEKLLTGGIWCMITVNYFYEEGQKTSPFSLFTLKPIQMPNMDMDEVFEARKQFDRDQWIDVLLRSVGMEPANIEQRTKWHLIARMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVDTLVKTSHLLAPFPDAMIDTAFFDRFHAYIPGWEIPKMRPEFFTNRYGLITDYLAEYMREMRKRSFSDAIDKFFKLGNNLNQRDVIAVRRTVSGLLKLMHPDGAYDKEDVRVCLAYALEVRRRVKEQLKKLGGLEFFDVNFSYIDNDSLEEFFVSVPEQGGSELIPAGMPKPGVVHLVTQADSGMTGLYRFETQMTAGNGKHAVSGLGSNTAAKESIRVGFDYFKGNLSRISAAAKFSEHEYHLHVVELHSTGPSTTTSLASLIAFCSVLLAKPVQEQMVVLGSMTLGGVTNPVQDLAACLQVAFDSGAKRVLLPMSSAMDIPTVPTELFTKFQVSFYADPVDAVYKALGVN

SEQ ID NO: 4084 - protein, 694 aa, Escherichia coli
MQTHHDLPVSGVSAGEIASEGYDLDALLNQHFAGRVVRKDLTKQLKEGANVPVYVLEYLLGMYCASDDDDVVEQGLQNVKRILADNYVRPDEAEKVKSLIRERGSYKIIDKVSVKLNQKKDVYEAQLSNLGIKDALVPSQMVKDNEKLLTGGIWCMITVNYFFEEGQKTSPFSLMTLKPIQMPNMDMEEVFDARKHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPELFTNRYGLITDYLAEYMREMRKRSFSDAIDKFFKLGNNLNQRDVIAVRRTVSGLLKLMHPDGAYSKEDVRVCLTYAMEVRRRVKEQLKKLGGLEFFDVNFSYIDNETLEEFFVSVPEQGGSELIPAGMPKPGVVHLVTQAESGMTGLYRFETQMTAGNGKHSVSGLGSNTSAKEAIRVGFDYFKGNLNRVSAAAKFSDHEYHLHVVELHNTGPSTATSLAALIALCSILLAKPVQEQMVVLGSMTLGGVINPVQDLAASLQLAFDSGAKRVLLPMSSAMDIPTVPAALFTKFQVSFYSDPVDAVYKALGVN

SEQ ID NO: 4085 - protein, 683 aa, Vibrio cholerae; identical to SEQ ID NO: 4029

SEQ ID NO: 4086 - protein, 694 aa, Escherichia coli; identical to SEQ ID NO: 4039

SEQ ID NO: 4087 - protein, 727 aa, Collinsella intestinalis
MDSNLDACGVPAYEKDDLDRKIIEHFPGKIVRKDLTSLMKRGAGIPTYVLEYLLGMYCATDDEAAIADGMARIRKILAENYVRPEESEKIKSRIRELGQYTVIDKVGARLDEYRDLYVAQFTNLNIEPFVMPDEYVRQHTKILTGGIWCIMRIQYLRPEDIAEDPLADIFGDDPAEQRGRARKGRTSGKGKRGPEDSPFKIASLTPIQMPSLDLSELVSHREDFTTDEWIALLLRSAGYEPSALTPRERLHFLTRMVPLVELNYNLCELGPRGTGKSHIYTEVSPYSYLLSGGQTTTAKLFANNAARAGQRIGLVGHWDCIAFDEVAGMNFRDQNAIQIMKGYMANGTFGRGTESFNAEASMVFEGNINDSVSNMLKTTHLFDPFPPEFNNDSAFFDRIHCYLPGWEVPKMRSDLICERYSLITDCLGEFLHAMRRRDFTHHIDRYFRLNSDFNRRDEIGVRKTFSGLAKLIFPDGKMSREDVRMLLEYAIEGRRRVKEQLKTMAGIEFIDVKLGYTDMENPVEMHLVSVLEQTDDSLIPDTTPQAGHVFGVGRSVADEMAVYKLENKAVNGNAAFRMEGAGSNREVRDALNAAFEQFKNCAPRLAAGMHVTSKDYLLFCNDLQAKGPSAEISLAEFIGLCSAASGRPVIAGLVIPGILRLSGSLEPVGNLADVLRVAKNAGAKRILLPMSSIADLQNVAPELIGAVSPEFYETGDAVAAARRALGL

SEQ ID NO: 4088 - protein, 694 aa, Salmonella enterica
MQTHHDLPVPAVSEGELVAEGYDLDALLNQHFRGRVVRKDLTKQLKEGANVPVYVLEYLLGMYCASDDDQIVEQGLQNVKRILADNYVRPDEAEKVKSLIRERGSYKIIDKVSVKLNQKKDVYEAQLSNLGIKDALVPPQMVKDNEKLLTGGIWCMITVNYFFEEGQKTSPFSLMTLKPIQMPNMDMEEVFTARTHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFYKLGNNLNQRDVIAVRRTVSGLLKLLHPNGSYSKEDVRVCLTYAMEARRRVKEQLKKLGGLEFFDVNFSYIDNETLEEFFVSVPEQGGSELIPAGMPKPGVVHLVTQAESGMTGLYRFETQMTAGNGKHSVSGLGSSTSAKEAIRVGFDYFKGNLSRVSATAKFSEHEYHLHVVELHNTGPSTATSLAALIALCSVLLAKPVQEQMVVLGSMTLGGVINPVQDLAASLQLAFDSGAKKVLLPMSSAVDIPTVPAELFTKFQVSFYSEPVDAVYKALGVN

SEQ ID NO: 4089 - protein, 694 aa, Escherichia coli; identical to SEQ ID NO: 4043

SEQ ID NO: 4090 - protein, 693 aa, Nitratireductor indicus
MSTLDDKINEHFAGFVVRKDLVKAVKGNAIVPTYVLEYLLGQYCATDDEASIATGIETVKDILRKHYVHRSEAGLVQSTIKERGRYKVIDQVSVALNEKTDAYEAVFENLGIKRVAIDSATVKAHPKLLVTGIWCIADVQYEFSEDSRISPWIIDTLKPIQIARVDYDGYRETRDKFTTEEWIDLLMQSIGFDPSLFGRRSKLLQLLRLVPFVERNYNLIELGPKGTGKSHIYSEFSPHGQLISGGEITVPKLFVNNSNGRIGLVGFWDVVAFDEFAGREKTANKALVDIMKNYMANKQFSRGVNPMGAEASFAFVGNTDHNVPWMLKNTDLFEALPPQFHDSAFIDRLHAYLPGWEVDIIRGEMFTSGYGFIVDYLAEILRHLRAEDFSHRPDRYFTVPVQTHIRDRAAINKTMSGLLKLIFPNGGETEAEVEELLRFAIECRKRVKDQLLRIDSTFEEADFHYITSDGAKRAVSTLEEEEFPQFYHRRSARDGDGSKDQPEITPIPAQPSSTPAASDAPADIVTPAFVPKPGHVVFTENRKGISFDKIFGPWTDGATRIIITDPYIRKYHQARNVMELIEMLIRRKQPEDQVAVHLVTAPDDGNIQEQRECLDGIAEACTGTGVDFTWAFDGSGTLHARDITTDTGWKMVLDRGLDIFQPTPRKMNGFSLGERMQEHRMVRGFYVTYVENL

SEQ ID NO: 4091 - protein, 694 aa, Escherichia coli; identical to SEQ ID NO: 4084

SEQ ID NO: 4092 - protein, 679 aa, Acinetobacter baumannii
MESANDKELDQLLNEHFAGRVVRKDLTKLIKEGANVPVYVLEYLLGMYCASDDPEIIEQGLRNVKTVLAENYVRPDEAEKVKSLVRERGSYKVIDRVTVKLNERKDKYEASFSNLGIKDAEISAGIVKEYEKLLVGGIWVIATLSYYFEEGQTNSPFGVSLLKPIQMPNMNMDELFSGRAALSTDQWRESLIRSIGMEPASLKEDVQWHLLARMVPFVENNYNVCELGPRGTGKSHIYKECSPNSILVSGGQTTVANLFYNMSSRRIGLVGLWDVVAFDEVAGISFKDKDGVQIMKDFMASGSFARGREQMEASASMVFVGNINQSVESLVKTSHLLAPFPEAMIDSAFFDRFHAYIPGWEIPKMRPEFFTNRYGLIVDYLAEFFREMRKRSFADAIEKYFKLGNNLNQRDVIAVRKTVSGLMKLLYPHGQFNKEDVRLCLEYALQVRRRVKEQLKKIGGMEFYDVHFSYIDNDTLEEHFVSVKEQGGGGLIPDGPAKPGFLYTIGLSNKGMPGLYRLELQVTKGSGKLATSGLWNSSSAKEQVKIAFDYFKANASRISGGSKVMEHDFHLHVVELQNTGPLSHLALPSLVAFASGLLGRSVQNQMVVLGDMSLGGNVTPVESIAECLQVAFDAGAKKVALPMSSAADIPTIPVELFTKFQTSFYADPVDAVFKGLGVD

SEQ ID NO: 4093 - protein, 694 aa, Escherichia coli
MQTHHDLPVSGVSAGEIASEGYDLDALLNQHFAGRVVRKDLTKQLKEGANVPVYVLEYLLGMYCASDDDDVVEQGLQNVKRILADNYVRPDEAEKVKSLIRERGSYKIIDKVSVKLNQKKDVYEAQLSNLGIKDALVPSQMVKDNEKLLTGGIWCMITVNYFFEEGQKTSPFSLMTLKPIQMPNMDMEEVFDARKHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFFKLGNNLNQRDVIAVRRTVSGLLKLMHPDGAYSKEDVRVCLTYAMEVRRRVKEQLKKLGGLEFFDVNFSYIDNETLEEFFVSVPEQGGSELIPAGMPKPGVVHLVTQAESGMTGLYRFETQMTAGNGKHSVSGLGSNTSAKEAIRVGFDYFKGNLNRVSAAAKFSDHEYHLHVVELHNTGPSTATSLAALIALCSILLAKPVQEQMVVLGSMTLGGVINPVQDLAASLQLAFDSGAKRVLLPMSSAMDIPTVPAALFTKFQVSFYSDPVDAVYKALGVN

SEQ ID NO: 4094 - protein, 677 aa, Enterococcus faecium; identical to SEQ ID NO: 4030

SEQ ID NO: 4095 - protein, 682 aa, Alcanivorax sp.
MQNETDNVLDLDAKLVEHFPGKIVRKDLTKRLKEGANVPVYVLEYLLGMYCSSADEEQIAEGMDRVKQVLSQNYVRPDEAEKIKARIRESGNFKIIDKVTVRLNEKKDQYEAILSNLGINNANIDSRQVHDYEKLLVGGIWSIISIKYDYEDGQSSSPFTIKELKPIQMPNMDMNALMEARQQFTEDEWLDVLLRSTGMEPTHFDTRVKWHLLARLIPFVENNYNVCELGPRGTGKSHVYKECSPNSILVSGGQTTVANLFYNMSRRQVGLVGMWDVVAFDEVAGISFKDKDGVQIMKDYMASGSFARGRDSISASASMVFVGNINHSVETLVKTSHLLSPFPEAMIDSAFFDRFHAYVPGWEIPKMRPEFFTNQYGLIVDYLAEYMREMRKRTFSDAIDQYYKLGNNLNQRDSIAVRRTVSGLLKLLYPHGDYDKAAVERCLQYALEVRRRVKEQLKKIGGMEFFDVHFSYIDVETLEEQYVSVKEQGGGGLIPEGQAKPGTVYTVSTGATSGHLGLYRLETQATAGNGKLNTSGLGSSSGAKEGLKVAHDYFKANVNRVSTMTKAGDFDLHLHMIELHNTGPSKQMTLASFIAYCSATMKRPTQNQMIVLGDMSLGGNIIPAENMAEALQVGMDAGAKKVLLPMANAQDIPTVPAELFSKYQVSFYSDPVDAVFKALGVE

SEQ ID NO: 4096 - protein, 683 aa, Vibrio cholerae; identical to SEQ ID NO: 4029

SEQ ID NO: 4097 - protein, 683 aa, Vibrio cholerae; identical to SEQ ID NO: 4029

SEQ ID NO: 4098 - protein, 691 aa, Escherichia coli
MTTDFSQDHKDEKNQMQSADLDALLNQYFKGRVVRKDLTKQLKEGANVPVYVLEYLLGMYCASDDDEVVMQGLDNVKKILTENYVRPDEAEKVKSLIRERGMFKIIDKVSVKLNQKKDVYEAALSNLGIKDALVPTKIVQDNEKLLTGGIWCIITVQYFFEEGQKTSPFSIMSLKPIQMPSMNMDEVFSTRRHFSTDQWMDVLLRSVGMEPTNLEHRVKWHLITRMIPFVENNYNVCELGPRGTGKSHVYKECSPNSLLVSGGQTTVANLFYNMSSRQVGLVGMWDVVAFDEVAGINFKDKDGVQIMKDYMASGSFARGRDSIEAKASMVFVGNINQSVETLVKTSHLLAPFPDAMIDTAFFDRFHSYIPGWEIPKMRPEFFTNSYGLITDYLAEYMREMRKRSFADAIDKFFKLGNNLNQRDVIAVRRTVSGLLKLLHPDAQYTKDDVRACLTYALETRRRVKEQLKKLGGMEFFDVHFSYIDNESLEEFFVNVPEQGGSKLIPEGLPRAGVVHLVTQGSTGQLGLYRYETQMMAGSGKHSVSGLGSNTAAKEAVRVGFDYFKGNLNRISASAKFSDHEYHLHVVELHNTGPSTKSSLAALIAFCSILMNRPIQEQMVVLGEMTLGGVVNPVQDLAGSLQLAMDSGAKRILLPMASASDIPTVPAELFSKFQISFYADPVDAVFKALGVN

SEQ ID NO: 4099 - protein, 730 aa, Bifidobacterium bifidum
MSQNGWIESPEHNADGNSLTALDVKITDLFPGVTVRKDLVNKVKGNALVPSYVLEFLLSAYATNTDQASIESGVDRVRAILANNYVHREEANLIQSKIREKGSHRIIDRVQVALNEKTDLYEATFSNLGISQVIVDPSLVKAYPKLLVTGIWCMCQIGYAYSGDPREVPWQLLQLKPVQMSRDDRENYMQQRSQFTDGEWIDLLMQSIGFNSDLFSDRAKLLHLVRMVPFVERNYNLVELGPKGTGKSHIYSEFSPHGMLISGGEVTVAKLFVNNSNGHLGLVGYWDTVAFDEFAGKAKKAGRDLVDIMKNYMANKSFSRGVETFQGEASMAFVGNTSHNVPYMLKNSDLFEELPKQYHDPAFLDRIHFYLPGWEFEQIRSEMFTSGFGFVVDYLAEILHNLRDADYSDRFEKYFELSSTLSTRDKDGIKKTFSGLMKLIYPDGKATPEQMEPLLRCAIEGRKRVKDQLCRIDSTMEEVEFTYKRVSDGEIVAVQTLEELDYPQLYWRGRVVENSEDESEAESFVAGDDVAIAGSEGEAGASENANALPVARQQETAAMTPVERLAAKADGKQWELVENQRGITYYKLFGPYLAGAKKIVVEDAYVRKPYQLRNLAEFLEMLLRCKNSDEDVAVHLVTGHNDPEFVEAQLNGLNELASTFSQLGVNLTYEFRDTLHDRSITSDTGWEILPGRGLDIFQKIVDGDWLNPLLRHQQLRRVKECKVTYRRIER

SEQ ID NO: 4100 - protein, 691 aa, Escherichia coli; identical to SEQ ID NO: 4079

SEQ ID NO: 4101 - protein, 694 aa, Salmonella enterica; identical to SEQ ID NO: 4088

SEQ ID NO: 4102 - protein, 691 aa, Vibrio cholerae
MTTDFSQDHKDEKNQMQSADLDALLNQYFKGRVVRKDLTKQLKEGANVPVYVLEYLLGMYCASDDDEVVMQGLDNVKKILAENYVRPDEAEKVKSLIRERGTFKIIDKVSVKLNQKKDVYEAALSNLGIKDALVPTKIVQDNEKLLTGGIWCIITVQYFFEEGQKTSPFSIMSLKPIQMPSMNMDEVFSTRRHFSTDQWMDVLLRSVGMEPTNLEHRVKWHLITRMIPFVENNYNVCELGPRGTGKSHVYKECSPNSLLVSGGQTTVANLFYNMSSRQVGLVGMWDVVAFDEVAGINFKDKDGVQIMKDYMASGSFARGRDSIEAKASMVFVGNINQSVETLVKTSHLLAPFPDAMIDTAFFDRFHSYIPGWEIPKMRPEFFTNSYGLITDYLAEYMREMRKRSFADAIDKFFKLGNNLNQRDVIAVRRTVSGLLKLLHPDAQYTKDDVRACLTYALETRRRVKEQLKKLGGMEFFDVHFSYIDNESLEEFFVNVPEQGGSKLIPEGLPRAGVVHLVTQGSTGQLGLYRYETQMMAGSGKHSVSGLGSNTAAKEAVRVGFDYFKGNLNRISASAKFSDHEYHLHVVELHNTGPSTKSSLAALIAFCSILMNRPIQEQMVVLGEMTLGGVVNPVQDLAGSLQLAMDSGAKRILLPMASASDIPTVPAELFSKFQISFYADPVDAVFKALGVN

SEQ ID NO: 4103 - protein, 679 aa, gamma proteobacterium
MESGNEKELDQLLNEHFGGRVVRKDLTKLIKEGANVPVYVLEYLLGMYCATDDPEVIEQGLNNVKTVLTENYVRPDEAEKVKSLVKERGTYKVIDRVTVKLNERKDKYEASFSNLGIKDAEISSGIVKEYEKLLVGGIWVIATLSYYHEEGQSGSPFGVTLLKPIQMPNMNMDELFQGRAALTADQWRECLIRSVGMEPAALGVDVQWHILARMIPFVENNYNVCELGPRGTGKSHIYKECSPNSILVSGGQTTVANLFYNMSSRRIGLVGLWDLVAFDEVAGISFKDKDGVQIMKDYMASGSFARGREQMEASASMVFVGNINQSVESLVKTSHLLAPFPEAMIDSAFFDRFHAYIPGWEIPKMRPEFFTNRYGLIVDYLAEFYREMRKRSFADAIEKHFKLGNNLNQRDVIAVRKTVSGLLKLMFPHGKYEKDDVRQCLEYALQVRRRVKEQLKKIGGMEFYDVHFSYIDNETLEEHFVSVKEQGGGGLIPEGPGKPGFLHTIGLSNKGMPGLYRLELQVTKGSGKLATSGLWNSSAAKEQVKIAFDYFKANASRISGGAKVGEHDFHLHAVELQNTGPFTHLALSSLVAFASGLLGRPAQSQMVVLGDMSLGGSVTPVESLAECLQVAFDAGAKKVALPMSSAADIPTIPAELFTKFQTSFYADPVDAVFKALGVD

SEQ ID NO: 4104 - protein, 691 aa, Pseudomonas psychrotolerans
MDTLDQKLTSTFDGKVVRKDLLHRIKKGTNVPTFVLEFLLARFCASDDDAEIQAGLEAVLDTLNENYVRPNEANAAQSKVATKGKHRFIDKVHVNYVEKDRRHWAALENFDSRKVAISEKYYRDHDRLLQGGLWAEVALAFNEIEDDDYAFYIEDLRPIQMSRFDFVRYCEGREQFTRDEWLDVVLRSVGLEPSKLSPRVKLHFIARLAPLIEPNYNFIELGPRGTGKSYFFSEFSPYSTLISGGQATKATLFYNNQRHKIGLVGYWDTVAFDEVGGLKVKDQDTIQIMKDFMANGRFSRGVEVIADASMAFVGNLDLSVEQVVNSEVHDLFQPLPKEFDLAVQDRFACYLPGWEMPKNSSEFLTSHYGFITDYLAEAFHYQLKQTNRYEEVSKRIKLGRAVEGRDEKGIKKTVCAFLKILHPDGAPSDQEFAEYVAYAVEGRRRVKEQMNKRKTDDEYARINLSYIDASGNDVVVYCPESRSALATQEPIRKSIHAGSGDEPLTAVVPSDQPVVPAETVVQQPVLAATSNETVLQEQHYTIHYGDTGYSYESILLPYLQGAKIVEIEDPYIRANHQIHNFVRFCEAVIKSPTVRAIKLTTSYDQDTDLKDVAERLEELKQSLLEMDIALEIKINENLHDREIRLDNGWVIKIGRGLDFFQKPDSWFGIGANDLTLRRCLETKVDIFKAKA

SEQ ID NO: 4105 - protein, 683 aa, Acetivibrio cellulolyticus
MENINEQAVDLDKKLNTYFAGRVVRKDLTKLIKEGANVPVYVLEYLLGMYCATDDEKSIEEGVERVKKILAENFVRPDEAEKVKSKIKEMGHYSIIDKVSVALNEKKDQYEAEFSNLGLKRVPISASYVKEFDKLLVGGIWCIMKMDYYFDEEAKGQSPFNISSLKPIQMPNMDISEIFEGRKNFSKDEWIDVLIRSTGMEPTQLENRVKWHLLLRLVPLVENNYNTCELGPRGTGKSHVYKEISPNSILISGGQSTVANLFYNMSTRKVGLVGMWDTVAFDEVAGINFKDKDGIQIMKDFMASGSFARGKEEKNASASMVFVGNINQSLDTLIKTSHLFAPFPDEMANDSAFFDRMHYYIPGWEIPKMRPEFFTDRYGFIVDYMAEFFREMRKRSFADSLDKFFKLGNNLNQRDVIAVRKTVSGLVKLLYPNGEYSSEDIEEILKYALEGRRRVKEQLKKIGGMEFYDVHFSYINKETLAEEYVSVPEQGGGKLIPEGMGKPGHVYTVGHGDSGMIGVYKLENQVVSGSGKFDKSGVGSHRGAKEALDTAFRYFTANSKSISASISTKTKDFLMHISDLQGIGLTEELAIAELIGLCSGALERAIQESTVVLGNMTVGGTISKVEEFANTLQVCVDAGAKKVLIPAASVVDFQTVPADLLIKVQPIFYSDPIDAVFKALGAM

SEQ ID NO: 4106 - protein, 677 aa, Enterococcus faecium; identical to SEQ ID NO: 4030

SEQ ID NO: 4107 - protein, 683 aa, Vibrio cholerae; identical to SEQ ID NO: 4029

SEQ ID NO: 4108 - protein, 694 aa, Salmonella enterica; identical to SEQ ID NO: 4088

SEQ ID NO: 4109 - protein, 683 aa, Vibrio cholerae; identical to SEQ ID NO: 4029

SEQ ID NO: 4110 - protein, 671 aa, Fusobacterium nucleatum
MDINEIGSKVFEGKIVRKDLVSKIKGGANVPVYVLEYLLGMYCNQTDEESIEEGMSKVKKILAENYVRPDEAEKVKSKIKEIGVYNVIDKVTVILNEKKDRYEGHLSNLGVSNIEIHKSYIKDYEKLLSGGIWCILTLSYQYDEYNATDSPFKLNKLKPIQIASLDMNEVYEARKHFTKDEWIGFILRSSGMEFENFDKDAIWHLLARMMPLVENNYNLCELGPRGTGKSYIYKEISPNSILLSGGQTTVANLFYNMSKRQVGLVGYWDVVAFDEIAGIKFKDKDGIQIMKDFMASGSFARGKEEKNANASMVFIGNINQSVDVLVKTAHLLVDFPPEMNNDSAFFDRMHCYIPGWDIPKLSPKSFTKEYGLIVDYMAEIFRELRKTSYGDALDRYFSLGRDLNQRDTIAVRKTVSALIKLVYPDGIFIKEEVEEILIRALEYRRRIKEQLKKMAGMEFFATNFSYIDKESGEEKYVGLKEQGGSKLIPEGPLKAGALYTIAMSTNSVKGLYKIESQISAGKGKITVSDNKYRKTFENAFNYLKINSKRISGAINISEKEFYLSVADEKNVGNTETITLGGFIAMCSISLNRQLMPQTVILGEMALSGSINAVSDLASTLQIAREAGAKKALIPILNAVDMSTLPPDILMDIQPIFYQDPIDATQKALGLM

SEQ ID NO: 4111 - protein, 671 aa, Fusobacterium sp.
MDINEIGSKVFEGKIVRKDLVSKIKGGANVPVYVLEYLLGMYCNQTDEESIEEGMSKVKKILAENYVRPDEAEKVKSKIKEIGVYNVIDKVTVILNEKKDRYEGHLSNLGVSNIEIHKSYIKDYEKLLSGGIWCILTLSYQYDEYNATDSPFKLNKLKPIQIASLDMNEVYEARKHFTKDEWIGFILRSSGMEFENFDKDAIWHLLARMMPLVENNYNLCELGPRGTGKSYIYKEISPNSILLSGGQTTVANLFYNMSKRQVGLVGYWDVVAFDEIAGIKFKDKDGIQIMKDFMASGSFARGKEEKNANASMVFIGNINQSVDVLVKTAHLLVDFPPEMNNDSAFFDRMHCYIPGWDIPKLSPKSFTKEYGLIVDYMAEIFRELRKTSYGDALDRYFSLGRDLNQRDTIAVRKTVSALIKLVYPDGIFTKEEVEEILIRALEYRRRIKEQLKKMAGMEFFATNFSYIDKESGEEKYVGLKEQGGSKLIPEGPLKAGALYTIAMSTNSVKGLYKIESQISAGKGKVTVSDNKYRKTFENAFNYLKINSKRISGAINISEKEFYLSVADEKNVGNTEAATLGGFIAMCSISLNRQLMSQTVILGEMALSGSINAVSDLASTLQIAREAGAKKALIPILNAVDMSILPPDILMDIQPIFYQDPIDATQKALGLM

SEQ ID NO: 4112 - protein, 684 aa, Lactobacillus casei
MTSDSAHEETSENEATLIKLEQNFPGRFVRKDLTQRIKEGANVPTYVLEFLLGQFANSSDTETIERGVENVKKTLAHNYVRPDEAEKVKSKIREDGAYTVIDKLSVRLNEGEDRYEASFSNLGLTGVPVDEHYVQDYERLLIGGIWSIVRVSYDHESLDHFSIQKLNPIQVPFVDMQEVYAGRKAFTTEEWLDVLLRTTGMEPTQFTEREKWLLLSRLIPFVENNYNFVELGPRGTGKSHVYKELSPDSILISGGQTTVANLFYNMSRREVGLVGMWDVVAFDEVAGIHFKDKDGVQIMKDYMASGSFARGRNEIQASAGMVFVGNINQSVDVLLRTSNLFEPFPEMMGNDTAFLDRIHNYLPGWEIPKYRPEFFTKGFGFITDYFAEVMRELRKISYADAIDEYFSFGKQLNQRDVIAVRKTVSGLIKLLYPDGVFEKADVAKILEFAMEMRRRVKEQLKRIGGMEFYDVNFSYIDKTTFEETYVSVPETGSSSLIPDGQENPGHVYTVAYDESKRLSLIKLETQVVPGLGRLSKSGVGSSTKAKEAMDTAFKYLEANYKGIDQRINANARDFVVSATNLNNSVPSSHISLATFIALVSIALGKPTLDRLVILGDFTIGGTISRIDDLADTLQVALDGGAKRVLLPAAAASDISGVPTDLMSSFNLIFYNSVKDAAFKALGVS

SEQ ID NO: 4113 - protein, 694 aa, Escherichia coli; identical to SEQ ID NO: 4084

SEQ ID NO: 4114 - protein, 679 aa, Acinetobacter sp.
MESANDKELDQLLNEHFAGRVVRKDLTKLIKEGANVPVYVLEYLLGIYCASDDPEIIEQGLRNVKTVLAENYVRPDEAEKVKSLVRERGSYKVIDRVTVKLNERKDKYEASFSNLGIKDAEISAGIVKEYEKLLVGGIWVIATLSYYFDEGQSNSPFGVSLLKPIQMPNMNMDELFSGRAALSTDQWRESLIRSIGMEPASLKEDVQWQLLARMVPFVENNYNVCELGPRGTGKSHIYKECSPNSILVSGGQTTVANLFYNMSSRRIGLVGLWDVVAFDEVAGISFKDKDGVQIMKDYMASGSFARGREQMEASASMVFVGNINQSVESLVKTSHLLAPFPEAMIDSAFFDRFHAYIPGWEIPKMRPEFFTNRYGLIVDYLAEFFREMRKRSFADAIEKYFKLGNNLNQRDVIAVRKTVSGLMKLLYPHGQFNKEDVRQCLEYALQVRRRVKEQLKKIGGMEFYDVHFSYIDNDTLEEHFVSVKEQGGGGLIPEGPAKPGFLYTIGLSNKGMPGLYRLELQVTKGSGKLATSGLWNSSSAKEQVKVAFDYFKANASRISGGSKVMEHDFHLHVVELQNTGPLSHLALPSLVAFASGLLGRSVQSQMVVLGDISLGGSVTPVESIAECLQVAFDAGAKKVALPMSSAADIPTIPVELFTKFQTSFYADPVDAVFKALGVG

SEQ ID NO: 4115 - protein, 683 aa, Vibrio cholerae; identical to SEQ ID NO: 4029

SEQ ID NO: 4116 - protein, 687 aa, Holdemania filiformis
MESTTGGESSREIIKDKLRQNFDGKIVRKDLTKKIKEGANVPVYVLEFLLGQYCSSDDDEVIEQGVQNVKRILADNFVRPDEAQKILSMLRQRGSHTVIDKITVSLNIKKDCYEAEFSNLGLKNIPIGEEYPTKFDRLLCGGIWCIVQLDYEYVEEDKKNGTPIRIRKLTPIQMPHVDIDELKAGRKAFTKDEWMDVLLRSIGMEPDELQYREKWLLLARMLPLVENNFNLCELGPRSTGKSHLFKEISPNSILVSGGQTTVANLFYNIGRKTVGLVGMWDCVAFDEVAGINFKDKDGIQIMKDYMASGSFARGKEEKAASASMVFVGNINQSVDVLLKTSSLFDPFPPEMGTDTAFLDRMHCYIPGWEIPKFRPEHFTEDYGFITDYLAEFIRELRKEQYGDALDKYYRLGKNLNQRDTIAVRKMVGGFLKLIYPDGVFTKEELEEVLQLSLEMRRRVKEQLKKLGGMEFYDVNFSYIDNETFEEHYVSVPEQGGGKLIPEGMCNPGQVYTVSQGKSGMIGVFRLESQILPGSGKFERTGIGSDRDCKEATNTAFNFLKANGSRISGSISTTTKDYIINYQDLQGIGMTSKLALPTLIALCSIALGKPALGSLAVLGEISISGTLIKADELANSLQVCLDSGAKKVLIPATSMIDFAMVPPDLMSAFQLIPYQSAEDAVFKALGVE

SEQ ID NO: 4117 - protein, 677 aa, Enterococcus faecium
MEQQEILKLSEFFPGKIVRKDLTKKIKEGANVPVYVLEYLLGMYASSLDETLVEKGVENVKNILARNYVRPDEAEKVKAKIRELGGYTVIDKVTVHLNEKKDCYEAEFSNLGLKNVQISEEYPKKFDRLLGGGIWCIVSMEYWYDENDRWNSPFIAKKVDPIQMPGLDIEAYKMARKEFTTDEWIDLLLRSIGMEPTQFNKRVKWLHLARLIPLIENNFNLCELGPRGTGKSHVYKEISPNSILVSGGQTTVANLFYNMASRTMGLVGMWDCVAFDEVAGIKFKDNDGVQIMKDYMASGSFARGKEEKNASASMAFVGNINQSVDVILKTSNLFEPFPEVMGTDSAFLDRMHCYLPGWEIPKYRPDFFTNDYGFITDYFSEVMRELRKVSFGDSFDKYFKLGSQLNQRDTIAVRRIVSGMMKLLYPDGRFEKSDVEEILRFALEMRRRVKEQLKKIGGMEFYDVNFSYIDLEEEREEYVSVPEQGGGTLIPEGLGKPGHLYTVSYGKTGQLGTYKLETQMTSGNGKFERTGINSDAGAREAMDSAYRYLRANYGSVSQSISLTTKDFVVHVQDMNGIGMTKTLSLPTIIALCSVSLNKPVLPSLVILGDITIGGSMIKVDNLANCLQVAKDAGAKKVLVPMISAADIGTVPPELMGTFNLIFYQTPEDAVFKALGVE

SEQ ID NO: 4118 - protein, 671 aa, Fusobacterium sp.
MDINETGSKVFEGKIVRKDLVSKIKGGANVPVYVLEYLLGMYCNQTDEESIEEGMSKVKKILAENYVRPDEAEKVKSKIKEIGVYNVIDKVTVVLNEKKDRYEGHLSNLGVSNIEIHKSYIKDYEKLLSGGIWCILTLSYQYDEYNATDSPFKLNKLKPIQIASLDMNEVYEARKHFTKDEWIGFLLRSSGMEFENFDKDAIWHLLARMMPLVENNYNLCELGPRGTGKSYIYKEISPNSILLSGGQTTVANLFYNMSKRQVGLVGYWDVVAFDEIAGIKFKDKDGIQIMKDFMASGSFARGKEEKNANASMVFIGNINQSVDVLVKTAHLLVDFPPEMNNDSAFFDRMHCYIPGWDIPKLSPKSFTKEYGLIVDYMAEIFRELRKTSYGDALDRYFSLGRDLNQRDTIAVRKTVSALIKLVYPDGIFTKEEVEEILIRALEYRRRIKEQLKKMAGMEFFATNFSYIDKESGEEKYVGLKEQGGTKLIPEGPLKAGALYTIAMSTNSVKGLYKIESQISAGKGKITVSDNKYRKTFENAFNYLKINSKRISGAINISEKEFYLSVADEKNVGNTEAITLGGFIAMCSISLNRQLMPQTVILGEMALSGSINAVSDLASTLQIAREAGAKKALIPILNAVDMSILPPDILMDIQPIFYQDPIDATQKALGLM

SEQ ID NO: 4119 - protein, 676 aa, Clostridium butyricum
MDELSIKLNQSFAGKVVRKDLTQKLKQGANVPIYVLEYLLGMYCATDDNDSINAGVERVKNILADNFVRPDEAEKIKSKIREMSRYTVIDKLTVKLNEKKDIYVAEFSNLGLKNVEISSKYVKDFEKLLGGGIWCIAKLQYFYEDGVIDQNPFIIESVTPIQMPNMDMDELIEGRKQFNKEEWIDILIRSIGMEPTQLENKVKWHMLLRMVPLCENNYNMCELGPRGTGKSHLYKEISPNSILVSGGQTTVANLFYNMSQRKIGLVGMWDTVAFDEVAGITFKDKDGIQIMKDYMASGSFARGKEEKAASASMVFVGNINQSVDVLLKTSHLFEPFPEAMAYDSAFFDRMHYYLPGWEVPKMRPELITNSFGFITDYLAEYLRTMRKRTFGDTIDKFFKLGNNLNQRDVIAVRKTVSGLVKLLYPHGEYSKEDIEEILRYALVGRRRVKEQLKKIGGMEFYDVHFSYIDNETMEEEFISVPEQGSGTLIPEGVSKSGHVYTIGVGDSGMIGVYKLEVEVVGGTGKFEKTGLGYDREAKESIETAFRYFKANSKSISASISTTNKDYLMHIQDVNGVGMTSSLSLAAIIAMCSGALNKPVQSQLAVLGSVSIGGTINKVEDLANALQVCFDAGAKKILLPMVNAADIPLVPPELFAKFQIMFYSGAEDGVFKALGVS

SEQ ID NO: 4120 - protein, 679 aa, Acinetobacter baumannii
MESANDKELDQLLNEHFAGRVVRKDLTKLIKEGANVPVYVLEYLLGMYCASDDPEIIEQGLRNVKTVLAENYVRPDEAEKVKSLVRERGSYKVIDRVTVKLNERKDKYEASFSNLGIKDAEISAGIVKEYEKLLVGGIWVIATLSYYFDEGQSNSPFGVSLLKPIQMPNMNMDELFSGRAALSTDQWRESLIRSIGMEPASLREDVQWHLLARMVPFVENNYNVCELGPRGTGKSHIYKECSPNSILVSGGQTTVANLFYNMSSRRIGLVGLWDVVAFDEVAGISFKDKDGVQIMKDYMASGSFARGREQMEASASMVFVGNINQSVESLVKTSHLLVPFPEAMIDSAFFDRFHAYIPGWEIPKMRPEFFTNRYGLIVDYLAEFFREMRKRSFADSIEKYFKLGNNLNQRDVIAVRKTVSGLMKLLYPHGQFNKEDVRQCLEYALQVRRRVKEQLKKIGGMEFYDVHFSYIDNDTLEEHFVSVKEQGGGGLILEGPAKPGFLYTIGLSNKGMPGLYRLELQVTKGSGKLATSGLWNSSSAKEQVKIAFDYFKANANRISGGSKVLEHDFHLHVVELQNTGPLSHLALPSLVAFASGLLGRSVQSQMVVLGDMSLGGSVTPVESIAECLQVAFDAGAKKVALPMSSAADIPTIPVELFTKFQTSFYADPVDAVFKALGVD

SEQ ID NO: 4121 - protein, 675 aa, Cellvibrio sp.
MNDKDLDQLLNEHFGGRVVRKDLTKLIKEGANVPVYVLEYLLGMYCASDDPQVIEQGLNNVKTVLVENYVRPDESEKVKSLVRERGTYKVIDRVTVRLNEKKDKYEAFFSNLGINAEISAGIVKEYEKLLVGGIWVIATLSYYHDEGQSSSPFGVTLLKPIQMPNMNMGELFEGRAALTADQWRETLIRSIGMEPASLAKDVQWHLLARMVPFVENNYNVCELGPRGTGKSHIYKECSPNSILVSGGQTTVANLFYNMSSRRIGLVGLWDVVAFDEVAGISFKDKDGVQIMKDFMASGSFARGREQMEANASMVFVGNINQSVESLVKTSHLLAPFPEAMIDSAFFDRFHAYIPGWEIPKMRPEFFTDKYGLIVDYLAEFYREMRKRSFSDAIDKYFKLGNNLNQRDVIAVRKTVSGLIKLLYPHGKFEKEDVRECLEYALQVRRRVKEQLKKIGGMEFYDVHFSYIDNSTFEEYFVSVKEQGGGGLIPEGPGKPGVIHTIGLSSKGMPGLYRLELQVTKGSGKLATSGLWNSSAAKEQVRIAFDYFKANASRISGAAKVMDHDFHLHAVELQNTGPFNHLALSSLVAFASGLLGKPIQNQMVVMGDMSLGGSVTPVESIAECLQVAFDAGAKRVALPMASAMDLPTIPAELFTKFQTSFYADPVDAVFKGLGVD

SEQ ID NO: 4122 - protein, 706 aa, Faecalibacterium prausnitzii
MEMMDMAADDTREELRRKLRSNFDGRIVRKDLTKKIKEGANVPVYVLEFLLGQYCSSDDETIIEQGVQNVKRILADNFVRPDEAQKILSQLRKNGHHTIIDMVTVHLDIKKDCFFAEFSNLGLTNVPITDDYPEKYDRLLCGGIWCIVQLEYESEGDSNFGITDIDGQPISSKQKKQKDISPISIHKLTPIQMPHVDIEEVREGRKAFTQEEWMDVMLRSCGYEPEQLNNREKWLLLARMLPLVENNFNLCELGPRSTGKSHIYKEISPNSILVSGGQTTVANLFYNMGRKTVGLVGLWDCVAFDEVAGIKFKDKDGIQIMKDYMASGSFARGKEEKAASASMVFVGNINQSVDVLLKTSSLFDPFPPEMGTDTAFLDRLHCYIPGWEIPKFRPEHFTNDYGFITDYLAEFIRELRKEQYGDALDKYFRLGKNLNQRDTIAVRKIVGGYVKLLYPDGEFTKEQIEEILVFALEMRRRVKEQLKKLGGMEFYDVNFSYIDLDTFEEKFVSVPEQGGGKLIPDGICNPGQVYTVSQGKSGMIGVFRLESQMLPGNGKFERTGLGSDRDCKESTNTAFNFLKANGNRISGSISTTMRDYIINYQDLQGIGMTGKLALPTLIALCSIALGRPTVSTLAVLGEISISGTILKVDELANSLQVCLDSGAKKVLLPITSAADLGTVPPELVGSFNLIFYSSAEDAVFKALGVE

SEQ ID NO: 4123 - protein, 685 aa, Fulvimarina pelagi
MSLSISPSLATSTEVDDLVVRHFGGKVVRKDLTKLLKEGANVPVYVLEYLLGMYCASDDEATIRDGLESVKRILSENYVRPDEAEKIKSTIKERGSFKVIDKVTVKLNEKKDRYEALLSNLGVKDAFIGSADVRKYEKLLSGGIWCIVTMHYLYEEGGKNSPFSISDLKPIQMPNMDMQELLEGRSHFAEEQWLDVLLRSTGMEPSNFEERVKWHLLTRLIPFVENNYNCCELGPRGTGKSHVYKECSPNSILVSGGQTTVANLFYNMASRVVGLVGMWDVVAFDEVAGINFKDKDGIQIMKDFMASGSFVRGRDTVAGSASMVFVGNINQSVDTLVKTSHLLAPFPEAMIDSAFFDRFHAYIPGWEIPKMRPEFFTNRFGLITDYLAEYMREMRKRNFSDAIDRYFKLGNNLNQRDTIAVRRTVSGLLKLLYPSADYDKEAVRRCLQYALETRRRVKEQLKKIGGMEFYDVHFSYIDNETLDETFVSVPEQGGGKLIPDSQMNPGSLHTITVGTNGHRGLYRLETQTTAGGGKFTTSGLGSNQKAKEALGIAFDFLKANSGRVSASTKPSDHDFHIHTVEMHNTGAPSTITLAGYVALCSGILKKPVQAQMVVLGDMSLGGNVVPVQNFAESLQMAFDSGAKKILVPMASAADISTIPPELFTKFQTSFYSDPTDAVFKALGLD

SEQ ID NO: 4124 - protein, 694 aa, Escherichia coli; identical to SEQ ID NO: 4056

SEQ ID NO: 4125 - protein, 676 aa, delta proteobacterium
MDDALDRKVTDIFAGKVVRKDLVRKIKVGVNVPVFVLEYLLGKYCATDDPMAIDAGLRVVNNTLAENFARPEEANKAQALVKEKERHTFIDKVKVRYLAQDDKYWAELVNFGNKYLHVPDRFVREFDRLLMGGVWAQVEIRHQYDEDAKGRRSPFWIDRITPIQLASFNLDEYREARSRFSSEEWVDLLIRSIGLEPTEFDRRLKLLFLLRLVPLSEANYNLVELGPRSTGKSFAYQELSPYAILLTGPTTVANLFYNIASGKMGLVGLWDAVGFDEVADLQKMPKEVVTTLKTYCESGSFARGKESLSGQASIAMFGNTNQPVDVMVRSSHLFMPMPDVIRDDLAFLDRIHCYLPGWEVPKMRMEFFTDHYGLVVDYLAEAMRELRRHNYTEVVERYFSFGDHLNARDVKAVRKTVSGLVKLVYPEGNVAKDEMTELLGLALESRRRVKEQLKKIGAFEYHQTSFSYRDKETTEETYVGVPEEGGRNLISTDPLAPGCLYTASVNSEGKVGLYRIEVGVSSGTGKLKMAGGLQSQMKESVQRAFAYLQGQKVPMGIAGVFDTSDFHVEAIDLLGNKSICEAGVAFIVAICSAIKKAQALSGVIILGDLSIQGNIKPVQSLVEPLQMAMENGAKRALIPLENKRNFLEVSGEIMEKVDPIFYSDPQTAAKKALSLK

SEQ ID NO: 4126 - protein, 677 aa, Enterococcus faecium; identical to SEQ ID NO: 4030

SEQ ID NO: 4127 - protein, 676 aa, Thiothrix nivea
MSMNDLDGLLNQHFKGRVVRKDLTKRLKEGANVPVYVLEYLLGMYCASDDEEVVREGLENVKRILAENYVRPDEAEKVKSLIRERGSYKIIDKVGVRLNQRKDIYEAALSNLGINDALIRPTTVQDNEKLLTGGIWCIVTLQYFYEEGQKTSPFSVVSLKPIQMPSMDMDELLNARQPFSLEEWMDVLLRSVGMEPANLEQRVKWHLLARMIPFVENNYNVCELGPRGTGKSHVYKECSPNSLLISGGQTTVANLFYNMSSHRVGLVGMWDLVAFDEVAGIHFKDKDGVQIMKDYMASGSFARGRDSVEAKASMVFIGNINQSVEMLVKTSHLLAPFPDAMIDTAFFDRFHAYIPGWEIPKMRPEFFTNNYGLITDYLAEFMREMRKRSFADAIDRYFKLGNNLNQRDVIAVRRTVSGLLKLLFPRADYGKEDVRTCLVYALELRRRIKEQLKKLGGMEFFDVHFSYHDNETLEEHFVSVPEQGGGKLIPEGALRPGVVHLVTQGGSGQLGLYRFETQMVAGTGKYSVTGLGSSTAAKEAIRIGFDYFKGNLGRISANARFAEHEFQLHVVELHNTAPSTKTSLAALVAFCSILMNKPVQAQMVVLGNMTLGGVVNPVDDLAGSLQMALDSGATRVLLPMASAMDIPSVPPELFAKFQISFFADPVDAVYKALGVQ

SEQ ID NO: 4128 - protein, 694 aa, Escherichia coli; identical to SEQ ID NO: 4064

SEQ ID NO: 4129 - protein, 710 aa, Brevibacterium mcbrellneri
MTDTASHSGEERNTESATPQQSDLDYKTNLLFAGSVVRKDLVKAVKGNAIVPSYVLEYLLGQYAASDDEATIQAGIDAVRKILADHYVHRNESELVKSTIREKGRHRIIDKVTVTLNDKQDVYQASFANLGLNGVIVEPATVKANPKLLVSGVWCICDIEYFHSDDARVVPWILGSLKPIQMSSFDYEGYLASRKEFNTEEWIDLLLQSIGFNPEMFGRRAKLLQLVRLIPFVERNYNLVELGPKGTGKSHIYSEFSPHGMLISGGEVTVPKLFVNNANGRIGLVGYWDVVAFDEFAGKKKRTDKALVDIMKNYMANKSFSRGVETLGAEASMVFVGNTSHNVPYMLKHSDLFDELPEAYHDSAYLDRLHFYIPGWEVDTIRSEMFSSGYGFVVDYIAEVLRSMRNTDYSDRYKQHFTLGSDISTRDRDGIHKTFSGLMKLIYPGGEATQEEIEELLRFAIEGRKRVKDQILRIDNTLAAVNFGYSDKSGTWRGVTTLEEDEYPNYYQARSPEAEGEVEASAEERGSAQAEVAVAAPVAPEVAAPLFEGHREFQENQRGVSYETLLMPYLHGATDITIVDPYIRLPHQGRNLVDLLALLAAAKDPADEIAVTLVTKEDRGEYAQQHLLMLKDIQDSTATVGIKFTVTWDETIHDRSIRTDHGWKLVLGRGLDIFQKGSGSQFDLGSRRQEFRQVFAFGITYIHETETDAN

SEQ ID NO: 4130 - protein, 694 aa, Escherichia coli; identical to SEQ ID NO: 4056

SEQ ID NO: 4131 - protein, 683 aa, Vibrio cholerae; identical to SEQ ID NO: 4029

SEQ ID NO: 4132 - protein, 677 aa, Enterococcus faecium; identical to SEQ ID NO: 4030

SEQ ID NO: 4133 - protein, 677 aa, Enterococcus faecium; identical to SEQ ID NO: 4030

SEQ ID NO: 4134 - protein, 691 aa, Vibrio cholerae; identical to SEQ ID NO: 4102

SEQ ID NO: 4135 - protein, 685 aa, Sporosarcina newyorkensis
MDERAEETMTLDLDKKLNEVFAGRVVRKDLTKLIKEGANVPVYVLEYLLGMYCATDDEESIREGVERVKKILSDNFVRPDEAEKIKSRIRELGQYSIIDKVTVALNPKIDTYEAEFSNLGLKGVPIASNFVKEYDKLLVGGIWCMVKIDYFYDEEVRVMNPFSVSSLQPIQMPNMDINEIFEGRKQFTKDEWIDVLIRSTGMEPTQLEERVKWHLLLRLVPLVENNYNMCELGPRGTGKSHVYKEISPNSILVSGGQSTVANLFYNMSTRKIGLVGMWDCVAFDEVAGIRFKDKDGIQIMKDYMASGSFARGKEEKNASASMVFVGNINQSVDVLLKTSHLFAPFPEEMANDTAFFDRMHYYMPGWEIPKMRPDFFTDKYGFIVDYIAEFFREMRKRSFADSIDRYYKLGNNLNQRDTVAVRKTVSGMVKLIYPHGEYTKEDIEEILQYALEGRRRVKEQLKKIGGMEFYDVMFSYLDKETMEEEYVSVPEQGGGKLIPEGMGKPGHVYVVGQSDSGMIGVYKLENQVVSGTGKFDKSGLGSHRGAKESLDTAFRFFTANSKAISNTISTKTKDYLMHVSDLQGIGLSGELAIAELIGLCSGALDKPVQESTVVIGNMTVGGTIAKVEEFANVLQVCVDAGAKKVLIPASSVMDLQTVPPDLLVKVQPVFYADPIDAVFKALGVS

SEQ ID NO: 4136 - protein, 683 aa, Vibrio cholerae; identical to SEQ ID NO: 4029

SEQ ID NO: 4137 - protein, 683 aa, Vibrio cholerae; identical to SEQ ID NO: 4029

SEQ ID NO: 4138 - protein, 683 aa, Vibrio cholerae; identical to SEQ ID NO: 4029

SEQ ID NO: 4139 - protein, 683 aa, Vibrio cholerae; identical to SEQ ID NO: 4029

SEQ ID NO: 4140 - protein, 683 aa, Vibrio cholerae; identical to SEQ ID NO: 4029

SEQ ID NO: 4141 - protein, 677 aa, Enterococcus faecium; identical to SEQ ID NO: 4030

SEQ ID NO: 4142 - protein, 698 aa, Vibrio shilonii
MTENYNQQEPIDVPSQADETQHVRDVDLDELMTTQFKGRVVRKDLTKQLKEGANVPVYVLEYLLGMYCSTDDDELIEAGLGRVKQILTDNYVRPDEAEKVKSLIREKGTHKVIDKVTVKLNQKKDVYEASLSNLGIKDAVISANVVKENEKLLTGGIWCIITLSYFYEEGQKTSPFSVVGLKAIQMPSMNMQEVFDARRNFTMDQWLDMLLRSIGMEPANLEHRAKWHILARMIPFVENNYNVCELGPRGTGKSHVYKECSPNSLLVSGGQTTVANLFYNMSSRQVGLVGMWDIVAFDEVAGIRFKDKDGVQIMKDYMASGSFSRGRDSIEAKASMVFVGNIDQSVETLVKTSHLLAPFPPEMIDSAFFDRFHAYIPGWEIPKMRPEFFTNRFGLITDYLAEYMREMRKHAFADAIDKFFKLGNNLNQRDVIAVRRTTSGLLKLLVPHSEYSKEDVRICLTYALEVRRRVKEQLKKIGGMEFFDVNFSYIDNETLEEFFVNVPEQGGSKIIPPGRPNAGVVHFVSPGTAGKLGVFRIETQKTAGNGKLTTSGLGSDTEAKEQVKVGFEYFKGNLSRIAANNQYSEHEFHLHFVDLQVSGHSHSSSLAALIANCSALLGKPMQESMVVLGSMTLGGVLHPVQDLAGSMQVALEAGASKILIPMASATDIPTVPAETFTKFQVSFYSDPVDAVYKALGVS

SEQ ID NO: 4143 - protein, 728 aa, Brachybacterium paraconglomeratum
MTNLEDALGEIDVLAAAEATDAAPEKSALDDKINEHFAGAVVRKDLVKAVRGNAVVPSYVLEYLLGQYAASDDEATIQAGIDSVRQILATHYVNRNEHMLVKSEIRRKGRHRVIDKVTVTLNEKNDVHEAEFENLQVKGVIIDDVTVKQNPKLLVGGVWCICDIEYFHSDDQRVVPWILGSLKPIQVAGVDVDHYYEAREAFTTEEWIDLLMQSIGLNPEQFNERGKLIALTRLIPFVERNYNVVELGPKGTGKSHTFSEFSPNGILLSGGEVTVAKLFVNNASGRIGLVGYWDCVAFDEFAANRRTDQNLVNVMKNYLANKSFSRGTSIYGADASMAFIGNTTHTVPYMLKNSDLFDELPDAYRDPAWLDRIHHYIPGWEVAPIRSEMFSNGYGFVVDYLAEILRAKRSEDFSDKYTDYFTLDTSISTRDQDGIRKTFSGLMKLVHPTGEANENEIRALLEFAIEGRKRVKDSILRIDATMRDNPVHFRYADKTGVWHDVATLEESQYPQLYRRDWDARPDTDAGSGEDAPTAPHPTLAPAPPATSLAAAPDVPAEPTPTPLAEGHRDFNAGQKGVSYENLLLPYLRGASKITITDPYIRMPHQGRNLADLLSLLATAKDDADEIDVLLVTTEEPNAEFKQRQLLMLKSIKDASDAVGARLAVQLDDTIHDRRIETNHGWRIDLGKGLDIWQRPSDNPFDFGRNRQEFRMISSAFTVHYMRMGLPHD

SEQ ID NO: 4144 - protein, 694 aa, Salmonella enterica; identical to SEQ ID NO: 4088

SEQ ID NO: 4145 - protein, 694 aa, Pseudoalteromonas luteoviolacea
MENEQLDNSNISSIESSQIRSADLDDLMTTEFKGRVVRKDLTKQLKEGANVPVYVLEYLLGMYCSSAEDELIQEGLKNVKKILTENYVRPDEAEKAKSLIREKGTHKVIDKVTVKLNQKKDIYEASLSNIGIKDAVVPNKIVKENEKLLTGGIWCIITVSYFYEEGQKTSPFSVFSLKPIQMPSMNMDEVYQARRKFSVDQWIDLLLRSIGMEPANLEHRCKWHLIARMIPFVENNYNVCELGPRGTGKSHVYKECSPNSLLVSGGQTTVANLFYNMSSRQIGLVGMWDVVAFDEVAGIRFKDKDGIQIMKDYMASGSFSRGRDSIEAKASMVFVGNIDHSVETLVKTSHLLAPFPDEMIDSAYFDRFHAYIPGWEIPKMRPEFFTDRFGLITDYLAEYMREMRKTTFSDAIDKFFKLGNNLNQRDVIGVRRTTSGLLKLLYPNGEYTKEDVRTCLTYALEVRRRVKEQLKKIGGMEFFDVNFSYIDNETLEEFFVNVPEQGGSNLIPAGVTKPGVVHFVDHGASGKLGVYRIETQMTPGTGKHSTSGFGSDTSAKEQVRVGFEYFKGNLNRIAANSRFSEHEFHIHFVDLQTSGNSHQASLGALVACCSVLLNKPVQEQMVVLGSITLGGVVNPVQDLASSMQIALEAGATKVLLPMASASDIPSVPAETFTKFQVSFYSDPVDAVYKALGVQ

SEQ ID NO: 4146 - protein, 676 aa, Clostridium perfringens
MDELSIKLNQSFAGKVVRKDLTQKLKQGANVPTYVLEYLLGMYCATDDEESINEGVERVKNILSDNFVRPDEAEKIKSKIREMTRYTVIDKLIVKLNEKRDIYVSEFSNLGLKDIEISSKYVKDFDKLLGGGIWCIVKLEYYYDENEKLSTPFIIESVTPIQMPNMDIDELIKGRRDFSKEEWIDILIRSIGMEPTQLEEHVKWHMLLRMVPLCENNYNMCELGPRGTGKSHLYKEISPNSILISGGQTTVANLFYNMARRKIGLVGMWDTVAFDEVAGITFKDKDGIQIMKDYMASGSFARGKEEKAASASMVFVGNINQSVDVLLKTSHLFEPFPEVMAYDSAFFDRIHFYLPGWEIPKMRPELLTNSFGFITDYLAEYLREMRKRTFGDSIDKYFRLGNNLNQRDVIAVRKTVSGLIKIIYPHGEFEKEDLEEILRYALVGRRRVKEQLKKIGGMEFYDVHFSYIDNETMREEFISVPEQGSGSLIPEGLGRAGHVYTIGLGDSGMIGIYKIETEVISGSGKFEKTGLGYSREAKESIETAFRYFKANSRNMSSSISTTTKDYLMHIQDVNGVGMTSSLSLAAIIAMCSGALNRPVQSQLVILGSVSIGGTINKVEDLANTLQVCFDAGAKKILLPMVNAGDIALVPPELFVKFQIMFYSTAEDAVFKALGVQ

SEQ ID NO: 4147 - protein, 677 aa, Enterococcus faecium; identical to SEQ ID NO: 4030

SEQ ID NO: 4148 - protein, 691 aa, Vibrio cholerae; identical to SEQ ID NO: 4102

SEQ ID NO: 4149 - protein, 694 aa, Escherichia coli; identical to SEQ ID NO: 4056

SEQ ID NO: 4150 - protein, 683 aa, Vibrio cholerae; identical to SEQ ID NO: 4029

SEQ ID NO: 4151 - protein, 683 aa, Vibrio cholerae; identical to SEQ ID NO: 4029

SEQ ID NO: 4152 - protein, 672 aa, Fusobacterium ulcerans
MDIINEIGNEAFEGKIVKKDLVSKIKGGANVPIYVLEYLLGMYCNQIDKENIEIGMEKVKKILAENYVRPDEAEKVKSKIKEIGSYTVIDKVNVKLNEKKDRYEGELSNLGVGNIEIPGAYIKEFEKLLSGGIWCILTLSYEFDELSVGDSPFKLEKLRPIQIANLNMLDVYDGRKKFTKNQWINFLLRSTGMEPEIFDKDAIWHLLGRMAPLVENNYNLCELGPRGTGKSYIYKEISPNSILLSGGQTTVANLFYNMSKKQIGLVGYWDVVAFDEIAGIKFKDKDGIQIMKDFMASGSFARGKEEKNANASMVFIGNINQSIDVLVKTAHLLVDFPPEMNNDSAFFDRMHSYIPGWEIPKLSPHCFTKEYGLIVDYMAEVFRELRKISYGDAIDKYFVLGRDLNQRDTIAVRKTVSAFIKLIYPDGEFGKEEVEEILVRALEYRRRVKEQLKKMAGMEFFATNFSYIDKEIGEEKYVNLKEQGGGKLIPEGQLKVGSLYTIASCNSSIKGLYKIECQVSSGKGRVTVSDNKYRKTFENAFSYLKINSRRISGAINISEKEFYLSVSDEKNVGLSDNLTLGGFISMCSNSLNRQVLGQTVILGEMALSGSVLVVSELANTLQIAREAGAKKALIPILNAKDMGSLPPDILGDVQLIFYQDPIDAVQKALGFL

SEQ ID NO: 4153 - protein, 702 aa, Roseobacter sp.
MSDLDARINEHFAGFVVRKDLVKAVKGNAIVPTYVLEYLLGQYCATDDEASIATGIETVKEILRKHYVHRSEAGLIQSTIKEKGGYKVIDQISVSLNEKTDSYEATFDNLGIKKVAVDSGTIKAHPKLLVTGVWCIADVQYEFSEDARISPWILETIKPIQIAKVDYEGYREARGSFNTDDWIDLLMQSIGFNPEAFGRRAKLLQLMRLIPFVERNYNIIELGPKGTGKSHIYSEFSPHGQLISGGEVTIPKLFVNNSNGRIGLVGYWDVVAFDEFAGREKTANKALVDIMKNYMANKTFSRGVNPMGAEASFAFVGNTDHNVPFMLKNSDLFEALPPQFHDSAFIDRLHAYLPGWEIDVIRGEMFTKGYGFIVDYLAEILRHLRQEDFSHRPDQHFKISEKISTRDRDAIYKTMSGLLKLIFPNGGETAEDVEELLRLAMESRKRVKDQLARIDSTYPEVDFHYLGTDGTKRRVTTVEEEEYPQFYHLKPALDPKEQEQSETSAGAGEPTSAGNEGASTSGSASEAARPVKAEAKPILEEGHHVFTEDRKGISYDLLFGPYIEGASKIIVTDPYVRYFYQIRNMMEFVEMVIRRKSPEDQVSVHLVTGPDDGNVGKQRELLDSIVDACVGSGVEFTWAFDGTGTAHARDIVTDTGWKIVLDRGLDIFQAPIKKDGFSLSDRLQEHRLIKGFYVTYLSDEKG

SEQ ID NO: 4154 - protein, 694 aa, Escherichia coli
MQTHHDLPVSGVSAGEIASEGYDLDALLNQHFAGRVVRKDLTKQLKEGANVPVYVLEYLLGMYCASDDDDVVEQGLQNVKRILADNYVRPDEAEKVKSLIRERGSYKIIDKVSVKLNQKKDVYEAQLSNLGIKDALVPSQMVKDNEKLLTGGIWCMITVNYFFEEGQKTSPFSLMTLKPIQMPNMDMEEVFDARRHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFFKLGNNLNQRDVIAVRRTVSGLLKLMHPDGAYSKEDVRVCLTYAMEVRRRVKEQLKKLGGLEFFDVNFSYIDNETLEEFFVSVPEQGGSELIPAGMPKPGVVHLVTQAESGMTGLYRFETQMTAGNGKHSVSGLGSNTSAKEAIRVGFDYFKGNLNRVSATAKFSDHEYHLHVVELHNTGPSTATSLAALIALCSILLAKPVQEQMVVLGSMTLGGVINPVQDLAASLQLAFDSGAKRVLLPMSSAMDIPTVPAELFTKFQVSFYSDPVDAVYKALGVN

SEQ ID NO: 4155 - protein, 684 aa, Paenibacillus elgii
METVSDEQSFDLDRKLNGVFSGRVVRKDLTKLMKEGANVPVYVLEYLLGMYAATDDEDNIREGIERVKKILVENFVRPDEAEKVKSRIRELGQYSVIDKITVTLNEKIDSYVAGFSNLGLKGVPISPNYVKEYDKLLAGGIWCMLKMDYFFDEEVKNSNPFSISSLKPIQMPNMDLNEVFEGRKSFTKEEWIDVLIRSTGMEPTQLEDRMKWHLLLRLVPLVENNYNMCELGPRGTGKSHVYKEISPNSILVSGGQSTVANLFYNMSTKKVGLVGLWDTVAFDEVAGITFKDKDGVQIMKDYMASGSFARGREEKAASASMVFVGNINQSLDSLIKTSHLFAPFPEAMANDSAFFDRMHYYLPGWEIPKMRPDFFTDKYGFIVDYMAEYFREMRKRSFADAIDPYFKLGNNLNQRDVIAVRKTVSGFIKLLYPNGEYTRENVEEILKYALEGRRRVKEQLKKIGGMEFYDVHFSYIDRETLSEEYVSVPEQGGGKLIPEGMGKPGHVYCVGHGDSGMIGVYKLENQVVSGTGKFEKSGVGIHRGAKESLDTAFRYFTSNSKSISSSISTKTKDYLMHISDLQGIGLTEELAIAELIGLCSGALERPVQESMVVLGNMTVGGTIAKVEEFANTLQVCVDAGAKKVLIPAASVVDFQTVPADLLIKVQPVFYSDPTDAVFKALGVS

SEQ ID NO: 4156 - protein, 694 aa, Escherichia coli; identical to SEQ ID NO: 4056

SEQ ID NO: 4157 - protein, 700 aa, Pseudomonas mandelii
MSQLDDKINQHFAGLVVRKDLVKAVKGNAIVPSYVLEYLLGQYCATNDEATIQTGIETVKEILRKHYVHRNEAGLVRSTIKEKGRHKVIDRISVSLNDKDDVYEAEFANLGIKKVLIDSNTVKAHQKLLVGGVWCIADVEYEYTEDKSSSPWILASLKPIQISRFDFDGYLEARKQFTTDEWIDLLIQSVGFNPQMFGKRNKLAQLIRLIPFCERNYNLIELGPKGTGKSHVYSEFSPHGILISGGEVTVPKLFVHNGTGKLGLVGYWDVVAFDEFAGKQKRVDKALVDIMKNYMANKSFSRGVETLGAEASMVFVGNTDHTVPYMLKHTDLFDPLPEKFHDSAFLDRIHSYIPGWEVDVIRGEMFSSGYGFVVDYLAEILRSLRSHDYSDRYKGQFTLSDDISTRDRDGINKTFSGLMKILYPHGEATDAEVEDVLRTAIEGRKRVKDQLLRIDATYPAVRFAYKGGDAQERLVRTLEEDEYPNQYHRRGATEVSTADLPQVGTDPLALIEAAPAMQGPASRPSNPAPMEPVVKEQHLVFHENQRGLSFDKLFSPYLVGAKRIIITDPYLRMFHQLRNLMELMETISKLQGPEDEVVVHVVTVEDDSNGDRQTESLQKIADACTGVGIQFSWAYDTSGTKHDRDITTDTGWKIVLGRGLDVFQRFELNDAFSFANRLQQHRQCKEFSVTFVRIGPAACS

SEQ ID NO: 4158 - protein, 691 aa, Vibrio cholerae; identical to SEQ ID NO: 4037

SEQ ID NO: 4159 - protein, 683 aa, Vibrio cholerae; identical to SEQ ID NO: 4029

SEQ ID NO: 4160 - protein, 683 aa, Vibrio cholerae; identical to SEQ ID NO: 4029

SEQ ID NO: 4161 - protein, 691 aa, Escherichia coli; identical to SEQ ID NO: 4079

SEQ ID NO: 4162 - protein, 694 aa, Salmonella enterica; identical to SEQ ID NO: 4088

SEQ ID NO: 4163 - protein, 727 aa, Collinsella stercoris
MDSSFGTCGVPAYEADELDRKIIEHFPGKIVRKDLTSLMKRSAGIPTYVLEYLLGMYCATDDEAAIADGMARIRKILAENYVRPEESEKIKSRIRELGQYTVIDKVSARLDEYRDLYIAQFTNLNIEPFVMPDEYVRQHTKILTGGIWCIMRIQYLRPEDIAEDPLADIFGDDPAEQRGRARKGRTSGKGKRGPEDSPFKIASLTPIQMPSLDLPEFVSHREAFSTDEWIALLLRSAGYEPSALTPRERMHFLTRMVPLVELNYNLCELGPRGTGKSHIYTEVSPYSYLLSGGQTTTAKLFANNAARAGQRIGLVGHWDCIAFDEVAGMNFRDQNAIQIMKGYMANGTFGRGTESFNAEASMVFEGNINDSVANVLKTTHLFDPFPPEFNNDSAFFDRIHCYLPGWEVPKMRSDLICERYSLITDCLGEFLHAMRRRDFTHHIDRYFRLNSDFNRRDEIGVRKTFSGLAKLIFPDGKMDREDVRMLLEYAIEGRRRVKEQLKTMAGIEFIDVKLGYTDVENPVEMHVVGVLEQTDDALIPDTTPQAGHVFGVGRSVADEMAIYKLENKAVSGNAAFRMEGVGPNREVRDALNAAFEQFKNCAPWLAAGMHVTSRDYLLFCNDLQAKGPSAEVSLAEFIGLCSAASGRPVIAGLVIPGILRLSGSLEPISNLADVLRVAKNAGAKRILLPMSSIADLQGVAPELIGAVSPEFYETGDAVAAARRALGL

SEQ ID NO: 4164 - protein, 677 aa, Enterococcus faecalis; identical to SEQ ID NO: 4065

SEQ ID NO: 4165 - protein, 687 aa, Pseudoalteromonas flavipulchra
MNKLNQKICDEFAGLVVRKDLVKTVKGNAIVPSYVLEYLLGQYCATSDEASIESGIQTVKEILAKHYVHRNEAGLIRSTIREKGRHKVIDKVSVSLNDKKDVYETEFSNLGIKKVLIDSGTVKKHPKLLVGGVWVIADIEYDHTEDKDASPWILSTIKPIQMSHFDYDGYISARNKFDLDEWIDVLVQSIGFNPEFFGRRSKLTQLVRLIPFCERNYNLIELGPKGTGKSHIYSEFSPHGILISGGEVTVPKLFVNNSSGKLGLVGYWDTVAFDEFAGKQKRVDKALVDIMKNYMANKSFSRGVETLGADASMAFVGNTEHSLPYMLKHSDLFDALPEKFYDSAFLDRLHFYIPGWEVDIIRGEMFSSGYGFVVDYLAEVLRHLRNQDYSDRYQEYFKLSSQISTRDRDAIHKTFSGLMKILFPQGGATEAEIEEILKFAMEGRKRVKDQLFRIDSTYVDVNFAYSNKAGQELAVQTLEELQYPNYFNQTVGEVSDIGMPEPDIEPVGVSSAQQPSQAVSAPCSELKEHHVTYAENQRGVSYDKLFGPYLKGAKHITITDPYIRMFYQAKNLMELLETIVKLKEEGEEVVVSLVTVEDESKGEAQRDFFEQIQSTMFSVGIKFAYSFDNSGTQHARHIVTDHGWKISLDRGLDIFQQYDSNDAFSLSTRLQTHRAVKAFEVTYIKVD

SEQ ID NO: 4166 - protein, 694 aa, Escherichia coli; identical to SEQ ID NO: 4039

SEQ ID NO: 4167 - protein, 706 aa, Johnsonella ignava
MEMMDMAADDTREELCRKLRSNFDGRIVRKDLTKKIREGANVPVYVLEFLLGQYCSSDDETIIEQGVQNVKRILADNFVRPDEAQKILSQLRKNGSHSIIDMVTVHLDIKKDCFFAEFSNLGLTNVPITDDYPEKYERLLCGGIWCIVQLEYESEGDSGFGITDIDGQPISSKQKKQKNISPISIHKLTPIQMPHIDIEEVREGRKAFTQEEWMNVMLRSCGYEPEQLNNREKWLLFARMLPLVENNFNLCELGPRSTGKSHIYKEISPNSILVSGGQTTVANLFYNMGRKTVGLVGLWDCVAFDEVAGIKFKDKDGIQIMKDYMASGSFARGKEEKAASASMVFVGNINQSVDVLLKTSSLFDPFPPEMGTDTAFLDRLHCYIPGWEIPKFRPEHFTNDYGFITDYLAEFIRELRKEQYGDALDKYFRLGKNLNQRDTIAVRKIVGGYVKLLYPDGEFTKEQIEEILVFALEMRRRIKEQLKKLGGMEFYDVNFSYIDLDTFEEKFVSVPEQGGGKLIPDGICNPGQVYTVSQGKSGMIGVFRLESQMLPGNGKFERTGLGSDRDCKESTNTAFNFLKANGNRISGSISTTMRDYIINYQDLQGIGMTGKLALPTLIALCSIALGRPTVNTLAVLGEISISGTILKVDELANSLQVCLDSGAKKVLLPITSAADLGTVPPELVGSFNLIFYSSAEDAVFKALGVE

SEQ ID NO: 4168 - protein, 683 aa, Vibrio cholerae; identical to SEQ ID NO: 4029

SEQ ID NO: 4169 - protein, 683 aa, Vibrio cholerae; identical to SEQ ID NO: 4029

SEQ ID NO: 4170 - protein, 694 aa, Enterobacter sp.
MQTHHDLPVPAVSEGELVAEGYDLDALLNQHFRGRVVRKDLTKQLKEGANVPVYVLEYLLGMYCASDDNQIVEQGLQNVKRILADNYVRPDEAEKVKSLIRERGSYKIIDKVSVKLNQKKDVYEAQLSNLGIKDALVPPQMVKDNEKLLTGGIWCMITVNYFFEEGQKTSPFSLMTLKPIQMPNMDMEEVFTARTHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFYKLGNNLNQRDVIAVRRTVSGLLKLLHPNGSYSKEDVRVCLTYAMEARRRVKEQLKKLGGLEFFDVNFSYIDNETLEEFFVSVPEQGGSELIPAGMPKPGVVHLVTQAESGMTGLYRFETQMTAGNGKHSVSGLGSSTSAKEAIRVGFDYFKGNLSRVSATAKFSEHEYHLHVVELHNTGPSTATSLAALIALCSVLLAKPVQEQMVVLGSMTLGGVINPVQDLAASLQLAFDSGAKKVLLPMSSAVDIPTVPAELFTKFQVSFYSEPVDAVYKALGVN

SEQ ID NO: 4171 - protein, 677 aa, Enterococcus faecium; identical to SEQ ID NO: 4030

SEQ ID NO: 4172 - protein, 683 aa, Vibrio cholerae; identical to SEQ ID NO: 4029

SEQ ID NO: 4173 - protein, 678 aa, Bacillus cereus
MEMEDLNIKLNAHFAGKVVRKDLTKKIKEGANVPVYVLEYLLGMYCATDDEKSMNDGVQMVKKILSDNFVRPDEAEKVKSKVKELGKYTVIDKIGVKLNDKKDIYEAEFSNLGLNGVPISSHYVKEFDKLLAGGIWCIVKMEYYFDEESKGTSPFSIESVTPIQMPNMDLEEMFEQRRQFSKEEWIDVLIRSTGMEPTQLEDTVKWHLLERMVPLVENNYNLCELGPRGTGKSHIYKEISPNSILVSGGQTTVANLFYNMSTRKIGLVGMWDTVAFDEVAGITFKDKDGIQIMKDYMASGSFARGREEKNANASMVFVGNINQSVDVLLKTSHLFDPFPEAMAYDSAFFDRMHYYLPGWEIPKMRPEFFTNEYGFITDYLAEFLREMRKRSFSDAIDKYFRLGNNLNQRDVIAVRKTVSGLIKLLYPNGEYIKEDVEEVLRYALIGRRRVKEQLKKIGGMEFYDVNFSYIDNESMNEEFVSVPEQGGGTLIPEGMNKPGHIYTVARGKTGMIGTYKLETEVVSGNGKFEKTGLNSDRDAKESIDTAFRFFKANNKNISGTISTTTKDYLMHIQDIHGVGLTGELSLAAFIALCSGALNKPVQSQMVVLGSISISGTINKVEELANVLQVCFDSGAKKILLPMASAVDIPIVPPELFAKFQIGFYQSAEDAVFKALGVE

SEQ ID NO: 4174 - protein, 677 aa, Enterococcus faecium; identical to SEQ ID NO: 4030

SEQ ID NO: 4175 - protein, 694 aa, Salmonella enterica; identical to SEQ ID NO: 4088

SEQ ID NO: 4176 - protein, 683 aa, Vibrio cholerae; identical to SEQ ID NO: 4029

SEQ ID NO: 4177 - protein, 683 aa, Vibrio cholerae; identical to SEQ ID NO: 4029

SEQ ID NO: 4178 - protein, 554 aa, Escherichia coli
MVKDNEKLLTGGIWCMITVNYFFEEGQKTSPFSLMTLKPIQMPNMDMEEVFDARKHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFFKLGNNLNQRDVIAVRRTVSGLLKLMHPDGAYSKEDVRVCLTYAMEVRRRVKEQLKKLGGLEFFDVNFSYIDNETLEEFFVSVPEQGGSELIPAGMPKPGVVHLVTQAESGMTGLYRFETQMTAGNGKHSVSGLGSNTSAKEAIRVGFDYFKGNLNRVSAAAKFSDHEYHLHVVELHNTGPSTATSLAALIALCSILLAKPVQEQMVVLGSMTLGGVINPVQDLAASLQLAFDSGAKRVLLPMSSAMDIPTVPAELFTKFQVSFYSDPVDAVYKALGVN

SEQ ID NO: 4179 - protein, 694 aa, Salmonella enterica; identical to SEQ ID NO: 4088

SEQ ID NO: 4180 - protein, 675 aa, Haloarcula japonica
MTTEDVDRKALDVFSGRVVRKDLVQDIKSGVNVPTYVLEYLIGQYCATDDEESLEEGLEKVKEILSKHYVRPDEAEFVKSEVRERGRYRVIDKVTVRLDEQQDAYIGSFVNLGLSDVEINEHLVSKHPKLLGGGVWAIIDLEYLPDNANSPKSLFGIDSFKPIQVSNLDLDQLKDRRKDFTRDEWMDLLLQTVGYDPSSFSDREKFLFLARCIPLVESNYNYVELGPRGTGKSYLYREISPHSILISGGKTTVAKLFLNLNTGRIGLVGRWDVVAFDEVGGLQFSDSEAVQMLKDYMESGSFSRGTEELTAQASMVYVGNIDLDVEGVLKSSHLFEPFPEDMQDLALIDRFHYYLPGWEVPKMRSEFFGDQFGFIVDYFAEFVRELRKESYGDAINEEFAFGDHLNQRDEKAVRKTVSGLLKLLHPHGHYTKEELREYLEFAMEGRRRVKEQLKRIGGMEYRAVEFSYLDLETKEEIYVSVPEEADESLIPPGTQQAGTVYTIGESEGRHAPFRIETQTLPGSGKTNISGTPGKRMKESFETACDYLQANMRELSREETLDEYDINVQVLNPSDANEGGETSVGLLVGIVSGILDRPVRPQTVVLGSMSLMGELVSVSSLIDKLQLSADSGAKTVLLPAKNKEDLPKIPDELLDQLQLVFYTNPLDAASKAIELE

SEQ ID NO: 4181 - protein, 684 aa, Lactobacillus rhamnosus; identical to SEQ ID NO: 4035

SEQ ID NO: 4182 - protein, 694 aa, Salmonella enterica; identical to SEQ ID NO: 4088

SEQ ID NO: 4183 - protein, 679 aa, Vibrio tubiashii
MESANDKELDQLLNEHFAGRVVRKDLTKLIKEGANVPVYVLEYLLGMYCASDDPDIIEQGLNNVKTVLAENYVRPDEAEKVKSLVKERGTYKVIDRVTVKLNERKDKYEASFSNLGIKDAEISSGIVKEYEKLLVGGIWVIATLSYYHEEGQTGSPFGVTLLKPIQMPNMNMDELFQGRAALTTDQWRECLIRSVGMEPAALGVDVQWHILARMIPFVENNYNVCELGPRGTGKSHIYKECSPNSILVSGGQTTVANLFYNMSSRRIGLVGLWDLVAFDEVAGISFKDKDGVQIMKDYMASGSFARGREQMEASASMVFVGNINQSVESLVKTSHLLAPFPDAMIDSAFFDRFHAYIPGWEIPKMRPEFFTNRYGLIVDYLAEFYREMRKRSFADAIEKYFKLGNNLNQRDVIAVRKTVSGLLKLLFPHGQFDKEDVRQCLEYALQVRRRVKEQLKKIGGMEFYDVHFSYIDNDSLEEHFVSVKEQGGGGLIPEGPGKPGFLHTIGLSNKGMPGLYRLELQVTKGSGKLATSGLWNSSAAKEQVKIAFDYFKANASRISGGSKVGEHDFHLHAVELQNTGPFSHLALSSLVAFASGLLGKPLQNQMVVLGDMSLGGSVTPVESLAECLQVAFDAGAKKVALPMSSAADIPTIPAELFTKFQTSFYADPVDAVFKALGVD

SEQ ID NO: 4184 - protein, 683 aa, Vibrio cholerae; identical to SEQ ID NO: 4029

SEQ ID NO: 4185 - protein, 683 aa, Vibrio cholerae; identical to SEQ ID NO: 4029

SEQ ID NO: 4186 - protein, 694 aa, Salmonella enterica; identical to SEQ ID NO: 4088

SEQ ID NO: 4187 - protein, 694 aa, Escherichia coli; identical to SEQ ID NO: 4056

SEQ ID NO: 4188 - protein, 683 aa, Vibrio cholerae; identical to SEQ ID NO: 4029

SEQ ID NO: 4189 - protein, 683 aa, Vibrio cholerae; identical to SEQ ID NO: 4029

SEQ ID NO: 4190 - protein, 694 aa, Escherichia coli; identical to SEQ ID NO: 4064

SEQ ID NO: 4191 - protein, 677 aa, Enterococcus faecium; identical to SEQ ID NO: 4030

SEQ ID NO: 4192 - protein, 683 aa, Vibrio cholerae; identical to SEQ ID NO: 4029

SEQ ID NO: 4193 - protein, 694 aa, Escherichia coli; identical to SEQ ID NO: 4056

SEQ ID NO: 4194 - protein, 692 aa, Sphingobium indicum
MTALDDKINERFPGLVVRKDLVKAVKGNAIVPTYVLEYLLGQYCATNDEASIQSGIETVREILRKHYVHRNEAGLIKSNIREKGRWKIIDRISVALNEKSDTYEASFANLGISKVLIDSGTVKTHPKLLVGGVWCIADIEYDYTEDKNVTPWILGTMKPIQLSHFDYEAYLEARKGFTTDEWIDLLFQTVGFDPEMFGRRSKLIQLMRLIPFVERNYNLIELGPKGTGKSHIYSEFSPHGILISGGEVTVPKLFVSNSSGKLGLVGYWDVVALDEFAGKQKKVDKALVDILKNYMANKTFSRGVEPLGAEASMVFVGNTKHTVPYMLKNTDLFDELPDKYYDSAFIDRLHTYIPGWEVGVIRGEMFSNGYGFVVDYLAEILRHLRNDDYSDRYRSNFELSSDISTRDRDGVHKTFSGLMKILFPTGEATPDEMEEILKLALEGRKRVKDQLMRLDATYPDVDFSFSRKNGEKVKVATLEENEFPSFYYRRAGGLGLPITEPTGDDASEAAAAPQLDAGATAVTSVSEGPKTGHFTYNENQRGVTFDNLFGPYLVGVQKITITDPYIRAFHQVRNVMEFIETLAKAKSPADEVEVHLVTCVDGIRPEKQTENLGAIAASCEGVGITFTWEFDETNTIHARHIVTDTGWKIALDRGLDIFQQYELNDAFSFANRLQQFRSVKAFEVIYLKNNSV

SEQ ID NO: 4195 - protein, 683 aa, Vibrio cholerae; identical to SEQ ID NO: 4029

SEQ ID NO: 4196 - protein, 683 aa, Vibrio cholerae; identical to SEQ ID NO: 4029

SEQ ID NO: 4197 - protein, 694 aa, Escherichia coli; identical to SEQ ID NO: 4039

SEQ ID NO: 4198 - protein, 676 aa, Sporolactobacillus vineae
MDDLDQKLYEAFPGKVVRKDLTKKIKEGANVPVYVLEYLLGMYCATDDEEGIEDGVRQVKKILAENYVRPDEAEKVKSRIRELGHYTVIDRITARLDERNDLYKAEFSNLGLSDVVISSKYVKDFDKLLTGGIWCIIQMAYFFDENDKASSPFTIEKLTPIQMPSMDLKELFAARKRFHKDEWIDILIRSIGMEPTQFEPAVKWHLLERLVPLVENNYNLCELGPRGTGKSHVYKEISPNSILVSGGQTTVANLFFNMATHQIGLVGMWDTVAFDEVAGIKFKDQDGIQIMKDYMASGSFARGREEKTAAASMVFVGNINQSVDVLLKTSNLFEPFPEVMAADSAFFDRMHFYLPGWEIPKMRPEYFTNNYGFITDYLSGFMREMRKRSFSDAIDHFYHLGNNLNQRDVIAVRKTVSGLIKLVYPDGVFNKEEIEEILRYALVGRRRVKEQLKKISGMEFYDVNFSYIDNDSMEEQFVSVPEQGGGKIIPEGLGKPGHVYTVCRGKTGMIGAYKIETEMTSGNGKFERAGFGSDSAAKESVDTAFHFFKSNGKSISGKISTQKKDYLLQIQDIHGVGLNDQLSLAALVALCSAAVGRPVQSQLVILGSISISGTIQRVDDLASVLQICLDSGGKKVLLPMSAAADLGTVPPEIFAKFQIIFYQSAEDAVFKALGVS

SEQ ID NO: 4199 - protein, 683 aa, Vibrio cholerae; identical to SEQ ID NO: 4029

SEQ ID NO: 4200 - protein, 711 aa, Streptomyces sp.
MSEVSEVSPVEPVGPDAPADADPRPSELDRKINRLFPGAVVRKDLVKAVKGNAIVPSYVLEYLLGQYAASDDAATIQAGIDTVRRILADHYVHRNQSELVKSTIRERGRHRIIDKVTATLNEKNDVYEAEFANLGIKGVLVEPATIKAHPKLLVGGVWCICDIEYFHSADPRVVPWILGSIKPIQLSNFDVEGYLVARREFTTDEWIDLLVQSIGFNPELFGRRAKLIQLVRLIPFVERNYNLVELGPKGTGKSHIFSEFSPHGMLISGGEVTVPKLFVNNANGRIGLVGYWDVVAFDEFAGKKKRTDRALVDIMKNYMANKSFSRGVETLGAEASMVFVGNTSHTVPYMLKHADLFDELPESYHDSAYLDRLHHYIPGWEVDTIRGEMFSDGYGFVVDYIAEVLKSMRSQDYSDRYQQHFSLSSDISTRDRDGIHKTFSGLMKILYPHGEAAPEEIEEILRFAIEGRKRVKDQILRIDSTMADVKFGYLDRSGAWHAVSTLEEDEYPAYYHRERPGAADSAIEPSAGAAVPTVQDGTPGEHAQVVAPLFEGHREFQENQRGVSFDTLLTPYLRRAGQITITDPYIRQFHQARNLMELIEGIAAVKDAADEVNVKLITTESNGGEDKVRKQLELLLKVKQGAAAGGVNLDVSFTNTIHDRSIVTDTGWKIVLGRGLDIFQYVTGDAFDLATRLQEYRQVKAFGVTYIREGK

SEQ ID NO: 4201 - protein, 694 aa, Salmonella enterica; identical to SEQ ID NO: 4088

SEQ ID NO: 4202 - protein, 677 aa, Enterococcus faecium; identical to SEQ ID NO: 4030

SEQ ID NO: 4203 - protein, 694 aa, Escherichia coli; identical to SEQ ID NO: 4056

SEQ ID NO: 4204 - protein, 712 aa, Bacteroides xylanisolvens
MDALDIKLNEAFPGKVVRKDLLHEIKRAVNVPSFVLEFLLSRYCASEDPEEIEEGKKAVLQTIEKCYVRPDESNKAQAIVEQKKRHKFIDKIHVKYVEREKRYWAEMENFASKRIAINPNFYQENEKLLESGIWAEVTLAYNEIQEDDYAFFIEDLRPIQIAHFDEQKFFKGREHFTTDEWIDVLIRSIGINPDWLAERSRKLLGDKNGRRLKFHILSRFLPLVQSNYNSIELGGRSTGKSYFYSEFSPYSTLLSGGQASTATLLYNNQRKQVGAVGFWDNVAFDEVAKMKIKDADTVQIMKDYMANGRFSRGREVTGYASFSFVGNFDLNIPRIVNSYDHDLLVTLPEAFDLAVIDRIYNYIPGWEIPKIDDSAYNNNFGLITDYMSEALHYLFVHDSDYVGVVNSRLKKGDNIEGRDNKALQKTVSGFIKLLFPTGQPTDEEFDEIVEYAIEGRRRVKEQLNKRKPDEEYARINMSYINKDGNKVVVYCPESKYSEATQNPRKDLNVEVLTKPIVEEVKPVVDQSIVLPIHSAIAPIVDSSPKEKTIDIQYGDIGYGYDDLFAEYLKGASIVMLEEPYLGNGFQIVNLVRFIELLVKIGDCKAFRLITKPGETPEESASISDNLKRIKETLGEMDGNIMSFEYEFDENSHDRYIRTSNNWDITLGRGLHFYQNMNPNKDSRNFFQMGTYDLSLRPCLKARFTFMKRDAQE

SEQ ID NO: 4205 - protein, 694 aa, Escherichia coli; identical to SEQ ID NO: 4056

SEQ ID NO: 4206 - protein, 694 aa, Salmonella enterica; identical to SEQ ID NO: 4088

SEQ ID NO: 4207 - protein, 712 aa, Bacteroides sp.; identical to SEQ ID NO: 4204

SEQ ID NO: 4208 - protein, 684 aa, Opitutaceae bacterium
MPDAPIELDALDLLANEAFPGMVVRKDLLRRMRTSFGVPAFVIEFLLGKYCASTDDREINEGLEFVRETLASKYVKPDQRESVKSSIKQHSTYEFIDKVSVKLVEVHDKYWASLSNLNLDFINIDERLVKEHERLLMGGVWAEITIRYDETYIFKNQNRPFFIESIRPIQISNRNMEGFRASRKRFTRDQWLDLLMRSMGYEPDHPYYTKRRKLHCMLRLVPFVERNFNSVELGPRGTGKSFVYQQMSPYCHLVSGGQTTTAQMFVNLSSGQRGLVCMWDVVAFDEAAGINFSDKSGVNIMKGYMEDGAFSRGRDIITAEGSIVFVGNIDGEIATIVRTSHLFYPMPKEMDTAFYDRIHAYIPGWEFQKTHDDAYTNHFGLVTDFLAEVFREVRKSSYTDYAERHFKFGSHLGGRDQKAVRKIVSGLIKLLHPDGEVTKVELAEYVEYALEMRRRVKEQLKKMGGLEYWNTSFSYIDRESGQETFVNVPEMGGGSLIPEGQQAPGSVYTIGTDASDSRLALFLLQAQVNPGSGRIIPLGNLSKSMKEAIKTADAYLRGNLKNLGITRDIDSYDFSLQAINLNQAKDGSETAVAFFISLVSAILEKSVLERTVVLGEMSVQGLLLKVNSLPERMQLAVEAGAKRILIPSENKRDLADVPDTIITAIQWHFYDSPIKAATIAMGLA

SEQ ID NO: 4209 - protein, 716 aa, Bacteroides coprophilus
MDRLDIKLNEYFPGKVVRKDLLHEIKQTVNVPSFVLEFLLSRYCASDDPDEIEEGKKAVLQIIEKNYVKPDESNKAQAIVEQKKRHKFIDKIHVKYVEREKRYWAEMENFGSKRIAINPQFYQKNEKLLESGIWAEVTLAYNEVQEDDYAFYVEDLRPIQIARFDEQKLFEGRKGFTTDEWIDVLIRSIGINPDWLAERSRSLKGDKDGKRLKFHILSRFIPLVQNNYNSIELGGRSTGKSYFYSEFSPYSTLLSGGQASTATLLYNNQRKQVGAVGFWDNVAFDEVANMKIKDADTIQIMKDYMANGRFSRGQEVTGQASFAFVGNFDLNIPTIVNSYDHDLLATLPKAFDFAVIDRFYNYIPGWEIPKIDDSAYNNNYGMISDYLSEVMHYLFDHNSDYLPILNKYLKVGDNVEGRDSRALQKTVLGFLKLIYPIGEPTPEEFDEIVAYALEGRRRVKEQLNKRKPDEEYARINMSYINKDGEKVVVWCPESKDSIATQDPRKTGDVEIATEQQPAASLPRKAKGKEKEAVSQNECLQDSSPVQATATPDEIIDNGPKPKSLAIRYGDTGYSYDKLFADYLEGAKVIELQEPYLSHGYQMQNLTRFIESIVKIGDCKKIILTTKMGESIDETQKIQDGLEQLKAALQDAGIDFEFTFSDLIHARYIITNNGWNISLDRGLHIYQNIGRNFYLMGYYDLDLRPCLETKIVYTKVE

SEQ ID NO: 4210 - protein, 678 aa, Bacteroides sp.
MELQQKILDAFIGKVVRKDLAFLVKGNLPVPTYVLEYLLGQYCASDDTVIIEEGLEKVKDVIRNNYVHRADAEEVKGKIREAGKYRIIDKISVILNDRADEYDATFANLGLANIPIPAEFVKKNPKLLSGNGVWCIVTIGYISGEDIKMRWDIQSLKPIQISNIDINEYITQREKFTTDEWIDFLIHTVGLKPENLNRREKFIVLSRLLPHVENNFNFMELGPKGTGKSHVFQELSPYGVLVSGGDVTSARLFVKISGNRELLGLVGYWDVVAWDEYEQQKGKSVDPVLIDTMQNYLANKSFNRGKGSHEASASMSFVGNTKHTVSYMLKNSHLFESIPTAFIKGAFLDRIHLYNPGWEIKMLKKDSFSNGYGLITDYIAAVLHALRNKDFSSELKNYVRFSGTLSERDHLAIRKTFSGMIKLLYPDGKYTGEEALEIIEFAAECRKRVKDQLYIIDETFRAEPAKFEYLILKTGETKQVETLERIENPVMEEEIQTEEPTKEDVSEPSISSPRLTPRPRIVQLASKQIEIRLNQRGVSYKSLFGDYIRTAKKITITDPFIRLGHQIDNLIEFIQMARETCMTPEELEIELHTQNEEEKIPEMIDIFNDLQEELLSYGITFNFMFDAEHDRKIELDNGWTINLGRGLDIFEKFSRFSLSNIRQENRRCKEFTVIYMHK

SEQ ID NO: 4211 - protein, 694 aa, Escherichia coli; identical to SEQ ID NO: 4056

SEQ ID NO: 4212 - protein, 694 aa, Escherichia coli; identical to SEQ ID NO: 4056

SEQ ID NO: 4213 - protein, 694 aa, Escherichia coli; identical to SEQ ID NO: 4039

SEQ ID NO: 4214 - protein, 695 aa, Thiorhodovibrio sp.
MDALDTKLTGVFDGKVVRKDLLHRIKKGTNVPTFVLEFLLARFCASDDDDEIQAGLEAVLDTLQDNYVRPNEANMAQSKVATKGKYRFIDKVHVNYVEKDKRHWAALENFDSRRVAIGEKFYRDNDRLLQGGLWAEIAIAYNEIEDDDYTFYIEDLRPIQLSRFDYAAYCEGRSQFSREEWLDVILRSMGLEPAKLTHRVKLHFIARLLPLVEPNYNFIELGPRGTGKSYFFSEFSPYSTLISGGQATKATLFYNNQRKKIGLVGFWDTVAFDEVGGIKIKDPDTIQIMKDFMANGRFSRGVEVIADASMAFVGNLDLSVSQIVNSEVYDLFQPLPKEFDLAIMDRFAAYLPGWEMPKNSSEFLTGNYGFITDYLAEAFHHQLKHTNRYEEVSQRIKLGQAVEGRDEKGIKKTVAALLKILHPSGPPDDDEFDEYVAYATECRRRVKEQMNKRKSDDEFALINLSFINSKGQDTIVFCPESKSAIATQEPARKNIHHPTGESDQKSARPSVPSVKTEAETPAPESSCADLQEAIEPIIPVLKEQHFTIQYGATGFSYESLMSPYLVNAKAVLIEDPYIRANHQIQNFVRFCETLVKQATIRKITLVTSYDDKTDLKEMASRLDELKQSLLEMDIQLEIKVNENLHDREIRIDNGWIIKIGRGLDFYQKPDSWYGIGSTDLSLRRCLETKVDIYQG

SEQ ID NO: 4215 - protein, 678 aa, Cylindrospermopsis raciborskii
MGGTALNNLDQKINAHFPGLVVRKDLVKTVKGNAIVPSYVLEYLLGQYCATNDEATINTGIETVKEILRKHYVHRNEAGLIRSNIREKGRYKVIDKISVELNEKADVYEAEFGNLGIKKVLVDSSTVKSHPKLLVSGVWCIADLEYEFSEDKNSSPWILASLKPIQLSYFDFDSYVQARQAFTTEEWIDLLVQSIGFNPEMFGRRSKLLQLIRLIPFCERNYNLIELGPKGTGKSHIFSEFSPHGILISGGEVTVAKLFVNNSTGRIGLVGYWDVVAFDEFAGKQKSVNKSLVDIMKNYMANKSFSRGIETLGAEASMVFVGNTKHTVPYMLKHSDLFEELPDKFHDSAFLDRIHFYIPGWEVDIIRGEMFCNGYGFVVDYLAEILRAMRNLDYSDYYHTYFSLSPDISTRDRDGIQKTFSGLMKLLFPQGSGTESEVEEMLQIAIEGRKRVKDQLLRIDSTYRKVNFAYENRKGTCKTVTTLEEEEYASFYHQILTEEKERPSLWEEEREVFPQEAHLTFKENQRGVSFDTLLGPYLEGAKEITITDPYIRVFHQACNLMDLIETVIKLKPNRDEVKINLITTLDELKGEQQVEYLVKIQDSCSIAGIDFKWEFDGTSTIHARHIVTDTGWKILLDRGLDIFQHYDLKDVFSIPNRLQEFRGCKAFEVTFLRCDPVD

SEQ ID NO: 4216 - protein, 683 aa, Vibrio cholerae; identical to SEQ ID NO: 4029

SEQ ID NO: 4217 - protein, 683 aa, Vibrio cholerae; identical to SEQ ID NO: 4029

SEQ ID NO: 4218 - protein, 689 aa, Enterobacter hormaechei
MQQQDNSATNMEMASVQDLDSLLNQHFRGRVVRKDLTKQLKEGANVPVYVLEYLLGMYCASDDDEVVDQGLQSVKRILSDNYVRPDEAEKIKSLIRERGSYKIIDKVTVKLNQKKDVYEAQLSNLGIKDALVPSQMVKDNEKLLTGGIWCMITVNYFYEEGQKTSPFSLFTLKPIQMPNMDMDEVFEARKQFDRDQWIDVLLRSVGMEPANIEPRTKWHLIARMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVDTLVKTSHLLAPFPDAMIDTAFFDRFHAYIPGWEIPKMRPEFFTNRYGLITDYLAEYMREMRKRSFSDAIDKFFKLGNNLNQRDVIAVRRTVSGLLKLMHPDGAYDKEDVRVCLTYALEVRRRVKEQLKKLGGLEFFDVNFSYIDNDSLEEFFVSVPEQGGSELIPAGMQKPGVVHLVTQADSGMTGLYRFETQMMAGNGKHAVSGLGSNTAAKEAVRVGFDYFKGNLSRISAAAKFSEHEYHLHVVELHNTGPSTTTSLASLIAFCSMLLAKPVQEQMVVLGSMTLGGVIKPVQDLAACLQVAFDSGAKRVLLPMASAMDIPTVPTELFTKFQVSFYADPVDAVYKALGVN

SEQ ID NO: 4219 - protein, 691 aa, Marinobacter sp.
MSSLDAKINQHFPGVVVRKDLVKAVKGNAIVPSYVLEYLLGQYCATDDEATIETGISTVKEILAKHYVHRNEAGLIRSNIKEKGRYKVIDKVTVSLNDSRDVYEAEFENLGIKKVLVDSGTIKKHPKLLVGGVWCICDIEYDFSEDGQSTPWVLLSLKPIQLSSLDYDAYLEGRKQFTTSEWIDVLMQSIGLNPEAFGRRSKLIQLVRLIPFCERNYNLIELGPKGTGKSHVYSEFSPHGTLVSGGEATLAKLFINNTTGKIGLVGYWDVVAMDEFAGSGKKPDIKLIDTLKNYMANKSFNRGTGPQGAEASMVFIGNTSHNVPYMLKHEHLFMDLPETYRNSDGQAILDRLHCFLPGWEMDNLRNDMFSTGFGFVVDYLAEVLRSLRSYDFSDRYQDRFTLSSDISTRDRDGINKTFSGLMKILFPHGGETEEEVEEILRFSMEGRKRVKDQLMRVDSTYATVNFSYQSAGGENQQVTTLEEEEYPAYYHKKINDEDDVKDVDLAAPEGFAAVKSQPVASAPQVILEEKHITFQENQKGVSYELLFGPYLKDATKITITDPYIRLFYQIRNLMELLELIVKTKAEEDEISVHLVTSRDEFKGELQDESFEKMRSSADTVGINFTWEFDETGTIHARHIVTDTGWKISLDRGLDIFQHYEMNDVFAFANRLQKYRSSKAFEATFIRYGGNQ

SEQ ID NO: 4220 - protein, 694 aa, Escherichia coli; identical to SEQ ID NO: 4039

SEQ ID NO: 4221 - protein, 694 aa, Salmonella enterica
MQTHHDLPVPAVSEGELVAEGYDLDALLNQHFRGRVVRKDLTKQLKEGANVPVYVLEYLLGMYCASDDDQIVEQGLQNVKRILADNYVRPDEAEKVKSLIRERGSYKIIDKVSVKLNQKKDVYEAQLSNLGIKDALVPPQMVKDNEKLLTGGIWCMITVNYFFEEGQKTSPFSLMTLKPIQMPNMDMEEVFTARTHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFYKLGNNLNQRDVIAVRRTVSGLLKLLHPNGSYSKEDIRVCLTYAMEARRRVKEQLKKLGGLEFFDVNFSYIDNETLEEFFVSVPEQGGSELIPAGMPKPGVVHLVTQAESGMTGLYRFETQMTAGNGKHSVSGLGSSTSAKEAIRVGFDYFKGNLSRVSATAKFSEHEYHLHVVELHNTGPSTATSLAALIALCSVLLAKPVQEQMVVLGSMTLGGVINPVQDLAASLQLAFDSGAKKVLLPMSSAVDIPTVPAELFTKFQVSFYSEPVDAVYKALGVN

SEQ ID NO: 4222 - protein, 709 aa, Lactobacillus casei
MTSDNKQEEEKLRAKSDGDVAVPAEPIAQEQAAENVQTDLLDKLEAFFPGRFVRKDLTQKIKEGANVPTYVLEFLLGQYANSSDPVIIERGVENVKKTLANNYVRPDEAEKVKSRIREEGAYTVIDKITVTLNSDKDRYEAAFGNLGITGVPVDERYVQDYERLLVGGIWSIVRVRYDHTSDDHFLIDQLTPVQVPSVNMQEVYDAREKFTTDEWIDLLLRTIGMEPTQFDDRVKWLMVSRLIPFVENNYNFVELGPRGTGKSHVYKELSPNSILVSGGQTTVANLFFNMARHEVGLVGMWDVVAFDEVAGIKFKDNDGVQIMKDYMASASFARGRDEIQASAGMVFVGNINQPVDVVMRTSNLFDPFPAVMANDTAFLDRIHNYLPGWEIPKYRPNFFTNGYGLITDYFAEVMRALRKISYGDAFDKYFTLGNQLNQRDTIAVRKTVSGMVKLLYPDGKFTKDDIAQILAFALEMRRRVKEQLKKIGGMEFYDVNFSYIDKETFDEHFVSVPEQGSTGLIPENEGKPGQVYTVAYDADERLSLIKLESQMTAGNGKTSWTGIQSNRLAKEEMDTAFNYLKANFSQVSQNIAPAQHDYIVNATNLNNGAMATELSLATYVALVSISVGKPVIGGLAILGDFSIGGTIKKMDSLADRLQVALDSGAKAVLIPSSATSELGTVPGDLIAAFSLKFYNTIEDAVMKALGVQQ

SEQ ID NO: 4223 - protein, 677 aa, Enterococcus faecium; identical to SEQ ID NO: 4030

SEQ ID NO: 4224 - protein, 683 aa, Glaciecola lipolytica
MAVLNDLDHKLLEHFRGYVVKKDLVRMVKVGANVPVFVLEYLIANSCSTDDEEKIKEGMENVKKILSEHYVNPEESSLIHSKIREKGRFKIIDKISVKLDSKKDIYWAQLQNSNINNGNIRDGLVKEHEKMLMGGIWAIIDVEYDPDIRIGQNIYPFVVTNIKPIQLSTFDNSKIIQKRNEFSRDEWLNVLLRSCGYEPDAEGMTTRVKMLLLARLLPMVESNFNFVELGPRSTGKSFVFKELTPYAVLISGGQGTVAKLFVHGSTGKVGAVGQWDAICFDEATDKIFKEKDAVPLMKDYMESGSFSRAGAGGEITGVASIILNGNINQPVETVLQTSHLFSPLSDEVNNDTAFLDRIHFYLPGWEMIKFAPKHFTSNFGFSTDYFSEALKSFRRVTYTDALENFFSLGSHLKQRDTKPVKKTVSGLIKLLHPNGEYTKEDVREYLEIALEMRRRVKEQLKRIGGMEFWDTNFSYIDKETQEEHFVGLPEEKGSHLIENTPLPPGVCYTSTSDGDNVALVRIEAVTTSGSGKLNISGVSNTGVKENIKNTYQYIKANEKTILSEQHSLKNYDMTIQVTNMLGASISTGIGSAVYIAIVSALYKKNLKAGLAVLGNISVGGAIERSINFADKITMLSENGAKTVVVPMDNLVELTNVPPTVLGNTDVPFYQNNQMLMQKSILLD

SEQ ID NO: 4225 - protein, 705 aa, Oribacterium sp.
MPDFMENSDTHAVIKEKLRRNFDGKIVRKDLTKKIKEGANVPVYVLEFLLGQYCSSDDPDVIEEGVNSVKHILSDNFVRPDEAQKILSVLRKKGSHTVIDMITVRLDIKKDCYFAEFSNLGLSNIPISDDYPEKFDRLLCGGIWCIVQLDYEMEGDSNFGIVDSDRYEMKSQQKKQKDISPISIRKLTPIQMPHIDINELKEGRKAFTKDEWIDVMLRSIGMEPDTLSNREKWLLLTRMIPLVENNFNLCELGPRSTGKSHLYKEISPNSILVSGGQTTVANLFYNMGRKSVGLVGLWDCVAFDEVAGIRFKDKDGIQIMKDYMASGSFARGKEEKAASASMVFVGNINQSVDVLLKTSSLFDPFPSEMGTDTAFLDRMHCYIPGWEIPKLRPEHFTDDYGFISDYLAEFIRELRKEQYGDALDKYFRLGKNLNQRDTIAVRKMVGGYVKILYPDGNFTKDDLEEILKIALEMRRRVKEQLKKLGGMEFYDVNFSYIDNESFEEHYVSVPEQSGGKLIPDGICNPGQVYTVSQGKSGMIGVFRLESQMLPGNGKFERTGIGTDRDAKEASNTAFNYLKANGSRISGSISTTTKDYIVNYQDLQGIGMTGKLALPTLIALCSIALGRPTVGNLLVLGDISISGTLIKVDELANVLQVCLDSGAKRVLIPSTSFVDFATVPPGLMSAFQLIPYQSAEDAVFKALGVE

SEQ ID NO: 4226 - protein, 683 aa, Vibrio cholerae; identical to SEQ ID NO: 4029

SEQ ID NO: 4227 - protein, 694 aa, Escherichia coli; identical to SEQ ID NO: 4056

SEQ ID NO: 4228 - protein, 694 aa, Escherichia coli; identical to SEQ ID NO: 4039

SEQ ID NO: 4229 - protein, 683 aa, Vibrio cholerae
MAVLNDLDHKLLEHFRGYVVKKDLVRMVKVGANVPVFVLEYLIANSCSTDDEEKIKVGMENVKKILGEHYVNPEESSLIHSKIREKGRFKIIDKISVKLDSKKDIYWAQLQNSNINNGNIRDGLVKEHEKMLMGGIWAIIDVEYDPDIRIGQNIYPFVVTNIKPIQLSTFDNSKIIQKRNEFSRDEWLNVLLRSCGYEPDAEGMTTRVKMLLLARLLPMVESNFNFVELGPRSTGKSFVFKELTPYAVLISGGQGTVAKLFVHGSTGKVGAVGQWDAICFDEATDKIFKEKDAVPLMKDYMESGSFSRAGAGGEITGVASIILNGNINQPVETVLQTSHLFSPLSDEVNNDTAFLDRIHFYLPGWEMIKFAPKHFTSNFGFSTDYFSEALKSFRRVTYTDALENFFSLGSHLKQRDTKPVKKTVSGLIKLLHPNGEYTKEDVREYLEIALEMRRRVKEQLKRIGGMEFWDTNFSYIDKETQEEHFVGLPEEKGSHLIENTPLPPGVCYTSTSDGDNVALVRIEAVTTSGSGKLNISGVSNTGVKENIKNTYQYIKANEKTILSEQHSLKNYDITIQVTNMLGASISTGIGSAVYIAIVSALYKKNLKAGLAVLGNISVGGAIERSINFADKITMLSENGAKTVVVPMDNLVELTNVPPTVLGNTDVPFYQNNQMLMQKSILLD

SEQ ID NO: 4230 - protein, 680 aa, Methanoplanus limicola
MTGPESTKETDNKLNKYFSGRVVRKDLTKKLKGSDNVPVYVLEYLLGSNCATDDEELIKKGVSRVKKILSDNYVRPDEAELIKSRIKETGYYTIIDKITVRLNERRDIYEAEFSSLGIREIEIDSETVKKYDKLLGGGIWCIVKMEYMPESSPRTPFVISGLKPIQIPNMDINEIIGRRKEFTKDEWIDILLRTTGIEPSKLKYPAKWHLLERLVPLAENNYNLCELGPRSTGKSHIYKEISPNTILISGGQTTVANLFYNLSSRQVGLVGLWDVVAFDEVAGIRFKDKDGIQILKDYMASGSFARGKDQINANASIVFVGNVNQSIPSLLKTAHLFAPFPDAINSDSAFFDRIHYYLPGWEVPKFRPEHFTDGYGFIVDYLAEYLREMRKRSFADHIGNYFRLGNNLNQRDVIAVRKTYSGLMKLIYPDGSITKEEAREILEYALTGRRRVKEQLKKIGGIEFYDVNFSYIDLEENSEHFVTVPESGGSKLIPEGMGRPGQVFAVNRNDSGKIGVYRMELQVVPGTGRYEKSGLGSDSKAKEAVQTAFSYFKANAKSVSQSISTKEKDYQLHVQDLNGAGMTDGLALAAFISLCSGALEKPVHEQTAVLGSFTIGGSVSSIDNLSDLLQVCLDAGAKKVLIPISSARKISAVPPELFSKFQISFYEDPVDAVYKALVLN

SEQ ID NO: 4231 - protein, 683 aa, Methanoplanus limicola
MSFELDSLDEKTTDLFEGYVVRKDLAREFAEKYPVPNYVAEFLIGKFCATTDEDEIAEGLEIVHKQLRDKVVKAGEQELFKARAKDKGTVKVIDLITARLDARSDNFFAAIPSLLINDAFIPSEFVYEHERMLTGGFYAEIEVEYGATQTEGQRSYPFTVKNLRPIQLSKRNVLDDLAAGREKMTTEEWKDFLCRSVGLEPSVLSERAKAVLFLRMIPFVEKNYNFIELGPRGTGKSYLFQQISPYSHLVSGGKATVAKMFVNNSSGQRGLVCQYDIVCFDEVSGISFDQKDGVNIMKGYMESGEFSRGKENIRAEGGIAMLGNFDVDVEHQQRIGHLFGPLPKEIRDDTAFMDRIHSYIPGWDYPKVHPDLLTEHYGFVSDFLAESWNRLRGESRLHKINGRVFFGDALSGRDRRAVNKTIDGLLKLLYPSSDMDIEEEDIEWAVRTALECRRRVKEQQKRIGSAEFRNTMFSYRLGVDGIEQYVSTPELHSENEISSDPLPPGQVWGIGPGDQNEGSGLYKIEVTTTPGSTIRLINVKAPSGLRESVKTAEQVLYTQNRILIGDHNPKEAEFSIQVRSLTSAKGGSSISMPILLALCSASIGKSLKGGIVIVGGMSVGGTIEPVYNALDMAELAAENGAVAILLPVASRKQLIDMSDDLASRLMVIYYKDPRDALFKVLGE

SEQ ID NO: 4232 - protein, 683 aa, Vibrio cholerae; identical to SEQ ID NO: 4029

SEQ ID NO: 4233 - protein, 694 aa, Escherichia coli; identical to SEQ ID NO: 4056

SEQ ID NO: 4234 - protein, 683 aa, Vibrio cholera; identical to SEQ ID NO: 4029

SEQ ID NO: 4235 - protein, 683 aa, Vibrio cholerae; identical to SEQ ID NO: 4029

SEQ ID NO: 4236 - protein, 676 aa, Bacillus cereus
MEDLNIKLNAHFAGKVVRKDLTKKIKEGANVPVYVLEYLLGMYCATDDEKSMNDGVQMVKKILSDNFVRPDEAEKVKSKVKELGKYTVIDKIGVKLNDKKDIYEAEFSNLGLNGVPISSHYVKEFDKLLAGGIWCIVKMEYYFDEESKGTSPFSIESVTPIQMPNMDLEEMFEQRRQFSKEEWIDVLIRSTGMEPTQLEDTVKWHLLERMVPLVENNYNLCELGPRGTGKSHIYKEISPNSILVSGGQTTVANLFYNMSTRKIGLVGMWDTVAFDEVAGITFKDKDGIQIMKDYMASGSFARGREEKNASASMVFVGNINQSVDVLLKTSHLFDPFPEAMAYDSAFFDRMHYYLPGWEIPKMRPEFFTNEYGFITDYLAEFLREMRKRSFSDAIDKYFRLGNNLNQRDVIAVRKTVSGLIKLLYPNGEYIKEDVEEVLRYALIGRRRVKEQLKKIGGMEFYDVNFSYIDNESMNEEFVSVPEQGGGTLIPEGMNKPGHIYTVARGKTGMIGTYKLETEVVSGNGKFEKTGLNSDRDAKESIDTAFRFFKANNKNISGTISTTTKDYLMHIQDIHGVGLTGELSLAAFIALCSGALNKPVQSQMVVLGSISISGTINKVEELANVLQVCFDSGAKKILLPMVSAVDIPTVPPELFAKFQIGFYQSAEDAVFKALGVE

SEQ ID NO: 4237 - protein, 683 aa, Vibrio cholerae; identical to SEQ ID NO: 4029

SEQ ID NO: 4238 - protein, 743 aa, Salmonella enterica
MPHDEINPTEGEFVGKETAQEPAVNVTHITNNVVIQQMDVYTEKLAQPSGTTVDEASMLSIDDELSQHASMDLDARLNRYFKGKVVRKDLTKQLKEGANVPVYVLEYLLGMYCASDDDEVVREGLENVKKILAENYVRPDEAEKVKSLIRERGSFKVIDKIGVKLNQKKDVYEAQLSNLGIKDAVIPANIVKANEKLLTGGIWCIVTLNYFYEEGQRISPFSIFNLKPIQMPSMDMEELFAARANFSTDQWLDTLIRSIGMEPTNLKQRVKWHLLTRMIPFVENNYNVCELGPRGTGKSHVYKECSPNSLLVSGGQTTVANLFYNMSSRQVGLVGMWDVVAFDEVAGITFKDKDGVQIMKDYMASGSFSRGRDSIEAKASMVFVGNINQSVETLVKTSHLLAPFPEAMIDTAFFDRFHAYIPGWDIPKMRPEFFTNNYGLITDYLAEYMREMRKRSFSDAIDRFFKLGNNLNQRDVIAVRRTVSGLLKLLYPHGVFGKEEVRPCLTYALELRRRIKEQLKKLGGMEFFDVHFSYLDNETLEEFFVNVPEQGGSQLIPEGLGKPGVVHMVTKGVTGQLGLYRFETQMTPGNGKHTTSGLGSNTPAKEAIRIGFDYFKGNLNRISATAKFSEHEYHLHAVELHNSGPSTKTSLAALVAFCSILMGKPVQEQMVVLGDMTLGGVVNPVEDLAGSLQLAMDSGGKRVLLPMASASDIPTVPAEIFSKFQISFYADPVDAVYKALGVQ

SEQ ID NO: 4239 - protein, 683 aa, Vibrio cholerae; identical to SEQ ID NO: 4229

SEQ ID NO: 4240 - protein, 788 aa, Collinsella aerofaciens
MFDSNDDNLWEVPSIDVDVPVEGVVPAEAAPAAEAPATEAVAPAPEPVAAAPVEAAATTKDESSTDGYDQAAAEAPEDDGYDMDGLDGKLLEHFAGKIVRKDLTALMKRGANVPTFVLEYLLGMYCSTDDEEAVAEGLDRIRRILTDNYVRPDESERIKSKIRELGRFTIIDKVTAKLDEYKDIYVASFANLTIEPFVMPAEYVRDYSKILQGGIWCIMSIEYRHPVDEEDEFGMEVFGDDAPRRSKAKRKKRGPEDSPFSVASLTPIQMPNLDLDAMIDERQYFTRDEWLNMLLRSAGYEPSELSEKERLHFIERMVPLIERNYNLCELGPRGTGKSHIYKEVSPYAILLSGGQTTTANLFGRMNSMRADRVGLVGHWDCVTFDEVAGMRFKDTNAVQIMKDYMASGSYARGRDQINADASMVFEGNINDTVQNVLKTTHLFDPFPPEFNNDSAFFDRIHYYLPGWEIPKMRSSLLTGHYGLITDCLSEFCKEMRRKDFTHHIDRYFRFNSDFNKRDEIAVRKTFSGLAKLLFPDEAMDKDDVRWLLDYAIEGRRRVKEQLKIMAGVEFIDVNLGYMDADNPQDVHVVRVPEQSEDTLIPDGPLLSGHVFGVGRSQGGEVAVYKLENKAVAGECKFKHEGVAFNKPVRDTLEAAFDNFVNLANRVAPGMHIGSKDYLLFYNDLQSKGLSEEVSLAEFVGLCSAACNRPVMPALAIPGILRMSGSMDEIRGLEDIMRVAKNAGAKRVILPLSAIAGLQSVSSEIISGLSPVFYMDGDPVDAAKKALDL

SEQ ID NO: 4241 - protein, 677 aa, Enterococcus faecium; identical to SEQ ID NO: 4030

SEQ ID NO: 4242 - protein, 683 aa, Vibrio cholerae; identical to SEQ ID NO: 4029

SEQ ID NO: 4243 - protein, 697 aa, Bacteroides sp.; identical to SEQ ID NO: 4078

SEQ ID NO: 4244 - protein, 676 aa, Vibrio cholerae
MQSADLDALLNQYFKGRVVRKDLTKQLKEGANVPVYVLEYLLGMYCASDDDEVVMQGLENVKKILAENYVRPDEAEKVKSLIRERGTFKIIDKVSVKLNQKKDVYEAALSNLGIKDALVPTKIVQDNEKLLTGGIWCIITVQYFFEEGQKTSPFSIMSLKPIQMPSMNMDEVFSTRRHFSTDQWMDVLLRSVGMEPTNLEHRVKWHLITRMIPFVENNYNVCELGPRGTGKSHVYKECSPNSLLVSGGQTTVANLFYNMSSRQVGLVGMWDVVAFDEVAGITFKDKDGVQIMKDYMSSGSFSRGRDSIEAKASMVFVGNINQSVETLVKTSHLLAPFPNAMIDTAFFDRFHSYIPGWEIPKMRPEFFTNSYGLITDYLAEYMREMRKRSFADAIDKFFKLGNNLNQRDVIAVRRTVSGLLKLLHPDAQYTKDDVRACLTYALETRRRVKEQLKKLGGMEFFDVHFSYIDNESLEEFFVNVPEQGGSKLIPEGLPRAGVVHLVTQGSTGQLGLYRYETQMMAGSGKHSVSGLGSNTAAKEAVRVGFDYFKGNLNRISASAKFSDHEYHLHVVELHNTGPSTKSSLAALIAFCSILMNRPIQEQMVVLGEMTLGGVVNPVQDLAGSLQLAMDSGAKRILLPMASASDIPTVPAELFSKFQISFYADPVDAVFKALGVN

SEQ ID NO: 4245 - protein, 691 aa, Vibrio cholerae; identical to SEQ ID NO: 4037

SEQ ID NO: 4246 - protein, 683 aa, Vibrio cholerae; identical to SEQ ID NO: 4029

SEQ ID NO: 4247 - protein, 677 aa, Enterococcus faecium; identical to SEQ ID NO: 4030

SEQ ID NO: 4248 - protein, 671 aa, Fusobacterium sp.
MDINEIGSKVFEGKIVRKDLVSKIKGGANVPVYVLEYLLGMYCNQTDEDSIEEGMLKVKKILAENYVRPDEAEKVKSKIREIGVYNVIDKVTVVLNEKKDRYEGHLSNLGVSNIEIHKNYIKDYEKLLSGGIWCILTLSYQYDELNISESPFKLNKLKPIQIASLDMNEVFEARKHFTKDEWIGFLLRSSGMEFENFDKDAIWHLLARMMPLVENNYNLCELGPRGTGKSYIYKEISPNSILLSGGQTTVANLFYNMSKRQVGLVGYWDVVAFDEIAGIKFKDKDGIQIMKDFMASGSFARGKEEKNANASMVFIGNINQSVDVLLKTAHLLVDFPPEMNNDSAFFDRMHCYIPGWDIPKLSPKSFTKEYGLIVDYMAEIFRELRKTSYGDALDKYFSLGRDLNQRDTIAVRKTVSALIKLVYPDGVFTKEEVEEILVRALEYRRRIKEQLKKMAGMEFFATNFSYIDKESGEEKYVGLKEQGGSKLIPEGPLKAGSLYTIAISANSVKGLYKVESQISAGKGKITVSDNKYRKTFENAFNYLKINSKRISGAINISEKEFYLSVADEKNVGNTEAITLGGFIAMCSIALNRQLMPQTVVLGEMALSGSINAVSDLVSMLQIAREAGAKKALIPILNAVDMSTLPPDILMDIQPIFYQDPIDATQKALGLI

SEQ ID NO: 4249 - protein, 683 aa, Vibrio cholerae; identical to SEQ ID NO: 4229

SEQ ID NO: 4250 - protein, 686 aa, Aurantimonas manganoxydans
MSLSISPSPATSTEVDELVVRHFGGKVVRKDLTKLLKEGANVPVYVLEYLLGMYCASDDEATIRDGLESVKRILSENYVRPDEAEKIKSTIKERGSFKVIDKVTVKLNEKKDRYEALLSNLGVKDAFISSADVRRYEKLLSGGIWCIVTMHYLYEEGSKSSPFSISDLKPIQMPNMDMPELLEGRSHFSEEQWLDVLLRSTGMEPSNFDNRVKWHLLSRLIPFVENNYNCCELGPRGTGKSHVYKECSPNSILVSGGQTTVANLFYNMASRVVGLVGMWDVVAFDEVAGISFKDKDGVQIMKDFMASGSFVRGRESVAGSASMVFVGNINQPVDTLVKTSHLLAPFPEAMIDSAFFDRFHAYIPGWEIPKMRPEFFTNRFGLITDYLAEYMREMRKRNFSDAIDHYFKLGNNLNQRDTIAVRRTVSGLLKLLHPSADYDKEAVRRCLEYALEARRRVKEQLKKIGGMEFYDVHFSYLDNETLEETFVSVPEQGGGKLIPESQMNPGTLHTIAAGAKSGHRSLYRLEVQTTTGSGKFTVSGLGSNQKAKEALGIAFDFFKANAGRISASTRPSDHDVHVHTVELHNAGAPTAITLAGFVALCSGILKKPVQGQMVILGDMSLGGSVVPVQDLAESLQMAFDSGAKKILIPMASAADIPTIPAELFTKFQTSFFSDPVDAAFKALGLN

SEQ ID NO: 4251 - protein, 688 aa, Sinorhizobium meliloti
MTTLDDKINERFPGLVVRKDLVKAVKGNAIVPSYVLEFLLGQYCATNDESSIQSGIETVKEILRKHYVHRNEAGLIRSNIREKGRWKVIDKVSVDLNTDKDAYEATFANLGIKKVIIDSDTVKAHPKLLVSGVWCIADVEYEHSEDKNVEPWILGSIKPIQLSKFDYEAFLGARAGFTTDEWIDLLFQTVGFDPEMFGRRSKLLQLTRLVPFVERNYNLIELGPKGTGKSHIFSEFSPHGILISGGEVTVPKLFVNNSSGKIGLVGYWDVVAFDEFAGRQKRVDKALVDIMKNYMANKSFSRGVETLGAEASMVFVGNTKHNVPYMLKHTDLFEELPEKYYDSAFIDRLHTYVPGWEIDVIRGEMFASGYGFVVDYLAEILRHMRNDDYSNRYRNLFTLSADISTRDRDGVNKTFSGMMKLLFPADNATEVEVEEILHLAVEGRKRVKDQLLRIDSTYPETDFSFMAQDGRKVVVKTLEETEYPQYYHKRAAGHDGSTPEGAGYVEGGSTTNVVQHAGEAETNVVGPHEGHKVFNENQKGITFADLFWPWLKGATNIVLTDPYIRMFHQLRNLMEFIEMIAQHKAPEDELTVHLVTCADEAYPEKQQSNLMAIEAAAGAAGIKLTWEFDGTNTIHARHLVTDRGWKISLDRGLDIFQKFEMNDAFSLANRLQTYRQVKAFEITYLRSV

SEQ ID NO: 4252 - protein, 693 aa, Sphingobium yanoikuyae
MSTLDDKINEHFAGFVVRKDLVKAVKGNAIVPTYVLEYLLGQYCATDDEASIATGIETVKDILRKHYVHRSEAGLVQSTIKERGRYKVIDQVSVALNEKTDAYEAVFENLGIKRVAIDSATVKAHPKLLVTGIWCIADVQYEFSEDSRISPWIIDTLKPIQIARVDYDGYRETRDKFTTEEWIDLLMQSIGFDPSLFGRRSKLLQLLRLVPFVERNYNLIELGPKGTGKSHIYSEFSPHGQLISGGEITVPKLFVNNSNGRIGLVGFWDVVAFDEFAGREKTANKALVDIMKNYMANKQFSRGVNPMGAEASFAFVGNTDHNVPWMLKNTDLFEALPPQFHDSAFIDRLHAYLPGWEVDIIRGEMFTSGYGFIVDYLAEILRHLRAEDFSHRPDRYFTIPVQTHIRDRAAINKTMSGLLKLIFPNGGETEAEVEELLRFAIECRKRVKDQLLRIDSTFEAADFHYIASDGAKRAVTTLEEEEFPQFYHRRSTDDGSDGVNQQEIGSVPAEPVSTAAASAAPTVTAAPHFPPTPGHVVFTENRKGISFDKIFGPWTDGATRIIITDPYIRKFHQARNVMELIEMLIRRKQPEDQIAVHLVTAPDDGNIQEQRECLDGIAEACTGTGVDFTWAFDGSGTLHARDITTDTGWKMVLDRGLDIFQPTPRKMNGFSLGERMQEHRMVRGFYVTYVENL

SEQ ID NO: 4253 - protein, 679 aa, Pseudomonas fragi
METQVDKDLDQLLNEHFAGRVVRKDLTKLIKEGANVPVYVLEYLLGMYCASDDSEVIEQGLKNVKKILAENYVRPDEAEKVKSLVRERGTYKVIDRVTVRLNEKKDRYEASFSNLGIKDAEISAGIVKEYEKLLVGGIWVIATLSYYHEEGQSGSPFGVTLLKPIQMPNMNMQELFEGRAALSTVNWRETLIRSIGMEPSTLDESVQWHLLARMVPFVENNYNVCELGPRGTGKSHIYKECSPNSMLVSGGQTTVANLFYNMSSRRIGLVGLWDVVAFDEVAGINFKDRDGVQIMKDFMASGSFGRGREQMEASASMVFVGNINQSVESLVKTSHLLAPFPEQMIDAAFFDRFHAYIPGWEIPKMRPEFFTNRYGLIVDYLAEFFREMRKHSFADAIDKHFKLGNNLNQRDVIAVRKTVSGLLKLLYPHDVFTKEDVRQCLEYALQVRRRVKEQLKKIGGMEFYDVHFSYIDNETLEEHFVTVKEQGGGGLIPEGPGKPGFIHTIGLSGKGMPGLYRIELQVTKGTGKLATSGLWNSSSAKEQVKIAFDYFKANASRISASAKVLEHDFHLHVVELQNTGPLTHMALPSLVAFASGLMGRPAQGQMVVLGDMSLGGSITPVESIAECLQVAFDAGGKRVALPMSSAKDIPSIPAELFTKFQTSFYGEPVEAVFKAMGVD

SEQ ID NO: 4254 - protein, 683 aa, Vibrio cholerae; identical to SEQ ID NO: 4029

SEQ ID NO: 4255 - protein, 705 aa, Faecalibacterium prausnitzii
MEPNAENSCRRDEIKEKLRQNFDGKIVRKDLTKKIKEGANVPVYVLEFLLGQYCSSDDEAIIEKGVQNVKRILADNFVRPDEAQKILSQLRKKGSHTVIDMITVNLDIKKNCFFASFSNLGLDKVPIADEYPEKYDRLLCGGIWCIVQLDYEVEGDNNFGLVDLGGEPLQSSQKKQKNLTPISIRKLTPIQMPHIDIDELKRGHKAFTKDEWLDILLRSIGMEPDEFTEREKWLLLTRMIPLVENNFNLCELGPRSTGKSHLYKEISPNSILISGGQTTVANLFYNMGRKSVGLVGLWDCVAFDEVAGIKFKDKDGIQIMKDYMASGSFARGKEEKAASASMVFVGNINQSVDVLLKTSSLFDPFPPEMGTDTAFLDRIHCYLPGWEIPKFRPEHFTNDYGFISDYLAEFIRELRKEQYGDALDHYFRLGKNLNQRDTIAVRRMVDGYLKLMYPDGVFDKSELEEVLQISLEMRRRVKEQLKKLGGMEFYDVNFSYIDLEDMSEHYVSVPEQGGGKLIPDGMCNPGQVYTVSRGKSGMIGVFRLESQMLPGSGKFERTGLGSDRDCKESTNTAFNFLKANGKRISGGISTASKDYIINYQDLQGIGMTGKLALPTLIALCSIALGRPTVSTLAVLGEISISGTILKVDELANSLQVCLDSGAKKVLLPITSAADFGTVPPELVGSFNLIFYSSAEDAVFKALGVE

SEQ ID NO: 4256 - protein, 679 aa, Acinetobacter sp.; identical to SEQ ID NO: 4073

SEQ ID NO: 4257 - protein, 693 aa, Bacteroides sp.
MTLQQKIMNAFLGKVVRKDLAFLVKGGLPVPTYVLEYLLGQYCACDDEATIEEGLEKVRQVIQDNYVHRAESEVIKGKIREQGCHRIIDKVTVTLNEKADEYQAHFANLGLTNVPIGTQYVTNNPKLLSGNGVWCIVTIGYISGEDIKVRWEIQTLKPVQISNVDVQDYIDKRKNFTTEEWLDFMMHTVGLNPDTLNRREKFITLARLLPHVENNFNFMELGPKGTGKSHVFQELSPYGVLVSGGDVTSPRLFVKMSGNKEILGLVGYWDVVAWDEFEQQKGRAVDAVLIDTMQNYLANKSFNRGKGTHEASASICFVGNTKHTVPYMLKNSHLFESIPTSFIKGAFLDRIHLYNPGWEIRMLKKDSFSKGYGLITDYIAAIMHELRNKDLTALLKDYAKFDGSLSERDHLAIRKTFSGMVKLIYPDGNMTDEEAFELIDFAAESRKRVKDQLYIVDETFNAEPAKFRYVREKDGVEINVETLEKVSNALIIPNNIHQESTIMANLDDSDIPLFQEGTETTMQVEPSSERQSRKRFIPLQEKNQFFRLGQTGVTYQSLFAEYLKDATEITIEDPFIRTSWQVKNLMEFLTMLIDTRDVDDLKVHLVTNEEEDKLPDLIDKLDDIKNDMIGYGIEFDYNFREFHDRCIKADNGWVISMGRGLDIYEKYSPYSVAATRPDKRKCKEFMVTFTKDK

SEQ ID NO: 4258 - protein, 746 aa, Proteus mirabilis
MNGNNDKDLIDHQGQSEEWIGAEHETPANVTQNIYVANMQVNVDEAGVEPEAPSEVIPSDISMSEREIRDMKNSDLDGLLNLHFKGRVVRKDLTKQLKEGANVPVYVLEYLLGMYCASDDDEVVMQGLENVKKILAENYVRPDEAEKVKSLIRERGTFKIIDKVSVKLNQKKDVYEAALSNLGIKDALVPTKIVQDNEKLLTGGIWCIITVQYFFEEGQKTSPFSIMSLKPIQMPSMNMDEVFSTRRHFSTDQWMDVLLRSVGMEPTNLEHRVKWHLITRMIPFVENNYNVCELGPRGTGKSHVYKECSPNSLLISGGQTTVANLFYNMSSRQVGLVGMWDVVAFDEVAGIHFKDKDGVQIMKDYMASGSFARGRDSIEAKASMVFVGNINQSVETLVKTSHLLAPFPDAMIDTAFFDRFHSYIPGWEIPKMRPEFFTNSYGLITDYLAEYMREMRKRSFADAIDKFFKLGNNLNQRDVIAVRRTVSGLLKLLHPDAQYTKDDVRACLTYALETRRRVKEQLKKLGGMEFFDVHFSYIDNESLEEFFVNVPEQGGSKLIPEGLPRAGVVHLVTQGSTGQLGLYRYETQMMAGSGKHSVSGLGSNTAAKEAVRVGFDYFKGNLNRISASAKFSDHEYHLHVVELHNTGPSTKSSLVALIAFCSILMNRPIQEQMVVLGEMTLGGVINPVQDLAGSLQLAMDSGAKRILLPMASASDIPTVPAELFSKFQISFYADPVDAVFKALGVN

SEQ ID NO: 4259 - protein, 678 aa, Bacteroides sp.
MLELDKKLLDQFQGYVVRKDVVRSVKGGANVPVFVLEYLLANSCSTDDEQKIKEGVENVKNVLRKHYVNPDEANLIQAKIREEGTYKVIDKISVRLDASKDKYWAELSNLNIRDANIDDRVVTEHEKMMMGGIWAIVDITYDSTMAIGSKLYPFVVSKVRPIQLSNFDMSRISSNRKNFTNEEWLNVLLRSGGYEPESEGMTQRMKMLLLSRFIPMVEANFNMAELGPRSSGKSYVFKELSPYSMLVSGGQGTAASLFVNNSNGQIGAMGKWDAVCFDESTDELFKDREVVPLMKDYMESGSFSRAGKSGEKSANASIILNGNINQPVETVLQTSHLFSPFSDKISDDTAFLDRIGFFLPGWEIMKFAPTNFTNHFGFSTDFFSEMLHALRKDNYTNAIDEYFTLGSQMRQRDTKPVRKTVSGLIKLLHPDGKYTKEDVRVYLEWAIEMRRRVKEQLKRIGGMEFWDTNFSYIDKETQEETFVPVPEERGSGLIGDSPLPPGTCYSATSDGDKVALVKIEVITMAGNGKLNISGTNSATVKEDIKNTYNYMRANEKMLLSQQRSFANMDVTVQVTALLGSAVQSGIGGAVFAAIISSVFSKNLKPALGIIGNISIGGAIERAINFSDKVSILSENGAKTVLVPMDNLIELSTLPTTVLGKTDVPFYANTQMIIQKMML

SEQ ID NO: 4260 - protein, 694 aa, Salmonella enterica; identical to SEQ ID NO: 4088

SEQ ID NO: 4261 - protein, 679 aa, Pseudomonas fuscovaginae
MDTYQDKDLDQLLNEHFAGRVVRKDLTKLIKEGANVPVYVLEYLLGMYCASDDTEVIAQGLKNVKTVLAENYVRPDEAEKVKSLVRERGTYKVIDRVTVRLNERKDRYEASFSNLGIKDAEISAGIVKEYEKLLVGGIWVIATLSYYHEEGQNGSPFGVTLLKPIQMPNMNMQELFSGRAALTTEQWREALIRSIGMEPSTLDGSVQWHLLARMVPFVENNYNVCELGPRGTGKSHIYKECSPNSMLVSGGQTTVANLFYNMSSRRIGLVGLWDVVAFDEVAGINFKDKDGVQIMKDFMASGSFGRGREQMEASASMVFVGNINQSVESLVKTSHLLAPFPEQMIDAAFFDRFHAYIPGWEIPKMRPEYFTNRYGLIVDYLAEFFREMRKRSFADAIDKYFKLGNNLNQRDVIAVRKTVSGLLKLLYPHDQFTKEDVRCCLDYALQVRRRVKEQLKKIGGMEFYDVHFSYIDNETLEEHFVTVKEQGGGTLIPEGQSKPGFIHTIGLSGKGMPGLYRLELQVTKGSGKLATSGLWNSSIAKEQVKIAFDYFKANASRISASARVLEHDFHLHVVELQNTGPLTHMALASLVAFASGLLGRSAQGQMVVLGDMSLGGNIAPVESIAECLQVAFDAGGKRVALPMSSALDLPTIPPELFTKFQTSFYADPVDAVIKALGVD

SEQ ID NO: 4262 - protein, 683 aa, Vibrio cholerae; identical to SEQ ID NO: 4029

SEQ ID NO: 4263 - protein, 706 aa, Roseburia inulinivorans; identical to SEQ ID NO: 4122

SEQ ID NO: 4264 - protein, 694 aa, Salmonella enterica
MQTHHDLPVPAVSEGELVAEGYDLDALLNQHFRGRVVRKDLTKQLKEGANVPVYVLEYLLGMYCASDDDQIVEQGLQNVKRILADNYVRPDEAEKVKSLIRERGSYKIIDKVSVKLNQKKDVYEAQLSNLGIKDALVPPQMVKDNEKLLTGGIWCMITVNYFFEEGQKTSPFSLMTLKPIQMPNMDMEEVFTARTHFSRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFYKLGNNLNQRDVIAVRRTVSGLLKLLHPNGSYSKEDVRVCLTYAMEARRRVKEQLKKLGGLEFFDVNFSYIDNETLEEFFVSVPEQGGSELIPAGMPKPGVVHLVTQAESGMTGLYRFETQMTAGNGKHSVSGLGSSTSAKEAIRVGFDYFKGNLSRVSATAKFSEHEYHLHVVELHNTGPSTATSLAALIALCSVLLAKPVQEQMVVLGSMTLGGVINPVQDLAASLQLAFDSGAKKVLLPMSSAVDIPTVPAELFTKFQVSFYSEPVDAVYKALGVN

SEQ ID NO: 4265 - protein, 691 aa, Acidovorax sp.
MTQELNPSIAAPPSEALESAADASLDDLLNTHFAGKVVRKDLTKLIKEGANVPVYVLEYLLGMYCASNDEATIQNGLQMVKRVLAENYVRADEAEKVKSKVRESGTYKVIDKITVKLNEKRDLYEALLSNLGVKNAEISDSYVRQFEKLLVGGIWCIVTLKYHFEEDQRGSPFTVTELKPIQMPNMDMQALFEARKAFTDAQWIDALIRSTGMEPTCFKEREKWHLLARMVPLVENNYNFCELGPRGTGKSHIYKEISPNSILVSGGQTTVANLFYNMSARKVGLVGLWDVVAFDEVAGINFKDHDGVQIMKDYMASGSFSRGRESINASAAMVFVGNINQSVESLVKTSHLLAPFPEAMIDSAFFDRFHAYVPGWEIPKMRPEFFTNQYGLIVDYLAEYLREMRKYSFADAIDKWFKLGNNLNQRDTIAVRRTTSGLLKLVCPNGEYTKESVRKCLEYALETRRRVKEQLKKIGGMEFYDVHFSYIDLEDGVERFVTVPEQSGGALVPEGRLQPGTLHTISMGASEMPGIYRLEIQSIPGGGKVNVSGAAPREAVKVAFDYFKANSSRVSASIKPGERDFHTHLVELQNSGAPQALTLASFIALCSAALAKPVQSQLAVLGDMSLGGTIVQVRNLAESMQVAFDAGAKRILLPMSSVTDIPSVPGELFAKFQTSFYSDPVDAAFKALGVE

SEQ ID NO: 4266 - protein, 681 aa, Desulfonatronospira thiodismutans
MELDYLDKKASQVLDGYLVRKDLVRTFSRQFPVPTYVVEFLLGRYCASVEWEEIEEGLEIVQKQLKSRTVKAGEEELFKARAKEAGQVKIIDSITARLDARTDSYITALPSLRLTDVRIDPELVIKNERMLTGGFYAEITLSYDPYIAQEKNGRPFGVEALREIQLSQRDVLDHLAEARKHFSTEEWKDFLLRSIGLEASTLSPRQKNAFMLRMVPFVERNYNMVELGPRGTGKSHLFQQVSPYAHLISGGKATVARMFVHMGTGQRGLVCQYDVVCFDEISGISFDQKDGVNIMKGYMESGEFSRGRDSIRADGSIVMVGNFEVDVEHQQRIGHLFGPMPQEMRDDTAFMDRLHAYLPGWDIPKISKKYLTDHFGLVSDFLSECWSRLRDESRVNLLQNRVFFGGALSGRDSNAVNKTISGLLKLLYPQDPLEIPDEELEWATQIALESRRRIKEQQKRIGAAEYRNTHFSYTIGTDGVEKFVSTPELHSENSIGADPLEPGQVWAISPGIENENPGLYRVEVNSGPGSGIKILNKPVPPAFKESMGYAEQNLYSRAAQLVGDKDPRSHEYTVQLRAFDAARSGAKLGVPALIALCTSLVRKSVRGGLVICGEINLGGSIEPIHNAVSMAEIAVEKGAVALLMPVSCRRQLIDLSDDMATKIDIQFYSDARDAFMKAIAD

SEQ ID NO: 4267 - protein, 686 aa, Oribacterium sp.; identical to SEQ ID NO: 4050

SEQ ID NO: 4268 - protein, 675 aa, Magnetospirillum sp.
MSDSLDDLLNAHFAGRVVRKDLTKLVKEGANVPVYVLEYLLGMYCASNDDVTIREGLESVKKILAENYVRPDEAEKVKSKIRERGSYKVIDKVTVHLNEKRNVYQALLSNLGVKDAEMPDHYVRQYEKLLVGGIWCIVTIQFYHEEGQKGSPFIVSDLKPIQMPNMDMEELFEGRKAFSESQWIDVLVRSSGMEPTTLSERVKWHLLARMVPLVENNYNVCELGPRGTGKSHIYKEISPNSILISGGQTTVANLFYNLGRRTVGLVGLWDCVAFDEVAGITFKEKDGVQIMKDYMASGSFARGKDAVSAYASMVFVGNINQPVDTLVKTSHLLAPFPDAMIDSAFFDRFHAYIPGWEIPKMRPEFFTNQYGLIVDYLAEFFREMRKRTFGDAIDKFFKLGNNLNQRDTIAVRRTVSGLLKLLYPHEGYDKDAVRRCLEYALETRRRVKEQLKKIGGMEFYDVHFSYIDQESMEEKWISVPEQGGGKIIPEGPLKPGVLHTVATGAAAHLGLYRFETQVTAGNGKLTTSGLGSNSGAKEAVKVAFDYFKANLTRVSGISKAGDHDFHLHTVELHNTGAAKAMTLASFVAFCSAIIQKPLQSQMVVLGDMSLGGSVVPVENLAECLQVAFDSGAKRILIPMSSAADIPTIPAELFAKFQTSFYSDPVDAVFKALGVD

SEQ ID NO: 4269 - protein, 694 aa, Escherichia coli; identical to SEQ ID NO: 4056

SEQ ID NO: 4270 - protein, 683 aa, Vibrio cholerae; identical to SEQ ID NO: 4029

SEQ ID NO: 4271 - protein, 679 aa, Acinetobacter baumannii
MESANDKELDQLLNEHFAGRVVRKDLTKLIKEGANVPVYVLEYLLGMYCASDDPEIIEQGLRNVKTVLAENYVRPDEAEKVKSLVRERGSYKVIDRVTVKLNERKDKYEASFSNLGIKDAEISAGIVKEYEKLLVGGIWVIATLSYYFEEGQTSSPFGVSLLKPIQMPNMNMDELFSGRAALSTDQWRESLIRSIGMEPASLKEDVQWHLLARMVPFVENNYNVCELGPRGTGKSHIYKECSPNSILVSGGQTTVANLFYNMSSRRIGLVGLWDVVAFDEVAGISFKDKDGVQIMKDYMASGSFARGREQMEASASMVFVGNINQSVESLVKTSHLLAPFPEAMIDSAFFDRFHAYIPGWEIPKMRPEFFTNRYGLIVDYLAEFFREMRKRSFADAIEKYFKLGNNLNQRDVIAVRKTVSGLMKLLYPHGRFNKEDVRQCLEYALQVRRRVKEQLKKIGGMEFYDVHFSYIDNDTLEEHFVSVKEQGGGGLIPEGPAKPGFLYTIGLSNKGMPGLYRLELQVTKGSGKLATSGLWNSSSAKEQVKIAFDYFKANASRISGGSKVLEHDFHLHVVELQNTGPLSHLALPSLVAFASGLLGRPVQNQMVVLGDMSLGGSVTPVESIAECLQVAFDAGAKKVALPMSSAADIPTIPVELFTKFQTSFYADPVDAVFKALGVD

SEQ ID NO: 4272 - protein, 679 aa, Acinetobacter baumannii; identical to SEQ ID NO: 4114

SEQ ID NO: 4273 - protein, 659 aa, Magnetospirillum sp.
MVRKDLTKLVKEGANVPVYVLEYLLGMYCASNDEVTIREGLESVKKILAENYVRPDEAEKVKSKIRERGSYKVIDKVTVHLNEKRNVYQALLSNLGVKDAEMPDHYVRQYEKLLVGGIWCIVTIQFYHEENQKGSPFIVSDLKPIQMPNMDMEELFEGRKAFDEAQWIDVLVRSSGMEPTTLSERVKWHLLARMVPLVENNYNVCELGPRGTGKSHIYKEISPNSILISGGQTTVANLFYNMGRRTVGLVGLWDCVAFDEVAGITFKEKDGVQIMKDYMASGSFARGKDSVSAYASMVFVGNINQPVDTLVKTSHLLAPFPEAMIDSAFFDRFHAYIPGWEIPKMRPEFFTNQYGLIVDYLAEFFREMRKRTFGDAIDKFFKLGNNLNQRDTIAVRRTVSGLLKLLYPHEGYDKDAVRRCLEYALETRRRVKEQLKKIGGMEFYDVHFSYIDMESMEEKWISVPEQGGGKIIPEGPLKPGVLHTVATGAAAHLGLYRFETQVTAGNGKLTTSGLGSSSGAKEAVKVAFDYFKANLTRVSGVSKAGDHDFHLHTVELHNTGAAKAMTLASFVAFCSAIIQKPLQSQMVVLGDMSLGGSVVPVENLAECLQVAFDSGAKRILIPMSSAADIPTIPAELFAKFQTSFYSDPVDAVFKALGVD

SEQ ID NO: 4274 - protein, 694 aa, Escherichia coli; identical to SEQ ID NO: 4056

SEQ ID NO: 4275 - protein, 683 aa, Vibrio cholerae; identical to SEQ ID NO: 4029

SEQ ID NO: 4276 - protein, 712 aa, Bacteroides sp.; identical to SEQ ID NO: 4204

SEQ ID NO: 4277 - protein, 683 aa, Vibrio cholerae; identical to SEQ ID NO: 4029

SEQ ID NO: 4278 - protein, 694 aa, Escherichia coli; identical to SEQ ID NO: 4056

SEQ ID NO: 4279 - protein, 683 aa, Vibrio cholerae; identical to SEQ ID NO: 4229

SEQ ID NO: 4280 - protein, 684 aa, Methylophaga aminisulfidivorans
MNQLDKKINEQFPGLVVRKDLVKTVKGNAIVPSYVLEYLLGQYCATSDEATIETGIETVKEILAKHYVHRNEAGLIRSTIREKGRHKVIDKISVALNDKKDVYEAEFSNLGIKKVLIDSDTIKRHPKLLVGGVWCIADIEYEHTEDKDASPWILASLKPIQMSHFDYESYIDARKKFSLDEWIDVLIQSVGFNPEYFGRRSKLIQLIRLIPFCERNYNLIELGPKGTGKSHIYSEFSPHGILISGGEVTVPKLFVNNSSGKIGLVGYWDCVAFDEFAGKKKRVDKALVDIMKNYMANKSFSRGVETLGADASMVFVGNTEHSVPYMLKHSDLFDALPEKFYDSAFLDRLHFYIPGWEVDIIRGEMFSNGYGFVVDYLAEILRHLRNQDFSDQYKEHFTLSSDISTRDRDAINKTFSGLMKILFPHGGATQENIEEILTLAMEGRKRVKDQLLRIDTTYADVDFSYQSQTGKKIRVRTLEEKEYPNYFHHTVAEGDDGDLEEYQFQDGTSSGQTQTNTTTDPAPEEKHLTFEENQKGLSYDSLFGAYLRGATDITITDPYIRAFYQIRNVMELLETIVKFKSDDEEVAVHLITVEDDFKGEQQKEHFEKMKEASAMLGISFSWDFDNSGAQHARHIVTDHGWKISLDRGLDIFQHYEMGDAFSFANRMQKYRQCRAFEVTYIKQH

SEQ ID NO: 4281 - protein, 694 aa, Escherichia coli; identical to SEQ ID NO: 4056

SEQ ID NO: 4282 - protein, 683 aa, Vibrio cholerae; identical to SEQ ID NO: 4029

SEQ ID NO: 4283 - protein, 696 aa, Photobacterium sp.
MGKQMNELNQKICSEFAGLVVRKDLVKTVKGNAIVPSYVLEYLLGQYCATSDEASIESGIQTVKEILAKHYVHRNEAGLIRSTIREKGRHKVIDKVSVSLNDKKDVYETEFSNLGIKKVLIDSGTVKKHPKLLVGGVWVIADVEYDHTEDKDASPWILSTIKPIQMSHLDYDSYIGARSKFSLDEWIDVLVQSIGFNPEFFGRRSKLMQLVRLIPFCERNFNLIELGPKGTGKSHIFSEFSPHGILISGGEVTVPKLFVNNSSGKLGLVGYWDTVAFDEFAGKQKKVDKALVDIMKNYMANKSFSRGVEMLGADASMAFIGNTEHSVPYMLKHSDLFDALPEKFYDSAFLDRLHFYIPGWEIDIIRGEMFSSSYGFVVDYLAEVLRHLRNQDYSDHYSEYFKISPQISTRDRDAIHKTFSGLMKILFPQGGASEEEIEEILKFSMEGRKRVKDQLFRIDSTYADVNFAYTDKAGNETPVQTLEELQYPNYFNKTVGDVTDIGMPEPEIPSYQESDHKVQPIAGASSATVSDEPTLKEQHLTFSENQRGVSYDSLIGPYLKGAKHITITDPYIRIFYQAKNLMELLETIVKQKAEEDEVVVSLVTVEDEFKGEQQREYFDKIQSSMFAVGIKFAYSFDTSGSQHARHIVTDIGWKVSLDRGLDIFQHYDVNDAFSLSTRLQKHRSCKQFEVTFIKVE

SEQ ID NO: 4284 - protein, 683 aa, Vibrio cholerae; identical to SEQ ID NO: 4029

SEQ ID NO: 4285 - protein, 671 aa, Fusobacterium sp.
MDINEIGSKVFEGKIVRKDLVSKIKGGANVPVYVLEYLLGMYCNQTDEESIEEGMSKVKKILAENYVRPDEAEKVKSKIKEIGVYNVIDKVTVVLNEKKDRYEGHLSNLGVSNIEIHKSYIKDYEKLLSGGIWCILTLSYQYDEYNATDSPFKLNKLKPIQIASLDMNEVYEARKHFTKDEWIGFLLRSSGMEFENFDKDAIWHLLARMMPLVENNYNLCELGPRGTGKSYIYKEISPNSILLSGGQTTVANLFYNMSKRQVGLVGYWDVVAFDEIAGIKFKDKDGIQIMKDFMASGSFARGKEEKNANASMVFIGNINQSVDVLVKTAHLLVDFPPEMNNDSAFFDRMHCYIPGWDIPKLSPKSFTKEYGLIVDYMAEIFRELRKTSYGDALDRYFSLGRDLNQRDTIAVRKTVSALIKLVYPDGIFTKEEVEEILIRALEYRRRIKEQLKKMAGMEFFATNFSYIDKESGEEKYVGLKEQGGTKLIPEGPLKAGALYTIAMSTNSVKGLYKIESQISAGKGKITVSDNKYRKTFENAFNYLKINSKRISGAINISEKEFYLSVADEKNVGNTETITLGGFIAMCSISLNRQLMPQTVILGEMALSGSINAVSDLASTLQIAREAGAKKALIPILNAVDMSILPPDILMDIQPIFYQDPIDATQKALGLM

SEQ ID NO: 4286 - protein, 676 aa, Clostridium perfringens
MDELSIKLNQSFAGKVVRKDLTQKLKQGANVPTYVLEYLLGMYCATDDEESINEGVERVKNILSDNFVRPDEAEKIKSKIREMTRYTVIDKLTVKLNEKRDIYVAEFSNLGLKDIEISSNYVKDFDKLLGGGIWCIVKLEYYYDENEKLSTPFIIESVTPIQMPNMDIDELIKGRRDFSKEEWIDILIRSIGMEPTQLEENVKWHMLLRMVPLCENNYNMCELGPRGTGKSHLYKEISPNSILISGGQTTVANLFYNMARRKIGLVGMWDTVAFDEVAGITFKDKDGIQIMKDYMASGSFARGKEEKAASASMVFVGNINQSVDVLLKTSHLFEPFPEVMAYDSAFFDRMHFYLPGWEIPKMRPELLTNSFGFITDYLAEYLREMRKRTFGDSIDKYFRLGNNLNQRDVIAVRKTVSGLIKIIYPHGEFEKEDLEEILRYALVGRRRVKEQLKKIGGMEFYDVHFSYMDNETMREEFISVPEQGSGSLIPEGLGRAGHVYTIGIGDSGMIGIYKIETEVISGSGKFEKTGLGYSREAKESIETAFRYFKANSRNMSSSISTTTKDYLMHIQDVNGVGMTSSLSLAAIIAMCSGALNKPVQSQLVILGSVSIGGTINKVEDLANTLQVCFDAGAKKILLPMVNAGDIALVPPELFAKFQIMFYSTAEDAVFKALGVQ

SEQ ID NO: 4287 - protein, 726 aa, Actinomyces neuii
MSERNQLEAKAAEYFPGYIVRKDLVQQVKGNAVVPTYVLEFLLAQYCASTNEAEIAAGVESVRKILAKHYVNRGESELIKSRIREQRGYRIIDKVSVSLDERKDRYVAAFENLGVRDALVSDQTVQGNDRLLTGGVWCMADITYTADVAVGGKPKEGPWTVTNLNAIQLPFFDRDGYVAAREQFDTAEWIDLLIASIGFNPEKLSRRAKLLQLTRLIPYVERNYNLVELGPKGTGKSHIYSELSPHGMLVSGGEVTLAKLFINNTTRQIGLVGFWDVVAFDEFAGKKKVKQNLVDTMKNYLANKSFSRGDSPVTAEASMVFVGNTSNTVPAMLANSDLFESLPEAYHDTAYMDRIHYYIPGWEVDVIRPELFNRGYGFVVDYLAEALRAFRAEDYSGRFAQYFDLDREMSTRDRDAVRKTFSGLMKLVHPSGQASEHEVEDLLRYAIEGRRRVKEQILRLDATMRESGLHFSYAPASGGNPREVVTQEELDYPELFGRDAQDGLAEAASGEAASGERAKPAAAESAKVAATGPAKVEGAGPASCAGSAGNGGSGKQAAAGPRERRLEVPENKLGVSLQRLLVDYLVGAAKVEIVDPYVRMPYQVENLYEVLATILAVKPRGETVDVKLLTGCDREHLEWVDNQRDMLEQLQNNFAKYGLNFSFEIGKAGHDRKITTDTGWSIDLGRGLDIYQPWTSDGAFDPRRRVTHYRRTKAFTFTASRQEREN

SEQ ID NO: 4288 - protein, 677 aa, Enterococcus faecium; identical to SEQ ID NO: 4030

SEQ ID NO: 4289 - protein, 694 aa, Escherichia coli; identical to SEQ ID NO: 4043

SEQ ID NO: 4290 - protein, 683 aa, Vibrio cholerae; identical to SEQ ID NO: 4029

SEQ ID NO: 4291 - protein, 683 aa, Vibrio cholerae; identical to SEQ ID NO: 4029

SEQ ID NO: 4292 - protein, 683 aa, Vibrio cholerae; identical to SEQ ID NO: 4029

SEQ ID NO: 4293 - protein, 682 aa, Xanthomonas vesicatoria
MVELDQIDRKAASELDGYLVRKDLVRTFSRQFPVPTYVVEFMLGRYCASIDQEEIDEGLEIVQRQLKSRTVRAGEEELFKARALETGEVKIIDLVTARVDNKGEYVASLPSLRLTDVRISSELVNQHERMLTGGFYAELGVTFDVAIAQEAKGRPFGITSLREIQLSKRDVLDTLAKARQSFTTEEWKCFLLRSIGIESGGLSDRERNALFLRMVPFVERNYNLVELGPRGTGKSHLFQQVSPYAHLISGGKATVAKMFVENTAKGRRGLVCQYDVVCFDEVSGISFDQKDGVNIMKGYMESGEFSRGKESIRADGSIVMVGNFDVDVEYQQRIGHLFGPMPPEMRDDTAFMDRIHAFLPGWDVPKINKELVTNHFGLVSDFLSECWSQLRSQSRVSELQSRVFFGGALSGRDTNAINKTVSGLLKLLYPSADVPVPDEDLEWAVRIAMEVRRRVKEQQKRVGAAEFRNTHFSYIMDADGVEKFVSTPELQSENSIGGDPLEPGQVWTISPGGGEEGSGLYRIEVNEGPGSGVKVLNKPIPPAFRESIGFAEQNLYARSMQLVGDKDPRQHEFTVQLRAFDAAKSGAKLGVASLVALCTSLLKRNVRGGLIIVGEINLGGSLEPVHNAVTIAEIAVEKGAASLLMPVACRRQLVDLSDDMATKIDIQFYSDARDALMKATAD

SEQ ID NO: 4294 - protein, 687 aa, Lactobacillus zeae
MTSDEHNDRSQADPQVDPTVAKLEQSFPGRFVRKDLTQRIKEGANVPIYVLEFLLGQYANSSDPQLIEDGVERVKKTLAHNYVRPDEAEMVKSKIRENGAYTVIDKLTVQLNERADRYEAFFSNLGLTNVPVDERYVQDYERLLIGGIWSIVRVEYQHDNEDHFTIEKLTPIQVPFVDMKEVYEGRKAFTTDEWLDVLLRTTGMEPTQFTEREKWLLLSRLIPFVENNYNFVELGPRGTGKSHVYKELSPDSILVSGGQTTVANLFYNMARREVGLVGMWDVVAFDEVAGIKFKDNDGVQIMKDYMASGSFARGRDQIQASASMVFVGNINQSVDVLLRTSNLFEPFPEVMGTDTAFLDRIHNYLPGWEIPKYRPEFFTKGFGFITDYFSEVMRELRKTSYGDAIDPYFNFGKQLNQRDVIAVRKTVSGMIKLLYPNGIFNKAEVAKVLEFALEMRRRVKEQLKRIGGMEFYDVNFSYIDKETFEEKFVSVPESGSSSLIPVGQENPGHVYTVAYDDSERLSLIKLETQVVPGSGKLSKTGVGSSGKAKEAMDTAFKYLKANYKSIDQRIAAEARDFVVSETNLNNTVPSSHISLATFVALVSIALGRPTLDQLVILGDFTIGGTISRIDNLPDVLQVAQDSGAKRVLIPTSSASEISAVPADLMSSFNLNFYSSVEDAAFKALGAN

SEQ ID NO: 4295 - protein, 712 aa, Bacteroides ovatus; identical to SEQ ID NO: 4204

SEQ ID NO: 4296 - protein, 694 aa, Escherichia coli; identical to SEQ ID NO: 4056

SEQ ID NO: 4297 - protein, 694 aa, Escherichia coli; identical to SEQ ID NO: 4056

SEQ ID NO: 4298 - protein, 683 aa, Coprobacillus sp.
MEESISNREEIKEKLRKYFDGKIVRKDLTKKIKEGANVPVYVLEFLLGQYCSSDDEDIIIAGVDKVKKILSDNFVRPDEAQKILSLLRQKGSYAVIDKMTVRLDVKKDTYLGEFSNLGIKDIPLSEDYPTKYDRLLCGGIWCMVTLDYEFIEEDKKSNPIKIRNLKPIQMPHVDIEELKTNREMFNKDEWIDILLRSIGMEPDELTNREKWLLLLRMVPLVENNFNLCELGPRSTGKSHLYKEISPNSILVSGGQTTVANLFYNMGRKTVGLVGLWDCVAFDEVAGINFKDKDGIQIMKDYMASGSFARGKEEKAASASMVFVGNINQSVDVLLKTSSLFDPFPPEMGTDTAFLDRMHCYLPGWEVPKFRPNHFTDDYGFITDYLAEFIRELRKDNQGDALDKYFRLGKNLNQRDTIAVRKMVSGLIKLIYPDSKYNKDDLEEILKISLEMRRRVKEQLKKLGGMEFYDVNFSYVDNDTFEEKYVSVPEQGVGTLIPEGILNPGQVYTVGQGKSGMLGVFRLESQMLPGNGKFEKSGLGSDTKYKESANAAYNFLKANANRISGSISTTSKDYIINYQDLQGIGMTDKLALSTLVAICSIALGKPVISSSVILGEISVAGSIMKVDELANSLQVCLDSGAKKVLLPITSAGDLSMVPPDLIGHFNLVFYQSAEDAVFKALGVE

SEQ ID NO: 4299 - protein, 482 aa, Thermomicrobium roseum
MTSVARVVSGSESLADKVERVFRGLVIDKRRLPASQLQKRGVPAYVGEWLLDTLVPGRGELTEEEARKVREWAEKYVPGPNDQQIIKHRLLQGEVIKVLTPVQVEVSLARATRSAKLRLLGIEDAAISDELPTRYPDLLRQGMWGVVELLSTGDGVAIQSFRPMQASLDLGLYKEARQEFTLDEWLRLMLTSMGYAPEAFTAEEQLWLIARLLPLVQKNLHLVELAPKATGKSYFYENISPRVRLVSGGNITPAVLFVNNATGQWGLLARYAVVVLDEVQTLKFEKPEEIIGGLKGFLANGRLTRGGLHEASSDCSFVMLANVPLDEKQEPIIQQNSLVDYLPEFMRETAFLDRIKGLLPGWKIRKLSKEAFANSVGLKADFFGDALLTLREDLEIDQYCARRIRLRGNRPYARNEIAVQALASGMMKILFPHGRVSDWDFRHYCVEPAVQLRQGIWDLLYQLDGEYRQWDRLIEAEIVPMS

SEQ ID NO: 4300 - protein, 680 aa, Acidiphilium multivorum
MSNGTLPARDALDNKANQLFAGKVVRKDLVRKVKVGANVPVFVLEFLLGKYCASSDEVAIQMGLQVVNDTLANNYIRPDESAKAQSKVKESGKYSFIDKVKVRLVDSDYWAEGVNFNNKFLHIPSQYVRDYERLLMGGVWAQVDMRFETDEESKGKNPFWIDKLVPIQIATFDLDEYRNVRKQFTTDEWLDLIVRSMGYEPGEMSRRLKLLFLVRLIPLTERNYNLVELGPRGTGKSYVVQEVSPYTALLTGGTTVANLFGHMSGRQKGMVQIWDVVGFDEVADLQKMPKEVITTMKTYCESGTFQRGQEAVAGDASIAMFGNTNQPIDVMVQTGHLFAPMPDTIRDDMAFIDRLHFYLPGWEIPQMRNELFTDHYGFVVDYLAEALRDMRKHNFTEIIDRFFSMGAHLNARDRKAVRKTASGLVKILFPHGDVTQEELAEILELALEGRRRVKEQLKKMGSFEYYQTSFSYTLQDTGEERFVGVPEQGGRDLISADPLSPGSVYTAGVTSDGTVGLYRLEVSVSSGTAKLRLAGGISGAMKESVQRAFSYVQAKKVELGITRDLETSDLHVEVIDLLGNRVEAEIGVAFFVAAYSALRKVPVSPALLVLGDMSVQGNIKPLRSLTEPLQVAKDNGAKRSLIPIENKRNFLDVSADIMEHVDPIFYGDPKTAAMKVLGNV

SEQ ID NO: 4301 - protein, 702 aa, Acidithiobacillus ferrivorans
MSALDDKINQHFAGLVVRKDLVKTVKGNATVPSYVLEYLLGQYCATNDEATIQTGIETVKEILRKHYVHRNEAGLVRSTIKEKGRHKVIDRISVSLNDKDDVYEAEFANLGIKKVLINAGTVKAHQKLLVSSVWCIADLEYEYSEEKSGSPWVLASLKPIQISRFDLDGYLAARKQFSTDEWIDLLIQSLGFNPQMFGKRNKLLQLIRLIPFCERNYNLIELGPKGTGKSHVYSEFSPHGILISGGEVTVPKLFVHNGTGKLGLVGYWDVVAFDEFAGKQKRVDKALVDIMKNYMANKSFSRGVETLGAEASMVFVGNTDHTVPYMLKHSDLFDPLPEKFHDSAFLDRIHYYIPGWEVDVIRGEMYSDGYGFVVDYLGEILRTLRGDDFSDRYKKRFSLSNEISSRDRDGINKTFSGLMKIIFPNDDASDAEIEEVLRYAIEGRKRVKDQLLRMDHTYPEVRFAYQSSDGQEVLVHTLEEEEYPSQYHRQLAADISLQELPFDVMGVAPVAHAAPAMEMLASPMNAAAGSDLVLKEQHLVFHENQRGVSFDKLFGPYLATSKRIVVTDPYLRAFHQLRNLMELMETISKQKSPDDEVAVHVVTVEDEFNGDRQTESLQKIADACAEVGIQFTWVYDTTNTLHDRDISTDLGWKIVLSRGLDVFQRFELNDAFSFANRLQQHRPCKAFNVTYVHDIRQEHSIG

SEQ ID NO: 4302 - protein, 679 aa, Acinetobacter baumannii; identical to SEQ ID NO: 4114

SEQ ID NO: 4303 - protein, 684 aa, Anaeromyxobacter dehalogenans
MTMTLDHLDQRAAEVFDGYLVRKDLVRKYARQYPVPTYVVEFLLGRYCASTDEKEIAEGLQIVEKQLRDRTVRTGEEELFKARAKEGGTVKLIDIVKARLDAKNDRFVAELPSLALRDVLIDDQFVRENERMLTDGFYAEVTLAYDGVAAQEQGGRPFSIESMRPIQMSKSDVLEVMGKARRAFTTQEWVDFLIRSIGLEPSSLTERAKRVAILRMVPFVERNYNLVELGPRGTGKSHLFQQISPYAHLISGGKATVAKMFVNNATGQRGLVCQYDVVCFDEVSGVSFDQKDGVNIMKGYMASGQFSRGKDNIRAEGGIVMVGNFDVDVEQQQRVAHLLSPLPPEMRNDTAFMDRLHAFVPGWDFPKLNPNDHFTDHFGLVSDFLSECWSKLRSGNRVSVMQGRVHLGGALSGRDIEAVNKTVSGLTKLLFPDPEATVPDEDLEWIARIALESRRRVKEQQKRCFKSEFRNTHFSYMLGSEGVEQFVSTPELHSDEAIESDPLPPGQVWAVSPSSPDAGPGLYRVEVTCGPGAGVKVLNQPTPPTFRESVKVGEQNLYTRAKELVGDRNPREHEFSIQMRALDTDKTGAGLGIPVLVALCGALLGRNTRGGTVVVGALNLGGSIEMIPNAVRVAELAVDKQAQTLLMPVAARRQLNDLPDELWTKLNIEFYKDASDAVFKSLVE

SEQ ID NO: 4304 - protein, 693 aa, Aromatoleum aromaticum
MCRCESTSPLRMTFETHMTEPVDTARLDGLLNAHFAGKVVRKDLTKLIKEGANVPVYVLEYLLGMYCASDDEATIQNGMTMVKRILAENYVRPDEAEKIKSKIRESGSYKVIDKVTVKLNEKRDVYEALLSNLGVKNAEVSETFVRQFEKLLVGGIWCIVTLNYRFEENQRGSPFTVTDLKPIQMPNMDMASLFEGRRAFTEDEWIDALIRSTGMEPGCFKDRVKWHLLARMIPLVENNYNFCELGPRGTGKSHIYKEISPNSILVSGGQTTVANLFYNMSARKVGLIGLWDTVAFDEVAGIHFKDHDGVQIMKDYMASGSFSRGREAINANASMVFVGNINQSVESLVKTSHLLAPFPEAMIDSAFFDRFHAYVPGWEIPKMRPEFFTNQYGLIVDYLAEYLREMRKRNFADAIDKWFKLGNNLNQRDTIAVRRTVSGLLKLLYPNGEYDKEAVRRCLEYALEVRRRVKEQLKKIGGMEFYDVHFSYIDLEDSQERFVTVPEQSGGALIPEGRLNPGTLHTISLGESEMPGTYRVEVQAIAGNGKASVSGVAPREAVKVAFDYFKANASRISASIKPGEHDFHLHLLELQHTGTPKAFTLAGLIALCSAALAKSIQPQMVVLGDMSLGGTVVQVRNLAESLQVAFDAGAKRILLPMSSVIDIPTVPGELFAKFQTSFYSDPVDAAFKALGVE

SEQ ID NO: 4305 - protein, 713 aa, Arthrobacter sp.
MTEAEVEFEDPAGDFPDPDPGLQAPEKSALDQKINDLFAGVVVRKDLVKAVKGNAIVPSFVLEYLLGQYAASDNEATIQTGIETVRKILADHYVHRNEAELVKSRIKEKGHLRIIDKVGVTLNEKDDVYQAEFANLSIKGVLVSSSTIKQHEKLLVGGVWCICEIEYSHTDDHRAVPWILSSIKPIQLSNFDFDNYVSTRKKFTTDEWIDLLIQSIGFNPELFGRRAKLIQLARLIPFVERNYNLVELGPKGTGKSHIFSEFSPHGMLISGGEVTVPKLFVNNANGKIGLVGYWDVVAFDEFAGKKKRTDKALVDIMKNYMANKSFSRGVETLGAEASMVFVGNTSHTVPYMLKHSDLFDELPESYHDSAFLDRLHHYIPGWEVDIIRGEMFSTGYGFVVDYIAEVLKSMRSLDFSDRYESTFTLDPSISTRDRDGIYKTFSGLMKVMYPHGAATSEEIEEVLRFAIEGRKRVKDQILRIDSTMNKVNFGYVDKSGEWHAVTTLEEDEYPEYYHREGSEGAEVGEPKAGGAVATAGGAQSPSAETVVDKPLFEGHREFQENQRGVSFDTLLVPYLRGATQITITDPYIRHFTQARNLMELIECIAATKDAADEVSVNLITSENSEGGDKLRKQFELLLKVKQGAAVGGINVDVIFDGSIHDRSIVTDTGWRILLGRGLDIFQYVTGDAFDLATRLQAFRQVRAFGVTYIRESE

SEQ ID NO: 4306 - protein, 683 aa, Azospirillum lipoferum
MMNVEMDSLDRLGAAAFDGFLVRKDLVRRYARQYPVPTYVVEFLLGRYCASVDEEEIAEGLEIVEKQLRDRTVRTGTEELFKAQARDRGSVKIIDIVKARLDTKNDCYIAELPSLTLRDVRIDDSVVRENERMLTDGFYAEVTLSYDAIIAQEKGGRPFGIEALRPIQLSKSDALEVLARGRAKFSTREWLDFLIRSVGLEPSSLTDRAKQVMLLRMAPFVESNYNLVELGPRGTGKSHLFQQISPYAHLISGGKATVAKMFVNNSSGERGLVCRYDVVCFDEVAGVSFDQKDGVNIMKGYMASGQFSRGKENIRAEGAIVMVGNLDVDLEQQQKIGHLLGPLPPEMRNDTAFMDRLHAYVPGWDFPKLSPTEHLTDHFGLVSDFISECWSRLRSVNRTQALERVHFGGALSGRDIEAVRKTFNGVAKLLFPDPDTPIPDEDLEWIVRLALEARRRVKEQQKRVFKSEFRNTHFSYTLGADGVEQFVSTPELHSDEAIESDPLPPGQVWAVGASAETAPGLYRLEVTCGPGSGVKILNQPTPPALRESVKVGEQNLYARSREMVGDRNPREEEFSIQMRAMDSDKTGAGLGLPVLVALCGSLLGRNSRGGTIVVGSLNLGGSVELIPNAVRIAELAVDRQAQTLLMPVSARKQLNDLPDELWTRISIEFYKDAADAVFKALED

SEQ ID NO: 4307 - protein, 722 aa, Bifidobacterium animalis
MTDTMQHELSPLDRKITDVFPQHTVRKDLVGEIKGNAVVPTYVLEFLLSQFATTTDALSIESGVRRVQEILAQHYVHRDEAMLIQSKIREKGHYRVIDKVQVTLNEKLDRYEASFSHLNIRQVVVDPNIVQKNEKLLVTGIWCICRIGYAYTGEKDEVPWRLESLKPVQMATDDVHNFIEGRKAFSTEEWIDLMLQSIGFNPELFSDRAKLLLLIRMVPFVERNFNVVELGPKGTGKSHIYSEFSPHGMLISGGEISVAKLFVNNATGRVGLVGFWDTIAFDEFAGRNKKAGKELVDIMKNYMANKTFSRGVEQIPGEASLVFVGNTDHDVPTMLRTSDLFEALPSQYHDPAFLDRIHVYIPGWEFEQIRSEMFTDGYGFVVDYLAEVLHNLRDLDYSDRFNPYFELSSSLSTRDKDGIRKTFSGLMKLIYPSGAASAEQIEPLLRLAIEGRKRVKDQLCRIDTTMTPVDFAYTKVGSETPITVRTFEEIDYPKLYRRQHTDDASDEDDGTIPEGALPDKDAALTEDAPEQPLTAKPTPSPIERMQALAKPGVKELEENERGFSYDKLFGPYVAGAQQLELIDPYIRLSYQMRNLAEFMEMVRRNSNPRQRVHVHLITKKDEEEHKAKRQQEMLEELKHNYAPMGVDLTFEFNDTIHDRRLCTDTGWKITMGRGLDIFQQGNDGDWLNPQNRIQKMRRIKSCTFTYLRDDDILTDQEKQSRN

SEQ ID NO: 4308 - protein, 690 aa, Bordetella parapertussis
MNELDQKINTHFPGLVVRKDLVKTVKGNAIVPSYVLEYLLGQYCATSDEPTIQTGIETVKEILAKHYVHRNEAGLVRSNIKEKGRYKVIDKISVDLNDKKDVYEAQFSNLGIKEVLVDSGTVKKHPKLLVGGVWCIADLEYEFTEDKAVSPWVLSTLKPIQLSHFDFDGYVEARKQFTTDEWIDLLVQSIGFNPDMFGKRSKLTQLVRLIPFCERNYNLIELGPKGTGKSHIYSEFSPHGILISGGEVTVPKLFVNNSSGKIGLVGYWDCVAFDEFAGKQKRVDKALVDIMKNYMANKSFSRGVETLGAEASMVFVGNTQHTVPYMLKHSDLFCELPDKFYDSAFLDRIHFYIPGWEVDIIRGEMFSSGYGFVVDYLAEILRSLRNHDYSDRYKEHFSLSSDISTRDRDGINKTFSGLMKILFPHGGATEEEVEELLRFAIEGRKRVKDQLMRIDSTYGNVRFTYLGTDGQAKPVTTLEEEEYPSYYHKTIAEGEDGEIIEAAQPGSPQGPSEPLAPAESVLEEKHLTFQENQKGLSFDTLLGPYLKGATTITVTDPYIRLFYQMRNFMEFLETVVKHKAPDEEVSVHLVTTEGEFKGEQQKENFEKMKESASSVGVNFTWEFDSTGTIHARHIVTDHGWKVSLDRGLDIFQRYELNDAFTFANRLQQYRPCKAFEVTFIRHKPNGAAGE

SEQ ID NO: 4309 - protein, 681 aa, Burkholderia sp.
MQLDDLDKKATTAFEGYVVRKDLVRTFSRQFPVPTYVVEFLLGRYCATTDEAEIQEGLDIVQRQLASRTVKAGEEELFKARARESGSVKIIDIITARLDSKTDSYVASLPSLRLNDVRLTPEMVKDNERMLTGGFYAEVTLGYDASIAQEKGGRPFGVDALRAIQLSKREVLDVLAKGRESFSTAEWRDLLLRSVGFEPETLPERAKDALLLRMVPFVERNYNLVELGPRGTGKSHLFQQVSPYAHLISGGKATVARMFVNNASGQRGLVCQYDVVCFDEVSGVSFDQKDGVNIMKGYMESGEFSRGKESIRADGSIVLVGNFDVDVEHQQRIGHLFGPLPPEMRDDTAFMDRIHCFLPGWDVPKLNPSLFTEHFGLVSDFLSECFTQLRNQSRVSTLQSRVYWGGSLSGRDLNGVNKTVSGLLKLLYPNAETPVSDEDLEWAVRLALEVRRRVKEQQKRIGAAEFRNTHFSYTMGAEGVEKFVSTPELQSQGGIGDEPLECGQIWTLSPGGQDEHPGLFRLEVTEGPGSGVRVLNNPVHSAFKESIRCAEQNLYARAQQLVGDRDPRSHEFSVQLRGFDAAKAGAKTGVASVIALAGALLRKSVRGGLIVVGEVTLGGTIEPIHNAVTLAEIAVEKGAQSLLLPVSCRRQLFELSDDMATKLDIEFYQDVRDALLKALAE

SEQ ID NO: 4310 - protein, 689 aa, Burkholderia gladioli
MAEPTSPPLAENATVDTAGDRSLDNLLNEKFAGRVVRKDLTKLIKEGANVPVYVLEYLLGMYCASDDPETIRAGLDSVKRILAENYVRPDEAEKVKSKIRELGSFKVIDKVTVKLNESRDAYEALLSNLGIKNAEVPDHYVRQYEKLLVGGIWCIVTLRYYFEENQKSSPFAVADLKPIQMPSLDMNELFSARKSFTEEQWIDAMLRSTGMEPTCFKERVKWHLLARMIPLVENNYNLCELGPRGTGKSHIYKEISPNSILVSGGQTTVANLFYNMSARKVGLVGLWDVVAFDEVAGINFKDQDGVQIMKDYMASGSFSRGRDSVNASASMVFVGNINQSVESLVKTSHLLAPFPDAMIDSAFFDRFHAYVPGWEIPKMRPEFFTNQYGLIVDYLAEWVREMRKRSFADAIDKWFKLGNNLNQRDTIAVRRTVSGLLKLICPNGEYEKETVRRCLEYALETRRRVKEQLKKIGGMEFYDVHFSYIDLEDMQERFVSVPEQTGGGIIPEGRLQPGVLHTIAMAEAEMPGVYRMEVQALSGSGKLSVSGSLSREHVRVAFDYFKANASRVSASIRPTERDFHLHLVELQNTGAPDAVTLASFIAFASAALAKPLQPQLAVMGDMTLGGTIAQARNLAESLQIAFDAGAKRILLPMSSVTDIPTVPGELFAKFQTSFYSDPVDAVFKALGVE

SEQ ID NO: 4311 - protein, 689 aa, Burkholderia vietnamiensis
MADPTSQPLAEKATVDTVGDRSLDTLLNASFAGRVVRKDLTKLIKEGANVPVYVLEYLLGMYCASDDPETIRAGLDSVKRILAENYVRPDEAEKVKSKIRELGSFKVIDKVTVKLNESRDAYEALLSNLGIKNAEVPDHYVRQYEKLLVGGIWCIVTLRYYFEENQKSSPFAVADLKPIQMPSLDMEELFSARKSFTEEQWIDALLRSTGMEPTCFKDRVKWHLLARMIPLVENNYNLCELGPRGTGKSHIYKEISPNSILVSGGQTTVANLFYNMSARKVGLVGLWDVVAFDEVAGISFKDHDGVQIMKDYMASGSFSRGRESVNASASMVFVGNINQSVESLVKTSHLLAPFPDAMIDSAFFDRFHAYVPGWEIPKMRPEFFTNQYGLIVDYLAEWVREMRKRSFADAIDKWFKLGNNLNQRDTIAVRRTVSGLLKLICPNGEYEKETVRRCLEYALEVRRRVKEQLKKIGGMEFYDVHFSYIDLEDMQERFVAVPEQTGGGIIPEGRLQPGVLHTIAMAEAEMPGVYRMEVQALGGSGKLSVSGSLSREHVRVAFDYFKANASRVSASIHPTERDFHLHLVELQNAGAPDAVTLASFIAFCSAALSKPLQSQLAVMGDMTLGGTIAQARNLAESLQVAFDAGAKRILLPMSSVTDIPTVPGELFAKFQTSFYSDPVDAVFKALGVE

SEQ ID NO: 4312 - protein, 535 aa, Calditerrivibrio nitroreducens
MDKLDKKISELFPGKIVSKELGQKLKTGYNAPNFVIEYLVGMYCATNDEEQIKDGMETVKDILTKHYVRADEIEKVKYLMREEGSYKVIDKAEVYLEEKEDKYFMRLKTMQLDKIQVKVDLIEKNPRLLTTGVWGIITLQYLRLEELINEKVNLFMPLENQECMSWLSNDNIKIISAIQDEVVNNKKIKYRPKNLEDPYLLEDFRPIQVPKVDLEEIFENRKEFSLEEWIDFIMRSCGLEPSYFNERQKFLFLYRLIPFVENNYNLIELGPRGTGKSFVYKEISPNAILISGGKTTVAQLFEWAGVIMRQNTLGLVNLWDVVGFDEISYNVFKNKESIQILKDYMESGSYSRGKNTRFADASMVFVGNIDEAIENIIKDKNKNLFQWIAQEMQDAAFLERIHCFIPGWEFPKMRPEFITKKSGFIVDYFAEFMRSMRKYNYTDKYEKYFKLKNASQRDSVAIKRTFSGLAKLLFPENEMTKEDIKKLLKYACECRKRVKYNLRRMLPHEYTTDFIGFTDIETGEEFEIFAEEEIR

SEQ ID NO: 4313 - protein, 676 aa, Carboxydothermus hydrogenoformans
MDELSAKLNQHFAGRVVRKDLTKKIKEGANVPVYVLEYLLGMYCATEDEDSIREGVERVKSILAENFVRPDEAEKVKSKIREHGRYTIIDRVTVKLNEKKDVYEAEFSNLGIKGVVMPSSYVKNYERLLAGGIWCIIKMDYYFDEEQKGSSPFCINSLTPIQLPNLELEEIMVGRRHFTKDEWIDVLIRSIGLEPTKLSNNVKWHMLERMVPLVENNYNLCELGPRGTGKSHIYKEISPNSILVSGGQTTVANLFYNMASRQIGLVGLWDCVAFDEVAGISFKDKDAIQIMKDYMASGSFARGKEEKAATASMVFIGNINQSVDALLKTSHLFEPFPEAIANDTAFFDRIHYYLPGWEIPKFRPEFFTDEYGFITDYLAEFLREMRKRSFSDAFDRYFKLGNNLNQRDVIAVRKTVSGLVKLIYPNGEFDKDDIEEILRYALIGRRRVKEQLKKIGGMEFYDVHFSYIDNETMNEQFVSVPEQGGDKIIPEGLGKPGHVYTVARGRTGMIGVYKIETQVVSGSGKFEKTGLGSDREAKEAIETAFRFFRANSKKISGSISTTTKDYLMHVEDINGVGLTSELSLAAFVALCSGALDRPCQSQMVILGSMSIGGTINKVEELANVLQVCFDAGAKKVLMPMSSATDIATVPPELFAKFQISFYQSPEDAVFKALGVE

SEQ ID NO: 4314 - protein, 689 aa, Chlorobium phaeobacteroides
MNELDQKINTHFPGLVVRKDLVKTVKGNAIVPSYVLEYLLGQYCATSDEPTIQTGIETVKEILRKHYVHRNEAGLVRSNIKEKGRYKVIDKIGVALNDKADVYEAEFSNLGIKKVLVDSGTVKTHPKLLVSGVWCIADIEYEFTEDKNASPWILSTLKPIQLSQFDFDSYLEARKQLTTDEWIDLLIQSIGFNPEMFGKRSKLTQLIRLIPFCERNYNLIELGPKGTGKSHIYSEFSPHGILISGGEITVPKLFVNNSSGKIGLVGYWDCVAFDEFAGKQKRVDKALVDIMKNYMANKSFSRGVETLGAEASMVFVGNTQHTVPYMLKHSDLFCELPEKFYDSAFLDRIHFYIPGWEVDIIRGEMFSNGYGFVVDYLAEILRSLRNHDYSDRYKEHFSLSSDISTRDRDGINKTFSGLMKILFPHDGATKEEIEELLRFAIEGRKRVKDQLMRIDSTYGNVRFTYQDSDGQAKPVTTLEEEEYPGYYHKTIAEGEDGEILEAAQPGSPQGPSEPLAPAEPALKEKHLTFQENQKGLSFDTLLGPYLKGATAITATDPYLRLFYQMRNFMEFLETVVKHKAPDEEVSVHLVTTEDEFKGEQQKENFEKMKESASAVGVNFTWEFDGTGTIHARHIVTDHGWKISLDRGLDIFQHYEMNDAFTFANRLQQYRPCKAFEVTFIKHKREAEGE

SEQ ID NO: 4315 - protein, 676 aa, Clostridium clariflavum
MDELSRKLNQYFAGRVVRKDLTKKIKEGANVPVFVLEYLLGMYCATDDEDGINEGVETVKRILAENFVRPDEAEKVKSKIREIGKYTVIDKVSVKLNEKKDIYEAEFSNLGIKGVAISPTYVKQYEKLLCGGIWCIIKMDYYYDEEARGTSPFNISNLTPIQMPNLDMEEIINGRKYFTKDEWIDILLRSIGMEPTRFENNVKWHLLARMIPLVENNYNLCELGPRGTGKSHVYKEISPNSILVSGGQTTVANLFYNMASRQIGLVGLWDCVAFDEVAGISFKDKDGIQIMKDYMASGSFARGKEEKNASASMVFVGNINQSVDVLLKTSHLFEPFPEAMANDTAFFDRMHYYIPGWEIPKMRPEFFTDEYGFITDYVSEFMREMRKRSFSDTLDKFFKLGNNLNQRDVIAVRKTVSGLVKLIYPNGEFARDDIEEILRYALVGRRRVKEQLKKIGGMEFYDVHFSYIDNETMSEEFVSVPEQGGGKIIPEGMGKPGHLYTIARGKSGMIGAYKIETQVISGTGKFERTGLGSDREAKESIETAFRYFRANSKNISGSISVTTKDYLMHVQDIHGVGMTSELALAAFVALCSGALGKPPQSQLVVLGSLSIGGTIIKVEELANVLQVCFDSGAKRVLLPMASAVDIPTVPPELFAKFQISFYQSPEDAVFKALGVE

SEQ ID NO: 4316 - protein, 676 aa, Clostridium clariflavum
MDELSKKLNQYFAGRVVRKDLTKKIKEGANVPVYVLEYLLGMYCATDDEEGIREGVETVKRILADNFVRPDEAEKVKSKIREIGKYTVIDKVGVKLNEKKDVYEAEFSNLGIKGVAISPTYVKQYEKLLCGGIWCIIKMDYYYDEEAKGTSPFNISNLTPIQMPNLDMEEIFNGRKNFTKDEWIDVLLRSIGMEPTRLENPVKWHLLARMIPLVENNYNLCELGPRGTGKSHVYKEISPNSILVSGGQTTVANLFYNMASRQIGLVGLWDCVAFDEVAGITFKDKDGIQIMKDYMASGSFARGKEEKNASASMVFVGNINQSVDVLLKTSHLFEPFPEAMANDSAFFDRMHYYVPGWEIPKMRPEFFTDEYGFITDYISEFMREMRKRSFSDALDKYFLLGNNLNQRDVIAVRKTVSGLVKLIYPNGEFTKDDIEEILRYALIGRRRVKEQLKKIGGMEFYDVHFSYIDNETMAEEFVSVPEQGGGKIIPEGMGKPGHLYTVARGKSGIIGTYKIETQVISGNGKFEKTGLGSDREAKESIETAFRYFRANSKNISGSISITTKDYLMHVQDINGVGMTSELALAAFVALCSGALGKPPQSQLVVLGSLSIGGTITKVEELANVLQVCFDSGAKKVLIPMSSAVDIPTVPPELFAKFQISFYQSPEDAVFKALGVE

SEQ ID NO: 4317 - protein, 676 aa, Clostridium ljungdahlii
MDELSKKLNTYFQGRVVRKDLTKKIKEGANVPVYVLEYLLGMYCATYDEDSINDGVERVKKILADNFVRPDEAEKIKSKIKELGRYTVIDKVSVKLNEKKDVYEAEFSNLGLKGVVISSHYVREFEKLLSGGIWNIVKISYFYDETARDVSPFNIDSLTPIQMPNLDIDEIMEGRKNFTKEEWIDILIRSIGMEPTQLDYSVKWHMLERIVPLVENNYNLCELGPRGTGKSHIYKEISPNSILISGGQTTVANLFYNMASRKIGLVGMWDAVAFDEVAGITFKDNDGIQIMKDYMASGSFARGREEKNASASMIFVGNINQSVEVLLKTSHLFEPFPEAMANDSAFFDRMHYYLPGWEVPKMRPEFLTDEYGYITDYLSEWCREMRKHSFTDAFDKYFKLGNNLNQRDVIAVRKTVSGLTKLIYPNGEYNKDDIAEILRYALVGRRRVKEQLKKIGGMEFYDVNFSYIDNETMEEEFVSVPEQGGGKIIPEGIGKAGHLYTIGRGRSGMIGAYKIETKVVNGSGKFEKTGLGSDREAKEAIETAFRFFKANSKNISGTISTGTKDYLMHVQDIHGVGLTSELALTAFIALCSAAMNRPAQSQIVVLGSMSIGGTISKVEELANVLQVCFDSGAKKILIPMSSAVDIGIVPPELFAKFQISFYQTPEDAVFKALGVE

SEQ ID NO: 4318 - protein, 688 aa, Clostridium saccharolyticum
MEEFKFEEVDNPNAALNKKLRQFFDGKIVRKDLTKSIKEGANVPVYVLEFLLGQYCSSDDPEIIEEGVKTVKRILSENFVRPDEAQKVLSILRERGSYTVIDRITAKLNIKEDRYEAEFSNLGVREILLAPSYVSEYDRLLCGGIWCIVQLEYEYLEEDRRANPIRVRKLTPIQMPHIELDEIKQARREFTKEEWLNVLIRSTGMESDKFSTREKWLLLARMIPLVENNFNLCELGPRSTGKSHIYKEISPNSILVSGGQTTVANLFYNMSNKTVGLVGMWDCVAFDEVAGITFKDKDGVQIMKDYMASGSFARGKEEKAASASMVFVGNINQSVDVLLKTSHLFEPFPEVMAYDTAFLDRMHCYVPGWEIPKYRPDFFTNEYAFITDYLSEFMKEMRKEQYGDACDKFYKFGSNLNQRDVIAVRKMISGFTKLLYPNGEFTKEDMAEIITVSLELRRRVKEQLKKIGGMEFYDVNFSYVDNETFEEHYVPVPEQGGGKLIPEGMTNPGHVYTVSRGKSGMVGVYRLETQVLPGNGKFERTGLGSDRDAKEATNTAFNYLKANGRHISNSVSTTTKDYMINYQDLNGIGITKTLTLPTLIAICSAALQKPTLSSLAVLGEISISGTIQKVEELANTLQVCLDSGAKKVLIPITSAVDMATVPPELMGAFSIIFYNTPQEAVFKALGVE

SEQ ID NO: 4319 - protein, 706 aa, Clostridium saccharolyticum
MEMMDMAADDTREELRRKLRSNFDGRIVRKDLTKKIKEGANVPVYVLEFLLGQYCSSDDETIIEQGVQNVKRILADNFVRPDEAQKILSQLRKNGSHTIIDMVTVHLDIKKDCFFAEFSNLGLTNVPITDDYPEKYDRLLCGGIWCIVQLEYESEGDSSFGITDIDGQPISSKQKKQKDISPISIHKLTPIQMPHIDIEEVREGRKAFTQEEWMDGMLRSCGYEPEQLNNREKWLLLARMLPLVENNFNLCELGPRSTGKSHIYKEISPNSILVSGGQTTVANLFYNMGRKTVGLVGLWDCVAFDEVAGIKFKDKDGIQIMKDYMASGSFARGKEEKAASASMVFVGNINQSVDVLLKTSSLFDPFPPEMGTDTAFLDRLHCYIPGWEIPKFRPEHFTNDYGFITDYLAEFIRELRKEQYGDALDKYFRLGKNLNQRDTIAVRKIVGGYVKLLYPDGEFTKEQIEEILVFALEMRRRVKEQLKKLGGMEFYDVNFSYIDLDTFEEKFVSVPEQGGGKLIPDGICNPGQVYTVSQGKSGMIGVFRLESQMLPGNGKFERTGLGSDRDCKESTNTAFNFLKANGNRISGSISTTMRDYIINYQDLQGIGMTGKLALPTLIALCSIALGRPTVSTLAVLGEISISGTILKVDELANSLQVCLDSGAKKVLLPITSAADLGTVPPELVGSFNLIFYSSAEDAVFKALGVE

SEQ ID NO: 4320 - protein, 688 aa, Clostridium sticklandii
MMDTMLMDNESPNALLNRKLRKYFDGKIVRKDLTKSIKEGANVPVYVLEFLLGQYCSSDDPEIIEDGVKTVKKILSENFVRPDEAQKVLSILRERGSYTVIDRITAKLNIKQDRYETEFSNLGVREILLDPMYVSKYDRLLCGGIWCIVQLEYEYLEEDKRAHPIRIRKLTPIQMPHIELDEIKSARKEFTKEEWLDVLIRSTGMEPSKFNTRQKWLLLARMIPLIENNFNLCELGPRSTGKSHIYKEISPNSILVSGGQTTVANLFYNMANKSVGLVGMWDCVAFDEVAGITFKDKDGIQIMKDYMASGSFARGKEEKAASASMVFVGNVNQSVDVLLKTSHLFEPFPEAMAYDTAFLDRMHCYVPGWEIPKYRPDFFTNDYAFITDYLSEFMREMRKEQFSDACDRYFKFGHNLNQRDVIAVRKMVSGFTKLLYPDGEYSKEDMAEILDISLELRRRVKEQLKKIGGMEFYDVNFSYIDNDTFEEHYVGVSEQGGGKLIPEGIINPGHIYTISRGKTGMVGVYRLETQALPGNGKIERTGLGSDRDAKEATNTAFNYLKAHGHSISNSISTTTKDYIINYQDLNGVGMTKYLTLPTVIAIASAALNKPTLSSLAVLGDISISGSIFKVEELANTLQVCLDSGAKKILLPITSAVDMATVPPELMGAFSIIFYNTPQEAVFKALGVE

SEQ ID NO: 4321 - protein, 686 aa, Clostridium sp.
MTEFMESEDKRSVIRNKLRQHFDGKIVRKDLTKKIKEGANVPVYVLEFLLGQYCSSDDPEVIEQGVENVKRILADNFVRPDEAQKILSMLRQRGSHTVIDMITVNLDIKHDCYVAEFSNLGLKAVPIDEEYPTKFDRLLCGGIWCIVQLDYEFIEEECNGTPIHIRKLTPIQMPHVDIDELKEGRKAFSKEEWIDVLLRSIGMEPDELNYREKWLLLTRMLPLIENNFNLCELGPRSTGKSHLYKEISPNSILVSGGQTTVANLFYNMGRKTVGLVGLWDCVAFDEVAGIRFKDKDGIQIMKDYMASGSFARGKEEKAASASMVFVGNINQSVDVLLKTSSLFDPFPPEMGTDTAFLDRMHCYIPGWEIPKFRPEHFTDDYGFITDYLAEFVRELRKEQYGDALDKYFRLGKNLNQRDTIAVRKMAGGFVKLLYPDGVFTKEDIEEILTISLEMRRRVKEQLKKLGGMEFYDVNFSYIDNESFEEKYVSVPEQGGGKLIPEGMCNPGQVYTVSQGKSGMIGVFRLESQMLPGNGKFERTGLGSDRECREASNTAFSFLKANGNRISGAISTTTKDYIVNYQDLQGIGMTGKLALPTLIALCSIALSKPTVSSLAVLGEISISGTMIKVDELANSLQVCLDSGAKKVLLPITSAGDLGTVPADLVGSFNLIFYSSAEDAVYKALGVE

SEQ ID NO: 4322 - protein, 702 aa, Cupriavidus necator
MNLPDALDQKLTSAFDGKVVRKDLLHRIKKGTNVPTFVLEFLLARFCASDDQAEMDAGMEAVLATLQDNYVRPDEANAAQSKVATKGKHRFIDKVHVRYVEKEKRHWASLENFNSQRIAIGEKFYRDNDRLLEGGIWAEVTLSHNDIEEDDYAFYIEDLRPIQLSRFDFERYAEGRATFTRDEWLDVIMRSVGLEPSKLSHRVKMHFIARLAALVEPNYNYIELGPRGTGKSYFFSEFSPYATLISGGQATKATLFYNNARRKVGLVGYWDTVAFDEVGGIKVRDPDTIQIMKDFMANGRFSRGAEVIADASLSFVGNIDLSVQQVVNSTEYDLFQPLPPELDLAVMDRFAAFIPGWEMPKNSSEFLTSRYGFITDYLAEAFHYQFKHTNRYEEVSKRIRLGKSIEGRDEKGIKKTVCAFLKILHPTGAPTDQEFEEYVAYAAECRRRVKEQMNKRKPDDEFALINLSYFKAAGEEVVVFCPESKDAAATQQPARRRLNQSVEQLGSVVEEKAGAEHAPAVEAEPSADPTALAPVSAGEAHTPTTVELKEQHFSILYGDTGYSYESILGPYLQGAKVVVIEDPYIRLQHQIQNFVRFCETVLKSNTVKKINLITGYDDKTQLAEIAEKMEELKQSLLELDVELEVKLNPNMHDREIRLDNGWIIKIGRGLDFYQKPGSWFEVGATDLSLRKCLETKVDIFRA

SEQ ID NO: 4323 - protein, 670 aa, Cyanothece sp.
MSNLEQKINQYFEGLVVRKDLVKEVRGNAIVPSYVLEYLLGQYCATHDEASIQTGIETVKEILRRHYVHRNEAGLIRSNIKEKGRYKIIDKISVTLNDKADVYEASFANLGIKKVLVDSTTVKAHPKLLVSGVWSIADIEYEFEEDKKACPWLLNSLKPIQLSHFNFDSYLEARQQFSTDEWMDLLIQSIGFNPNFLGRRSKLTQLIRLIPFCERNYNLIELGPKGTGKSHIYSEFSPHGILISGGEVTVPKLFVNNATGKIGLVGYWDVVAFDEFAGKQKRVDKALVDIMKNYMANKSFSRGIETLGAESSLVFVGNTQHTVPYMLKHSDLFADLPQKFYDSAFLDRIHFYIPGWEMDIIRGEMFSSGYGFVVDYLAEILRYLRNYDYSDRYQPYFSLTSDISARDREGINKTFSGLMKLLFPSGEATSEEIEDILKLAIEGRKRVKDQLIRMDNTYPPVCFAYLNQSGNSHSVPTLEEQEYPQYYSKTTPTDIETITSPLECNSSENLKEQTITIQDNQKGITFDYLFGPYLQNVNQLTVIEPHLKNSPQLDNFFELLETVIKFKSTDEEMLVHLITTEDEFQVEFQQETFNNLAQSCLSVGIHLSWEFDSTKTQEGCQIITANGWQISLSQGLDIFQQRDKNNAFSFANRLQLLRFCKNCQVNYKRT

SEQ ID NO: 4324 - protein, 676 aa, Dehalococcoides sp.
MQQDDLDKKVTSIFAGKVVRKDLLHQIKGGENVPSYVLEYLLGKYCASDNDEEIRIGVDAVKETLTTNYFRHDEANKAQSMVEQKGKHRFIDRIEVRFLPSENKYWASMDHFGYARIHIPEEFYRRYERLLEGGIWAIVDVEFRLSEEGKKDSPFHVVDLKPIQLARFDLDEYLDGRRDLSRDEWIDLLLRSIGLEPVRMDRRLKILLITRLIPFVEKNYNFIELGPRGTGKSYAFSEMSPYCMLLSGGKASTANLFYNNARRQVGLVGHWDVVAFDEVGGMKITDPDAIQIMKDYMANGRFSRGVTQVLADASLVFIGNLNNPVESLVQNSATDLFQPLPKEFDLAVLDRIHFYLPGWEVPKNSKDMLTVHYGFVTDYLAEAFRALRKQNRFDETERVFRFGSHVEGRDATAAKKTVSGLLKILHPGGEWTKEELTEYLELAMEGRRRVKEQLKKRGSFEFYKTSFSYINLENDAERSVGVPEQGGAGVISPDPLPAGTVYTASVDSEAKVGLFRIEITLTAGTGKLRTPTGLEKSLKESLNRAFSYLQNVKDKLGLTQMLAQKDIYAEAVDLSGGRIDCPCGVAFFSAIISAVRGRQVQAGTVVVGDLTIQGNIKGPASITEPLQLCLEAGAARVLVPVSNKAQFAGLPEDVIERLDVVFYGDIDRAVLKTLET

SEQ ID NO: 4325 - protein, 706 aa, Dehalogenimonas lykanthroporepellens
MTNDALDIKLLDAFGGKVVRKDLLHRIKKGTNVPTFVLEFLLARYCASDDAAEIQEGLEAVIATLQDNYVRADEANAAQSKVATKGKHRFFDKVHVRYVEKEKRHWAALENFNSQRIAISEKFYRDNNRLLEGGIWAEVTLGYNEIEDDDYAFYIEDLRPIQLSRFDFEGYAEGRKPFSRDEWLDIVLRSVGLEGSRLSHRLKLHFVARLAPLVEPNFNFVELGPRGTGKSYFFSEFSPYSTLISGGQATKATLFYNNARSRIGLVGFWDTVAFDEVGGIKIKDPDTIQIMKDYLANGRFSRGVEVIADASMAFVGNIDYSIEQVVNSTEHDLFMPLPKEFDLAVMDRFACYLPGWEMPKNSSDYLTSNYGFITDYLAEAFHYQFSHTNRYEEVTKRIQLGKSVEGRDEKGIKKTVCALLKILHPDGPPSDAEFEEYVAYAVECRRRVKEQMNKRKPDDEFANINMSYRTADGREVVVFCPESRNAPATQHPLRRTLANEPGSDVEPVISKESVTASIPDSPPPAENPVDLPATIAPEQEQSPVDLGPSERHFTILYGDTGHSYESIIAPYVKNAREIVVEDPYIRLTHQIQNFVRFCEAVLKHSSVKRIKLITSYDDSTNMMEINDRLGELKQSLLEMDVVLDIDLNPNMHDREIRIDNGWIIKIGRGLDFYQKPASWFSIGANDLNLRPCLETKVDIFQKKNTE

SEQ ID NO: 4326 - protein, 691 aa, Desulfitobacterium hafniense
MDLEEASYTSETDDANEVIYRKLREHFDGKIVRKDLTKAIKEGANVPVYVLEFLLGQYCSSDDPKIIEDGVSNVKRILSENFVRPDEAQKVLSGLRERGSYTVIDRITVSLNIKLDRYEADFSNLGVRNIPISSGYVSKYDRLLCGGIWCIVGLEYEYVEEDKKSTPIRIVKLTPIQMPHIDMDEIKNGRRAFTKDEWITILLRSTGMEADRFSDREKWLQLTRMLPLIENNFNLCELGPRSTGKSHLYKEISPNSILVSGGQTTVANLFYNMSSKQVGLVGLWDCVAFDEVAGITFKDKDGVQIMKDYMASGSFARGKEEKAASASMAFVGNINQSVDVLLKTSHLFDPFPEVMAYDTAFLDRMHCYIPGWEIPKYRPESFTNDYGFITDYLAEFMREMRKEPFGDVCDKYFRFGSNLNQRDVIAVRKIVSGFAKLLYPNGEFNKENIEEILTFALEMRRRVKEQLKKIGGMEFYDVNFSYIDNESFEERYVSVPEQGGGKIIPEGLTNPGNVYTISQGKSGMIGVYRLETQMLPGNGKFERTGLGTDRDAREATNTAFNFLKASASHISGSISTTTKDYIINYQDLNGIGMTKFLTLPTVIALASCALGKPTLSNLAVLGEISISGTILKVEELASVLQVCLDSGAKKVLIPITSAAELGTVPADLIGAFSLIFYSTPQEAVFKALGVE

SEQ ID NO: 4327 - protein, 683 aa, Desulfobacula toluolica
MTALDDKINEHFSGLVVRKDLVKTVKGNAIVPSYVLEYLLGQYCATADEESIKTGIDTVKDVLRKHYVHRNESGLIKSVIREKGRHKIIDKVSVALNDAKDVYEASFANLGIKKVLVDSDTVKKHPKLLVSGVWTIVDMEYEHFEDKSTSPWIINKLKPIQLSHFNYDNYIAARKQFNTDEWIDLLVQSIGFNPEKLGKRSKLLQLVRLIPFCERNYNLIELGPKGTGKSHVFSDFSPHGILISGGEITVPKLFVNNNSGKIGLVGYWDIVAFDEFAGKKKRVNKALVDIMKNYMANKSFSRGVETIGAEASMVFVGNTRHTLPYMLKHTDLFDELPEQYYDSAFLDRIHFYLPGWEVDIIRGEMFSNGYGFVVDYLAEILRSLRNHDYSDLYAQHFNLVSDISTRDKDGINKTFSGMMKILFPHKEATEKEIKEVLQFAIEGRKRVKDQLMKIDSTYAAVRFAYTCNDGGKTIHVKSLEEEEYPQYFGSFQDKESETEIDPQQLEQPNVQDAAKEKLSELKERQVIVQENQRGVTYDKLFDQYLQGARKITVTDSYIRIFYQIRNFMEFLETIAKIKPKDDEVKVHLITAEDEFKGPQQVENFMKIQENCAIAGVRFSWEFDENQILHARHIVTDHGWKILLDRGLDIFQHYEMNDSFSLSNRLQQYRSCKAFEITYLRVDS

SEQ ID NO: 4328 - protein, 681 aa, Desulfomicrobium baculatum
MNLDAIDRKAASTFEGYLVRKDLVRTFSRQFPVPTYVVEFLLGRYCASIDQDEIDEGLGIVQRQLLDRTVKAGEEELFKSRAREKGQVKIIDLVSARLDAKSDSYLATLPSLRLTDARIEAAVVSKHERMLTGGFYAEITLGYDPIIAQEKTGRPFGIDGLREIQLSNRDVLEKLGEARAQFSTKEWKTLLLRSIGIEDSALSERQQNALFLRMVPFVERNFNMVELGPRGTGKSHLFQQVSPYAHLISGGKATVARMFVHMGTGQKGLVCQYDVVCFDEISGISFDQKDGVNIMKGYMESGEFSRGKESIRADGSVVMVGNFDVDVEHQQRVGHLFGPMPAEMRDDTAFMDRLHAFLPGWDVPKISKELLTNHFGLVSDFLSECWTQLRNQSRVSQLQNRVFYGGALSGRDTNAVNKTVSGLLKLLHPDGTQQIPEEDIEWAVRIAMESRRRVKEQQKRIGAAEFRNTHFSYVMGTDGVEKFVSTPELQSDNSIGTDPLEPGQVWAISPGGNGENPGLYRIEVNEGPGSGLKVLNKPIPPAFRESIGCAEQNLYSRASQLVGDKDPRHHEFTAQLRAFDASKSGAKIGVAALVALCTALLKKSVRGGLILVGEINLGGSIESIHNPVNIAEIAVEKGATSLLIPVSCRKQLFDLSDDMATKVDIQFYSDAKDALLKAIIE

SEQ ID NO: 4329 - protein, 686 aa, Desulfosporosinus meridiei
MSELEMGIKNVSELLEKLKTHFSGKIVRKDLTKKIKEGANVPVYVLEYLLGMYCSSMDQEEIDAGVQNVKQILAENYVRPDEAQKIISKLRERGSYTVIDKVSVKLNYKNDIYESEFSNLGIKNVPLAEKYVSDFERLLCGGIWCIVQMEYFYDEADKNRCPFIIRKLTPIQMPSLDIDEVKSARANFSDEEWIDLVLRSTGMEPSQFDKRVKWLHLARLIPLIENNYNFCELGPRGTGKSHIYKEISPNSILVSGGQTTVANLFYNMGSKTVGLVGLWDCVAFDEVAGIKFKDQDGVQIMKDYMASGSFSRGKEEKNAYASMVFVGNINQSVDVLLKTSHLFDPFPEAMSNDSAFLDRLHCYLPGWEIPKYRPEYFTDDYGFITDYFSEIMRELRKISYADAYDKYFKLGNNLNQRDVIAVKKTVSGLVKLIHPDGQFTKENVEEILRFALEMRRRVKEQLKKIGGMEFYDVNFSYIDHETFNEDYVSVPEQGGGKLIPEGMGKPGHIYTVSRGKSGMIGVYKLEMQMTAGNGKFERTGIGSDREAKEAVDTAYRYLKANGKNISGSISTTTKDYLMHVQDLNGIGMTKRLTLPTVVAICSIALHKPALSSAVILGDLSIGGTIIKVEELANTLQVCLDSGAKKVLIPITSAVDLGTVPSELIGCFNIIFYQSAEDAVFKALGVD

SEQ ID NO: 4330 - protein, 677 aa, Desulfovibrio magneticus
MDNEAPSLDSLLNEHFQGKVVRKDLTKLLKEGANVPVYVLEYLLGMYCASDDEDIIQEGIKSVKDILAQNYVRPDEAEKVKSIIRERGSFKVIDKVTVKLNEKRDCYEALLSNLGTKGVEISSNTVKEFEKLLVGGIWCIISLNYFYEEGQKGSPFSISDLKPIQMPNMDMETIYEGRKHFTEDQWLDVLLRSTGIEPTTFEERAKWHLLSRLIPLVENNYNICELGPRGTGKSHVYKEISPNSILVSGGQTTVANLFYNMGNHKVGLVGVWDVVAFDEVAGITFKDKDGVQIMKDYMASGSFSRGRDAISANASMVFVGNINQSVDTLVKTSHLFAPFPETMIDTAFFDRMHCYTPGWEIPKMRPEFFTNQYGLIVDYLAEYFREMRKTTFADAIDKYFHLGNNLNQRDTIAVRKTVSGLLKLLYPHGDYTKEAVEKCLRYALECRRRVKEQLKKLGGMEFYDVHFSYIDNETRDEKFVGIPEQGGSSLIPEGPPNPGTLHTVGCGSGHLGLYRIELQVTAGNGKLSISGVGSSNQAKEPIKVAFDYFKANASRVSGSSKPGDRDYHLHIVELHNTGPNDAMTLPSFIALCSGLLGKPVQGSLVVLGDMSLGGSIIRAGDLAASLQVAFDAGAKRILIPMSSVGDIQTVPGELFAKFQTSFYSDPVDAVFKALGVE

SEQ ID NO: 4331 - protein, 689 aa, Desulfovibrio vulgaris
MNELDQKINTHFPGLVVRKDLVKTVKGNAIVPSYVLEYLLGQYCATSDEPTIQTGIETVKEILAKHYVHRNEAGLVRSNIKEKGRYKVIDKISVDLNDKKDVYQAQFSNLGLKEVLVDSGTVKKHPKLLVGGVWCIADLEYEFTEDKSASPWILSTLKPIQLSHFDFDGYVEARKQFTTDEWIDLLVQSIGFNPEMFGKRSKLTQLVRLIPFCERNYNLIELGPKGTGKSHIYSEFSPHGILISGGEVTVPKLFVNNSSGKIGLVGYWDCVAFDEFAGKQKRVDKALVDIMKNYMANKSFSRGVETLGAEASMVFVGNTQHTVPYMLKHSDLFCELPDKFYDSAFLDRIHFYIPGWEVDIIRGEMFSNGYGFVVDYLAEILRSLRNHDYSDRYKDHFSLSSDISTRDRDGINKTFSGLMKILFPHGGATKEEVEELLRFAIEGRKRVKDQLMRIDSTYGNVRFTYQDTDGRAKPVTTLEEEEYPGYYHKTIAEGEDGEILEAAQPDSPQGPSEPLAPAEPVLKEKHLTFQENQKGLSFDTLLGPYLKGATTITVTDPYIRLFYQVRNFMEFLETVVKHKAPDEEVSVHLVTTEDEFKGEQQKDNFEKMKEAACSVGVNFTWEFDGTGTIHARHIVTDHGWKISLDRGLDIFQHYEMNDAFTFANRLQQCRPCKAFEVTFIKTGESDNDH

SEQ ID NO: 4332 - protein, 689 aa, Desulfovibrio vulgaris; identical to SEQ ID NO: 4331

SEQ ID NO: 4333 - protein, 684 aa, Desulfurivibrio alkaliphilus
MDTLTLDQIDRKAAAALDGYLVRKDLVRTFSRQFPVPTYVVEFLLGRYCASIEQEEIEEGLEIVQRQLSDRTVRAGEEELFKSRAREQGEVKIIDLITARLDAKTDSYLATLPSLRLTDARIDAELVSRHERMLTGGFYAEITLDYDPIIAQEKNGRPFGVAGLREIQLSQRNVLDQLAAARANFSTTEWKEFLLRSIGIEPAGLTPRQVDAFLLRMVPFVERNYNLVELGPRGTGKSHLFQQVSPYAHLISGGKATVARMFVHMGTGQRGLVCQYDVVCFDEVSGISFDQKDGVNIMKGYMESGEFSRGKESIRADGSIVLVGNFGVDVEHQQRLGHLLGPLPPEMRDDTAFMDRIHAFLPGWDVPKISKELLTGHFGLVSDFLSECWSRLRSQSRLGSLQNRLYLGGALSGRDTNAVHKTISGLLKLLYPGQDAVIPDEDLEWAARIALEARRRVKEQQKRIGAAEFRNTHFSYVMGADGVEKFVSTPELQSENSIGGDPLEPGQVWAISPGGDEEHPGLYRIEVNEGAGNGVKILNKPVPPAFRESMGYAEQNLYARAIQLVGDKDPRHHEFTVQLRAFDASKSGAKLGVAALIALSTALLRKSVRGGLIVVGEINLGGSIEPVHNPVAMAEIAVEKGATVLLMPVTCRRQLFDLSDDMATKIDIQFYADARDALLKAMVD

SEQ ID NO: 4334 - protein, 743 aa, Enterobacter cloacae
MPHDEINPTEGEFVGKETAQEPAVNVTHITNNVVIQQMDVYTEKLAQPSGTTVDEASMLSIDDELSQHASMDLDARLNRYFKGKVVRKDLTKQLKEGANVPVYVLEYLLGMYCASDDDEVVREGLENVKKILAENYVRPDEAEKVKSLIRERGSFKVIDKIGVKLNQKKDVYEAQLSNLGIKDAVIPANIVKANEKLLTGGIWCIVTLNYFYEEGQRISPFSIFNLKPIQMPSMDMEELFAARANFSTDQWLDTLIRSIGMEPTNLKQRVKWHLLTRMIPFVENNYNVCELGPRGTGKSHVYKECSPNSLLVSGGQTTVANLFYNMSSRQVGLVGMWDVVAFDEVAGITFKDKDGVQIMKDYMASGSFSRGRDSIEAKASMVFVGNINQSVETLVKTSHLLAPFPEAMIDTAFFDRFHAYIPGWDIPKMRPEFFTNNYGLITDYLAEYMREMRKRSFSDAIDRFFKLGNNLNQRDVIAVRRTVSGLLKLLYPHGVFGKEEVRPCLTYALELRRRIKEQLKKLGGMEFFDVHFSYLDNETLEEFFVNVPEQGGSQLIPEGLSKPGVVHMATKGVTGQLGLYRFETQMTPGNGKHTTSGLGSNTPAKEAIRIGFDYFKGNLNRISATAKFSEHEYHLHAVELHNSGPSTKTSLAALVAFCSILMGKPVQEQMVVLGDMTLGGVVNPVEDLAGSLQLAMDSGGKRVLLPMASASDIPTVPAEIFSKFQISFYADPVDAVYKALGVQ

SEQ ID NO: 4335 - protein, 694 aa, Erwinia sp.
MQTHYDLPVPVISEGELVAEGYDLDALLNQHFRGRVVRKDLTKQLKEGANVPVYVLEYLLGMYCASDDDQIVEQGLQNVKRILADNYVRPDEAEKVKSLIRERGSYKIIDKVSVKLNQKKDVYEAQLSNLGIKDALVPPQMVKDNEKLLTGGIWCMITVNYFFEEGQKTSPFSLMTIKPIQMPNMDMEEVFTARAHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFYKLGNNLNQRDVIAVRRTVSGLLKLLHPNGAYSKEDVRVCLTYAMEARRRVKEQLKKLGGLEFFDVNFSYIDNETLEEFFVSVPEQGGSELIPAGMPKPGVVHLVTQAEGGMTGLYRFETQMTAGNGKHSVSGIGSNTGAKEAIRVGFDYFKGNLSRISATAKFSDHEYHLHAVELHSTGPSISTSLAALIAFCSVLLSKPVQEQMVVLGSMTLGGVINPVQDLAACLQVAFDSGAKRVLLPMASAMDIPTVPTELFTKFQVSFYSEPVDAVYKALGVN

SEQ ID NO: 4336 - protein, 694 aa, Erwinia pyrifoliae
MQTHHDLPVPVISEGELVAEGYDLDALLNQHFRGRVVRKDLTKQLKEGANVPVYVLEYLLGMYCASDDDQIVEQGLQNVKRILADNYVRPDEAEKVKSLIRERGSYKIIDKVSVKLNQKKDVYEAQLSNLGIKDALVPPQMVKDNEKLLTGGIWCMITVNYFFEEGQKTSPFSLMTIKPIQMPNMDMEEVLTARAHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFYKLGNNLNQRDVIAVRRTVSGLLKLLHPNGAYSKEDVRVCLTYAMEARRRVKEQLKKLGGLEFFDVNFSYIDNETLEEFFVSVPEQGGSELIPAGMPKPGVVHLVTQAEGGMTGLYRFETQMTAGNGKHSVSGIGSNTGAKEAIRVGFDYFKGNLSRISATAKFSDHEYHLHAVELHSTGPSISTSLAALIAFCSVLLSKPVQEQMVVLGSMTLGGVINPVQDLAACLQVAFDSGAKRVLLPMASAMDIPTVPTELFTKFQVSFYSEPVDAVYKALGVN

SEQ ID NO: 4337 - protein, 694 aa, Erwinia pyrifoliae; identical to SEQ ID NO: 4336

SEQ ID NO: 4338 - protein, 693 aa, Erythrobacter litoralis
MSALDDKINEHFAGYVVRKDLVKAVKGNAIVPTYVLEYLLGQYCATDDEASIDSGIDTVKDILKKHYVHRSEAGLIQSTIKEKGRYKVIDQISVSLNEKTDSYEAVFDNLGIKKVAVDSGTVKAHPKLLVTGVWCIADVQYEYSEDSRISPWVIETIKPIQIAKVDYEGYKQARAQFSKDEWIDLLMQSIGFNPEAFGRRSKLLQLMRLIPFVERNYNIIELGPKGTGKSHIYSEFSPHGQLISGGEVTIPKLFVNNANGRIGLVGYWDVVAFDEFAGREKTANKALVDIMKNYMANKTFSRGINPMGAEASFAFVGNTDHNVPFMLKNSDLFEALPPQFHDSAFIDRLHAYLPGWEIDVIRSEMFTTGYGFIVDYLAEILRHLRQEDFSNRPDLHFKISEKISTRDRDAVYKTMSGFLKVIFPAGGETAEDVEELLQLALESRKRVKDQLFRIDATYPEVDFSYTGSGGEKRRVQTVEEQEFPQFYYLKPALDPKQQDESSDAVDEDVTGDRPEAANASVSTRPAKPVAEEGHHVFAENRKGISYNKLFAPYLEGASRIVVTDPYIRYFYQIKNMMEFVEMVIQRKALEDQVAVHLVTGPDDGNVQKQRELLDSITEACTGTGVDFTWAFDSSGTGHSRDIITDTGWKIVLDRGLDIFQAPMRRDGFTLGDRLQEHRMLKNFYVTYVRQDQR

SEQ ID NO: 4339 - protein, 694 aa, Escherichia coli; identical to SEQ ID NO: 4064

SEQ ID NO: 4340 - protein, 694 aa, Escherichia coli; identical to SEQ ID NO: 4064

SEQ ID NO: 4341 - protein, 694 aa, Escherichia coli; identical to SEQ ID NO: 4039

SEQ ID NO: 4342 - protein, 694 aa, Escherichia coli; identical to SEQ ID NO: 4056

SEQ ID NO: 4343 - protein, 691 aa, Escherichia fergusonii
MTTDFSQDHKDEKNQMQSADLDALLNQYFKGRVVRKDLTKQLKEGANVPVYVLEYLLGMYCASDDDEVVMQGLDNVKKILAENYVRPDEAEKVKSLIRERGMFKIIDKVSVKLNQKKDVYEAALSNLGIKDALVPTKIVQDNEKLLTGGIWCIITVQYFFEEGQKTSPFSIMSLKPIQMPSMNMDEVFSTRRHFSTDQWMDVLLRSVGMEPTNLEHRVKWHLITRMIPFVENNYNVCELGPRGTGKSHVYKECSPNSLLVSGGQTTVANLFYNMSSRQVGLVGMWDVVAFDEVAGINFKDKDGVQIMKDYMASGSFARGRDSIEAKASMVFVGNINQSVETLVKTSHLLAPFPEAMIDTAFFDRFHSYIPGWEIPKMRPEFFTNSYGLITDYLAEYMREMRKRSFADAIDKFFKLGNNLNQRDVIAVRRTVSGLLKLLHPDAQYTKDDVRACLTYALETRRRVKEQLKKLGGMEFFDVHFSYIDNDSLEEFFVNVPEQGGSKLIPEGLPRAGVVHLVTQGSTGQLGLYRYETQMMAGSGKHSVSGLGSNTAAKEAVRVGFDYFKGNLNRISASAKFSDHEYHLHVVELHNTGPSTKSSLAALIAFCSILMNRPIQEQMVVLGEMTLGGVVNPVQDLAGSLQLAMDSGAKRILLPMASASDIPTVPAELFSKFQISFYADPVDAVFKALGVN

SEQ ID NO: 4344 - protein, 685 aa, Exiguobacterium sibiricum
MAEETDGTSTLDLDKKLNDIFAGRVVRKDLTKLIKEGANVPVYVLEYLLGMYAATDDEQSIQEGVDRVKKILTDNFVRPDESEKIKSRIRELGQYSIIDKVTVALNPKIDTYEAEFSNLGLKGVPIPSNFVKEFDKLLVGGIWCMVKIDYYYDEEGRASNPFSVSSLQPIQMPNMDMNEVFEGRKQFTKNEWIDALIRSTGMEPTQLEERVKWHLLLRLVPLVENNYNMCELGPRGTGKSHVYKEISPNSILVSGGQSTVANLFYNMSTRKVGLVGMWDCVAFDEVAGIRFKDKDGIQIMKDYMASGSFARGKEEKNASASMVFVGNINQSLDVLLKTSHLFAPFPEEMANDTAFFDRMHYYMPGWEIPKMRPDFFTDKYGFIVDYIAEFFREMRKRSFADSTDRYFKLGNNLNQRDTIAVRKTVSGMVKLIYPNGIYTKEDIEEILRYALEGRRRVKEQLKKIGGMEFYDVMFSYIDKETLEEEHVSVPEQGGGKLIPEGMGKSGHIYVVGHGNSGMIGVYKLENQVVSGTGKFDKSGVGSSRETKESLDTAFRFFTANSKSISNTISTKTKDYLMHISDLQGIGLTNELAIAELIGLCSAALDKSVQESTVVIGNMTVGGTIAKVEEFASVLQVCVDAGAKKVLIPASSVMDLQTVPPDLLVKVQPVFYADPTDAVFKALGVN

SEQ ID NO: 4345 - protein, 682 aa, Flavobacterium branchiophilum
MIVLDDLDKKALDHFRGYVVKKDLVGIIKGGANVPAFVLEYLLANTCSTEDEEKLKEGMENVKTILRDHYINPEESTLIQSKLKEKGSYKIIDKISVQLDPQKDKYWANISNSNIRKANISDELVTSHEKLLLGGIWAIIDMEYDPMITVGSTVFPFVVKEIRPIQLSSFDNSKISDKRKEFTTEEWKKLLLRSAGYEPYSEGLDERKLNLLLCRLIPLVEANFNMVELGPRSSGKSYIYKEITPYAILISGGQGSVAQLFVNNTSGRVGAVGLWDAICFDESTDKLFKDRDAIPLMKDYMESGSFSRAKGGEISGSASIILNGNINQPVETVLQTSHLFSPLSDEVNHDTAFLDRINLFLPGWEITKFSPQNFTHHFGFSTDFFSEVLKSQRKTTYYDALNKYFSLGSHLKQRDSKSIRRIISGFLKLLHPNGEYSKEDIREYLIIAMEMRRRVKEQLKRIGGMEFWDTNFSYIDKETQEEIFVGLPEEKGSSLIEANPLAPGVCYTATSDGDNNSLIKIEVVALKGSGKLNITGTNSTEVKENIKNTFNYIRANEKTILNEQHSLANYDLNIQVSNIMGANIHDGIGSAVYVAIISAIYKKNLKAGLAVLGNVSIGGAIERALNFADKVTLLSENGAKTVIVPMDNLSEIGTLPTTILGKTDVPFYGNSQMLLQKSVLGE

SEQ ID NO: 4346 - protein, 676 aa, Gallionella capsiferriformans
MIDSNQEKSLDVLLNEFLPGKVVRKDLTKLIKEGANVPVYVLEYLLGMYCASDDPATIEAGLTNVKRVLAENYVRPDEAEKVKSKIRESGSYKVIDKVTVKLNEKRDSYEAMLSNLSIRDAEIPDSDVRNFEKLLVGGIWCIVTLRYRFEENQKGSPFSISDLKPIQMPNMDMEALFNARKGFTEEQWIDSLIRSTGMEPTCFDQRVKWHLLARMIPLVENNYNICELGPRGTGKSHIYKEISPNSILVSGGQTTVANLFYNMGSRKIGLVGLWDVVAFDEVAGINFKEQDGIQIMKDYMASGSFSRGRESINASASMVFVGNINQSVEQMVKTSHLLEPFPDAMIDSAFFDRFHAYVPGWEIPKMRPEFFTNQYGMIVDYLAEWMREMRKRSFADAIDKWFKLGNNLNQRDTIAVRRTVSGLLKLTCPHGEYGKESVRRALEYALETRRRIKEQLKKIGGMEFYDVHFSYIDLEDGQERFISVPEQGGGSLIPDGRPNPGTLHTISIGENGMPGVYRLEIQSIAGNGKISISGNNSREPSRVAFDYFKAHASRVSGAIKPSDYDYHLHLVELQNSGAPETLTLANFIALCSATLGKSMQSQMVVMGDMSLGGTITQARNLAESLQVAFDAGAKRILLPMSSVTDIPTVPGELFAKFQTSFYSDPVDAVFKALGVE

SEQ ID NO: 4347 - protein, 681 aa, Gallionella capsiferriformans
MQLDDLDRKAADAFDGYIVRKDLVRQFSRQFPVPTYVVEFMLGRYCATIDENEIQEGLGIVQRQLSERTVRAGNEELIKSTAKEKGQVRIIDIIAARLDAKTDSYLVELPSLKLRDVRVSSELVNQHQRMLTGGFYAEVTLGYDASIALEKGGRPFSVDGLRAIQLSQRDVLDKLSQARAKFTTAEWKDFLLRSIGIEPAGMLDRAKDAMLLRMVPFVERNYNMVEIGPRGTGKSHLFQQVSPYAHLVSGGKATVARMFVNNANGQRGLVCQYDVVCFDEVSGISFDQKDGVNIMKGYMESGEFSRGKESIRADGSIVMVGNFDVDVEHQQRIGHLFQPLPPEMRDDTAFMDRIHCYLPGWDVPKLKPDIFTNHFGLVSDFLSECLTQLRSQSRLATLQNRVFFGGALSGRDINGVNKTISGLLKLISPNQDAEISDEDLEWAVRLGLEVRRRVKEQQKRIGAAEFRNTHFGYTIGAEGVEKFVSTPELQGQNGIGDEPLEAGQIWVLSPGGQDEHPGLFRLEVTEGPGSGVRILNKPVPQAFQESIRCAEQNLYARALQLVGDRDPRSHEFSAQLRGFDSAKTGAKTGVASLIALCSALLRKSVRGGLIVVGEVTLGGTIEPIHNAVSLAELAVEKGAKSLLLPVACRRQLFDLSDDMATKLDIEFYQDAKDALLKALVD

SEQ ID NO: 4348 - protein, 676 aa, Geobacter sulfurreducens
MNDVLDQKLVDVFSGKVVRKDLVRKVKVGANVPVFVLEYLLGKYCATDDEAAMEAGLRVVNNTLAENFVRPEEANKAQALVREKGRHTFIDKVKVRYLAEDDKYWAECVNFGHKYLHIPERYIREYDRLLMGGVWAQMEIRHQYDEEAKGRRSPFWIESITPIQLATFDLNAYQEGRRQFTSEEWVDMLIRSVGMEPEHFTRRLKLLFLIRLIPLCEANYNLVELGPRGTGKSYAYQELSPYAILMTGPTTVANLFFNISTNKMGLVGLWDAVAFDEVADLEKMPKEVVTTMKTYCESGSFARGKESLSGMASIALFGNTNQPVETMVKSSHLFIPLPEIVREDMAFLDRIHYYIPGWEIPKMRIEYFTQHYGFVVDYLAEALRELRRHNFTEVSDRYFSFGAHLNARDVKAVRKTVSGLVKLLYPHGEFTKDELAETVDIAMEGRRRVKEQLKKMGSFEYHQTSFSYRDNESTEERYIGVPEEGGRALISTDPLAPGSVYAASVNADGKVGLYRIEVGVSAGTGKLKLAGGVESTMKESITRAFGFLQGHKVPMGIASIFDTTDFHVEAIDLLTNRVGCEAGIAFIIAIISAIKKTQVAPGMVILGDLSIQGNIKGVSSLSEPLQIAMENGAKRALIPLENKRNFLEVSGEIVEKVDPVFFSDPQTAAAKALNLS

SEQ ID NO: 4349 - protein, 681 aa, Haliscomenobacter hydrossis
MELDQIDQLSAKAFEGFIVRKDLLEQFRKTYPVPTYVIEFLLGRYCATTDEEEIQEGLEIVKRQLQDRTVRPGEEEYFKSKAREKGSIKLIDIITARLDTASDSYVATLPSLQLNKVRISPELVNANDRMLTGGFYAEIELEYDATIAQENNGRPFGISNIRPIQLSQRNVLEVLYKGREFFSLTEWKDFLIRSVGMEPASLSERARNVLFARMIPFVERNYNLIELGPRGTGKSHLYQQISPYAHLVSGGKATVAKMFVNMGSGERGLVCKYDVVCFDEVSGVSFDQKDGVNIMKGYMESGEFSRGKEPIRADGGIVMVGNFDVDVEHQQRISHLFGPMPKEMRDDTAFMDRIHAFAPGWDFPKLNKTYFTTHFGLVSDFLAECWTRLRDTSRLSSVLPRIDFGGALSGRDTTAVNKTINGLLKLMQPNPEAPISDELLEWAIKVALEYRRRVKEQQKRIGSAEFRNTHFSYRIGEDGIETFVTTPEIHSESTIGDDPLPPGQIWALNAGGQEETTGLYKIEINTGPGSSVKILNKPAPPQFQESVRYAEQNLYSKGKELLGDRDPRSHEFSIQLRAFDASKSGNGMGMAVLMGMCSAILGKNTKGGLVIIGQLNLGGSLDLVYNAVNLAEIAVEKGATTLLVPLNARKQLNELSDDMITKINIQYYTDLRDCLMKALLD

SEQ ID NO: 4350 - protein, 694 aa, Klebsiella oxytoca
MQIHHDLPVPAVSEGELVAEGYDLDALLNQHFRGRVVRKDLTKQLKEGANVPVYVLEYLLGMYCASDDDQIVEQGLQNVKRILADNYVRPDEAEKVKSLIRERGSYKIIDKVSVKLNQKKDVYEAQLSNLGIKDALVPPQMVKDNEKLLTGGIWCMITVNYFFEEGQKTSPFSLMTLKPIQMPNMDMEEVFTARTHFNRDQWIDVLLRSVGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFYKLGNNLNQRDVIAVRRTVSGLLKLLHPNGCYSKEDVRVCLTYAMEARRRVKEQLKKLGGLEFFDVNFSYIDNETLEEFFVSVPEQGGSELIPAGMPKPGVVHLVTQAESGMTGLYRFETQMTAGNGKHSVSGLGSSTSAKEAIRVGFDYFKGNLSRVSATAKFSEHEYHLHVVELHNTGPSTATSLAALIALCSVLLAKPVQEQMVVLGSMTLGGVINPVQDLAASLQLAFDSGAKKVLLPMSSAVDIPTVPAELFTKFQVSFYSEPVDAVYKALGVN

SEQ ID NO: 4351 - protein, 684 aa, Lactobacillus casei
MTSDSAHDEASENDATLIKLEQNFPGRFVRKDLTQRIKEGANVPTYVLEFLLGQFANSSDTETIERGVENVKKTLAHNYVRPDEAEKVKSKIREDGAYTVIDKLSVRLNEGEDRYEASFSNLGLTGVPVDEHYVQDYERLLIGGIWSIVRVSYDHESLDHFSIQKLNPIQVPFVDMQEVYAGRKAFTTEEWLDVLLRTTGMEPTQFTEREKWLLLSRLIPFVENNYNFVELGPRGTGKSHVYKELSPDSILISGGQTTVANLFYNMSRREVGLVGMWDVVAFDEVAGIHFKDKDGVQIMKDYMASGSFARGRNEIQASAGMVFVGNINQSVDVLLRTSNLFEPFPEMMGNDTAFLDRIHNYLPGWEIPKYRPEFFTKGFGFITDYFAEVMRELRKISYADAIDEYFSFGKQLNQRDVIAVRKTVSGLIKLLYPDGVFEKADVAKILEFAMEMRRRVKEQLKRIGGMEFYDVNFSYIDKTTFEETYVSVPETGSSSLIPDGQENPGHVYTVAYDESKRLSLIKLETQVVPGLGRLSKSGVGSSTKAKEAMDTAFKYLEANYKGIDQRINANARDFVVSATNLNNSVPSSHISLATFIALVSIALGKPTLDRLVILGDFTIGGTISRIDDLADTLQVALDSGAKRVLLPAAAASDISGVPTDLMSSFNLIFYNSVKDAAFKALGVS

SEQ ID NO: 4352 - protein, 684 aa, Lactobacillus rhamnosus
MTSDDTQADSVKNDEVLVKLEQNFPGRFVRKDLTQRIKEGANVPTYVLEFLLGQFANSSDEETIERGVENVKKTLAHNYVRPDEAEKVKSKIREDGAYTVIDKLTVHLNEGEDRYEASFSNLGLTGVPVDERYVQDYERLLIGGIWSIVRVSYDHESLDHFSIQKLNPIQVPFVDMKEVYAGRKAFTTDEWLDVLLRTTGMEPTQFTEREKWLLLSRLIPFVENNYNFVELGPRGTGKSHVYKELSPDSILVSGGQTTVANLFYNMSRREVGLVGMWDVVAFDEVAGIHFKDKDGVQIMKDYMASGSFARGRNEIQASAGMVFVGNINQSVDVLLRTSNLFEPFPEMMGNDTAFLDRIHNYLPGWEIPKYRPEFFTKGFGFITDYFAEVMRELRKISYADAIDEYFSFGKQLNQRDVIAVRTTVSGLVKLLFPDGVFTKDDVAKILEFAMEMRRRVKEQLKRVGGMEFYDVNFSYIDKVSFEEKYVSVPESGSSSLIPEGQENPGHVYTVAYDDSKRLSLIKLETQTVPGLGRLNRSGVGSSTKAKEAMNTAFNYLEANYKSIDQRINADARDFFVSATNLNNSAPSSHISLATLIALVSIALGKPTLDRLVILGDFTIGGTISRIDDLADTLQVALDSGAKRVLLPAAAASDISSVPTDLMSSFNLIFYNSVKDAAFKALGVG

SEQ ID NO: 4353 - protein, 684 aa, Lactobacillus rhamnosus; identical to SEQ ID NO: 4352

SEQ ID NO: 4354 - protein, 712 aa, Leuconostoc kimchii
MTLVNDDNNLHDDLESSNDDVDITATEVLASGSDSNFDLLDKLEINFPGRFVRKDLTQRIKEGANVPSYVLEYLLGMYANSSDPATIEQGVENVKKTLANNYVRPDEAEKIKSKIRENGAYTVIDKLTVTLNTRLDRYEAAFSNLGITGVPVDSRYPQDYERLLGGGIWAIVRLSYYHDDMESDSTAPFNVEKLTPIQVAGLDMSEVRQGREKFTTDEWIDLLLRTIGMEPTQFEKRQKWLFISRLIPMVENNYNFVELGPRGTGKSHVYKELSPNSILVSGGQTTVANLFYNMSRHQVGLVGMWDTVAFDEVAGITFKDKDGVQIMKDYMASGSFARGKDEIQASASMVFVGNINQSVDVVMRTSHLFDPFPDVMANDSAFLDRIHNYLPGWEIPKYKPSFFTKGYGFITDYFAEVMRELRKISYGDAFEAYFKLGNQLNQRDTIAVRKTVSGMIKLIYPHGEFSKEDVEEVLRFAIEMRRRVKEQLKKIGGMEFFDVNLSYIDNETFEEKFVAVPEQGSSTLIPVGTEKPGHVYSVGYDAGNRLSLFKIETQMTAGNGKFATTGIGGHRGAKESMDTAYKYLKANAGQVSGTISLSQHDFILNATNLNNGLMTDHLSLATYLALISISLAKPTVDSLVVVGDLTIGGSVVKPENLADTLQVARDSGAKKVLLPMTSAADFGTVPSDLLGSFTIIFYNTIEEAAFKALGVE

SEQ ID NO: 4355 - protein, 678 aa, Methanoculleus bourgensis
MAELDALDQLVADVFDGYVVRKDLAQKFKGNYPVPTYVAEFLIGKYCATTDEEEIREGLEIVQRQLSERIVRAGEQELYKAQAKVHGSVKVIDLITARLDAKSDSFLATVPSLLLNDVHISSELVYEHERMLTGGFYAEIELAYGDPESNRPFSVMRLRPIQLSKRNVLNDVTRGRESMSDQEWKDILIRSVGIEPSSLSSRAQDVLFLRMVPFVEKGYNMIELGPRGTGKSYLYQQVSPYSHLVSGGKATVAKMFVNNATGQRGLVCQYDIVCFDEVSGINFDQKDGVNIMKGYMESGEFSRGRESIRAEGGIVMLGNFDVDVEHQQRVGHLFGPLPKEIRDDTAFMDRIHSYVPGWDYPKIHPDMMTEHFGLVSDFLSECWRQLRSENRLHLINDRVFFGDALSGRDRRAVNKTVNGLLKLIYPSPDMEISDETLEWAVRIALECRRRVKEQQKRIGSAEFRNTMFSYRLGLDGIEQYVSTPELHSENEIGQDPLPPGQVWAVGPGDENEGSGLYKIEVTVTPGSSIRLINVKAPSGLREGLRAAEQVLYTQAKSLIGDRDPKGSEFSVQVRALTAVKGASSLGMSILLALCSAALGRSLKGGVVVAGGISVGGTVEPVYSALDMAELAAENGASAILLPVSSRRQLNEMSDDLASRLMVIYYKDPRDALFKVLGE

SEQ ID NO: 4356 - protein, 679 aa, Methanolobus psychrophilus
MLTNDTDIGTDEKLNLYFPGRVVRKDLTKQIKVGHNVPVYVLEYLLGANCATTDEELIQQGVKKVKGILSDNYVRPDEAEKIKSKIRETGYYTIIDKVSVKLNEKRDIYEALFSNLGLSAVQVDPEYVTRYDKLLGGGIWCIIKMEYNAEMVPSPFIISSLKPIQIPNINISEVIEQRKNFTKDEWIDVLLRSVGMEPTQLEMPAKWHLLERMVPLVENNYNLCELGPRSTGKSHIYKEISPNSILISGGQTTVANLFYNLGTRQVGLVGLWDVVAFDEVAGIRFKDKDGIQILKDYMASGSFARGKDQINANASIAFVGNVNQSISSLLKTSHLFSPFPEAMNNDSAFFDRMHYYLPGWEVPKFRPEHFTDRYGFIVDYLAEFLREMRKRSYSDLIFRYFSLGNNLNQRDVIAVKKTVSGLAKIIHPDEDISKQDAQEILEYALVGRRRVKEQLKKIGGMEFFDVNFSYIDNEDMEEHFVNVPESGGNKIIPPGLTKPGQVYAVAATESGKIGIYKTELQVVSGSGKYEASGLNSNAKAKESVKTAINYFKANAKSISQSISTKERDYFMNLQDVYGVGASDGLSLAAFISLCSGALERPIQEQTAIIGTMTIGGSILNIDNLSDLLQVSLDAGARKVLIPASATSKLGTVPADLLSKFQLAFYADPVDAVHKALFFG

SEQ ID NO: 4357 - protein, 678 aa, Methanomethylovorans hollandica
MPEADTDITTDRKLNTYFQGRVVRKDLTKLVKVGHNVPVYVLEYLLGANCATDDEELIEQGVRKVKNILSENYVRPDEAEKIKSKIRETGYYTIIDKVSVKLNEKRDIYEAVFSHLGLSKVQVDPEYVTKYDKLLGGGIWCIIKMEYSAEMLPSPFVIASLKPIQIPNINISEIIDQRKNFTKDEWIDVLLRSIGMEPTQLETPAKWHLMERLVPLIENNYNLCELGPRSTGKSHVFKEISPNSILISGGQTTVANLFYNMGTRQVGLVGLWDVVAFDEVAGIKFKDKDGIQIMKDYMASGSFARGKDQINANASIVFVGNINQSVSSMLKTSHLFVPFPEEMNNDSAFFDRMHYYLPGWEVPKFRPEHFTDRYGFIVDYLAEFLREMRKRSFTDVLFKYYKLGNNLNQRDVIAVKKTFSGLAKLIYPDENITKEDAREILEYALVGRRRVKEQLKRMGGMEFFDVNFSYIDNDNMEEHFVNVPEISGNKIIPPGLTKPGQVYAVSATDSGKIGVYKTELQVVSGTGKYEPSGLSSNSKARESIRTAINYFKANAKSISQSISTKENDYFMNIQDLYGVGLSDGLALAGFISLCSGAMERPVQEQTAIIGTMTIGGSILNIDNLSELLQVSLDAGAKRVLIPASSTSKLGTVPSDLLSKFQLSFYADPMDAVHKALYF

SEQ ID NO: 4358 - protein, 682 aa, Methanosarcina acetivorans
MTEEALEIASLETDRKLIQYFPGRVVRKDLTKLLKVGHNVPVYVLEYLLGSYCADEDEEVIQEGIQIVKNILSQNYVRPDEAEKIKSRIRETGYYTVIDKITVMLNERRDIYEATFSNLGLKSIEVDSDYVIKYDKLLGGGIWCMIKMEYSTESASSPFIISSLKPIQIPNVNIQEILVERKNFTKDEWIDVLMRSIGMEPTQLEASTKWHMLERLVPLVENNYNLCELGPKSTGKSHVYKEISPNTILMSGGQTTVANLFYNMATRQIGLVGYWDVVAFDEVAGIRFKDKDGIQILKDYMASGSFARGKEQKNANASIVFVGNVNQSIESLLKTSHLFSPFPEAMNSDTAFFDRMHYYIPGWEIPKFRPEHFTDRYGFIVDYIAEFFREMRKRSYADNINRFFKLGNNLNQRDVIAVKKTFSGLMKLLYPDENITREQAQEILEYALTGRRRVKEQLKKIGGIEFFDVNFSYIDNENLKEAFVSVPESGGNKIIPSGITKPGEAYAVAATDFGKIGIYKFEVQVIAGSGKYEKSGTGSNSQTKESIKTAFNYFKANAKSISQSISVKEKDYFLHVQDLYGVGMSEELALPAFISLCSGALERSLQEQTAILGSMTIGGSVGVLENLAGLLQVCLDAGAKRVMIPISSAGKIATVPPDLFSKFQISFYEDPIDAVYKSMALI

SEQ ID NO: 4359 - protein, 682 aa, Methanosarcina mazei
MTEESLETESLETDRKLIQHFPGRVVRKDLTKLLKVGHNVPVYVLEYLLGSYCADDDEEVIQEGIQIVKNILSQNYVRPDEAEKIKSRIRETGYYTVIDKITVILNERRDIYEAEFSNLGLKNIEIDSDYVIKYDKLLGGGIWCMIKMEYSTESASSPFIISSLKPIQIPNVNIQEILAERKNFTKDEWIDVLMRSIGMEPTQLETSTKWHMLERLVPLVENNYNLCELGPKSTGKSHVYKEISPNTILMSGGQTTVANLFYNMGTRQIGLVGFWDVVAFDEVAGIRFKDKDGIQILKDYMASGSFARGKEQKNANASIVFVGNVNQSIESLLKTSHLFSPFPEAMNSDTAFFDRMHYYLPGWEIPKFRPEHFTDRYGFIVDYIAEFFREMRKRSYADNINRFFKLGNNLNQRDVIAVKKTFSGLMKLIYPDENITREQAQEILEYTLVGRRRVKEQLKKIGGIEFFDVNFSYIDNENLKESFVSVPESGGNKIIPAGITKPGEAYAVGATESGKIGIYKFEVQVVAGSGKYEKSGTGSNTQTKESIKTAFNYFKANAKSISQSISVKEKDYFLHVQDLYGVGMSEELALPAFISLCSGALERSLQEQTAILGSMTIGGSVGILENLAGLLQVCLDAGAKRVMIPISSAGKIATVPPDLFSKFQISFYEDPIDAVYKSMSLI

SEQ ID NO: 4360 - protein, 681 aa, Methanospirillum hungatei
MAELDNLDEQVTKIFDGYVVRKDLAQQFRGSYPVPTYVAEFLIGRYCATTDDEEIKEGLEIVQRQLQERIVRAGEQELFKARAREKGSVKIIDLVTARLDTKTDTFEASLPSLILDDVYIPAEMVYDNERMLTGGFYAEVEIEYGSGIEGKGGRPFSITNLKPIQLSKRNVLSDLAEGRKQMSTEDWRSFLIRSIGLEPETLSKRAQDVIFLRMIPYVEKNYNCVELGPRGTGKSYIYQEISPYSHLVSGGKATVAKMFVNNATGQRGLVCQYDLVCFDEVAGIKFDTKEGVNIMKGYMASGQFSRGRENIRAEGGLVMVGNFDVDVEHQQRIGHLFGPLPPEMRDDTAFMDRIHSYIPGWDFPKYHPTQLTTHFGLVSDFLSECFRQLRNDSRLPKIMDRVSFGDALSGRDRTGVLKTLDGLLKLLYPAHDSDISDEDLEWAVRLALECRRRVKEQQKRIGSAEFRNTMFSYRLGIEGIEQYVSTPELHRENTISPEPLPPGQVWALGPGEGNEGNGLYKLEITVTPGSSIRLINVKAAAGLRESLRSAEQVLYTRAKSLVGDHDPTSVEFSVQVRAMTPVSGGSSLSVPILIALCSAALNKSTKGGYVIAGGMSVGGTLEPVYNALDMAELAAEKGALAIVLPVSCRKQMNEMSDELAARLVVLYYTEPRDALLKMLDE

SEQ ID NO: 4361 - protein, 687 aa, Methanospirillum hungatei
MTDLTPEPLPEQSDDPDTDRKLNTWFPGRVVRKDLTIKLKGSNNVPVYVLEYLLGSYCATDDESLIEEGVTKVKRILADNYVRPDEAELIKSRIRETGYYTVIDKITVRLNEKRDVYEAEFSSLGIKEIEIEPETIRRYEKLLGGGIWCIVKMEYMSEGSRSPFVIASLKPIQIPNMDINELIDRRKYFTKDEWIDILLRTVGMEPDTLDYTVKWHLLLRLVPLVENNYNLCELGPRSTGKSHVYKEISPNSILISGGQTTVANLFYNLSLRQVGLVGLWDVVAFDEVAGIRFKDKDGIQILKDYMASGSFARGKDQINANASIVFVGNVNESIQSLLKTAHLFAPFPDAMNNDSAFFDRIHYYLPGWEVPKFRPEHFTMRYGFIVDYLAEYLREMRKRSFGDTIFKYFRFGSNLNQRDTIAIKKTCSGLLKLIYPDDSATKEDVREILEYALVGRRRVKEQLKKIGGIEFYDVNFSYFDNEEGTEHFVTVPESGGSKLIPEGMTKPGQVYSVSRNEEGKIGVYKFELQVIPGSGKYEKSGLGSNMKAKESVQTAFHYFKANAKSVSQSISTKERDYQLHVQDLMGVGISDELALPAFISLCSGALGKPVHESIVILGTFTIGGSVSTIDNLSDLLQIALDAGAKKVLIPISSAGKISVVPPDLFSKFQISFYEDPVDAVYKSIVLS

SEQ ID NO: 4362 - protein, 713 aa, Microlunatus phosphovorus
MTDTGSPGAQNPEAEPSAPQQSDLDYMINLLFGGSVVRKDLVKAVKGNAIVPSYVLEYLLAQYAASDDEATIQAGIDAVRRILADHYVHRNESELVKSTIREKGRHRIIDKVTVTLNDKQDVYQASFANLGLNGVIVEPATVKANPKLLVGGVWCICDIEYFHTDDARVVPWILGSLKPIQMSSFDYEGYLASREGFNTEEWIDLLIQSIGFNPEMFGRRAKLLQLVRLIPFVERNYNLVELGPKGTGKSHIYSEFSPHGMLISGGEVTVPKLFVNNANGRIGLVGYWDVVAFDEFAGKKKRTDKALVDIMKNYMANKSFSRGVETLGAEASMVFVGNTSHNVPYMLKHSDLFDELPEAYHDSAYLDRLHFYIPGWEVDTIRSEMFSSGYGFVVDYIAEVLRAMRHTDYSDRYQQHFTLGSDISTRDRDGIHKTFSGLMKLIYPNGQATPDEIEELLRFAVEGRKRVKDQILRIDTTMAAVNFGYSDKTGTWRGVTTLEEDEYPDYYQARRAQTEEDPDPFGPAESSEEKGEAPLLPPVEVVPQLFEGHREFQENQRGISYETLLMPYLLGASEISIVDPYIRLAHQGRNLVDLLALLAASKDPADEIAVTLVTKEVRGEYEQQHLLMLKDIQDSAATVGIQFTVAWDQTIHDRSIRTDHGWKLLLGRGLDIFQKGSGNQFDLGSRRQEFRQVFAFGITYINECKGPDDDFKH

SEQ ID NO: 4363 - protein, 682 aa, Moorella thermoacetica
MELDALDKLAASVFDGYIVRKDLVRKYSRQYPVPTYVVEFLLGRYCATVDEKEIEEGLEIVERQLRDRTVRTGEEELFKARAREIGSIKIIDLIKARLDTKNDCFVAQLPSLGLKDVRIDDALVHENERMLTDGFYAEVTLVYDATIAQEKNGRPFAIENLRAIQLSKVDALAALQRGRSQFTTDEWKRLLIRSVGLEPDTLSERAQDIALLRMVPFVERNYNLVEIGPRGTGKSHLFQQISPYSHLISGGKATVAKMFVNNATGQRGLVCHYDVVCFDEVSGISFDQKDGVNIMKGYMASGEFSRGKESIRASGGIVMLGNFDVDVQQQQRIGHLFSPLPPEMRDDTAFMDRIHAYVPGWEFPKLNPNIHLTDHFGLVSDFLSECWHRLRDGSRVSVLQGRVNWGGALSGRDIEAVHKTVSGLIKLLFPDPEMPIPDEELEKIVRLALESRRRVKEQQKRCLKTEFRNTHFSFSMGVEGVEQFVATPELHSDETIDSDPLPPGQVWAISPGGQDASPALYRIEVAAGPGSGVKILNAPVPPAFRESVRYGEQNLYVRAKELVGDRDPRAREFSIQLRAMDVERSGQGLGLPVLIALCGALIERSVKGGLIIVGALNLGGSIEMIPNPVAVAELALEKGATTLLMPISSRRQLFDLPDEMATKINIEFYADATDAFVKAIVD

SEQ ID NO: 4364 - protein, 697 aa, Parvularcula bermudensis
MTALDNKINEHFAGFVVRKDLVKAVKGNAIVPTYVLEYLLGQYCATDDEASIATGIETVKDILRMHYVHRSESRLIQSTIREKGRYKVIDQVSVALNEKTDNYEAVFENLGIKKVAVDSGTVKAHPKLLVTGVWCIADVQYEFNEDARISPWILESIKPIQIAKVDYDQYRALRGEFTTDEWIDLLMQSIGFNPEAFGRRSKLLQLMRLIPFVERNYNIIELGPKGTGKSHIYSEFSPHGQLISGGEVTVPKLFVNNANGRIGLVGYWDVVAFDEFAGREKTANKALVDIMKNYMANKSFSRGITPMGAEASFAFVGNTDHNVPYMLKNTDLFEALPAQFHDSAFIDRLHAYLPGWEVDVIRSEMFTSGYGFIVDYLAEILRHLRSEDFSNRPDEFFSISPKVSTRDRDAIYKTMSGFLKLVFPAGDQTEAEVEELLRLAMESRKRVKDQLARIDSTYPEVDFYFVGSDGEKHAVTTVEEEEYPQFYYKGSRSEHDGEGDPSTAQGEKQRTSGEQTAPPSEGQHSVIGGVALEEGHHVYAENRKGVSYDKLFGPYISGAQRIVVTDPYIRFFYQIRNMMEFVEMVIRRKPPEDQVSIHLVTGPDDGNISRQRELLDSISTACTGTGVEFSWAFDESGTAHARDILIDTGWKIVLDRGLDIFQAPIKTDGFALGDRLQEHRMLKNFYVTYVREDQAAR

SEQ ID NO: 4365 - protein, 694 aa, Pectobacterium carotovorum
MQTHHDLPVPAVSEGELVAEGYDLDALLNQHFRGRVVRKDLTKQLKEGANVPVYVLEYLLGMYCASDDDQIVEQGLQNVKRILADNYVRPDEAEKVKSLIRERGSYKIIDKVSVKLNQKKDVYEAQLSNLGIKDALVPSQMVKDNEKLLTGGIWCMITVNYFFEEGQKTSPFSLMTLKPIQMPNMDMEEVFTARTHFNRDQWIDVLLRSVGMEPANIEQRTKWHLLTRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVETLVKTSHLLAPFPAAMIDTAFFDRFHAYIPGWEIPKMRPEFFTNRYGLITDYLAEYMREMRKRSFSDAIDKFYKLGNNLNQRDVIAVRRTVSGLLKLLHPNGSYSKEDVRICLTYAMEARRRVKEQLKKLGGLEFFDVNFSYIDNETLEEFFVSVPEQGGSELIPAGMPKPGVVHLVTQAESGMTGLYRFETQMTAGNGKHSVSGLGSSTSAKEAIRVGFDYFKGNLSRVSATAKFSEHEYHLHIIELHNTGPSTATSLAALIALCSVLLAKPVQEQMVVLGSMTLGGVINPVQDLAASLQLAFDSGAKKVLLPMSSAVDIPTVPAELFTKFQVSFYSDPVDAVYKTLGFN

SEQ ID NO: 4366 - protein, 679 aa, Pelobacter propionicus
MDTQLNCSLDSLLNQHFAGKVVRKDLTKLVKEGANVPVYVLEYLLGMYCASDNEEVIQDGLVNVKKILAENYVRPDEAEKVKSKIRELGTYKVIDKVTVKLNEKRDTYEALLSNLGVKGVEIASGTVKKYEKLLVGGIWCIVTLNYFYEENMKGSPFSIGDLKPIQMPNMDMEGLFEGRKAFSQEQWMDVLVRSTGMEPSVLEQRVKWHLIARMIPFVENGYNLCELGPRGTGKSHIYKEISPNSILVSGGQTTVANLFYNMGSHQVGLVGMWDVVAFDEVAGISFKDKDGVQIMKDYMASGSFARGKDQISANAAMVFVGNINQPVDTLVKTSHLLAPFPESMIDSAFFDRFHCYIPGWEVPKMRPEFFTNQYGLIVDYLAEYLREMRKYNFSDAIDKFFKLGNNLNQRDTIAVRRTVSGLLKLLYPHGEFDKEAVRQCLHYALEVRRRIKEQLKKIGGMEFYDVHFSYIDNESMEERFIGVPEQGGSSLIPEGQLKPGTLHTVSTGSGGMLGLYRLELQVIGGNGKLSLSGFGTSQNAKEPVKVAFDYFKANLTRVSGIAKAIDHDYHMHMVELHNTGPASALTIASFVCFCSGLLGKPIQSQMVILGDMSLGGSIIPAENLAESLQVAFDAGAKRILIPMSSVKDIPTIPGELFAKFQTSFYADPVDAVFKALGVD

SEQ ID NO: 4367 - protein, 684 aa, Pelodictyon phaeoclathratiforme
MSIVLDQLDEKLLEHFRGFVVKKDLVQMLKVGENVPVFVLEYLIANSCSTNDEEAIKKGLDNVKRILSDHYVNPEESALIHSKIKNEGRYKIIDKISVELDTGKDVYWAKLQNSNIKHANISESLVNQHEKMMLGGIWAIIEMRYDPGIMIGSTIYPFVVEEIKPIQLSNFENGHFVRNRSHFTTEEWIDILLRSSGIEPSAEGITRRIKLLLISRLIPLVEANFNFLEIGPRSTGKTYVFKELTPYAVVISGGQGTVAKLFVHGSTGKVGAVGQWDAITFDEATDKLFKERDAIPLMKDYMESGSFSRAGAGGEITGSASIVLNGNINQPIETVLQNSNLLSPLSPEINTDTAFLDRIHYYLPGWEMPKFAPKHFTKNFGFSTDFFSECLKSQRKINHTDVVEEFFALGSHLKQRDTKPVKKTVSGFIKLIHPDGKYTREEVQEYLTIALEMRRRVKEQLKRIGGMEFWDTNFSYIDKNTQEETFVSLPEERSSHLIENSPLQPGVCYTATSDGENLTLVRIETAVVTGSGKLNISGTNSTTPKEDIKNTYQYIKANEKTILNEQHSLKNYDISIQVTSLLGSTIASGIGAAAYVAIISAIYKRNLKPALSILGNISIGGAIERAMNFSDKVSMLSENGAKLVLVPMSNLNELQDLPPSVLGATDVPFYGNNQMLMQKVILGE

SEQ ID NO: 4368 - protein, 686 aa, Polaromonas sp.
MTQALTTPDTQTESLADISLDDLLNTHFGGKVVRKDLTKLIKEGANVPVYVLEYLLGMYCASNDDATIQNGMQGVKRILAENYVRPDEAEKVKSKIRESGTYKVIDKVTVKLNEKRDVYEALLSNLGVKNAEVSDTYVRQFEKLLVGGIWCIVTLKYQFEEDQKGSPFSVTELKPIQMPNMDMQELFTARKAFTDEQWIDALIRSTGMEPSCFKERVKWHLLARMVPLVENNYNFCELGPRGTGKSHIYKEISPNSILVSGGQTTVANLFYNMGARKVGLVGLWDVVAFDEVAGINFKDHDGVQIMKDYMASGSFSRGRESINANAAMVFVGNINQSVESLVKTSHLLAPFPEAMIDSAFFDRFHAYVPGWEIPKMRPEFFTNQYGLIVDYLAEYLREMRKYSFADAIDKWFKLGNNLNQRDTIAVRRTTSGLLKLVCPNGEYTKESVRKCLEYALETRRRVKEQLKKIGGMEFYDVHFSYIDLADSVERFVTVPEQSGGALVPEGRLQPGSLHTISMGSAEMPGIYRLEIQSIPGAGKVNVSGAAPREAVRVAFDYFKANASRVSASIRPGERDFHTHLVELQHSGAPQALTLASFIALCSAALGKPVQSQLAVMGDMSLGGTIVQVRNLAESMQVAFDAGAKRILLPMSSVTDIPSVPGELFAKFQTGFYSDPVDAVFKALGVE

SEQ ID NO: 4369 - protein, 687 aa, Pseudomonas brassicacearum
MNELDQKLTATFDGKVLRKDLLHRIKKGTNVPTFVLEFLLARFCASDDQAEMDAGMEAVLASLQDNYVKPDEANAAQSKVATKGKHRFIDKVHVRYVEKEKRHWASLENFNSQRIAIGEKFYRDNDRLLEGGIWAEVTLAHNAIEEDDYAFYIEDLRPIQISRFDFDRYCDGRTQFTRDEWIAVILRTVGLEPTKLSKRVCMHFIARLAALVEPNYNYIELGPRGTGKSYFFSEFSPYATLISGGQATKSALFYNNARRKVGLVGFWDTVAFDEVGGIKVKDPDTIQIMKDFMANGRFSRGAEVIADASLSFVGNFDLSISQVVNSVEHDLFQPLPAEFDLAIMDRFAAYIPGWEMPKNSSEFLTSSYGFITDYLAEAFHYQFKHTNRYEEVSKRIRLGKSVEGRDEKGIKKTVCAFLKILHPTGSPTDEDFEEYVAYAVECRRRVKEQMNKRKPDDEFARIDLSFLNAQGQEIVVYCPESKDAAATQQPFRRQLNDKLAPERDVATEATQEPLVPEPAIKVAATPPVVPEELVEKHFTIMYGDVGHTYESIIGPYLRGAKTVVIEDPYIRLQHQIQNFVRFCECVLKAGTVKKIKLITGYDDNTQLADIAEKLEELKQSLLEMDVELEVKLNPNLHDREIRLDNGWVIKVGRGLDFYQKPGGCFEVGANDLSLRKCLETKVDIFRE

SEQ ID NO: 4370 - protein, 689 aa, Pseudomonas stutzeri
MNELDQKINTHFPGLVVRKDLVKTVKGNAIVPSYVLEYLLGQYCATSDEPTIQTGIETVKEVLAKHYVHRNEAGLVRSNIKEKGRYKVIDKISVDLNDKKDVYEAQFSNLGIKEVLVDSGTVKKHPKLLVGGVWCIADLEYEFTEDKAVSPWVLSTLKPIQLSHFDFDGYVEARKQFTTDEWIDLLVQSIGFNPDMFGKRSKLTQLVRLIPFCERNYNLIELGPKGTGKSHIYSEFSPHGILISGGEVTVPKLFVNNSSGKIGLVGYWDCVAFDEFAGKQKRVDKALVDVMKNYMANKSFSRGVETLGAEASMVFVGNTQHTVPYMLKHSDLFCELPDKFYDSAFLDRIHFYIPGWEVDIIRGEMFSSGYGFVVDYLAEILRSLRNHDYSDRYKEHFSLSSDISTRDRDGINKTFSGLMKILFPHGGATNEEVEELLRFAIEGRKRVKDQLMRIDSTYGNVRFTYLGTDGQAKPVTTLEEEEYPSYYHKTIAEGEDGNILEAAQPSLPPVPTEPLAPAEPVLKEMHLTFQENQKGLSFDTLLGPYLKDATAITVTDPYIRLFYQMRNFMEFLETVVKHKAPDEEVSVHLVTTEDEFKGEQQKENFEKMKESASSVGVNFTWELDSTGTIHARHIVTDHGWKISLDRGLDIFQRYELNDAFTFANRLQQYRPCKAFEVTFIKQKPNRAEG

SEQ ID NO: 4371 - protein, 714 aa, Rhodococcus erythropolis
MTEVSETSYEAPVDSRPVQSELDRKINRLFPGVVVRKDLVKTVKGNAIVPSYVLEYLLGQYAASDDEATIQAGIDTVRKILADHYVHRNQSELVKSTIRERGRHRIIDKVTATLNEKADVYEAEFTNLGIKGVLVDPSTIKAHPKLLVGGVWCICDIEYFHSDDSRVVPWILGSIKPIQLSNFDFEGYLAARREFTTDEWIDLLVQSIGFNPELFGRRAKLIQLVRLIPFVERNYNLVELGPKGTGKSHIYSEFSPHGMLISGGEVTVPKLFVNNANGRIGLVGYWDVVAFDEFAGKKKRTDKALVDIMKNYMANRSFSRGIETLGAEASMVFVGNTSHTVPYMLKHSDLFDELPESYHDSAYLDRLHHYIPGWEVDTIRGEMFSDGYGFVVDYIAEVLRSMRSADYSDRYQPHFTLSSDISTRDSDGVHKTFSGLMKILYPHGEAHPEEIEEILRFAIEGRKRVKDQILRMDSTMVDVKFGYTDTSGAWHPVSTLEEDEYPTYYHREHHDVTETTDDTRGLTVGTPTSATKVETPPEAEPPAEAPLFAGYREFQENQRGVSFDTLLVPYLRGAGKITITDPYIRQFHQARNLMELIEGIANVKDPADEVHIKLVTAENRDGDGDKLRKQLEYLVKIKQGALAGGIHFDVAFDGAIHDRSIVTDTGWKILLGRGLDIFQYVTGDVFDLATKLQEYRQVKAFGVTYIRDVSDRPR

SEQ ID NO: 4372 - protein, 678 aa, Rhodopseudomonas palustris
MSTAPVRDALDDKVNRTFAGKVVRKDLVRKVKVGANVPVFVLEFLLGKYCASSDEMAIQMGLQVVNDTLANNYIRSDESMKAQSKVKEKGSWTFIDKVKVRLVDSDYWAELSNFGNKFVHIQNQYVRDYERLLTGGVWAQVDMRFEYDEEGKGKNPFWIEKLTPIQIAAFDLAEYQRLRAEFTTDEWINLILRSMGYEPGEMTKRLKLLFLTRLIPLCERNYNLVELGPRGTGKSYVIQEVSPYAALMTGPTTVANLFGHMGGRAKGLVQIWDVVGFDEVADLEKMPKEVITTMKTYCESGSFQRGQEAASGEAGVALFGNTQQPIDVMVQTGHLFEPMPEVIRDDMAFIDRLHFYLPGWEIPKMRNDLFTDHYGFVVDFLAEALRELRRHNFTEISDRHFTMGSHLITRDRKAVKKTVSGLMKIIHPSGEATQDEIAELLEFAMEGRRRVKEQLKKMGSFEYYHTSFSYTLNDTGEERFVGVPEQGGRNMISADPLPPGSVYTAAVAQDGTVGMYRIEVSVSSGSGKLKTAGGVNGVTKESINRAFSYMLAKKGDLSIARELDVSDLHVEVIDLMNNRVEGEIGLGFFIAAFSALKKAPPSAAMLVVGDLSVQGNIKGLRSLAEPLQLAMDNGAKRALIPIENKRSFLEVTGDVVEHVDPIFYGDPKTAAFKALGIN

SEQ ID NO: 4373 - protein, 682 aa, Saccharophagus degradans
MELDQLDQIAAAHLEGYLVRKDLVRTFARQFPVPTYVVEFLLGRYCASTDPDEIEEGLEIVQRQLESRTVRAGEEELFKARAYKNGTVKLIDLVSARFSQKDNGYVATLPSVQLNRVRINDNVVDDNERLLTGGFYAEITLEYDSLIAEEKGDAFGIKDLRPIQLSKRDVLDDLAEARKQFTSQQWKDFLLRSTGLEANVLSDRAKDANLLRMVPFVERNYNLVELGPRGTGKSHLFQQVSPYAHLISGGKATIAKMFVNNASGARGLVCQYDVVCFDEVSGISFDSKEGINIMKGYMESGEFSRGKESIRADGSMVFVGNFDVDVEHQQRVGHLFGPLPQEMRDDTAWMDRIHCYLPGWDVPKMHKELTTDHFGLVSDFFSECLSRLRFQSRVSVLQNRVHFGGALSGRDVNAVNKTVSGLLKLMYPSQDMEISDEDLEWAVRLGLEVRRRVKEQQKRVGAAEFRNTHFSYFLGDDGVEKFVATPELRSDNEIGDDPLEPGQIWTVSEGGQDIDDNPGLYRIEVNEGPGSGVKILNNPVPPAFRESVRYAEQNLYSRSMQLVGDRDPRAHEFTIQLRAFDASKKGSKLGIASLVAMCSSLLKKPVKGGLIVVGEINLGGSIEPIHSAVNIAELAVEKGASSLLMPVTCRRQLYDLSDDMATKIDIQFYQDARDALLKAIVE

SEQ ID NO: 4374 - protein, 694 aa, Salmonella enterica; identical to SEQ ID NO: 4088

SEQ ID NO: 4375 - protein, 694 aa, Salmonella enterica; identical to SEQ ID NO: 4088

SEQ ID NO: 4376 - protein, 694 aa, Salmonella enterica; identical to SEQ ID NO: 4088

SEQ ID NO: 4377 - protein, 694 aa, Salmonella enterica; identical to SEQ ID NO: 4088

SEQ ID NO: 4378 - protein, 694 aa, Salmonella enterica; identical to SEQ ID NO: 4088

SEQ ID NO: 4379 - protein, 694 aa, Salmonella enterica; identical to SEQ ID NO: 4088

SEQ ID NO: 4380 - protein, 694 aa, Salmonella enterica; identical to SEQ ID NO: 4088

SEQ ID NO: 4381 - protein, 694 aa, Salmonella enterica; identical to SEQ ID NO: 4088

SEQ ID NO: 4382 - protein, 694 aa, Slackia heliotrinireducens
MNELDRKLNEIFTGYVVRKDLVKLVRGNAAVPSYVLEYLLGQNCATDDEEQIAAGVERVRDILAKHYVQRAEAGAIRSDIKQSGYMRVIDKVSVMLNEKRDAYEATFENLGISRVLVDSDTVKRNRRLLVSGVWCVADIGYSPNEAKDESPYLLQQLKPIQMARFDLDGYIEKRTRFTVDEWLDVIIRSIGLDPEQLGKRSKLFQLTRLVTYCERNYNLIELGPKGTGKSHVFSEFSPHGILISGGEVTPAKLFVNNSTGRIGLVGYWDCVAFDEFAGVNKRPKADIVDILKNYMANKSFSRGIEQVTAEASMAFVGNTSHDVAYMINQTDLFEDLPKVYHDPAFIDRIHAYIPGWEVDIIRGEMFCTDYGFIVDYLAEALRSLRGLDYSGQLWERFELSETLSTRDRDGVMKTYSGLMKLLFPGKNATIEEEAEIIEFALEMRKRVKDQLYRIDETFARVDFSYREIGGQWREVSTLEEINFPNTYHSRDKVPWERRDAEEPLLSMDDASVPENPDLQLSQSAIVSKADEGPFVGHKSYRENQRGVSYEKLFGPYLEGARSIEIIDPYIRTFHQCRNLMEVLEVIITHFDYCVPEIHVHLLTCPDQYDPVKQDDYLCQIADALHPFGLTLEWDFDDTNTIHARHFVIDDKWDILLDRGLDIWQKFDSGNAFAIESRVQEMRMVKQFEITYMKL

SEQ ID NO: 4383 - protein, 675 aa, Spirosoma linguale
MEYADKVRTFFSGKVVRKDLTAQIKGSAVVPTYVLEYLLGQYCASDDEVIVADGIERIKDIIKSNFVHRSDAELVKSRVREQGEHRIIDKINVVLNDKQNQYEADFANLMLRDVPIVDRIVTQHKKLLSGAGVWCIIDLSYDHSRDAKVRWGIESIKPIQVSAIDVQEYLGARPQFTTDEWLDLLLHSIGYEPQYFSRRDKFIQLSRLIPFVESNFNFIELGPKGTGKSHVFSELSPHGVLVSGGDVSKATLFVNNNTRQLGLVGFWDVVALDEFEQEKNSKTIDGDLVKILQNYMANQSFNRGNDTIMATASMAFVGNTKHTVPYMLKNSHLFESIPQGYLKGAFLDRMHLYIPGWEVRILKESVFSHGHGFIVDYLAEILREMRRLDFSDLLSSVAILDPSLTQRDKLAVFKTFSGLAKLLYPHRQLTEEEAEELVEFAMEGRRRVKEQLYLIDETFQQQPSLFRYVHKATGQEREVALLESLSLDSTFEIPDVITVDVDSGSVNTTSTNPTTNKLFIGDRAFKENQTGLSFRKLFGDYIEGAKQISLIDPYIRQPHQYRLLMEFLVLISERKPLDQEVDVEVVTYFESPDKEIEAKANFDQLTESVADLGIQLTYRFDPAIHDRFIYLNNGWRIKLGMGLDMFQKPDLMDIASVFPEKRKCKKRFEISYQRI

SEQ ID NO: 4384 - protein, 674 aa, Sulfuricurvum kujiense
MDLNQKIIDNFPGKAVRKDLTKKLKGGVSVPVYVLEYLLGMYCATDNEETIAEGIEKVKEILTQNYVRPDEAEMVKSRIKERGRYKVIDKISAKLNEKEDRYEADFSNLGIKRVIIPAEVIKEYQKLLAGGIWCIVTISYFYDENNKGESPYVLESLKPIQMPGMDLSEFLSARKAFEKEEWMDLLIRSTGMEPANLDMSAKWHLMARLIPFVENNFNMCELGPRGTGKSYVYKEISPNSILVSGGQTTVANLFYNMSSRTVGLVGMWDIVAFDEVAGIRFKDKDGVQIMKDYMESGSFARGKEMKEARASMIFVGNIDGSIANIVKTSHLLSPFPSEMIDTAFFDRFHHYLPGWEVPKMRPEFFTDQYGFITDYMAEWMRELQKSNFSDAIDRYFRFGKDLNQRDVKAVRKTTSGLLKLMFPDGSFTKEDVEQALIYALVGRRRIKEQLKKIGGMEFYDVHFSYIDLENGEEKYVTVPESGGGGLIPEGELSPGALYAVATNSANGHKGLIRLDLQVMGGNGKMTDTGFGTGTIKDELKEARNYLQANLSRVSLSAKFSEHDYHIKANDLNGIGGAQGLTLAIWLSLVSGTLSKPLLPQLAVLGSMGIGGGIIGTDNLADALQIAADSGAKRVLIPAADMVHYGTVPTDLMSKLQPIIYTDPVDAAMKAMGVN

SEQ ID NO: 4385 - protein, 675 aa, Synechococcus sp.
MSELDRKVASVFAGKVVRKDLVRKVKVGANIPVFVLEYLLGKYCATDDPVAIEAGLKVVNNTLSSNFVRPDESNKAQSMVKDKGRYTLIDKVQVRYLSEDDKHWAELKNFGHKFVHIPEHYLRDYDRLLMGGVWAQLDIRHQYDEEQKGKRSPFWIDNLKPIQLATFDLDDYRSCRAEFTSEEWIDLLLRSIGLEPSHFDKRSKLLFLARLIPLCEQNFNLVELGPRGTGKSYGYQELTPYSILLTGPTTAANLFYNIASGKMGLVGIWDAVAFDEVADLQKMPKEVVTTLKTYCESGTFARGKDSLSGMASIAMFGNTNQPVDVMVRSSHLFMPMPEVIREDMAFLDRIHFYIPGWELPKMRMEFFTNSYGFVVDYLAEALRELRKHNFTEIIDRYFSLGSHLNARDVKAVRKSVSGLIKLIYPHGEVPKSELGELLELAIEGRRRVKEQLKKMGSFEYHQTSFSYINGETCEERFVGVPEQGGRDMIATDPLAPGSVYTASVDDQGKVGLYRFEVGCSPGTGKLKLSGGIEGLMKESLQRAFAYLQSQKGKIGIGQQFDTTDFYVEAIDLLSNHIPCEAGIALVVAIYSALKKQSVLASLVVLGDLSIQGNIKAVRTLVEPLQVSMDNGARRALVPLENKRNFLEVAGEIMERVDPIFFSDPMTAAMKALGMS

SEQ ID NO: 4386 - protein, 679 aa, Syntrophomonas wolfei
MIDNLDKKALEHFRGYVVRKDLAPLIKGGANVPTFVLEYLLANTCSTEDEQKINVGMENVKSILRDHYVIPEESSLIQSKLREKGRYKIIDKVSVDLDPQRDRYWANISNSNIKRANISDELVKKHEKMLLGGIWAIIDMEYDPMISIGSSVYPFVVKDINPIQLSSYDAGKLAAKRKEFSKDEWMTLLLRSAGYEPGSEGLDDRKQSLLLMRLIPLVEANFNMVELGPRSSGKSYIYKEITPYALLISGGQGTVAQLFVNNTTGRVGSVGEWDAICFDESTDKLFKDRDAVPLMKDYMESGSFSRGGKTGEIAGHASVIYNGNINQPVETVLQTSHLFSPLSDEVNHDTAFLDRINLYLPGWEISKFSPDNFTRHYGFSTDFFSEILKAQRKTTYYEVIDKYFSLGHHLKQRDSKSVRKTISGFIKLLHPDGNFTKEDIREYLVVALEMRRRVKEQLKRIGGMEFWDTNFSYIDKETQEEFFVTLPEERGSDLIERNPLPPGVCYTATSDGNTNALVKIEVVAVKGSGKLNITGTNNNQVKENIKNTYNYLRANEKNILTEQRSLKGYDLNIQISNLLGAYISEGIGSAVYVAIISSIYNKNLKAGLAVLGNLSIGGAIEQSLHFADKVTLLSDNGAKTVLVPIGNINELTTLPASVFEKADVPFYGNSQMLLQKAVE

SEQ ID NO: 4387 - protein, 678 aa, Syntrophomonas wolfei
METSYLDAKLNRHFAGRVVRKDLTGMIKQGANVPTYVLEYLLGMYCATDDEEAIHDGVERVKKILADNFVRPDEAEKVKSRIKELGQYTVIDKLTVKLNEKRDIYEAEFSNLGIKGVAVSSEYVKKYEKLLAGGIWAILKMEYFYDEENRHNNPFSIVSLKPIQMPNMDLNEIKVGRKQFTKDEWIDLLIRSTGLEPTQLEPVVKWHLLLRLVPLVENNYNLCELGPRGTGKSHVYKEISPNSILVSGGQTTVANLFYNMSTRSIGLVGLWDCVAFDEVAGIHFKDKDGIQIMKDYMASASFARGKEEKNANASMVFVGNINESLDFLLKTSHLFAPFPEGMANDSAFFDRMHYYLPGWEIPKMRPELITHNYGFIVDYLAEYLREMRKQSFADAIDRYFKLGNNLNQRDVIAVRKTVSGMMKLLYPHGEYTCDDVAEILEYALVGRRRVKEQLKKIGGMEFYDVHFSYIDRETLEEKFVSVPEQGGGKLIPEGLGKPGHVYLIGKGDSGMIGVFKLENQAVSGTGKFERTGLGSRKEVKESIDTAFRYFTANCKNVSSGITTKNKDYLMHATDLQGIGMNAELALAEFIGLCSSALDRPVQESLVVLGNITVSGTIEKISDFANVLQVCVDAGAKRVLIPAVSVVDLQNVPPELLIKVQPIFYSDPIDAVFKALGAV

SEQ ID NO: 4388 - protein, 683 aa, Syntrophus aciditrophicus
MKELDHLDQLAASAFDGYLVRKDLVRRYSRQYPVPTYVVEFLLGRYCASVDSQEIDEGLKIVERQLQDRTVRTSEQELFKARAREKGSVKLIDIVKARLDAKTDSFLVELPSLGIRDVRIADAIVHEHERMLTDGFYAEVTLTYDAAIAAEKHGRPFAIDSLRAIQLSKSDVLATLRKGRESFTSYEWKDFLLRSVGLEPATMSDRAQMVVLLRMIPFVERNYNLVELGPRGTGKSHLYQQISPYSHLISGGKATVAKMFVNMSSGQRGLVCLYDAVCFDEVSGISFDQKDGVNILKGYMAAGEFSRGKESIRASGGIVMVGNFDVDVEQQQRIGHLLSPLPPEMRNDTAFMDRIHAYAPGWDFPKLKASDHLTNHFGLVTDYLSECWTKLREGTRISALQGRAHWGGALSGRDIEAVNKTISGLLKLLFPDPNMSIPDDDLEFIIRIALEARRRVKEQQKRCLKTEFRNTHFSYFMGMDGVEQFVSTPELHSDEAIEADPLPPGQVWAISPGGQDAAPSLYRIEVTCGPGNGVKILNAPVPPAFRESVRFGEQNLYSQAKSLVGDRDPRSHEFSVQLRAMDTDHSGHGLGLPLLIALCGSLMERSTKGRLIVIGSLNLGGSVEMIPNPVAVAELGVEKGAAQILMPISARRQLLELPDEMATKVNIVFYADPADAFMKAILE

SEQ ID NO: 4389 - protein, 670 aa, Tepidanaerobacter acetatoxydans
MDELSKKLNRYFPGRVVRKDLTKKIKEGANVPVYVLEYLLGMYCATDDENSINDGVETVKNILAENFVRPDEAEKVKSKVRELGRFTVIDMITVKLNEKLDIYQAEFSNLGLKGVEISPQYVKDFDKLLAGGIWCIVKMSYFYDEEVKMASPFNIDSLTPIQMPHMDIQEIFEGRKHFSKDEWIDVLMRSVGMEPTQLEQKVKWHILERMVPLVENNYNLCELGPRGTGKSHLYKEISPNSILVSGGQTTVANLFYNMASRQIGLVGLWDCVAFDEVAGIKFKDQDGIQIMKDFMASGSFARGKEEKNANASMVFIGNINQSVDVLLKTSHLFEPFPEAMANDAAFFDRMHYYLPGWEIPKMRPEYFTDEYGFITDYLSEFMREMRKRSFTDAFDKYFKLGNNLNQRDVIAVRKTVSGLLKLIYPDGNFSKEDVEEVLRYALVGRRRVKEQLKKIGGMEFYDVHFSYIDIETMEEKFVSVPEQGGGKIIPEGLSKPGHLYTVGRGKSGMIGVYKIETEVVNGTGKFEKTGLGSDREAKEAIETAFRYFRANSKNISGTISTSKKDYLMHVEDIQGVGLTSELALAAFIALCSGALSRPVQSQLVVLGSMSIGGTINKVEELANVLQVCFDSGAKKSFNSNVISSRYRHSTSGIVCKIPDILLSRSQGCCF

SEQ ID NO: 4390 - protein, 676 aa, Tepidanaerobacter acetatoxydans
MDELSKKLNRYFPGRVVRKDLTKKIKEGANVPVYVLEYLLGMYCATDDENSINDGVETVKNILAENFVRPDEAEKVKSKVRELGRFTVIDMITVKLNEKLDIYQAEFSNLGLKGVEISPQYVKDFDKLLAGGIWCIVKMSYFYDEEVKMASPFNIDSLTPIQMPHMDIQEIFEGRKHFSKDEWIDVLMRSVGMEPTQLEQKVKWHILERMVPLVENNYNLCELGPRGTGKSHLYKEISPNSILVSGGQTTVANLFYNMASRQIGLVGLWDCVAFDEVAGIKFKDQDGIQIMKDFMASGSFARGKEEKNANASMVFIGNINQSVDVLLKTSHLFEPFPEAMANDAAFFDRMHYYLPGWEIPKMRPEYFTDEYGFITDYLSEFMREMRKRSFTDAFDKYFKLGNNLNQRDVIAVRKTVSGLLKLIYPDGNFSKEDVEEVLRYALVGRRRVKEQLKKIGGMEFYDVHFSYIDIETMEEKFVSVPEQGGGKIIPEGLSKPGHLYTVGRGKSGMIGVYKIETEVVNGTGKFEKTGLGSDREAKEAIETAFRYFRANSKNISGTISTSKKDYLMHVEDIQGVGLTSELALAAFIALCSGALSRPVQSQLVVLGSMSIGGTINKVEELANVLQVCFDSGAKKVLIPMSSAADIGTVPPELFAKFQISFYQDPKDAVFKALGVE

SEQ ID NO: 4391 - protein, 676 aa, Thauera sp.
MTEPVDTARLDGLLNTHFAGKVVRKDLTKLIKEGANVPVYVLEYLLGMYCASDDEATIQNGMTMVKRILAENYVRPDEAEKIKSKIRESGSYKVIDKVTVKLNEKRDVYAALLSNLGVKNAEVSDAFVRQFEKLLVGGIWCIVTLNYLFEENQRGSPFTVTDLKPIQMPNMDMAGLFEGRRAFTEDEWIDALIRSTGMEPSCFKERVKWHLLARMIPLVENNYNFCELGPRGTGKSHIYKEISPNSILVSGGQTTVANLFYNMSARKVGLVGLWDTVAFDEVAGINFKDHDGVQIMKDYMASGSFSRGREAINANASMVFVGNINQTVESLVKTSHLLAPFPEAMIDSAFFDRFHAYVPGWEIPKMRPEFFTNQYGLIVDYLAEYLREMRKRNFADAIDKWFKLGNNLNQRDTIAVRRTVSGLLKLICPHGEYDKEIVRRCLEYALESRRRVKEQLKKIGGMEFYDVHFSYIDLEAGEERFVTVPEQSGGALIAEGRLNPGTLHTISLGDTEMPGAYRIEIQTIAGGGKVSASGLAPREAVKVAFDYFKANSGRVSASIKPGEHDFHLHLVELQHTGTPKALTLAGFIALCSGALAKPVQSQMVVMGDMSLGGTVVQVRNLAESLQVAFDAGAKRILLPMSSVTDIPSVPGELFAKFQTSFYSDPVDAVFKALGVE

SEQ ID NO: 4392 - protein, 682 aa, Thermacetogenium phaeum
MELDALDKLAASVFDGYIVRKDLVRKYSRQYPVPTYVVEFLLGRYCASVDEKEIEEGLEIVERQLRDRTVRTGEEELFKARAREIGSIKLIDLIKARLDTKNDCFIAELPSLGLKEVRIDDDLVHKNERMLTDGFYAEITLIYDAAIAQEKYGRPFAIESLRPIQLSKVDALAVLQRGRRQFTTDEWKRLLIRSIGLEPEALSERAQSIALLRMVPFVERNYNLVEIGPRGTGKSHLFQQVSPYSHLISGGKATVAKMFVNNATGQRGLVCHYDVVCFDEVSGISFDQKDGVNIMKGYMASGEFSRGKESIRASGSIVMLGNFDVDVQQQQRIGHLFSLLPPEMRDDTAFMDRIHSYVPGWEFPKLNPNIQLTDHFGLVSDFLSECWHKLRDGSRVSVLQGRVNWGGALSGRDIEAVNKTVSGLIKLLFPDPEMPIPDEELEKIVRMALESRRRVKEQQKRCLMTEFRNTHFSYSMGVDGVEQFVSTPELHSDKAIDSDPLPPGQVWAISPGGQNASPALYRIEVTVGPGSGVKILNAPVPPAFRESVRYGEQNLYVRAKELVGDRDPRAHEFSIQLRAMDAERSGQGLGLPVLIALCSALIERSVKGGLIIVGALNLGGSIEMITNPVAVAELALEKGATTLLMPISSRRQLFDLPDEMATKINIEFYADASDAFVKAVVD

SEQ ID NO: 4393 - protein, 676 aa, Thermoanaerobacterium thermosaccharolyticum
MDELSKKLNKYFAGRVVRKDLTKKIKEGANVPVYVLEYLLGMYCATDDEEGIAEGVETVKRILAENYVRPDEAEKVKSKIREIGKYTVIDKVSVKLNEKKDVYEAEFSNLGIKGVAISPTYVKQYEKLLCGGIWCIIKMDYYYDEEAKGVSPFNISSLTPIQMPNLDMEEIFNGRKYFTKDEWIDILLRSIGMEPTRFENSVKWHLLARMIPLVENNYNLCELGPRGTGKSHVYKEISPNSILVSGGQTTVANLFYNMASRQIGLVGLWDCVAFDEVAGITFKDKDGIQIMKDYMASGSFARGKEEKNASASMVFVGNINQSVDVLLKTSHLFDPFPEAMANDTAFFDRMHYYIPGWEIPKMRPEFFTDEYGFITDYVSEFMREMRKRSFSDALDKFFKLGNNLNQRDVIAVRKTVSGLVKLIYPNGEFTRDDIEEILRYALVGRRRVKEQLKKIGGMEFYDVHFSYIDNETMNEEFVSVPEQGGGKIIPEGMGKPGHLYTVARGKSGMIGAYKIETQVISGTGKFERTGLGSDREAKESIETAFRYFRANSKNVSGSISVTTKDYLMHVQDIHGVGMTRELALAAFVALCSGALGKPPQSQLVVLGSLSIGGTIIKVEELANVLQVCFDSGAKRVLLPMASAVDIPTVPPELFAKFQISFYQSPEDAVFKALGVE

SEQ ID NO: 4394 - protein, 699 aa, Thioflavicoccus mobilis
MDALDTKLNEVFSGRVVRKDLVQQVKKGTNVPTFVLEFLLAKYCASNDPDEIAAGIEATLEYLARHYVRPDESNKAQSTVQQKGTHKYVDKVHVRHVEKEKRHWAAMENFNSQRIAINQKFYKDNDRLLEGGLWAEVTVGYNDVEDDNYAFYVEDLRPIQLSRFDFDRYLEGRARFTRDEWMDIVLRSVGLKPSKLSPRLKLHFIARLLPLVEPNYNFIELGPRGTGKSYFFSEFSPYATLVSGGQATKATLFYNNARGKVGLVGFWDAVAFDEVAGIKIKDQDAIQIMKDYMANGRFSRGVEVIANASMAFVGNIDESIHQLVNSTEHDLFLPLPAALDLAVMDRFYCYLPGWEIPKNSSAYLTGAFGFITDYLAEAFHHLFKQTNRYEYVNSHIRLGPAVEGRDEKGIKKTVAAFLKILHPGGAPEPAELEEYVAYAVEARRRVKEQMNKRKPDDEFARINLSYFGADGSEVVVYCPESKGAPATQSPSRRTLDRGAEARAPTASTVEGPAEIQLTRPAAVPDDEQAAPEHPREPELKEQHFTILYGDTGYTYDSLIGPYLAGARSVTIEDPYIRAPHQIANFVRFCETVSKTPGVRSVTLVTSYDDQTNLADLNDKLGELKQSLMEVDIVLEIRINEKLHDREIRLDNGWIIKLGRGLDFYQKPESWFAIGASDFSLRKCLETKVDIFREAPRSND

SEQ ID NO: 4395 - protein, 691 aa, Vibrio cholerae; identical to SEQ ID NO: 4102

SEQ ID NO: 4396 - protein, 683 aa, Vibrio cholerae; identical to SEQ ID NO: 4029

SEQ ID NO: 4397 - protein, 693 aa, Zymomonas mobilis
MSTLDDKINEHFAGFVVRKDLVKAVKGNAIVPTYVLEYLLGQYCATDDEASIATGIETVKDILRKHYVHRSEAGLVQSTIKERGRYKVIDQVSVALNEKTDAYEAMFENLGIKRVAIDSATVKAHPKLLVTGIWCIADVQYEFSEDSRISPWIIDTLKPIQIARVDYDGYREMRDKFTTEEWIDLLMQSIGFDPSLFGRRSKLLQLLRLVPFVERNYNLIELGPKGTGKSHIYSEFSPHGQLISGGEVTVPKLFVNNSNGRIGLVGYWDVVAFDEFAGREKTANKALVDIMKNYMANKQFSRGVNPMGAEASFAFVGNTDHNVPWMLKNTDLFEALPPQFHDSAFIDRLHAYLPGWEVDIIRGEMFTSGYGFIVDYLAEILRHLRAEDFSHRPDRFFTVPVQTHIRDRAAINKTMSGLLKLIFPNGGETEADVEELLRFAIECRKRVKDQLLRIDSTFEDADFHYVASDGAKRPVTTLEEEEFPQFYHRRSTGDGDGSGGQSVTTPVSAQQSSTPATSQAPAVAVVPASAPKPGHVVFTENRKGISFDKIFGPWTDGATRIIITDPYIRKYHQARNVMELIEMLIRRKQPEDQVAVHLVTAPDDGNIQEQRECLDGIAEACTGTGVDFTWAFDGTGAIHARDIATDTGWKMVLDRGLDIFQPTPRKMNGFSLGERMQEHRMVRGFYVTYVKNL

SEQ ID NO: 4398 - protein, 675 aa, Magnetospirillum magneticum
MSDSLDDLLNSHFAGRVVRKDLTKLVKEGANVPVYVLEYLLGMYCASNDEVTIREGLESVKKILAENYVRPDEAEKVKSKIRERGSYKVIDKVTVHLNEKRNVYQALLSNLGVKDAEMPDHYVRQYEKLLVGGIWCIVTIQFYHEENQKSSPFIVSDLKPIQMPNMDMDELFEGRKAFDESQWIDVLVRSSGMEPTTLSERVKWHLLARMVPLVENNYNVCELGPRGTGKSHIYKEISPNSILISGGQTTVANLFYNMGRRTVGLVGLWDCVAFDEVAGITFKEKDGVQIMKDYMASGSFARGKDSVSAYASMVFVGNINQPVDTLVKTSHLLAPFPEAMIDSAFFDRFHAYIPGWEIPKMRPEFFTNQYGLIVDYLAEFFREMRKRTFGDAIDKFFKLGNNLNQRDTIAVRRTVSGLLKLLYPHEEYDKDAVRRCLEYALESRRRVKEQLKKIGGMEFYDVHFSYIDIESMEEKWISVPEQGGGKIIPEGPLKPGVLHTVATGAAAHLGLYRFETQVTAGNGKLTTSGLGSSSGAKEAVKVAFDYFKANLTRVSGVSKAGDHDFHLHTVELHNTGAAKAMTLASFVAFCSAIIQKPLQSQMVVLGDMSLGGSVVPVENLAECLQVAFDSGAKRILIPMSSAADIPTIPAELFAKFQTSFYSDPVDAVFKALGVD

SEQ ID NO: 4399 - protein, 686 aa, Marinobacter aquaeolei
MSTLDQKINEHFQGLVVRKDLVKTVKGNAIVPSYVLEYLLGQYCATNDEATIQTGIETVKEILAKHYVHRNEAGLVRSNIKEKGRYKVIDKISAALNEKTDAYEAQFSNLGIKKVLVDSGTVKAHPKLLVSGVWCIADIEYVFSEDQNVSPWILSTLKPIQLSHFDYDAYVAARQQFSTDEWIDLLIQSIGFNPEMFGRRSKLTQLVRLIPFCERNYNLIELGPKGTGKSHVYSEFSPHGILVSGGEVTVPKLFVNNSSGKIGLVGYWDCVAFDEFAGKQKRVDKALVDIMKNYMANKSFSRGVETLGAEASMVFVGNTRHTVPYMLKHSDLFDELPDKFYDSAFLDRIHFYIPGWEVDIIRGEMFSDGYGFVVDYLAEILRSMRNYDYSDQYREYFTLSSDISTRDRDGINKTFSGLMKILFPQGGATRDEVEEVLRFAIEGRKRVKDQLQRIDTTYGEVRFSYQDQEGQEILVTTLEEEEYPGYYHQTVSTPDDEGVELEPTAGVKGGEPEELHAPEPALEEKHLTFQENQKGISFDGLFGAYLKGASKITVTDPYIRLFYQIRNFMEFLEAIVKNKAEEDEVAVHLVTVRDEFKGDLQDESFEKIQESARTVGIDFTWEFDDSGTIHARHIVTDHGWKISLDRGLDIFQHYEMNEAFAFANRLQQFRSSKAFEVTFIRQEQKA

SEQ ID NO: 4400 - protein, 672 aa, Nostoc punctiforme
MHDLNQKLNSIYPGKVVRKDLTKRIKEGANVPVYVLEYLLGMYCATDDETTIEEGVTRVKNILAQNYVRPDEAEQIKSKIRELGRFTIIDRVTVTLNDRDDIYQGTLMNLGVKGVVIDPEIVKPNQKLLGGGIWCILQLEYEAGTKPSPFIVGSLKPIQMPSVDMDELFAGRPAFTRSEWIDLLIRSTGLEPTTVSEDVKWHLLARLVALCENNYNCCELGPRSTGKSHVYKEVSPNSILVSGGKTTVANLFYNMSNRRVGLVGLFDVVAFDEVAGMSFHDNDGVQIMKDYMASGSFARGKAEITANASMVFVGNINQSVESLVKTSHLLAPFPEAMIDTAFFDRFHAYIPGWEIPKFSPENFTNQYGFIVDYLAEWLREMRKRSFADAIDLHFRLGNNLKQRDVQAVRKTVSGLLKLLFPDGSFSKEDVREALVYGLRVRRRVKEQLKKIGGMEFYDVHFSYIDLETLDEHFVSVPEQGGSSLISQEMLTPGHLHFVSTGDSGIIGAFKLELQAVPGSGKLVRTGVATAGKMKDSLNIAMNYFKANAQRVSSSIHPSNLDFLLQLLDLQGSGAPQESGLALFVSLCSASLKRSVQTQFAIFGEMTIGGTITPVSNLAGSLQVAFDAGAKRILLPMASAVDLGSVPPELFAKFQTSFYADPVDAVFKALAVD

SEQ ID NO: 4401 - protein, 703 aa, Rhodobacter sphaeroides
MSDLDAKINEHFAGFVVRKDLVKAVKGNAIVPSYVLEYLLGQYCATDDEASIQTGIETVKEILHRHYVHRNEAGLIRSNIREKGRGKVIDKVSVALNEKSDSYEASFANLGIKKVLVDSDTVKKNQKMLVSGVWSIADLEYDHKEEANAVPWVLAGLKAIQMSSFDFDAYLAARAKFTTEEWIDLLIQTIGFNPDAFGRRSKLLQLLRLIPYVERNYNLIELGPKGTGKSHIFSEFSPHGILISGGEVTVPKLFVSNASGKIGLVGYWDTIAFDEFAGRQKKVDKALVDIMKNYLANKSFSRGVETLGAEASMAFIGNTKHSVAYMLKHTDLFEELPEKYYDSAFIDRLHAYLPGWEIDVIRGEMFAIGYGFIVDYLAEVLRHMRGQDRSLDYRDLFTLDASISTRDRDGVQKTFSGLMKLLFPNGGATPEEIRELLTLSIEGRKRVKDQLMRIDSTYPEVEFSFADKAGRVTKVQTLEEREHPRWYHRRNVEEAGEAVIEPDSTHLDSSAPAFAPVQDAPESRHPPRPAALNVPREPLPGHVTFAENQKGVSFDKLLGPWLDGASVITLTDPYIRVYHQMRNLMELLEVVALRKPDGEDVQFRLITAPDPDDIERQTGYLEQVRDGIASLGVEFSWAFDGTSTIHARHLVTDTGWKILLDRGLDVFQRADLNNGFSPANRHQRFRQVKAFEVTYLQEGAAAL

SEQ ID NO: 4402 - protein, 675 aa, Runella slithyformis
MDLLDSKLNQSFAGKVVRKDLTKQIKEGANVPVYVLEYLLGMYCATDDEATIKEGIQKVKQILSENYVRPDESEKVKAKIKEKGRFKIIDKVSVKLNEKADRYEGLLSNINLRNVIIDDTYIRKYEKLLSGGIWCILTLEYWFDENSKDSPFKMVELKPIQMPETDISDFIRHRQDFTLDEWINVICRSVGMEPVNLDEKAKWHLVARMIPFVEKNFNICELGPRGTGKSYVYDEISPYSILISGGQSTVANLFYNMSTRTVGLVGMWDVVAFDEVAGINMKDKDGIQIMKGFMANGSFSRGKESINADASMVFVGNINGSVENLVKTSHLLAPFPADMIDTAFFDRFHHYLPGWEIPKMRPEFFTNAYGFISDYYAECLRELRKHNFSDAISHYFRLGKDLNQRDSIAVKRTVSGLIKLLFPDGKYTKEDLRKCLEYALVGRRRVKEQLKKIGGMEFYDVHFSYVDLEQNEEHFVSVPESGGKSLIPEGDLPAGTVYTIGKNAASGHKGLFRLDIQRMPGNGKISDTGFGGGTAIKEELKEAVNYVRSNLNRITQTAKFNDFEFHLKATDLNGIGNTKGLELAIFLSIVSSIVERPLLPQLAVLGSMSIGGAIIGSDNLAEYLQVSADSGAKKVLIPAVDVIQLGKVPTDLISKFSLLIYSDPIDAGFKAMGLG

SEQ ID NO: 4403 - protein, 474 aa, Aciduliprofundum sp.
MNELDDKIKRIFPEESVFKSPKEYRIFSGYNLPSFVKDWILRKFTDEYGNLDVDALKLFLNAHIAHKESKIKGTLLNDLKEVTLLARIVVDPDIKSGILRFSIPDIGIKPNEGRIPQYIAKKFPELKGGEVWGVVKLVYIPPEGKQRGAIEIVDYKPFKPYDVDVKYFREKRKEFTLEEWIDLMIRSMEYNPDGFESLSQKLLFLARLLVFVEPNLNMIELAPKGTGKSYTFNNLSKYGWVISGGVVSRAKLLYDVARSTPGIITRYDFVVLDEIETIKFTDPSELQGALKNYLESGNFSVADYRGVSSAGFMLLGNIPLKKDRKPLHNKYFVNLPKFFQDSALLDRFHGFIEGWRLPRMREDLKLRGYALNVEYFSEILHKLRTIPDFAKVVDSLLDIPKNADTRDTRAIVKISTGYLKLLFPHIHKVEDIYKKEFETFCLKPAIEMRKIIKKQISLIDNEFNDTLPEIKIRG

SEQ ID NO: 4404 - protein, 486 aa, Anaerobaculum mobile
MNANDVLQDKIRTFFQEMVVYKDPIQNKFFSSLSIPSYLRDWIVMRFSDDDGKLNLDEVRDYIKTNIPTKNDWELLKSKMVHDGQRVKFLAKIRVEIDVRTGHGVFKLPDLGFPNRKYEAIVKDHVLNHNREELLNDSETWGVIECEWNPFGVTGKEGDGAIYMISFKPFKPYKVDVNYYQEVRKEFTLSEWIDMLLLAVDYNPAGFLDTRQKLALLSRLLPFVENRINLIELAPKGTGKSYMMSQLSKYGWLVSGGSITRARLFYDISRSTPGLLSRYDYVAFDEVQTISFPDVDEIRGALKGYMESGEYRVGDYRGTGKAGLVLMGNISDEKMREDTDVFTELPYAFQESALIDRFHGFIKGWDIPRMRENMKAHGWALNVEYFSEVMHSLRNEIIYPAIVENLLMVPKSSDTRDVTAIRRICSGFMRLFFPHAKSAEDVNIDEFRTYCLDLALKMRGIIRHQLHLMDSEYSDTLPDIQVKQKI

SEQ ID NO: 4405 - protein, 485 aa, Candidatus Desulforudis
MTQLDQTIGKMRSVFSGMVVYKNPQQNSFFQSLNIPPYLRDWLTMKFGGKEGKIDSEQIQGFVSRYIPRRRDWERLKVEMIKEARRVRFLAKVQVTIDVQSGEGLFHLPDLGFPRKKYEARIAGRLLREKKEELLVSSETWGVIELEWVPAGVKGKRGQGSVVMIDFTPFRPYTIDVDFYREARREFSVEEWIDVLLLAVDYHPAGFLDERQKLALLSRLLPLVEKRVNLVELAPKGTGKSYLFSQISKYGWLVSGGSVSRARLFYDLNRRETGLVSRYDYVALDEIQSISFPDEEEIRGALKGYLESGEYRVGDQLGVGEAGLVLLGNISYECMDENKVMLRELPAVFQESALLDRFHGFIKGWNIPRMRENLKAEGWGLNTEYFSEVMHALRDDVRYASVVDELLRVPKGADTRDTRSIKRLTTAWLKLLFPHVVQSETADRAAFDKYCLTPALMMRGIIRRQLHLMDAEYADILPEIVLAGE

SEQ ID NO: 4406 - protein, 482 aa, Coprothermobacter proteolyticus
MSEDLDRKIRDVFPDESVYKMPQNYGVFSGRNIPSFIKDWLIKKFTDEDGTLDKQGLLSYLDRFLPDKKQAQIIKKQLVQTQEPYTVLARVQTQADIKKGIIRFSIPDFGIGPGEGIIPRSLIEAHPELMADEIWGIFTLVYEPEDEHTPGHISVMDFKPFKPYEVDLDYFKEGRKEFTLEEWIDVLIRAMEYMPTGFESAQQKLLFLSRLLVFVEPRLNMIELAPKGTGKSYIFNNLTKYGWCISGGTVTRAKMFYDISRRSFGYITRYDFVALDEIETLKFAEEEELKGALKNYLELGKFTIADVTKTSEAGFMLLGNIPLTSEHKPINDIYFSHLPDFFRDSALLDRFHGFIEGWHLPRINEDMKVSGYTLNVEFFSEILHKVRERSEYAAIVDELLDIPPKADTRDVTAVKRLCTAYLKILFPHITDSSQITKEEFETYCLKPALEKRAIVKRQIHLMDPEFKAAIPDIVVKQDHVST

SEQ ID NO: 4407 - protein, 487 aa, Cyanobacterium stanieri
MNFSNNYSTYDNELVTRVFGSLSIDKKRLPSSSLTSVGVPSFVGEWILEHIVAGTGELNDGEKEKVRNFVDKAFPRKDDKEEIKFELTQGGIYTLIGLMQVRVTLEKTSEQIPEPVASISVLNLTDCEISTDIVNRHRRLLRQGIWGKITLRYSPDMKGKFKVSVIDFAPFQCSAVDLKSYGELRSQFSTEKWRDLMFCSMGFNPEHPDYNHQAKTWILSRLLPLVEPNFHLIELAPKGTGKSFFYENINNKVSVVSGGKITPARLFIDGKTREVGLLGRYNVVVLDEVQSLTFDNPDEIIGPLKTYLANGSYNRGGYSDIASDCSLVLLANIELNEYQRPKNEYNLMANLPKFFSETAFLDRFAGILPGWEIPKFQKEMMANQIGLKMDFFGEVLFALRRDTRFQQYAETHTNFLSKVSIRHQQGIIKTASGFLKILYPHLDLTLQDYWNDCLKPACLLRQQIHSLIYNLDDEFKQYGKEIIVDII

SEQ ID NO: 4408 - protein, 480 aa, Denitrovibrio acetiphilus
MTDKLRNCFDEMVVFKDLKKNNFFSSLNLPSFMRDWLLKKFEDDNGQFETEELIRFVRTYLPGKDGWTAIKDRIIKENERVKFLAKISSDIAIKTGEVSFSLPDFGLTSKDTIIEDNVWNDCKNELVRGRETWGMVELGYRMAEPELKLTGKIKLTSFKSFCPYTIDLEYYKDARREFETSEWLDVLLGAVDYNASGYLGDEEQKLTMLTRLLPFVEKRLNLIELAPKGTGKSYLFGRVSRFGWLSSGGVMSRAKMFYDQNKRTEGLVSGNDFVVLDEVQTISFTDVDEMRAALKGYLESGVFTVGNYEGKADSGVILCGNIKKETMDSDGFSSMFEELPAIFHESALIERFHGFIKGWNIPRMNDDLKISGWALNSEYFCSILHELREDLSYRAIVDELIHVSEAADTRDTEAVKRIATAYLKLLFPHVRDASDISASEFKRYCLDRARKMRDTIKYQLGLLDIEYRGKDIPTFSVRGD

SEQ ID NO: 4409 - protein, 500 aa, Desulfitobacterium dichloroeliminans
MYDVDKLREYFPSTTVYKDPSVMAMFKSAKIEAFLRDWILKRKAGPDGRVENVDVLSEYVASIIPPRSEKERLQDEARSNGETRPFLAKVNISFNSSADYYCFEIPGLGFTYSHTIIEDYVWDRIKDELIGEAGGWGLVRLGYMPPEGNKKNGRFTLLDYKNFCPYEVNLDAFREARTHFEVEEWMGIILGAIDYNPDGFEREGWIDTDIWNAKHTMLTRLLPFIQPRINLIELAPQQTGKSYIFGKVGKYGWLLSGGSVSRTMLFLDRRAGARAKGLVTFNDFVAIDEVKSISFTNDKEMGGILKGYMEDGYTTVGGTRVDGDAGIIFLGNIAVEDMDASKDMLRELPDIFRDSALIQRIHGFVPGQFIPPLSPRMYISGWALNTEYFTEIMHLLRSPAETMRYRGFVEELVDVSSKSGDTSGREQDAIMRLCTAYLKLFFPHADSALIRDSKFKREFDKYCLQPAKRMQETVLKQMKIINPGMFGNTGFATYKVRYDI

SEQ ID NO: 4410 - protein, 485 aa, Geobacter sp.
MVDTDKLRAAFPDTTVFKAPNIVAIFKAASIPSFLRDWILKRKAESDGRIHNAEALRNYIYDIIPRREDLLNLQTAARSEGRTKKFLAKIEIQFSVRSNEYTFAIPELGLGHAETLIEDYVWTRIKDDVVNTAGGWGLVQLGYRSPDDENARGCFTLLEYKNFCPYTIDLDAYREARCQFTTEEWIDVVLGAIDYNPEGYEDWVQKHTVLTRLLPFIEPRLNLIELAPKGTGKSYMFGRVGKYGWLVSGGTLTRAKMFGDINGKSPGLIASNDFVALDEIQSINFPDPSEMQGGLKAYMESGEITVGKNRIIGGAGVILLGNIPQTDMDETKDMFQRLPQVFHESALLDRFHGFIRGRDIPRMSENLKINGWALNTEYFSEIMHLLRQPAETMIYRHVVERLVDYPSGADTRDTEAVLRLCTAYLKLLFPHVTAPGRIDKGEFKRYCLRPAVQMRTVIRQQLQSIDPLEFGGKNVAAYTLREVNE

SEQ ID NO: 4411 - protein, 487 aa, Prevotella denticola
MKEEICNKIRQHFSAMSIYKDPASTSSLFAGRNLPAFVRDFLLKRYLNIQTGEVDRMALSQFLDKVIPAKQGSVKDRLQSGEEVMLLARFVVYIDIVKNERQFAIPDYGIKQREGLIPEYVYSRNSGEFVEGEKWGIIKLCLLPDADGKKNHIQMVDYKPFKPYSSVDISYLAEARHYFTTLEWIDVLLSAMEYDPDGFTSLTQKIEFLTRLLIFIEPRLNVIELAPKGTGKSYVFGNLSKYGWLVSGGKVTRAKLFFDKTKQQNGIIKNHDFTVFDEIQTIVFQEPAEIQAALKSYLESGKTTIDNNEFSSECGLMLMGNIPLSAQHMPVSPFYFTNLPENFRESALLDRFHCFIEGWILPRVDKSMIFKGWTINVEYFSEILHTMRTQNTYGLLFDQLVRFEEKADVRDSKAVKRIATAYMKLLFPHWQRTEDVNEEEFKIYCLDPAIHRRGIVKEQCYNIDPEFKSRMPHVEIVQKGFTENKLF

SEQ ID NO: 4412 - protein, 473 aa, Thermotoga petrophila
MNELDEKIKKIFSEESVFKSPKEYRMFSGYNLPSFVKDWILRKFTDEFGNLDVDALKLFLNTHIAHKGSKIKGTLLNDLKEVTLLARIIVEPDIKSGILRFSIPDIGIKLDEGRIPPHVAKKYLELKGGEVWGVVKLAYIPPEGKQKGTIEIVDYKPFKPYEVDVEYFREKRKEFTLEEWIDLLIRSMEYNPNGFESLSQKLLFLARLLVFVEPNLNMIELAPKGTGKSYTFNNLSKYGWVISGGTVSRAKLLYDVARSTPGIITRYDFVVLDEIESITFTDPSELQGALKNYLESGNFSVANYRGVSSAGFMLLGNIPLTKDRKPLHSKYFVNLPKFFQDSALLDRFHGFIEGWKLPRMREDLKLRGYALNVEYFSEILHKLRTTPDFTKIVDSLLDIPKNADTRDTRAIVKICTGYLKLIFPHVHERDDISKNEFETFCLKPAIKMRKIIKSQISLIDNEFSDTLPEIKIK

SEQ ID NO: 4413 - DNA, 1308 bp, Dehalococcoides sp.
atgccaattaagtcatactatcagaagcagtatggtctaaaggggaatccttttccaagtagggctacctacaatgtggatagtccgagtgtttacgttccggagatgttcggacctcagcagccggagttcctgaagaaattcattttggcgcctttgcagaacatacagccgttaattggtgcagtctggtcagtgtcagtcggagatccagaagcccgcggattcggtaaatcaatgctaatggctgaggagtcaaaaagaatagattgcgatttcggcaagtccactttgatgagtttaggagtatcggaggaagatgctcaaagctcacccattctggctggctatgtatctttcaatgtcagcggatacgggagtatttccagtattgatgctgccgccttcaatttagcgaggttcatcttacgcgtacgggatgaccaaggcgtaagtactcacgcaaaattgagggagcgagctgcagctcggcttatcgcggagggaaaagctaccgctggaaatgaggatgctgcaatcgtcacagcaattaaggaaaggtttacaagattagcaaacacggtggacatcaggaatctacttgaagactatattttccatctggcttctgataatacggatggcttagaacaattcttggcgtcaggagtcggaacttggcatcacgatcgcaacggcttaaaatacctgcaaattctcgtagtcttcgccgatattgctgggatcgaacacttcacgttctttattgaccaggttgaggatttcacctacgttgcaggaccagccaagatacaaaagaatattaagattataagggatgctctaatcgaggccgagccgttctcatcaaaagcatctttcgtttttcaattacacccaattgcgtgggaaaaactccgggatgcttgggaacacgaagatcttccatctcttgaatatgatgacgctctgactgagcctcgggtggtagtattaaaggggctcgaagaattcagtactgcccgtttgctggtcgaaggaattatcaatcatccgtccgtggtattacccaaccgtgctgatagtattacacccttcactgaggaaggattaaagagtgtatgggaggcaacaaagccgaatcccagagagtttctacgctcggttaaccttttactagaactcggcaataatcaacagataccaatactcgacgaggctttcattgcaccaaaattggagcgtttaatacgttcacttcatactggagaagccgcagaagaagaagtggatgagcgcacagcctag

SEQ ID NO: 4414 - DNA, 1344 bp, Desulfitobacterium hafniense
gtgggaatggatatgagtcaagtcaagataccaaagagaatcagcaccgcattgatacagtccttatcagcgggagtcgttccccggatcgggctggagcatattgcagtgggcagaaaagaagaaatcgaatccctcttaggtgacctggaaaatgtgggagcaggcggggcctctttccggtttattgtcgggaggtacggaagtggcaagagttttctgatgcaaacactccgtaattacgctatggaaaggaattatgtcgtcgctgatgtcgatctatcaccggagcgccgtttcactgggactaaagggcagggtctggctacctaccgggaattgctgaccaatttatccatcaaaaccaggccggatggtggtgccctaacctcaattctagaaaaatggattggggcaatccagatggaggtcatgaaggatacggggctgcgtcctcaggataatggttttggtgaagctgtagaactcaaaatctttgaggcggtaaatcatatgtcaggaatggtacatggttttgactttgccaatgcagtgattgcttattggaatggccatcgtcaagccgatgagtcccaaaaggctgctgcattgcgctggctgcggggcgaatttgccaccaagactgaggctaaagcttttttaaaggtccagatgattattgatgacgaaagctggtacgattatcttaaattaatggcagcttttgtggcccatataggatatagaggattaattgtgtttattgatgaaggcgttaatctctacaaaatcagcaacagtgtagccagacatagcaactatgaaaagcttctgaccatgttcaatgataccatgcagggcaaggcacagcatcttggtatccttctaggtggtacccctcaatttgtggaggatcagcgcagagggttatacagctatgaggctctacgttccagattagcggagagcaggttcggccaaggtggcctgcgggatcttttcggcccaatcatccgcttgcaaacactgacccatgaagaaatctttgtgctcttaaaacgtctggttgaagttcatgggcagcattatggatatgagtcccgtattacggatcaggagatgctggccttcatgcaggaggtagccggacggatgggtgccgacgaacttttaacaccgagagaggtagttcgtgattttatggggcttttaaatatcttgcttcagaatccccagatttctttcagtgaagttttatatggccctgatttcaagctaaaggcggcagaccaagatccggagcaaataagtcaagacgatgagtatgcggagtttactttatga

SEQ ID NO: 4415 - DNA, 1326 bp, Thiocystis violascens
atgactacattgacccgcaaggatgtcgagcatgtcttcgaatcgttgcgcaagggtttggtccccgagcgagggatcgatgcctttggcgtcgggtgcgagaagcctcgcggcgagctgcatcggcagttggacttggccgggaacggggagggcaccatcaagtttttgcgaggtggctatggctgcggcaagactttcatggcgcgtctcgcgttgctcgatgctcaggcgcgcgggtttgcgaccagctttgttgtcgtctccgacaatgacctgcgcttccaccgttttgacgacatttaccgcaaggtgctcgcagagctgagcacgacggcgtgtccgcgcggcgctttgggcgatatcctggatcgctggattggacggatcgaggcggcgctgatcgccgttggcgaagacgagcaggccgctgatttcgatgatcgcgtccggcagcgactggatgaggatctctcctcgctgacgggcggacaggcgccgcaggatttcatccgggtcgtgcagcgggtcttcgacctcaagcaggccggtgactcgagcagcgcgggtgcgctgctctcctggctctgcggcagcggaaatgtcgcgtcttcgatcaagcagacggccggggtcaagggggacattggtagccgcgatgcgctcgattatctgcgcggcgtgctggagatcgtgaaggcggcgggttatgcgggcctggtcatcgtcatcgacgaggccgagacgatcctgcggatgcgagccgattcgcggcataaatcgctcaacgggatccgccagatcgccgatgcggccggatcctatccggggctggtctggctcttcaccgggacgccagagttcttcgacagccgtcatggggtggccggtctgacgcccttgcatgagcggatccgcttcctccagcagggacgtttcgcgagcctgcgtcaagcccagcttgcactcgcccccttcgatgccgagcgtctgcgcgccgtggcgctgcgtctgcgcgagatctaccccgctcaggatcgggcgagactggaaacctgtatcagcacgaccttcgtcgatcgactggtcactgaagtcaccaggggtttcaaaggcgatgtgggtgtcgtgcccagacagttcctgcgcgaactcgtcaatcagctggatttggtcgaggagcacgccgactacgatcccatgaccgagtatggcttcaggccagaccagcttagtgcggaggagcaacacctgcttgctggtgtgtcatcaagcgatgtcgatgcagaggatgaggctttgattccccaggaagatgtctggtga

SEQ ID NO: 4416 - DNA, 1323 bp, Planctomyces limnophilus
atgacatccatcactggccgcgacgttgaacatatttttgagtcattgcgcaaagggcttgttcccgagcgtggaatcgatacgttcgccgtcgggattgagaaacagcgaaacgaactgcatcgccaactggaactggttggcagccacgaagggtcgatcaagttcctgcgtggtggctatggctgcggcaagaccttcatggctcgcctggcattgctcgatgctcaagcacgtggattcgcaaccagtttcgtcgtcgtctccgacaacgatttgcactttcatcgatttgacgatgtgtatcgaaaagtaatgaccgagctgggcacagcgtcctgtccgcggggtgcattgggggacattctggatcgctggattggtgcggtcgaagaaacattggtcaatgccggcgtcgatgacactgctgacgatttcgatgagcgtgtccggaagcgactaaacgaagacttggtttcgttgacgggcgggaacgccccggaagacttcattcgcgtaattcagacaatcttcgatcttaaacaggacggaaacgtcgttgacgctggagcactgatctcatggctgtgcggcagtggaaacgtagcggcctccgcgaagaaggtagctcaagtcaaaggtgatatcggtagccgcgacgccttgcactacctaaggggtgttctggaaatcgtgaaagcggccggctacaaggggctcgtcatcgtcattgacgaggcggaaacgattcttcgcatgagaaaggactcacgtcacaagtcattgaatgggattcggcagattgccgatgcggcaagctcttatccaggactgctgtggctgttcactggaactgcggagttctttgacacccggcatggagtagcaggactgacgcctctgcatgatcgaattcgatttatttccagtgggggattcgccagtctcaggcaggcgcaacttgaattaaaaccgttcgatacagagcgactgaaggcggtcgcgttacgcttgcgagaaatctatccgggacaggatcgttcgcggctcgagtctgcggtcagccaagaatttattgagcgtcttgtggcaaatgtgacagccggtttcaagggagatgtcggaatcgtccctcgacagtttctccgtgagttcgtcacacagatggatctcgtcgaagaaaacaaagattacagcccagcggaacagtacggtttcaaaccaactgaattgagtacggaggaacagactgtgttatccggtaccaacggcaatagagagtctaaggacgatgagctggtacccacggaggacgcatggtaa

SEQ ID NO: 4417 - DNA, 1326 bp, Anaeromyxobacter dehalogenans
atgggactcacccggcgggacgtgaaccacatcttcgagcggctgcggtcgggcgtggtgcccgagcgcggcctcgacgccttcgcggtcggcatcgagcggcagcgcgcggagctcggccgggtgctcgaccttgcacacgcaggcgagggcgtcttcaagttcctccgcggcggctacggctgcgggaagacgttcatgtctcgcctcgccgtcctggacgcgcaggcccgggggttcgccacgagcttcgtcgtggtctccgacaacgacctccatttccaccgcttcgacgagctgtaccgaaagatcgtccaggaactcgggacgagctcgtgcccgcgcggtgcgctcgccgacatcgtggaccgctggatcgcgaaggtcgagaacgcgctggtcgcggccggcgcgaacgaggaggcgcccgggttcgacgcccaggtgcagaagcggatcggggaggagatcacgtcgctgaccggcggcaaggcgcccgaggacttcgcgcgcgtgctgcgcgagatcttcgcgctcaagcaggcagggaagggagcagacgcgggcgcgctgctgtcctggctgtccgggagcggcaacgtggccgcccagcagaagaagtccgccggcatcaagggcgacatcacgagcgccgaggcgctggattatcttcacgggctactcgagatcgtgaaggcggccgggtacaaaggactcgtcatcgtcatcgatgaggcggagacgatcctgcggatgcggcaggacgtgcgcgggaagtcgctgaacgggattcgccagatctgcgacgcagccgaccggtaccacgggctcctctggatcttcacgggcacccccgacttcttcgacacgaagcggggcgtcgccggcctccagccgctccacgatcggatccggttcctctcgcagccgggctacgtgagcctcaggcaggcgcagctcgagctaaagccgttcgacgccggtcggctgaaggaggtcgcgctgaagctccgcgagatctaccccgcgagcgacccgcccgggctggaggcgcgtgtcacgccggagttcatcgagcggctcgtgcgcgaggtgacgaagggcttcggcggcgacgtcggcatcgtgccgcggcagttcctgcggcagctcgtgaacgtgttcgacctcacgatcgagtttcccgagtacgacccggagaagcagttcaagttcgagccgcagggcacgagtgactacgaggcgcgcaagctcgaggggaagcctccgtacgaccccgagcccggtgacgacaagggatacccgacgacgtccgtggagttctga

SEQ ID NO: 4418 - DNA, 1353 bp, Haliangium ochraceum
atgagtacgatgacggagagagacatccgccatgtgatcgagtcgttgcgcagcggtctggtgcccgagcgcggcatcgacgccttcgccgtgggtgtggacaaagagcgcggcgaattgcagcgccagctcgacctggccgcgagcggcgagggcgccatcaagtttttgcgcggcggttacggctgcggcaagaccttcatggcccgcctggccctgctcgacgcccaggcgcgcggcttcgccaccagcttcgtggtggtctccgacaacgacctgcgctttcaccgctttgacgacgtgtaccgcaaagtcgtgggcgagctggccaccgcctcgtgtccgcgcggcgcgctcggcgacatcctcgaccgctggatcggcgggatcgaggccgggatgatcgcggccggcgccgacgaggacgccgacgacttcgaccagcaggtgcgcaagcgcatcgacgacgacctgatgtcgctcacgggcggccaggtgccggccgatttcgtccgcgtggtccagaccgtgttcgacctcaagcagcgcggcgaagtcgccgaggccggcgcgctgataagctggctctcgggcagcggcaacgtctccgccggggccaagaagcgcgccggcatcaagggcgacatcggcagccgcgacgcgctcgactacctgcgcggcgtgctcgcgatcgtcaagaaggccggctacaagggcctggtcatcgtcatcgacgaggccgagaccatcctgcgcatgcgcaaggactcgcgccacaagtcgctcaacggcatccgccagatcgccgacgccgcgggctcgtaccacgggctgttgtggatgttcaccggtacgcccgagttcttcgacgagcgccgcggcgtggccgggctggcgccgctgcacgagcgcgtgcgcttcatcaagcagggcggctttgccagccggcgccagcctcagctcgagctgcatcccttcgacagccagcggctgagcgccgtggccctgctgctgcgcggcctgtacctgcgcgtggccgaggagccggcgcgcgtggacgagcgcgtcaccgaggcgttcatcggacgcatggtcgaagaagtgaccaagggctttcgcggcgacgtcggcgtggtgccgcggcagtttctgcgcgagttcgtgtcgcagatggaccgcgtggatgagttcgaggagtgcgacccgatgcgcgactggaacttccagaccgacgccctgcgtcccgaggaagagcgcgccatgcgcggcgccggcgcgcggctgccgaccgtcgagggggaggaaggggacgaagaggacgacggcgtggtgcccgtcgagcagctctggtga

SEQ ID NO: 4419 - DNA, 1353 bp, Haliangium ochraceum
atgagtacgatgacggagagagacatccggcacgtgatcgagtcgttgcgcagcggcctggtgcccgagcgcggtatcgacgccttcgccgtgggtgtggacaaggagcgcggcgaattgcagcgccagctcgacctggccgcgagcggcgagggcgccatcaagtttttgcgcggcggttacggctgcggcaagaccttcatggcccgcctggccctgctcgacgcccaggcgcgcggcttcgccaccagcttcgtggtcgtctccgacaacgacctgcgctttcaccgctttgacgacgtgtaccgcaaagtcgtgggcgagctggccacggcctcgtgtccgcgcggcgcgctcggcgacatcctcgaccgctggatcggcgggatcgaggctgggatgatcgcggccggcgctgacgaggacaccgacgacttcgaccagcaggtgcgcaagcgcatcgacgacgacctgatgtcgctcaccggcggccaggtgccggccgatttcgtccgcgtggtccagaccgtgttcgacctcaagcagcgcggcgaagtcgccgaggccggcgcgctgataagctggctctcgggcagcggcaacgtctccgccggggccaagaagcgcgccggcatcaagggcgacatcggcagccgcgacgccctcgactacctgcgcggcgtgctcgcgatcgtcaagaaggccggctacaagggcctggtcatcgtcatcgacgaggccgagaccatcctgcgcatgcgcaaggactcgcgccacaagtcgctcaacggcatccgccagatcgccgacgcggcgggctcgtaccacgggcttttgtggatgttcaccggcacgcccgagttcttcgacgagcgccgcggcgtggccgggctggcgccgctgcacgagcgcgtgcgcttcatcaagcagggcggctttgccagccggcgccaaccccagctcgagctgcatcccttcgacagccagcggctgagcgccgtggccctgctgctgcgcggcctgtacctgcgcgtggccgaggagccggcgcgcgtcgatgagcgcatcaccgaggcgttcatcggacgaatggtcgaagaagtgaccaagggctttcgcggcgacgtcggcgtggtgccgcgccagtttctgcgcgagttcgtgtcgcagatggaccgcgtggacgagttcgaggagtgcgacccgatgcgcgactggaacttccagaccgacgccctgcgtcccgaggaagagcgcgccctgcgcggcgccagcgggcggccgccgaccgtcgagggagaggaaggggacgaagaggacgacggcgtggtgcccgtcgagcagctctggtga

SEQ ID NO: 4420 - DNA, 1320 bp, Candidatus Accumulibacter
atgatcagtccagcccgtcgctcggagatcatcgatgccttgcgtcggggtacggtgccgcggaatggcctggatgctttcgcagtcggcgttgaccgccttcaggcgacgctcgacaacgaactctcgtcggtcagttcggggggcgctgtgttcaaggcgctgcgcggcgaatatggcagcggcaagacgttcttcggtcgctggttgcaggaacgggcgcgtgccgccggcttcgccagcagcgaggtgcagatctcggagacagaaactcctctgcatcgaatggaaacgatctatcgtcgcctgatcgagcggcttgccacggccgacgccggcgaaggggcattccgcgggatcattgatggctggttttacgttctcgagcaggatgtacttgccgatggccagcttgacccgaacgatgcgcaagggctgatggccgctaccggcgtgctcatggaacagcgactggcaagtatcaacaaggtggctcccgcgttttcggcagccctgcgcgcgtatcgcgaagcggtggcgcgcggggaaacggccttggccgaaggcctggtgagctgggtatccggacaaccgaacgtggcagcacagatcaaacggacggcaggcctcaagggcgatatcgatcacttcggtgctgcaagttttatcgctggggtcttggcaatccttcgcgattcgggctaccagggattgatcctcgtaatcgacgaggtcgaaactttgcagcgaatgcgggctgacacccgggaaaaagggctcaatggtctgcgccaatggctcgacgagattgatgcgggtcgcttccccgggttgtacctgatgatcaacggcacgcctgcgttctacgatggtccgcaaggggtgcagcggctggcgcccctggcgcagcgcctgcatgttgatttcagcacggaggctcgattcgataatccgcgcgcggtgcaaatccgcttacccaactttgaccttggattgctgtcgcaggttggttgcaaggttcgcgacatttttgccgagggtgccgtcgatgcggatcgtgttcggtccctcgtagacgacagttatgtgcatgacctggccgtcgccgtcgcgggaaagcttggtggaaaggttggtgtcgcgccacggatcttcctgaaaaaactggtcgctgatgttctggaccgtgtagaccagtttgctgattttgatccccgccagcactacgcgctgacgcttgcgcccaacgaattgacacgttccgaggcggcagcctcgggactttccagcattgatgccattgaactcgacgtggaatga

SEQ ID NO: 4421 - DNA, 1350 bp, Corynebacterium variabile
atgggaaggcactctgacgcaccgctgaccggcaccacctccacggatcagcggcacgggttgtccccggtccgtcgccggaacatcctccaggcgctgcgccgaggcaccgtcccgtcggacggactcgaccagttggcggtcggtctgggccatctcgaaccggtcatcgaggacgagctgtctgccgtcgccggcggggcagggatgttcaaggctatccgcggtgagtacggctccggtaagaccttcgcgtcccggtggatcgagcagttggcgctggagcaggatttcgccgtcgccgaggtgcagatctcggagacggacaccccgctgcacaagctggagaccgtgtaccggcggaccaccgaggaactgcggacgacggcgtcccccacccgcgcgttccgcgacgtgctcgatgcctggctcgccaccgtggacatggatgccgaggctgccggccgtgaccgtgacgagctgatcgaggaacggttgagttcggtggcgcaggtcgcgccggtctttccgctggcgctgcgcggctacctgcgcgccgtggaggaggacgacaccgagatagccgacggtctggccgcctggttgggtgggcagggaaatgtcagtgccgcggtgaagcggtacgcagggatcaagggtgagctggacaagttcaccgcgacgggcttcctgcgtgggctcatcgagatcctgcgcggtgcaggacagtccgggctgctgctggtgctcgacgaggtcgagacgctgcagcggatgcggaccgatacccgggagaagtcgctcaacgcgctgcgccagtggctcgacgagatctcgaacgaccggtacccgggactgtacctgctgatcaccgggacgaccgccttcttcgagggcggtcagggtgtgaagcgactgcagccgctgtacgaccggcttcgggtggacttctccggggatccccggtgggacaacccgcgggcggtgcagatccggttgcagtccttcgaccacgcccggctggtggaggcgggatgccgggtgcgggacctgttcgtcgacgggttggcagcggaggaggcggagcgggtggcttccgccgtgtctgacgactatgtcgcctctctggcggatgcggtcgccggtgagctcggcggacgcatcggtgtcgccccgcggatcttcctgcgcaccgtggtcgacgtgctcgaccgcgtcgagctgcacgcggactttgatccgcgggagaattacaatataaaggttgaagtctccgcgacttcgaatacaggtagagagaggatcccgaggaacacagtaaacgatccagactcaatagatttcacctag

SEQ ID NO: 4422 - DNA, 1329 bp, Frankia sp.
gtgaccatctccgaacaacgccgacgggaggtgatcgacgcgcttcggcgcggaaccgtgccgcggcagggcctggatgtgctcgcggtcggtcttgaccgcttcaccacggcgatcgaggaggatctcgaccggctcgccggcggacaggcgacgttccgggcgatccgcggcgattacggcgcgggaaagacgttcttcacccgctggctcgccgagcgggccaaggcccgggggttcgccaccgccgagatcgcgatctccgagaacgagaccccgctgcaccggctcgaaacggtctaccgccggctcgccgaacggctcgcgaccgccgaattcgcgccgagcgcgctgcgtcccatcgtcgattcctggttcttcgcgctggaggaggacgttctcgccggcggcgaggtcgtcgagaatgagctggcgcgccgggtcgacgagttgctggaacagcggctggccgccgtcgggcgggtcgcgccgtccttctcagccgccctacgggcgtaccggcgggcgaccgcggccggcgaaaccgcggccgcggagggactgatcgcttggctgggcgggcaaccgcacgtggcggcggcggtgaaacgggccggcggtgtccggggcgacctcgatcacgacggagcgctcggcttcctgcaggggctgctcgcggtgctcaccgacagcggccatgccggtctcgtggtcgtcctcgacgaggtcgagacgctgcagcgggtccggggcgacatgcgtgacaaggcgctcaacgcgctgcgccagctcatcgacgacgtggacgctgggcgattccccgggctgatgctcgtcatcaccggcactcccgcgttcttcgacggaccgcagggagcgcaacggctcgccccgctcgcgcagcggctccacgtcgacttcctcccggatcaagctttcgataaccctcgggcggtgcagctgcgactgcccgggttcaaccgggattccctgctggagctcggcggccggatccgggagctgtacagctccggccatggtgatccggagcggttcgccacggcagtggacgaaggctacctggccgagttcgcgcaggccgtggtcgggcagttcggcgggcgagtaggcgtcgcgccccgcatcttcgtgaagaaactcgtcgatgtgctcgaccgcgtcgaccagcatcccgccttcgatccccggcgtgcgtacgtcccgcggctgtccgccaccgagctcaccgacaccgaacgtgcggcgatgcccagcccgccacaaccgcccccggcggcatcggtcgacgacatcgacctaccgctgtga

SEQ ID NO: 4423 - DNA, 1338 bp, Frankia sp.
gtgagtggcgagattgacgtcagcgccgcccggcggcgggacgtgctcgacgcgctgcgacgcggggccgtgcccgcggccgggctggacctgcttgcggttgggctggaccggttcgagcgggcggccgccgaggacatcgcggcggttgctgccggcggctcagtgttcaaggcggtccgtggcgagtacggctccgggaagacgttcttcacccgctggctcgccgagcgtgccaagaaggccggccttgccaccgccgaggtgcagatctcggagaacgagaccccgctacacaagctggagaccgtctaccgtcggctcaccgaacggctgactacagcgaccttcccgccaagcgcgctgcgccaggttgtcgacggctggttctacgcgctggaagaggacgttctcgccgccgacgacaaggccggtgatgacgctgaggcgctcgaccgggccgtcgacgagctggtcgaccggcgactcgccgaggtcggccgcacggcgccggcattcgccgcggcgctacgtggctaccgggctgcgctcgcggccggtgacgaggcgaccgcggcggccgtgctcgcctggctcggcgggcagccgcacgtctcggcgagcgctcgcaggtccgccggggtgcgcggggacctggaccatttcggcgcgctcggcttcctgcagggactgctggtcgtcctgcgtgacagcggcttccgcggcctgctcgtcgtcctcgacgaggtcgagaccttgcaacgagtccgatccgacgcgcgagacaaggcgctgaacgcgctgcggcagctcatcgacgaggttcacagcggccggttccccgggctgttcctcgtcatcaccgggacgccggccttctacgacggcccgcagggtgtgcagcggctgacgccgctcgcgcagcggctggcgaccgacttcaccgccaacccaaagttcgacaacccgcgggcggtgcagctgcggctcgctgggttcaccgaggcgtcgctcgtggagctcggcgggcgggtccgcggcctgtacgtggccggaacgtcgagcggtgcggccggacggataggggacttggtcgacgatgcctatctcggagagctcgccggggccgtggccggacggctcggcgggaaggtcggcgtcgcgccgcggctctttttgaagaagctcgtcggcgacgtcctcgacagggtcgaccagttcgacgacttcgacccgcgtcgcgactacccgctgaccatcaactcggccgagatgagcgatctagagcgcaacgccgccgccaatcgggccgacgacatcgacctggacctcgggtga

SEQ ID NO: 4424 - DNA, 1329 bp, Microlunatus phosphovorus
gtgaccgaccctgggcccgtgtcgccgcgccgccgacgggaggtgctggatgcgctgcgtcgaggcactgtgcctgcgcaaggactggatctgctcgcggttggcctgcggccattcgagtccacgctcagcgatgagctgaccacagtcgctggcggcggctcggtcttcaaggccgtgcgcggtgagtacggatcgggcaagacattcttcgctcgctatctgagcgaactggcgttgcggcgaggcttcgccgcggcggaggtgcagatctcggagaccgagacgccgctgcaccggctggagacggtctaccgccgcattgtggagtcgttgcggaccttgtcggtaccgccgagcgcgttccgttctgtgctcgactcctggctgtttaccgtggagtcggacgtcgaggagagcggtgagggctcagttgcctcggtcgaccgagtgctggagcaacggctcactgcggtgcgaaacaccacacccgcgttcgcgcaggcgctgcgggcctatcgggccgccgtgtcgggcggtgaccagtcgaccgcggactcgctaatcgcctggctcggcggtcagccacatgtggccgccgccgcaaagcgatctgccgggattcgcggcgacctcgatcacttcggtgcgatgggtgctttgcagggactgctcctggtactgagggacgctgggcatcccgggttggtggtcgtgctcgatgaggtagagacgctgcagcgggtgcgcggggatgtgcgggacaaggcactgaacgcgctacggcagctgatcgacgagatggacgccggccgctacccaggtctgtacctgatgatcaccggcaccccagccttcttcgagggaccgtccgggctgtctcggctgccgccgttggcgcagcgcctgcacgccgacttcactgctgagcgacgcttcgacaaccccagagcagtgcagatccggctggccggattcacccggggatccctggtggagctgggagttcgggtccgagatctttacgcagagggtagcgatcacgcagatcgggtccgcgctcttgtcgacgatgcatacctgggtgtgctggctgatgcggtggccggctcgctaggcggcagtatcggcgttgccccacgagtcttcctcaagaagctcgtcggagatgtgctggaccgcgttgatcagttcgaggacttcgacccacggcagcactaccggttgaccgtcaccgacgcagaactgaccgcgaccgagcgtgcgacggcgagctccccgcgagctcgcggggctcaaggaccggacgatatcgatctcgagttttga

SEQ ID NO: 4425 - DNA, 1302 bp, Micromonospora aurantiaca
atgacggccgacgtgagcgcccggcgccgacgtgacatcgtcgacgcgttgcgcaggggagtggtgcccgccaacggcctggatgcgctcgcggtcggcctcgaccgcttcgtcaccgcgctcgacgaggatctggatcgcgtggccggcgcgggcagtgtgttcaaggccgtccggggcgagtacggtgccggcaagaccttcttcacccggtggctcggcgagcgggcgaagcggcgcggattcgccgtcgccgaggtgcagatctccgaactcgagacaccgctgcaccggatggaaaccgtctaccggcgcctcgtcgagcagttgtccaccgagcagttcccgccgagcgcgctgcggcccgtactggacaactggatcttcgccttggaggaggatgtcctcgcggccggccgggtgaccgaggaggatgccgaagcgctcgaccgagcggtgggcgaactgctcgagacccgcctcgcggacatctcgcggagcacccccgcgttcgccgcggcgctgcgtggctaccgtaccgccctcgcggacggtgacgacgtcaccgctggtggcctcgccgcatggctgggcgggcagccgcatgtcgccgcagccacccggcgtgccaccggagtcaagggggacctcgaccacttcggcgcgctcaacttcctgcggggcctgctgaccgtgctgcgcgacagcggccaccccggtctgcttctggtgctcgacgaggtcgagaccctgcagcgggttcgtgcggatgcccgcgacaaggccctcaacgccctacgtcaactcgtcgacgacatctacgccggccgcttccctgggttgttcctggtgatcacaggcacgccggcgttcttcgacgggccacaaggtgtccagcggctcgccccactggcccaacgcctcgccaccgacttcggcccggaggtccgctgggacaatcctcgggccacccagcttcggctgcccggattcaccgaggagtccctgactcaactgggcgtccgtgtgcgggaaatctacggcggcgatcaggtgggccgccgcgtcgacgacggttatctgggcgaactcgctcgtgcggtggcagggcggctgggtggccaggtcggggtggcaccgcgggtctacctaaagaagctggtcgcggaagtcctcgaccgggtcgaccagttccccgagtgggatccgcgccagcactacgggctgaccttgcgacccgccgagttgaccgaggtggagcggaacgcgtttgcggccgacgacgtcgagctgtcgttatga

SEQ ID NO: 4426 - DNA, 1275 bp, Mycobacterium gilvum
gtgaccgtgtcggcgcgacggcgccgcgagatcctggacgcgctgcgccgcggcaccgtgccgtccaacggtctggaccagttggctgtcgggctgggccgcttcgaaaccgaacttgacaacgaactcgatgtcgtcgccgccggcggtgcggtgttcaaggcggttcgcggtgaatacggttcgggtaagacatttttcgcgcgctggctgggcgaccgggcgatgaagaagggtttcgccgtcgccgaggtacagatcaacgagatcgacaccccgctgcacaagctggagacggtgtaccggcgcagcatcgaatcactgcgcacggcgtcggtgcccccgagcgcactgcgccccatcctggacgcctggctgttcaccatcgacgacgacgcccgccagcagggcgccgatgttgatgtgttgttggagcgccgcctgtccgatgtggccgcccgcgccccggtgttcccgatggcgatccgggcctaccgccgcttcgtcgccgcgggcgatcacgacggcgccgacgcactggtggcgtggctcggcgggcaaccgcacgtggcggccgcggtcaaacgcaaggccggcatcaagggcgacctcgatcattatcttgcgctgggattcctgcgtggtctgttggcgatcctggccgatgccggccacccgggcctgctcctggtgcttgacgaggtcgagacgctgcagcgcatccgcagcgacgcccgcgccaaagcgttgaatgcgctgcggcagttgatagacgaggtgcacgacggccacttccccggcctgtacctgctgatcaccggaaccccggcgtttttcgaaggacggcaaggcattccgctgttgccgccgctggccgaccggctgcacaccgagttcgccaaggatccgcgcttcgacaacccgcgggcgcctcagctgcggctgacgggtttcgacccggcacgtctgatcgaactgggcggccgggtgcgcgatctgtatctggccggcctcagtgatcccgaccgggtcgccggcgtggccgatgacaccttcctggaacagttcgccgctgcggtggccggtgaactgggcggcaaagtgggcatcgcgccgcggctgttcctgcgcaagctggtcgatgtgctggacaagatcgaacagttccccgacttcgccccatacattgactacgaggtcaagatcgcccccgccgagctgtccgacgccgaacgggccgcgctcactgcggacgacgttccgctcgatctgtga

SEQ ID NO: 4427 - DNA, 1314 bp, Nocardia cyriacigeorgica
gtgagtagccagccaacccaggtcagcgcggcccggcggcgcaccgtcatcgatgcgctgcgacgcggcgcggtgcccgagagcggactggacctgctggcgaccgggctggaccggttcgaggccgctctcgacgacgagctggacctggtcgaatccggcggttcggtgttcaaagctgtacgtggtgagtacggatctggtaagacgttcttcgcccgatggctgggcgagcgtgcgaaacggcgcaatttcgccgtgtcggaggtgcagatctccgaaaccgagactccattgcacaagctggaaacggtataccggcgacttaccgagcgactcaccacatcgagtttcccgccgagtgcactgcgctcggtggtcgatgcctggttctacgctctcgaggaagacgccctggcgacgggcgccgacgacgactcgctcatcgaagcggtcgatcacctcatggccgcccggttgatcgaggtttcccggcatgcgccgtccttcgcgacggcgctacgtggatatcggtcggcgatggtcgacggtgacgaggcgacagccgccgcgatcctggcgtggctgggcgggcagccgaacgttgccgcgtcggcgcggcgggccgcgggtgtgcgcggcgaactcgaccatttcggcgccttcggattcctccaggggctgctcaccgcgctgcgcgacagtgggcatcgtggtctgctgctggtactcgacgaggtcgagactctccagcgggtgcgctccgacgccagggacaaagcactcaacgcactgcgccaactgatcgacgaggtctactccggccggtttcctggactgtacttgctgatcaccggcactcccgcgttctatgacggccagcagggggtgcaacgcctcgcaccgctggcgcagcgtgtcgctacggatttcaccaccgacccccgcttcgacaatcctcgcgctgtgcagctgcgattgcctggattcaccatggactcccttgtcgcactgggtattaccatccgcgatctatatgccgatggtagtgagcacccagcgaggattcgcgatatcgccgatgacgcgtacatcgctgatctggccgctgccgtctgcggcactctcggcggcaaagtcggcgtggcacctcgtctcttcctcaagaagctcgtcgccgacgttctcgaccgggtcgaccagtttcccgacttcgatccgcgacagcactacaggttgacggtcaagtccgccgaactcaccaatgccgagcggaacctcgtacgcgccgacgacatcgacctggacccatga

SEQ ID NO: 4428 - DNA, 1311 bp, Polaromonas naphthalenivorans
atgatcagcgcggcacgtcgggatgacatcattggcgccttgcgccgcggcacggtgcccagcgccgggctggacgcgctggccgttggcatcgagtcgttcgcgcccacgctggaggccgaactggccacggttgccacagggcgcggcggcttcaaggcggtgcgcggcgagtacggcacgggcaagactttcttcggccgctggctgcaggaacgcgcgcgcgccaaaggctttgccaccagcgaagtgcagatcaacgaaaccgaaacacccctgcatcgcctggagacgatttaccgccggctggtcgagcggctgggtacggccgacagcagcacgggtgcctttcgcagcgtgatcgacggctggttttttgccctggagcaggatgtgctggccgacggctcggtcgatgcggatgacgcccaggccctgctggcgcggaccgacacgctcatggaagcgcagctggcgggtatcagcaaaaccgcgccggctttttccgccgtgctgaggacctaccgccgggccctggcaggcggcgaccaccagctggccgaaggcttgatcagctggctggccggccagcccaacgtcgctgccagcgtcaagcgcgcagcaggcatcaagggcgaactggaccatttcggtgcggccaacttcctgatcggactgctgaccatcctgcgcgacagtggttttgccggcctgctcctggtgctcgacgaagtcgagacgctccagcgcatgcgcgccgacacgcgagagcgcggcctgaacgccttgcgccagttgatcgacgagatcgacgcgggacgctttcccgggctgtacctggtcatcaccggcacaccggcgttcttcgatggcgcccagggtgtgcagcgcctggcgcctttggcgcagcgcctgcatgtggactttggcaccgagcgcacctttgacaatccgcgcgcggtgcagattcgcctggcgccgtttgatcaaggctcgctcgtggcggtgggccagcgggtgcgcgatatttatgcgcaactgcaggctaacgaacctcgtttgcgcagcgtggtcgatgacgcgtatatcgaagtgctggcccgcgccgtggcgggcgggctgggcggcaaggtcggcgtggcgcccaggctgttcctgaaaaaactggtggccgatgtgctggaccgggtggatttgcatgcgagctttgagccgcgcctgcattacaagctgacgctggccgacaacgaaatgacggtcaacgaacgcgctgcagcgggcgcggccagcgtggacgacatcgagttgtga

SEQ ID NO: 4429 - DNA, 1323 bp, Saccharomonospora viridis
gtgaccggcgctgtgagccaggcgcgcaggcgtgatgtgatcaacgctttgcgtcgaggcaccgtgccccaaaccggcctggacctgctcgcggtgggcctcgaccgattcaccaccgccatggacgacgacctcgacaccgtcgcccgaggaggcgcggccttccacgccgtgcgcggcgaatacggctcgggcaaaacgttcttcgcacgctggctcgccgaacgagccaaacgccgaggactggcgacctccgagatccagatctccgaaaccgaaaccccattacaccgactggagacggtctaccggcgactcaccgaacgactcaccaccgccacccaccaacccagcgctcttcgcgccgtcgtcgactcctggctctacaccctcgaagaacacgtactggacgccggggaggctacggaggacgacgaggaggccttcaccgccgcagtcgacaaactcgccgaacagcggctcgccgacgtggcacgcacgacccccgcattcgccgcggccctacgcggctaccggcaagccctcgccgacgacgacgccaccaccgccgaagccctcatcgcctggctcgggggacagaaatccgtggcggcctccgcccgccggaccgccggagtacgtggggacctcgaccacttcggagccctcggcttcctccagggcctactcacggtcctacgtgactgcggacatccgggcctgttactcatcctcgacgaaaccgaaacgctgcaacgagtccgcggcgatgtccgcgaaaaaggcctcaacgcgctacgtcagctcattgacgaaatcgacgccggccgcttccccggactgttcctcgtgctcaccgggacacccgcgttcttcgacggacaacagggtgtgcaacgcctcccaccactggcacaacgtctcgccaccgatttctccaccgacccgcgcttcgactcaccccgcgcggtgcagcttcggctccccggtttcgacctcgaccggctcagtgagctcggccggaccgtgcgcgagctctacgcaggagtggcgcgcaacccggagcgggtgcgggaggtggtggacgacgcctacatcgccatcctcgcgaaagcactcaccggcgaactcggtgggaaggtcggcgtggcacccaggctgttcctgcgcaaactcgtggccgacgtgctcgaccgggtagacgacttcgccgacttcgacccacgccgggactacccgatcaccgtcaccgacaccgaactcaccgacgtcgagcgcaacgccgtcgccagcgccgacgacatcgacctggagctaccgtga

SEQ ID NO: 4430 - DNA, 1257 bp, Saccharopolyspora erythraea
gtgccccaggctggactggacctgctcgtggtcggacttgaccggttcacgaccgcgatgagcgacgatctcgacaccgtggcgcggggtggtgccgccttccacgcagtgcgcggcgagtacgggtcgggcaagacgttcttctcccgctggctggccgaatccgctaagcggcgcgggatggcgacctccgagatccagatctccgagaccgagaccccgttgcacaagctggagacggtgtaccggaggctcaccgaacgcctcgccaccgccgcacatcggcccagcgcgctgcgttccatcgtaaactcctggttctacacgcttgaagaacaggtcctcgatgccgacgagatcaaccccgacgaccaggctgccctcggcgaggccgtcgacgcacttctggagaaacgcctcgccgacgtcgcgcgcacgacccccgcgttcgccgctgccctgcgtgggtatcggcatgccgtcgactccggcgacaccaccacagccgaagcactgatcgcatggctcggggggcagaggtccgtcgctgcatccgcgcgtcgggccgccggtgtacgcggggatctggaccacttcgccgctttggggtttctgcagggactgttgacggtgctgcgtgactgtgggcatcccggactgctgctggtgctcgacgagaccgagacgttgcagcgtgtgcggggcgacgttcgggagaaggggctcaacgccctgcggcagctcctcgacgagatcgacgcgggacgctttcccgggttgttcctggtgatgactggaaccccggcgttcttcgacgggcgtcagggtgtgcagcggctgcccccgctcgcgcagcgtctcgccacggactttacgacagacgcgcggttcgactcgccgcgcgccgtgcaactgcggctgccaggattcgacctgccgtccctgggcgagctggggagacgcgtgcggaacctctacgccgatggagcacggaatcccgagcgagtgcgttccctcgtcgacgattcgtatgtggatacgctcgctcgggcgctcgccggcgaacttggcggtcaggtcggagtggcgccgcggatcttcctgcgcaaactcgtcgccgacgtgctcgaccgcgtcgacgatttcgacgacttcgatccccggcagtactacaccctcacactcagctcgggtgacctatccgaagtggaacgcaacgcgtcacgtgctgaggacgtcgacctggatctgccgtga

SEQ ID NO: 4431 - DNA, 1320 bp, Saccharothrix espanaensis
atgacgacggtcagtccggcacgcaggagggcggtgctggccgcgctgcgacgcggaaccgtaccggaaagcggcttggacctgttcgcggtcggcttggaccggttggcacccaccctggacgaggagctgtcggcgtgcgcttcgggtgccgccgagttcaaggccgtgcgcggcgagtacggagcggggaagaccttcctggcccgctggctggccgaacgcgccaaagccgccggcatggcggtgagcgaagtgcagatctcggagaccgagaccccgctgcaccgcttggaaacggtgtaccggcggctgtgtgagaacttgacgaccgccgccgcgccgcccagtgcgttccgcgccgtgctggacagctggctgttcgcgctggaggaggacgtgctggccgagggcgaggtcgacgcgtccgacgcacagcgcctgggctcggcggtggacgacctgttggagctgcggctgggcggactggcccgaaccacaccgggctacgcgaccggcctccgcggctaccgccgagcggtggccgagggcaacacggacaccgccgacggcttggccgcgtggctggccgggcagccccacgtggcctcctccgcgaaacgcgccgcagcggtgaagggcgacatcgaccacttccaggctttggggttcctgcagggactgctcaccgtgctccgcgacgcggggcaccccgggctgctcctggtgctggacgaagtcgaaaccctgcaacgggttcgcagtgatgcgcgggccaaggcgctcaacgccctgcgccagttgatcgacgagatcgacaagggccgcttccccggcctgtacctgatggtcaccggaacaccggccttcttcgacggacgtcaaggcgtgcaactgctccagccactggcggatcggctgcacaccgacttcggcacggacaaccggttcgacaacgcgcgcgccccgcaggtccggctgaccggtttcaccctcgaccgcctggtcgagctcggcagccgagtgcgtagcctctatgcgaatggatcgcctgccgcacaacgcatcctgcagttggtggacgacgcctacctccgggacttcgccgcatcggtggccggccgcctcggcggaaaagtcggtgtcgcaccgagggtgttcctgcgcaagctggtgctgaacgtgttcgacaccatcgagctgcaccccgacttcgacccgcgcagcgactacaccgtcgcggtcgaacgcgccgaactgacgagcgtcgaacgggaagccgccgccacgtcggcggacgacatcgacctcgatgtctga

SEQ ID NO: 4432 - DNA, 1320 bp, Singulisphaera acidiphila
atggaaatcagccgagaacgccgccgcgaaatcatcagtgcgctccgcaaggggacggtcccgcaacggggcctcgacttcctctccgtaggactcggccggttcgagcccgtcatgaccggggaactcgccgacgtggcccaagggagctcggtgttcaaggcagtccggggcgagtacggctgcggcaagaccttctttgggcgttgggtgcaggagtacgccaagaagaagggatacgccatcgccgaggtccagatctccgagaccgagacacccctccatcgcctcgaaacagtttaccgtcgggcgatggagcagttgtccacggccgactgcttcctgggtgcctatcgctccatcattgacggctggttctacggcttggaggaggacatcctctctgagggagagatcgaggccagcgacctcgaagccttggcgcgacgtgcagacgaactcctcgaacagcggctcctcgagatcacccgggcgacccctcagttcgccgccgccctgcgatcgtaccgggcggcgcagcgacggaacgaccatgccaccgccgaggggcttgtcggatggctcgccgggcagccgcacgtcgcggcctcgatcaaaagaatcgccgggatcaagggggacgtggaccacttcgccgccctcagcttcctccgtggcttgctcctgattttgaaagattcgggattctcgggactcgtcctcgtgctcgacgagatcgagacgctccagcgtgtccggggcgacgtgcgagaaaaggggttgaacgccctgaggcaactgatcgacgacattgatggcgggcggttccccggcctctacctgctgatcaccgggacgcccgcattttacgatggcccgcagggtgtccgtcggctggagccgttggcgcagcgactccaggtcgatttccagaccgatgctcgcttcgacaatctgcgggccgtgcagatccgcctccctgcgttctcgcacgcccggctcgtcgaagtgggtctgaaagtccgcgatctctatgcccaggacgctcaggatcgcgaacgaatcctcacgttggtggatgacacctacgtcgccgaactggcctcggccgtggcgggtgatttaggtggccaggtcggagtagcacctcggttgttcctcaagaagctcctggccgacgtgctcgaccgggtcgatcagcacgccgacttccatccccgccaacactaccggctgacgatcgccgaggatgaattgaaccgtgtcgagcgtgccgcccgcggtgccgcgtccgtcgacgagatcgagctggacctctaa

SEQ ID NO: 4433 - DNA, 1362 bp, Sorangium cellulosum
atggcgccgccgagcctgatccgacgccgcgagatcatcgcggccctccgtaacgggacggtcccgcgccgcgggctcgagctcttcgccgtgggtctcgggcggttcgacgcggcgatcgaggaggagctggggcgggccgcgctcggcgagggcgtattcaaggcggtgcggggcgagtacgggacgggaaagacgttcttctcgcgctgggtgcagcaccgggcgcagcaggcgggattcgcgacgtcggatgtgcagatctccgagacggagacgccgctctaccggatggagaccctttatcggcgcgccctcgagaacctgcggacgcgcgagtgggagagcggggcgttcaggtcgctgatcgacaagtggttcttcacgctggaggaggaggtcgccgggaggcctggcttcgatccggaagccgaaggcgggatgtccgaggcggtgggcgagctcctcgaagcgaggctgtccgagatcaaggcgacgcacccgcagttcgcctcggtcctgcgggcctgtcatcgcgcgcgggtggaaggggatgacgcgacgtccgaggggctgctcggctggctgatgggccagcccaacgtgggcgcggagccgaagcgcgccgcggggatcaagggcgagatcgatcacttcgccgcctcgggcttcctccgcgggctgctcgtcgtgctccgcgagacggggcgaaaggggctgctcctggtgctcgacgaggtcgagaccgtgcagcggatgcgcgccgactcccgcgagaagagcctgaacgcgctgcgccagctcatcgacgagctcgacggaggccgctacccggggctttacgtgatgatcaccgggacgcccgccttttatgacggcccgcagggggtgaggcgcctcgcgccgctggagcagcggcttcacgtcgacttcaccggcgacccgcggtgggagtccgcgaaagcgacgcagatccggctgcacccgttcgatgtcgaccggctcgtggaggtggggcggctggtgcgggacctctatccggcccatgcgcccgagcgggtctccgcgcgggtgacggacgaggtggtccgcgacctcgccgtgggcgtgaccggctactttggcggcaaggtcggcgtcgcgccgcggatctacctgcgaaagctgatcggcgagcttctggacaaggtcgacgagcaccccgagtacgacccggcgaagcacttcaagctggtggtcgacgcgcgcgagatgaccgcggaggaacgcgccgcggcgggcgtcgagtcgtccgtcggcgacctgccgctggaggcgggtgacggctcgtcgggcggcgcggggagccacgagctcgagtga

SEQ ID NO: 4434 - DNA, 1350 bp, Streptomyces coelicolor
gtgagcaccaccggatctccgcgccccgctcaggtgagcgccgcccgccgccgcaccgtgatcgacgccctgcgccgaggggccgtgcccgagagtggactcgatctgctagccaccggactcggacggttcgaggcagctctcgacgcggaactggacggcgtcatgtccggcgggtccgtgttcaaggcggtgcgcggcgagtacggggccggcaaaacgttcttcacgcgatggctgggggagcgggccaagcgccggaacttcgccatcgccgagatccagatctccgagaacgagacaccgctgcacaagctggagaccgtctaccgccgcctcaccgaacggctcaccacgtccagttttccgcccagcgcgctgcggcccgtcgtggacgcctggttctacgccctggaggaggacgcgctcgccgccggcgccaccgaggaggaactgccggcggaggtcgagaagctcctcctcgcacggctcgccgaggtgtcccggcacgcgccgtccttcgccaccgcactgcgcgggtaccgggcggcgctcgcggagggcgacgaggcgaccgcctcggccgtgctggcgtggctcggcggccagccacacgtcgccgctgctgcccgccggtccgccggcgtgcgcggggacctcgaccacttcggtgccctgggcttcctgcagggcctgctcaccgtgctgcgcgactccgggcacaccgggctcttcgtcgtcctcgacgaggtcgagaccctgcagagagtcaggtcggatgcccgcgacaaggcgctgaacgctctgcggcagctcatcgacgaggttcactccggccgcttcccgggcctgtacctggcgatcaccggcacgcccgccttctacgacggccagcagggcgtccagcgcctcgccccgctcgcccaacggctcgcgaccgacttcaccaccgacccgcgtttcgacaacccccgtgccgttcagatccggctgcccggcttcagccgggagtcgctggtcggtctcggcctcaccatccgtgagttgtacgcggacgctgcccaggctcccgagcgcgtgcgggcggtcgtcgatgacgtctatgtcgccgacctcgcccaggccgtcggcggcgccctgggcggcaaggtgggggtggcgccaaggctgttcctgaagaagctcgttggtgacgttctggaccgggtcgaccagttcgacgacttcgacccacgacagcactatcggctgaccgtggcgagcagcgaactcaccgacgtcgaacgtaacctggccgccacggtcaccggcggttcggtatccgccgacgacatcgaactggagctgtga

SEQ ID NO: 4435 - DNA, 1329 bp, Streptomyces griseus
gtgagctcagccaaaccacatcctcccgcctctgccgcccgccgtcgcaccgtgatcgatgcgctccggcgcggggccgtacccgacagcggactcgacctgctggccacaggcctggaccgcttcgcttcggcgctcgacggcgagctggactcggtcgcatccggtggcgccgtgttcaaggcggtgcgcggcgagtacgggtcgggcaagacctttttcacgcgttggctgggagagcgggccaagcgactcggcttcgcggtcgcggagatccaggtgtcggagacggaaacgcctctgcacaagctggaaaccgtctaccggcggctcactgagcggctggccactgcgagtttcccaccgagtgcactccggcccattgtggacgcctggttctacgcgctggaggaggacgccctcgccgccggcgcgagcgaccatgaactggcccgtgaggtcgaggcgttgctgaccacccggctggccgaggtctcacggcacgctccgtcgttcgcgaccgctctgcgcggctaccgtgcggcgctcatcgagggcgacgaagcgacggccgcagccgtactcgcatggctgggtggccaacctcatgtcgccgcggccgctcggcggtcggccggggtccggggcgacctcgaccacttcggtgccctcggcttcctccaagggctgctcaccgtgctgcgtgactccgggcaccgtggactgttcgtcgttctcgatgaggtggaaacgctccagcgcgtacggtccgacgcccgggacaaagctctgaacgcactgcgccagctcatcgacgaagtccactcgggccgcttccccggcctctacctcgtgatcaccggtacgcccgccttctacgacggacagcagggcgtgcagcgcctggctccgctggcccagcggctggccaccgacttcaccaccgacccgcgcttcgacaatccccgcgcggtgcagctgcggctacctggattcacccaggaatccctggtggatctgggcgtgaccatccgtgacctctatgcggccggcgcctcggctcccgaacgtaccgtggccgtcgtcgacgacgcctatgtggccgaactcgcccgagcggtcggcggcgcactcggtggcaaggtgggagtggcaccgcggcttttcctgaagaagctggtgggcgacgtcctcgatcgtgtcgaccagttcgacgacttcgaccctcgtcagcactaccggctgaccgtgaacagcaacgaactcaccgacgtggagaggaactccgccgccacccactcggcggacgacatcgagctggacgtctga

SEQ ID NO: 4436 - DNA, 1326 bp, Thermobifida fusca
gtgaaaaccgtcagcgccgcccgccgccgcgaagtcctcgacgcgctccgccgcggaaccgtgccccaaaacggcctcgacctgttcgccgtcggactcgaccggtacgaaaccgtgctcgacgaggaactcgccgccgtaggcgcgggcagcgcaagcttcaaagccgtccgcggcgaatacggttccggaaaaaccttcttctcccgctggctcgccgaacgcgccaaacgcgccggcttcgccgtcaccgaaatccaaatctccgaaaccgaaaccccgctgcaccggctcgaaaccgtctaccggcggctcaccgaacgcctcgccaccgccacccagccgcccagcgccctccgagaaatcgtcgacaactgggtctacaccctcgaagaagacgtcctcgaccacggcactgtgcccagcggcgacgaacacgccctcacccaagccgtcgcggaactcctcgaacaacgcctcgccggagtcgcccgcagcagccccgccgtggcccttgccctccgcggctaccaccgcgcccaagccgaagggcagcacgccatcgcagacgcgctcgtcgcctggctcggcggacaacccaacgtggccgccgccgcgaaacgctacgccggaatcaaaggcgacctcgaccactccggggccctcgctgccctccaaggcctcctcaccctgctccgcgactgcggccaccctgggctcctcatcgtcctcgacgaactcgaaaccctgcaacgcgcccgctccgacacccgcgacaaagccctcaacgcgctccgccaactcatcgacgaaatcaccgccggccgcttccccggcctctacctcgtcatcaccggcacccccgccttctacgacgggccgcaaggcgtgcaacgcctcgcccccctcgcccaacggctcgccaccgacttcatgcccgacccgcgccacgacaacctgcgggccgtccaaatccgcctccccagcttcgacctcgaccggctccaccagctcggcaccaccgtccgcgacctgtacgccaacggagccgaagcccccgaccggatccgcgcccgcgtcgacaacacctacatccgcgacctcgcccaagccgtcgccggagaactcggcggccgtgtcggagtagccccccgcctcttcctccgcaaactcgtcgacgtcatcgaccgggtcaacgacatccccgacttcgacccgcgcatccactaccagctgaccgtgcgcgccagcgacctcaccgaaaccgaacgcaacacctggaccccgcgcgccgcatccgccgatgaggtagaactcagcctgtga

SEQ ID NO: 4437 - DNA, 1320 bp, Hahella chejuensis
atgacgattagcaagcaaagaagccgagacattattgacgctttaaggcgcggcacggtgccgcaatatggtttggatgcgctcgcagtcgggctagatccgcttgaaaaggcactatcagaagaattaaacaaagtcgctggtggcggttcggtttttaaagctgtgcgtggtgagtatggtagtggtaaaaccttcgcgtctcgctggctgcgggaaaaagctcatcggttagggtttgcttgtgcagaagtgcaagtatcagaaacagagacaccgctccaccggctggaaacagtatatcgacgtttgatggaacgacttacaacaccggacagttcaacaggcgcctttcggaatattgtcgaatcctggttctacacgttagaagaagatgtgctatcgcaagaaaaggtcgatgagaatgatgtcgagtctttggtgagtgcgacggatgctcttatggaaaagcgattaggcgaagtggtgagaactgcgcctgcttttgcattaacgttaagagcatatcgaaaggctctcgtggaaggacgggaagaaatagcggacggtttacttgcttggatggcgggacaaccgaacattgcggcctccattaagcgttatgcagaaattaaaggcgatattgaccattttggcgcactgagctttctacaaggcgttttaacgatattaaaggattccggtcattctggtttattactggtattggatgaagttgaaacgcttcaacgcatgcgtggcgatgtacgggataaaagccttaacgccttgcgacagttgatggacgaaattgatagtgggcgattccccgggttgtacttattgattaccggtactcctgcttttttcgatgggccgatgggtgtacagagactggcgccgctggcacaacgtttagccgtagatttctccacagacagtcgatttgataatccaagagcggtgcaaattcgattaaaaggttttgatttgtcgtcgcttgaagaagtgggacagaaagtgagggatctgtacgcgaatatcagtgatactcccgagcgagtcaatactaaggccgatgacacatacatcgcagatcttgccaaagcggtgacaggaaacctgggcggaaagatcggcgttgcgcctcgaatcttcttaaagaaattggtcggcgacgtgctggatagaattgaccaacatgatgagttcaaccctagagagcactacgctttaacgatttcggatacggagttgaacgcggtagagcgtgcagccaagtctgcttcaagtgtggacgatatcgagctggatctatga

SEQ ID NO: 4438 - protein, 435 aa, Dehalococcoides sp.
MPIKSYYQKQYGLKGNPFPSRATYNVDSPSVYVPEMFGPQQPEFLKKFILAPLQNIQPLIGAVWSVSVGDPEARGFGKSMLMAEESKRIDCDFGKSTLMSLGVSEEDAQSSPILAGYVSFNVSGYGSISSIDAAAFNLARFILRVRDDQGVSTHAKLRERAAARLIAEGKATAGNEDAAIVTAIKERFTRLANTVDIRNLLEDYIFHLASDNTDGLEQFLASGVGTWHHDRNGLKYLQILVVFADIAGIEHFTFFIDQVEDFTYVAGPAKIQKNIKIIRDALIEAEPFSSKASFVFQLHPIAWEKLRDAWEHEDLPSLEYDDALTEPRVVVLKGLEEFSTARLLVEGIINHPSVVLPNRADSITPFTEEGLKSVWEATKPNPREFLRSVNLLLELGNNQQIPILDEAFIAPKLERLIRSLHTGEAAEEEVDERTA

SEQ ID NO: 4439 - protein, 447 aa, Desulfitobacterium hafniense
MGMDMSQVKIPKRISTALIQSLSAGVVPRIGLEHIAVGRKEEIESLLGDLENVGAGGASFRFIVGRYGSGKSFLMQTLRNYAMERNYVVADVDLSPERRFTGTKGQGLATYRELLTNLSIKTRPDGGALTSILEKWIGAIQMEVMKDTGLRPQDNGFGEAVELKIFEAVNHMSGMVHGFDFANAVIAYWNGHRQADESQKAAALRWLRGEFATKTEAKAFLKVQMIIDDESWYDYLKLMAAFVAHIGYRGLIVFIDEGVNLYKISNSVARHSNYEKLLTMFNDTMQGKAQHLGILLGGTPQFVEDQRRGLYSYEALRSRLAESRFGQGGLRDLFGPIIRLQTLTHEEIFVLLKRLVEVHGQHYGYESRITDQEMLAFMQEVAGRMGADELLTPREVVRDFMGLLNILLQNPQISFSEVLYGPDFKLKAADQDPEQISQDDEYAEFTL

SEQ ID NO: 4440 - protein, 441 aa, Thiocystis violascens
MTTLTRKDVEHVFESLRKGLVPERGIDAFGVGCEKPRGELHRQLDLAGNGEGTIKFLRGGYGCGKTFMARLALLDAQARGFATSFVVVSDNDLRFHRFDDIYRKVLAELSTTACPRGALGDILDRWIGRIEAALIAVGEDEQAADFDDRVRQRLDEDLSSLTGGQAPQDFIRVVQRVFDLKQAGDSSSAGALLSWLCGSGNVASSIKQTAGVKGDIGSRDALDYLRGVLEIVKAAGYAGLVIVIDEAETILRMRADSRHKSLNGIRQIADAAGSYPGLVWLFTGTPEFFDSRHGVAGLTPLHERIRFLQQGRFASLRQAQLALAPFDAERLRAVALRLREIYPAQDRARLETCISTTFVDRLVTEVTRGFKGDVGVVPRQFLRELVNQLDLVEEHADYDPMTEYGFRPDQLSAEEQHLLAGVSSSDVDAEDEALIPQEDVW

SEQ ID NO: 4441 - protein, 440 aa, Planctomyces limnophilus
MTSITGRDVEHIFESLRKGLVPERGIDTFAVGIEKQRNELHRQLELVGSHEGSIKFLRGGYGCGKTFMARLALLDAQARGFATSFVVVSDNDLHFHRFDDVYRKVMTELGTASCPRGALGDILDRWIGAVEETLVNAGVDDTADDFDERVRKRLNEDLVSLTGGNAPEDFIRVIQTIFDLKQDGNVVDAGALISWLCGSGNVAASAKKVAQVKGDIGSRDALHYLRGVLEIVKAAGYKGLVIVIDEAETILRMRKDSRHKSLNGIRQIADAASSYPGLLWLFTGTAEFFDTRHGVAGLTPLHDRIRFISSGGFASLRQAQLELKPFDTERLKAVALRLREIYPGQDRSRLESAVSQEFIERLVANVTAGFKGDVGIVPRQFLREFVTQMDLVEENKDYSPAEQYGFKPTELSTEEQTVLSGTNGNRESKDDELVPTEDAW

SEQ ID NO: 4442 - protein, 441 aa, Anaeromyxobacter dehalogenans
MGLTRRDVNHIFERLRSGVVPERGLDAFAVGIERQRAELGRVLDLAHAGEGVFKFLRGGYGCGKTFMSRLAVLDAQARGFATSFVVVSDNDLHFHRFDELYRKIVQELGTSSCPRGALADIVDRWIAKVENALVAAGANEEAPGFDAQVQKRIGEEITSLTGGKAPEDFARVLREIFALKQAGKGADAGALLSWLSGSGNVAAQQKKSAGIKGDITSAEALDYLHGLLEIVKAAGYKGLVIVIDEAETILRMRQDVRGKSLNGIRQICDAADRYHGLLWIFTGTPDFFDTKRGVAGLQPLHDRIRFLSQPGYVSLRQAQLELKPFDAGRLKEVALKLREIYPASDPPGLEARVTPEFIERLVREVTKGFGGDVGIVPRQFLRQLVNVFDLTIEFPEYDPEKQFKFEPQGTSDYEARKLEGKPPYDPEPGDDKGYPTTSVEF

SEQ ID NO: 4443 - protein, 450 aa, Haliangium ochraceum
MSTMTERDIRHVIESLRSGLVPERGIDAFAVGVDKERGELQRQLDLAASGEGAIKFLRGGYGCGKTFMARLALLDAQARGFATSFVVVSDNDLRFHRFDDVYRKVVGELATASCPRGALGDILDRWIGGIEAGMIAAGADEDADDFDQQVRKRIDDDLMSLTGGQVPADFVRVVQTVFDLKQRGEVAEAGALISWLSGSGNVSAGAKKRAGIKGDIGSRDALDYLRGVLAIVKKAGYKGLVIVIDEAETILRMRKDSRHKSLNGIRQIADAAGSYHGLLWMFTGTPEFFDERRGVAGLAPLHERVRFIKQGGFASRRQPQLELHPFDSQRLSAVALLLRGLYLRVAEEPARVDERVTEAFIGRMVEEVTKGFRGDVGVVPRQFLREFVSQMDRVDEFEECDPMRDWNFQTDALRPEEERAMRGAGARLPTVEGEEGDEEDDGVVPVEQLW

SEQ ID NO: 4444 - protein, 450 aa, Haliangium ochraceum
MSTMTERDIRHVIESLRSGLVPERGIDAFAVGVDKERGELQRQLDLAASGEGAIKFLRGGYGCGKTFMARLALLDAQARGFATSFVVVSDNDLRFHRFDDVYRKVVGELATASCPRGALGDILDRWIGGIEAGMIAAGADEDTDDFDQQVRKRIDDDLMSLTGGQVPADFVRVVQTVFDLKQRGEVAEAGALISWLSGSGNVSAGAKKRAGIKGDIGSRDALDYLRGVLAIVKKAGYKGLVIVIDEAETILRMRKDSRHKSLNGIRQIADAAGSYHGLLWMFTGTPEFFDERRGVAGLAPLHERVRFIKQGGFASRRQPQLELHPFDSQRLSAVALLLRGLYLRVAEEPARVDERITEAFIGRMVEEVTKGFRGDVGVVPRQFLREFVSQMDRVDEFEECDPMRDWNFQTDALRPEEERALRGASGRPPTVEGEEGDEEDDGVVPVEQLW

SEQ ID NO: 4445 - protein, 439 aa, Candidatus Accumulibacter
MISPARRSEIIDALRRGTVPRNGLDAFAVGVDRLQATLDNELSSVSSGGAVFKALRGEYGSGKTFFGRWLQERARAAGFASSEVQISETETPLHRMETIYRRLIERLATADAGEGAFRGIIDGWFYVLEQDVLADGQLDPNDAQGLMAATGVLMEQRLASINKVAPAFSAALRAYREAVARGETALAEGLVSWVSGQPNVAAQIKRTAGLKGDIDHFGAASFIAGVLAILRDSGYQGLILVIDEVETLQRMRADTREKGLNGLRQWLDEIDAGRFPGLYLMINGTPAFYDGPQGVQRLAPLAQRLHVDFSTEARFDNPRAVQIRLPNFDLGLLSQVGCKVRDIFAEGAVDADRVRSLVDDSYVHDLAVAVAGKLGGKVGVAPRIFLKKLVADVLDRVDQFADFDPRQHYALTLAPNELTRSEAAASGLSSIDAIELDVE

SEQ ID NO: 4446 - protein, 449 aa, Corynebacterium variabile
MGRHSDAPLTGTTSTDQRHGLSPVRRRNILQALRRGTVPSDGLDQLAVGLGHLEPVIEDELSAVAGGAGMFKAIRGEYGSGKTFASRWIEQLALEQDFAVAEVQISETDTPLHKLETVYRRTTEELRTTASPTRAFRDVLDAWLATVDMDAEAAGRDRDELIEERLSSVAQVAPVFPLALRGYLRAVEEDDTEIADGLAAWLGGQGNVSAAVKRYAGIKGELDKFTATGFLRGLIEILRGAGQSGLLLVLDEVETLQRMRTDTREKSLNALRQWLDEISNDRYPGLYLLITGTTAFFEGGQGVKRLQPLYDRLRVDFSGDPRWDNPRAVQIRLQSFDHARLVEAGCRVRDLFVDGLAAEEAERVASAVSDDYVASLADAVAGELGGRIGVAPRIFLRTVVDVLDRVELHADFDPRENYNIKVEVSATSNTGRERIPRNTVNDPDSIDFT

SEQ ID NO: 4447 - protein, 442 aa, Frankia sp.
MTISEQRRREVIDALRRGTVPRQGLDVLAVGLDRFTTAIEEDLDRLAGGQATFRAIRGDYGAGKTFFTRWLAERAKARGFATAEIAISENETPLHRLETVYRRLAERLATAEFAPSALRPIVDSWFFALEEDVLAGGEVVENELARRVDELLEQRLAAVGRVAPSFSAALRAYRRATAAGETAAAEGLIAWLGGQPHVAAAVKRAGGVRGDLDHDGALGFLQGLLAVLTDSGHAGLVVVLDEVETLQRVRGDMRDKALNALRQLIDDVDAGRFPGLMLVITGTPAFFDGPQGAQRLAPLAQRLHVDFLPDQAFDNPRAVQLRLPGFNRDSLLELGGRIRELYSSGHGDPERFATAVDEGYLAEFAQAVVGQFGGRVGVAPRIFVKKLVDVLDRVDQHPAFDPRRAYVPRLSATELTDTERAAMPSPPQPPPAASVDDIDLPL

SEQ ID NO: 4448 - protein, 445 aa, Frankia sp.
MSGEIDVSAARRRDVLDALRRGAVPAAGLDLLAVGLDRFERAAAEDIAAVAAGGSVFKAVRGEYGSGKTFFTRWLAERAKKAGLATAEVQISENETPLHKLETVYRRLTERLTTATFPPSALRQVVDGWFYALEEDVLAADDKAGDDAEALDRAVDELVDRRLAEVGRTAPAFAAALRGYRAALAAGDEATAAAVLAWLGGQPHVSASARRSAGVRGDLDHFGALGFLQGLLVVLRDSGFRGLLVVLDEVETLQRVRSDARDKALNALRQLIDEVHSGRFPGLFLVITGTPAFYDGPQGVQRLTPLAQRLATDFTANPKFDNPRAVQLRLAGFTEASLVELGGRVRGLYVAGTSSGAAGRIGDLVDDAYLGELAGAVAGRLGGKVGVAPRLFLKKLVGDVLDRVDQFDDFDPRRDYPLTINSAEMSDLERNAAANRADDIDLDLG

SEQ ID NO: 4449 - protein, 442 aa, Microlunatus phosphovorus
MTDPGPVSPRRRREVLDALRRGTVPAQGLDLLAVGLRPFESTLSDELTTVAGGGSVFKAVRGEYGSGKTFFARYLSELALRRGFAAAEVQISETETPLHRLETVYRRIVESLRTLSVPPSAFRSVLDSWLFTVESDVEESGEGSVASVDRVLEQRLTAVRNTTPAFAQALRAYRAAVSGGDQSTADSLIAWLGGQPHVAAAAKRSAGIRGDLDHFGAMGALQGLLLVLRDAGHPGLVVVLDEVETLQRVRGDVRDKALNALRQLIDEMDAGRYPGLYLMITGTPAFFEGPSGLSRLPPLAQRLHADFTAERRFDNPRAVQIRLAGFTRGSLVELGVRVRDLYAEGSDHADRVRALVDDAYLGVLADAVAGSLGGSIGVAPRVFLKKLVGDVLDRVDQFEDFDPRQHYRLTVTDAELTATERATASSPRARGAQGPDDIDLEF

SEQ ID NO: 4450 - protein, 433 aa, Micromonospora aurantiaca
MTADVSARRRRDIVDALRRGVVPANGLDALAVGLDRFVTALDEDLDRVAGAGSVFKAVRGEYGAGKTFFTRWLGERAKRRGFAVAEVQISELETPLHRMETVYRRLVEQLSTEQFPPSALRPVLDNWIFALEEDVLAAGRVTEEDAEALDRAVGELLETRLADISRSTPAFAAALRGYRTALADGDDVTAGGLAAWLGGQPHVAAATRRATGVKGDLDHFGALNFLRGLLTVLRDSGHPGLLLVLDEVETLQRVRADARDKALNALRQLVDDIYAGRFPGLFLVITGTPAFFDGPQGVQRLAPLAQRLATDFGPEVRWDNPRATQLRLPGFTEESLTQLGVRVREIYGGDQVGRRVDDGYLGELARAVAGRLGGQVGVAPRVYLKKLVAEVLDRVDQFPEWDPRQHYGLTLRPAELTEVERNAFAADDVELSL

SEQ ID NO: 4451 - protein, 424 aa, Mycobacterium gilvum
MTVSARRRREILDALRRGTVPSNGLDQLAVGLGRFETELDNELDVVAAGGAVFKAVRGEYGSGKTFFARWLGDRAMKKGFAVAEVQINEIDTPLHKLETVYRRSIESLRTASVPPSALRPILDAWLFTIDDDARQQGADVDVLLERRLSDVAARAPVFPMAIRAYRRFVAAGDHDGADALVAWLGGQPHVAAAVKRKAGIKGDLDHYLALGFLRGLLAILADAGHPGLLLVLDEVETLQRIRSDARAKALNALRQLIDEVHDGHFPGLYLLITGTPAFFEGRQGIPLLPPLADRLHTEFAKDPRFDNPRAPQLRLTGFDPARLIELGGRVRDLYLAGLSDPDRVAGVADDTFLEQFAAAVAGELGGKVGIAPRLFLRKLVDVLDKIEQFPDFAPYIDYEVKIAPAELSDAERAALTADDVPLDL

SEQ ID NO: 4452 - protein, 437 aa, Nocardia cyriacigeorgica
MSSQPTQVSAARRRTVIDALRRGAVPESGLDLLATGLDRFEAALDDELDLVESGGSVFKAVRGEYGSGKTFFARWLGERAKRRNFAVSEVQISETETPLHKLETVYRRLTERLTTSSFPPSALRSVVDAWFYALEEDALATGADDDSLIEAVDHLMAARLIEVSRHAPSFATALRGYRSAMVDGDEATAAAILAWLGGQPNVAASARRAAGVRGELDHFGAFGFLQGLLTALRDSGHRGLLLVLDEVETLQRVRSDARDKALNALRQLIDEVYSGRFPGLYLLITGTPAFYDGQQGVQRLAPLAQRVATDFTTDPRFDNPRAVQLRLPGFTMDSLVALGITIRDLYADGSEHPARIRDIADDAYIADLAAAVCGTLGGKVGVAPRLFLKKLVADVLDRVDQFPDFDPRQHYRLTVKSAELTNAERNLVRADDIDLDP

SEQ ID NO: 4453 - protein, 436 aa, Polaromonas naphthalenivorans
MISAARRDDIIGALRRGTVPSAGLDALAVGIESFAPTLEAELATVATGRGGFKAVRGEYGTGKTFFGRWLQERARAKGFATSEVQINETETPLHRLETIYRRLVERLGTADSSTGAFRSVIDGWFFALEQDVLADGSVDADDAQALLARTDTLMEAQLAGISKTAPAFSAVLRTYRRALAGGDHQLAEGLISWLAGQPNVAASVKRAAGIKGELDHFGAANFLIGLLTILRDSGFAGLLLVLDEVETLQRMRADTRERGLNALRQLIDEIDAGRFPGLYLVITGTPAFFDGAQGVQRLAPLAQRLHVDFGTERTFDNPRAVQIRLAPFDQGSLVAVGQRVRDIYAQLQANEPRLRSVVDDAYIEVLARAVAGGLGGKVGVAPRLFLKKLVADVLDRVDLHASFEPRLHYKLTLADNEMTVNERAAAGAASVDDIEL

SEQ ID NO: 4454 - protein, 440 aa, Saccharomonospora viridis
MTGAVSQARRRDVINALRRGTVPQTGLDLLAVGLDRFTTAMDDDLDTVARGGAAFHAVRGEYGSGKTFFARWLAERAKRRGLATSEIQISETETPLHRLETVYRRLTERLTTATHQPSALRAVVDSWLYTLEEHVLDAGEATEDDEEAFTAAVDKLAEQRLADVARTTPAFAAALRGYRQALADDDATTAEALIAWLGGQKSVAASARRTAGVRGDLDHFGALGFLQGLLTVLRDCGHPGLLLILDETETLQRVRGDVREKGLNALRQLIDEIDAGRFPGLFLVLTGTPAFFDGQQGVQRLPPLAQRLATDFSTDPRFDSPRAVQLRLPGFDLDRLSELGRTVRELYAGVARNPERVREVVDDAYIAILAKALTGELGGKVGVAPRLFLRKLVADVLDRVDDFADFDPRRDYPITVTDTELTDVERNAVASADDIDLELP

SEQ ID NO: 4455 - protein, 418 aa, Saccharopolyspora erythraea
MPQAGLDLLVVGLDRFTTAMSDDLDTVARGGAAFHAVRGEYGSGKTFFSRWLAESAKRRGMATSEIQISETETPLHKLETVYRRLTERLATAAHRPSALRSIVNSWFYTLEEQVLDADEINPDDQAALGEAVDALLEKRLADVARTTPAFAAALRGYRHAVDSGDTTTAEALIAWLGGQRSVAASARRAAGVRGDLDHFAALGFLQGLLTVLRDCGHPGLLLVLDETETLQRVRGDVREKGLNALRQLLDEIDAGRFPGLFLVMTGTPAFFDGRQGVQRLPPLAQRLATDFTTDARFDSPRAVQLRLPGFDLPSLGELGRRVRNLYADGARNPERVRSLVDDSYVDTLARALAGELGGQVGVAPRIFLRKLVADVLDRVDDFDDFDPRQYYTLTLSSGDLSEVERNASRAEDVDLDLP

SEQ ID NO: 4456 - protein, 439 aa, Saccharothrix espanaensis
MTTVSPARRRAVLAALRRGTVPESGLDLFAVGLDRLAPTLDEELSACASGAAEFKAVRGEYGAGKTFLARWLAERAKAAGMAVSEVQISETETPLHRLETVYRRLCENLTTAAAPPSAFRAVLDSWLFALEEDVLAEGEVDASDAQRLGSAVDDLLELRLGGLARTTPGYATGLRGYRRAVAEGNTDTADGLAAWLAGQPHVASSAKRAAAVKGDIDHFQALGFLQGLLTVLRDAGHPGLLLVLDEVETLQRVRSDARAKALNALRQLIDEIDKGRFPGLYLMVTGTPAFFDGRQGVQLLQPLADRLHTDFGTDNRFDNARAPQVRLTGFTLDRLVELGSRVRSLYANGSPAAQRILQLVDDAYLRDFAASVAGRLGGKVGVAPRVFLRKLVLNVFDTIELHPDFDPRSDYTVAVERAELTSVEREAAATSADDIDLDV

SEQ ID NO: 4457 - protein, 439 aa, Singulisphaera acidiphila
MEISRERRREIISALRKGTVPQRGLDFLSVGLGRFEPVMTGELADVAQGSSVFKAVRGEYGCGKTFFGRWVQEYAKKKGYAIAEVQISETETPLHRLETVYRRAMEQLSTADCFLGAYRSIIDGWFYGLEEDILSEGEIEASDLEALARRADELLEQRLLEITRATPQFAAALRSYRAAQRRNDHATAEGLVGWLAGQPHVAASIKRIAGIKGDVDHFAALSFLRGLLLILKDSGFSGLVLVLDEIETLQRVRGDVREKGLNALRQLIDDIDGGRFPGLYLLITGTPAFYDGPQGVRRLEPLAQRLQVDFQTDARFDNLRAVQIRLPAFSHARLVEVGLKVRDLYAQDAQDRERILTLVDDTYVAELASAVAGDLGGQVGVAPRLFLKKLLADVLDRVDQHADFHPRQHYRLTIAEDELNRVERAARGAASVDEIELDL

SEQ ID NO: 4458 - protein, 453 aa, Sorangium cellulosum
MAPPSLIRRREIIAALRNGTVPRRGLELFAVGLGRFDAAIEEELGRAALGEGVFKAVRGEYGTGKTFFSRWVQHRAQQAGFATSDVQISETETPLYRMETLYRRALENLRTREWESGAFRSLIDKWFFTLEEEVAGRPGFDPEAEGGMSEAVGELLEARLSEIKATHPQFASVLRACHRARVEGDDATSEGLLGWLMGQPNVGAEPKRAAGIKGEIDHFAASGFLRGLLVVLRETGRKGLLLVLDEVETVQRMRADSREKSLNALRQLIDELDGGRYPGLYVMITGTPAFYDGPQGVRRLAPLEQRLHVDFTGDPRWESAKATQIRLHPFDVDRLVEVGRLVRDLYPAHAPERVSARVTDEVVRDLAVGVTGYFGGKVGVAPRIYLRKLIGELLDKVDEHPEYDPAKHFKLVVDAREMTAEERAAAGVESSVGDLPLEAGDGSSGGAGSHELE

SEQ ID NO: 4459 - protein, 449 aa, Streptomyces coelicolor
MSTTGSPRPAQVSAARRRTVIDALRRGAVPESGLDLLATGLGRFEAALDAELDGVMSGGSVFKAVRGEYGAGKTFFTRWLGERAKRRNFAIAEIQISENETPLHKLETVYRRLTERLTTSSFPPSALRPVVDAWFYALEEDALAAGATEEELPAEVEKLLLARLAEVSRHAPSFATALRGYRAALAEGDEATASAVLAWLGGQPHVAAAARRSAGVRGDLDHFGALGFLQGLLTVLRDSGHTGLFVVLDEVETLQRVRSDARDKALNALRQLIDEVHSGRFPGLYLAITGTPAFYDGQQGVQRLAPLAQRLATDFTTDPRFDNPRAVQIRLPGFSRESLVGLGLTIRELYADAAQAPERVRAVVDDVYVADLAQAVGGALGGKVGVAPRLFLKKLVGDVLDRVDQFDDFDPRQHYRLTVASSELTDVERNLAATVTGGSVSADDIELEL

SEQ ID NO: 4460 - protein, 442 aa, Streptomyces griseus
MSSAKPHPPASAARRRTVIDALRRGAVPDSGLDLLATGLDRFASALDGELDSVASGGAVFKAVRGEYGSGKTFFTRWLGERAKRLGFAVAEIQVSETETPLHKLETVYRRLTERLATASFPPSALRPIVDAWFYALEEDALAAGASDHELAREVEALLTTRLAEVSRHAPSFATALRGYRAALIEGDEATAAAVLAWLGGQPHVAAAARRSAGVRGDLDHFGALGFLQGLLTVLRDSGHRGLFVVLDEVETLQRVRSDARDKALNALRQLIDEVHSGRFPGLYLVITGTPAFYDGQQGVQRLAPLAQRLATDFTTDPRFDNPRAVQLRLPGFTQESLVDLGVTIRDLYAAGASAPERTVAVVDDAYVAELARAVGGALGGKVGVAPRLFLKKLVGDVLDRVDQFDDFDPRQHYRLTVNSNELTDVERNSAATHSADDIELDV

SEQ ID NO: 4461 - protein, 441 aa, Thermobifida fusca
MKTVSAARRREVLDALRRGTVPQNGLDLFAVGLDRYETVLDEELAAVGAGSASFKAVRGEYGSGKTFFSRWLAERAKRAGFAVTEIQISETETPLHRLETVYRRLTERLATATQPPSALREIVDNWVYTLEEDVLDHGTVPSGDEHALTQAVAELLEQRLAGVARSSPAVALALRGYHRAQAEGQHAIADALVAWLGGQPNVAAAAKRYAGIKGDLDHSGALAALQGLLTLLRDCGHPGLLIVLDELETLQRARSDTRDKALNALRQLIDEITAGRFPGLYLVITGTPAFYDGPQGVQRLAPLAQRLATDFMPDPRHDNLRAVQIRLPSFDLDRLHQLGTTVRDLYANGAEAPDRIRARVDNTYIRDLAQAVAGELGGRVGVAPRLFLRKLVDVIDRVNDIPDFDPRIHYQLTVRASDLTETERNTWTPRAASADEVELSL

SEQ ID NO: 4462 - protein, 439 aa, Hahella chejuensis
MTISKQRSRDIIDALRRGTVPQYGLDALAVGLDPLEKALSEELNKVAGGGSVFKAVRGEYGSGKTFASRWLREKAHRLGFACAEVQVSETETPLHRLETVYRRLMERLTTPDSSTGAFRNIVESWFYTLEEDVLSQEKVDENDVESLVSATDALMEKRLGEVVRTAPAFALTLRAYRKALVEGREEIADGLLAWMAGQPNIAASIKRYAEIKGDIDHFGALSFLQGVLTILKDSGHSGLLLVLDEVETLQRMRGDVRDKSLNALRQLMDEIDSGRFPGLYLLITGTPAFFDGPMGVQRLAPLAQRLAVDFSTDSRFDNPRAVQIRLKGFDLSSLEEVGQKVRDLYANISDTPERVNTKADDTYIADLAKAVTGNLGGKIGVAPRIFLKKLVGDVLDRIDQHDEFNPREHYALTISDTELNAVERAAKSASSVDDIELDL

SEQ ID NO: 4463 - protein, 242 aa, Fusobacterium sp.
MKKTLEIKNLSYSFGDNHILKDINIYVKENEMVAIVGSSGVGKSTLFNLIAGVLKKQSGEITIDGSDDYIGKVAYMLQKDLLFEHKTIINNVILPLIIAKIDKKVALEEGRKILKQFNLEKYVDKYPKQLSGGMRQRVALIRTYMFKRNIFLLDEAFSALDAITKKELHKWYLNLKKEFNLTTLLITHDIEEAIFLSDRIYILANKPGEIIKEIKIEINPNEDIDVQRLFYKKEILNIMNIE

SEQ ID NO: 4464 - protein, 442 aa, Rhodopirellula sp.
MTAMTNRDIQHIFESLRKGLVPERGIDAFAVGIEKLRGEMERQLELAEGGEGTIKFLRGGYGCGKTFMARLSLLDAQTHGFATSFVVVSDNDLRFHRFDDVYRKVMIELGTNVCPRGAMGDILDRWIGKVEDALIASGEDENADDFDAKVRKRLDDDLASMTGGQAPQDFIRVIQTIFDLKQQGNAAEAGSLISWLCGSGNVAASAKKAAGIKGDITSRDALDYLRGVLEIVKAAGYKGLVIVIDEAETILRMRKDSRHKSLNGIRQIADAAGSYPKMLWVFTGTPDFFDSRQGVAGLAPLHDRIQFMKQGRFASLRQAQLELTPFDAERLRSVAVKLRELYPTNDQSRIDSKVSIEFIDRLVNEVTQGFKGDVGVVPRQFLRQFVTQLDLVDENEDYDPMTEYGFEPQDLSSEEQLAISGAALTQGDGDDDGEPPVAEDIW

SEQ ID NO: 4465 - protein, 439 aa, Pseudanabaena biceps
MNLSAKDTEHVFEKLRSGVVPERGLEAFAVGIDRSRKEIQRQLELAADGEGVFKFLRGGYGCGKTFMSRLATLEARDRGFATSFIVVSDNDLHFHKFDDVYRKAVQELGTNVCPRGALGDILDRWIARVEDMLIAGGKDEDDPNFDDAVRDRLDEELASMTGGQVPEDMTRVLRTIFTLKQQGNFAEASALISWLSGSENVAASAKKIAGIKGDIGSREALDYLLGILQIVKAAGYKGWAIVIDEAETILRMRQDVRGKSLNGIRQICDAADRFHGLLWIFTGTPDFFDTKRGIAGLTPLHDRIKFETYSGFSSPRQPQLELTPFDAIRLKEVALRLRELFNAGDRIHLERKITLEFIDRLIAEVTKGFKGDVGVVPRQFLRQYVNLLDLVIDNPDFEPISALSLPEDTLNDYELRIKSGLPYCDPEPEENEVYAVVEF

SEQ ID NO: 4466 - protein, 441 aa, Saccharomonospora glauca
MVTSAVSEARRRDVINALRRGTVPQSGLDLLAVGLDRFATAMDDDLATVARGGAAFHAVRGEYGSGKTFFARWLAERAKRRGLATSEIQISETETPLHRLETVYRRLTERLATATHQPSALRAVVDSWLYTLEEHVLDAGEVAEDDSTAFAAAVDTLAEQRLADVARTTPAFAAALRGYRQALADGDTATAEALIAWLGGQKSVAASARRAAGVRGDLDHFGALGFLQGLLTVLRDCGHPGLLLVLDETETLQRVRGDVREKGLNALRQLVDEIDAGRFPGLFLVLTGTPAFFDGQQGVQRLPPLAQRLATDFSTDPRFDSPRAVQLRLPGFDLDRLGELGRTVRDLYAGTARNPERVREVVDDAYLATLARALTGELGGKVGVAPRLFLRKLVADVLDRVDEFADFDPRRDYALTVTETELTDVERNAVASADDVDLELP

SEQ ID NO: 4467 - protein, 430 aa, Rhodococcus triatomae
MSTLSPVRRRELLQSLRQGTVPDGNLDALAVGIDRFAATVDADLDAVAAGGRAFKAVRGEYGSGKTFFSRWVEQRAMRRGLAVAEVQISELETPLHKLETVYRRTIEELRTSAFAKSAFRPVIDAWLYGIEEDAATAAGVDEATSEQVLELLEQRLKSVATAAPTYPMVLRAYRSALEREDAATADALIAWLGGQPHVGAAAKRAAGVRQDVDHFAAMGFLQGLLAVLKGSRHPGLVLVIDEVETLQRMRSDSRAKALNALRQWIDELDSGRYPGLYLLITGTPAFFDGRLGVQSLPPLAQRLHTDFGTDARFDNPRAPQIRLTGFDLDRLVEVGARVRDIYSDGSSAPDRVRSMVDDAYLRDLASAVAGELGGKVGVSPRIFLKKLVADILDRVDQFPDFDPRQHYSLTIADTEKAEIARATTADEVEL

SEQ ID NO: 4468 - protein, 441 aa, Saccharomonospora cyanea
MVTSAVSEARRRDVINALRRGTVPQSGLDLLAVGLDRFATAMDDDLATVARGGAAFHAVRGEYGSGKTFFARWLAERAKRRGLATSEIQVSETETPLHRLETVYRRLTERLTTATHQPSALRAVVDSWLYTLEEHVLDAGEVTEDDPAAFAAAVDTLAEQRLVDVARTTPAFAAALRGYRQALADGDTATAEALIAWLGGQKSVAASARRAAGVRGDLDHFGALGFLQGLLTVLRDCGHPGLLLVLDETETLQRVRGDVREKGLNALRQLVDEIDAGRFPGLFLVLTGTPAFFDGQQGVQRLPPLAQRLATDFSTDPRFDSPRAVQLRLPGFDLDRLGELGRTVRDLYAGTARNPERVREVVDDAYLATLAQALTGELGGKVGLAPRLFLRKLVADVLDRVDEFADFDPRRDYPITVTETELTDVERNAVASADDVDLELP

SEQ ID NO: 4469 - protein, 441 aa, Gordonia polyisoprenivorans
MSGSSPNGPAPTGLSPVRRREILTALRQGSVPSGNLDVLAVGIDSFAPTIDDEIAAVAAGGSVFKAVRGEYGSGKTFFARWVEQRAIRQGLAVAEVQVSELETPLHKLETVYRRTTESLRTSAFAPSAFRSVIDAWLFEIENDAAALVAGDVPTADEVGALLEQRLAAVATAAPVYPMVLRAYRSAVESGDAVTADALIAWLGGQPHVAATAKRAAGVRQDVDHFLAMGFLQGLLAVLKGARHPGLVLVIDEVETIQRMRSDSRAKALNALRQWIDELDSGRYPGLYLLITGTPAFFDGRMGVQSLPPLAQRLATDFTTDPRFDNPRAPQIRLRNFDIDRLVEVGTRVREVYADGAGDPTRIRAVVDDAYIGDLARALAGKLGGQVGVAPRLFVKKLVVDVLDRVDLHADFDPRRDYALTVSGSELTDTERAAASPDDIEL

SEQ ID NO: 4470 - protein, 339 aa, Amycolatopsis azurea
MYRRLTERLSTATHQPSALRSVIDSWFYTLEEEVLDTGEVDEEDEDAIAEAVDTLMERRLGDVARTTPAFASALRGYRHVKRADDAATAEAVIAWLGGQKSVAASAKRAAGVRGDLDHFGALGFLQGLLTVLKDCGHPGLLVVLDEIETLQRVRGDVREKGLNALRQLLDEIDTGRFPGLFLVITGTPAFFDGQQGVQRLPPLAQRLATDFTTDARFDNPRAVQLRLPGFDLNRLGELGRNVRDLYVGDAKEPERIAARVDDAYVDELARAVTGGMGGKVGVAPRVFLRKLVQDVLDRVDEHEEFDPRVHYPVTVKGSELSEEERNTVADVDDIDLDLP

SEQ ID NO: 4471 - protein, 439 aa, Marinobacter sp.
MSISQQRRQDILDALRRGTVPQYGLDALAVGLQPFEQAFDEELGKVCRGGAVFKAIRGEYGSGKTFASRWLREKAHGCGFACAEVQISETETPLHRLETVYRRLMERLTTPDSASGAFQNIVESWFYTLEEDVLSQQDIDPEDSEALVSATDVLMEKRLGEVVRSAPAFALTLRAYRRALLEGKEEIADGLLAWMAGQPNIAAAVKRYAMIKGDIDHFGALSFLQGVLTILKDSGHPGLLLVFDEVETLQRMRGDVRDKSLNALRQLMDEVDSGRFPGLYLVITGTPAFFDGPMGVQRLAPLAQRLAVDFNTDARFDNPRAVQVRLRGFNLASLEEVGCKVRDLYAQNSVVSERILQSADDRYIAELAQAVTGKLGGKIGIAPRIFLKKLVGDVLDRIDQFDDFDPRKHYALTIADTELTAVERANKPAGSVNDIELDI

SEQ ID NO: 4472 - protein, 438 aa, Saccharopolyspora erythraea
MSVVSEARRRDVIDALRRGTVPQAGLDLLVVGLDRFTTAMSDDLDTVARGGAAFHAVRGEYGSGKTFFSRWLAESAKRRGMATSEIQISETETPLHKLETVYRRLTERLATAAHRPSALRSIVNSWFYTLEEQVLDADEINPDDQAALGEAVDALLEKRLADVARTTPAFAAALRGYRHAVDSGDTTTAEALIAWLGGQRSVAASARRAAGVRGDLDHFAALGFLQGLLTVLRDCGHPGLLLVLDETETLQRVRGDVREKGLNALRQLLDEIDAGRFPGLFLVMTGTPAFFDGRQGVQRLPPLAQRLATDFTTDARFDSPRAVQLRLPGFDLPSLGELGRRVRNLYADGARNPERVRSLVDDSYVDTLARALAGELGGQVGVAPRIFLRKLVADVLDRVDDFDDFDPRQYYTLTLSSGDLSEVERNASRAEDVDLDLP

SEQ ID NO: 4473 - protein, 449 aa, Streptomyces turgidiscabies
MSTTGSQRLAQVSAARRRTVIDALRRGAVPDSGLDLLATGLDRFEAALDAELDAVASGGSVFKAVRGEYGSGKTFFTRWLGERAKRRNFAVAEIQVSENETPLHRLETVYRRLTERLTTSSFPPSALRPVVDAWFYALEEDALAAGATEEELPNEVERLLVARLAEVSRHAPSFATALRGYRSALADGDEATAAAVLAWLGGQPHVAASARRSAGVRGDLDHFGALGFLQGLLTVLRDSGHTGLFVVLDEVETLQRVRSDARDKALNALRQLIDEVHSGRFPGLYLVITGTPAFYDGQQGVQRLAPLAQRLATDFTTDPRFDNPRAVQIRLPGFNQESLVGLGLTIRDLYADAAEMPERVRKVVDDAYVADLAVAVGGALGGKVGVAPRLFLKKLVGDVLDRVDQFDDFDPRQHYRLTVGGSELTDVERNLAATVSGDSASADDIDLEL

SEQ ID NO: 4474 - protein, 437 aa, Gemmata obscuriglobus
MTVSPRRRQEIVDALRRGTVPHSSLDAFAVGLERLEPVFQEELLAVKAGGAAFKACRGDYGCGKTFLARWLADRARRLGFATAEVQVSETETPLHRLETVYRRLCERLATADASQGALRNLIDGWIYALEQDALAEGGTGDEGELLARTDRLMEQRLARVTAAAPTFGTALRGYRRAQVAGDAATADAILAWLAGQPNVAAAAKRAAGVKGEIDHFGALTFLQGLLTVVRDSGGAGLLVVLDEVETLQRVRSDVRDKGLNALRQLIDEVDGGRFPGLYLLVTGTPAFFDGPQGVPRLEPLAQRLHVDFKTDARFDNPRAVQVRLAAFDLDRLAAVGCRVREIYRQHCPAADRIARLCDDAYVRDLAAAVAGKLGGRVGIAPRVFLKKLVADVLDRVDQFADFDPRRDYAPTVTEGELTAAERAAAQATDVDDIELDP

SEQ ID NO: 4475 - protein, 426 aa, Rhodococcus ruber
MSAAVSPRRRREILDALRRGTVPANGLDQLAVGLGRFECELDAELEVVAGGGAMFKAVRGDYGSGKTFFARWLADRATKRGFAVAEVQINEIDTPLHKLETVYRRSIESLRTASIPPSALRPILDAWLFTIEDDATQQGASVDDLLERRLADVAARAPVFPMAIRAYRQMVAEGDHDGADGLVAWLGGQPHVAASVKRRAGIKGDLDHFLALGFLRGLLAVLADAGNAGLLLVLDEVETLQRVRSDARAKALNALRQLIDEIHDGHFPGLYLLITGTPAFFEGRQGIQLLPPLADRLHTDFSRDPRFDNPRAPQLRLNGFDLDRLVELGGRVRDLFCSGIDSAERVRATADDEFLRRFAGAVAGSLGGRVGIAPRLFLRKLVDVLDVIELHPDFDPYTDYEIKIGASELSEAEREVVSAGDVELDL

SEQ ID NO: 4476 - protein, 424 aa, Mycobacterium xenopi
MSVSARRRREILDALRRGTVPSNGLDQLAVGLGRFEAELDASLDAVAAGGAMFKAVRGEYGSGKTFFARWLAGRAMKKGFAVAEVQINEIDTPLHKLETVYRRSIESLRTATIPPSALRPVLDAWLFTIDDDARQQGVDADTLLERRLADVAARAPVFPLAIRAYRRMVADGDHDGADGLVAWLGGQPHVAAAVKRRAGIKGDLDHFLALGFLRGLLAVLADAGHPGLLLVLDEVETLQRIRSDARAKALNALRQLVDEIHDGHFPGLYLLITGTPAFFVGRQGIPLLPPLADRLHTEFAKDPRFDNPRAPQLRLTGFDQPRLIELGTRVRALYIAGVPDPNRVASVADDSFLQRFSAAVTGELGGRVGIAPRLFLRKLVDVLDKIEQFPDFDPYRDYEVRIAENELSPAERAALTADDVALNL

SEQ ID NO: 4477 - protein, 433 aa, Micromonospora sp.
MTVEVSARRRKDIVDALRRGAVPANGLDALAVGLDRFAAALDEDLDRVAGGGSVFKAVRGEYGAGKTFFTRWLGERAKRRGFAVAEVQVSELETPLHRMETVYRRLVEQLTTEQFAPSALRPVLDGWIYALEEDVLAAGTVAEADADGLDRAVGELLERRLADISRSTPGFAAALRGYRAAIALGDHVTAGGLAAWLGGQPHVAASARRASGVKGDLDHFGALSFLQGLLTVLRDSGHPGLLLVLDEVETLQRVRSDARDKALNALRQLVDDIYAGRFPGLFLLITGTPAFFDGQQGVQRLAPLAQRLATDFGPEPRWDNPRATQLRLPGFTQTALVQLGIRVREIYGSDRVTAVADDEYLGELASAVAGRLGGQVGVAPRVYLKKLVADVFDRVDQFADWNPREHYALTLRSDELTEVERNAASADDVDLTL

SEQ ID NO: 4478 - protein, 457 aa, Saccharomonospora xinjiangensis
MAGAVSEARRRDVINALRRGTVPQTGLDLLAVGLDRFGTAMDDDLATVARGGAAFHAVRGEYGSGKTFFARWLAERAKRKGLATSEIQISETETPLHRLETVYRRLTERLSTATHQPSALRAVVDSWLYTLEEHVLDAGEVTEDHEEAFAAAVDTLAEQRLADVARTTPAFASALRGYRRALADGDTGTAEALIAWLGGQKSVAASARRVAGVRGDLDHFGALGFLQGLLTVLRDCGHPGLLLVLDETETLQRVRGDVREKGLNALRQLIDEIDAGRFPGLFLVLTGTPAFFDGQQGVQRLPPLAQRLATDFSTDARFDSPRAVQLRLPGFDLERLGELGRTVRDLYAGTARHPERVRAVVDNTYLAVLAEALTGELGGKVGIAPRLFLRKLVADVLDRVDDFADFDPRRDYPITVTDAELTDVERNAVAGGSVGSAGSGGSTGDAGTADEIDLELP

SEQ ID NO: 4479 - protein, 440 aa, Bradyrhizobium sp.
MSETSGPSVLLRKDVIEALRRGTVPRRGLDLFAVGTDRFSVSLKEELERCATGGAVFKALRGDFGCGKSFTARWYQQQALARGFAVAEVQISENDTPLHRLETVYRRATEGLRTAEWDTGAFRAIISQWLMGLEEEVSRTLRDPDDMKALSEGVGNLLEARLKDVSAVQPQYAAVLRAYHAAEVAGNLALSEGLIAWLMGQPNVSADIKKQAGIKGEIDHTGALGFLRGLLAVLQQCGRPGLLLVLDEVETIQRVRSDSRDKSLEAIRKLIDDLYGGRFAGLYVLITGTPAFFDGPNGVKRLPPLAQRLYVDFSGDAKWDNPRDVQVRLFPFDQERLIEVGRRVRDLYPTEHPEHMKARVTDAVLTGVAHEVAGKLGGKVGVAPRIFLRKLVATILDRVDLFPEFDPAKDLNIRVDVEELTVEEQAAAAGKRPDDIEIDL

SEQ ID NO: 4480 - protein, 438 aa, Planctomyces maris
MISPRRREEIIDALRRGTVPQNSLDAFAVGLDHFEPALKEELEKVASSGGVFKAVRGEYGCGKTFFSRWLADQARKQGFASAEVQVSETETPLHRLETVYRRLMERLSTAGTPQGAWRNIVDGWFYALEEDVLSEGQIDEADQQALLERTNELLEQRLAKVTDITPTFSSALRGYRRAQVAGERAIADGILAWLAGQPNVSASAKRYCGVKGDIDHFGALSFLQGVLTVLRDSGHPGLLLILDEVETIQRVRSDVRDKSLNALRQLIDEVDSGRFPGLYLLVTGTPAFYEGPQGIQRLEPLAQRLHVDFQTDARFDNPRAPQIRLPAFSLERLCLVGCKVRDIYQQHAQASERIAELCDDSYVQELAQAVAGKLGGKVGVAPRIFLKKLVADILDRIDQFDDFKPHEHYTLTMTDSELTTVERQAAGATDIDQIELEL

SEQ ID NO: 4481 - protein, 449 aa, Streptomyces gancidicus
MSTTGSQRATQVSAARRRTVVDALRRGAVPESGLDLLATGLDRFEAALDAELDAVASGGSVFKAVRGEYGSGKTFFTRWLGERAKRRNFAVAEIQISENETPLHKLETVYRRLTERLTTSSFPPSALRPVVDAWFYALEEDALAAGATEEELPGEVEKLLVARLAEVSRHAPSFATALRGYRAALADGDEATAAAVLAWLGGQPHVAASARRSAGVRGDLDHFGALGFLQGLLTVLRDSGHTGLFVVLDEVETLQRVRSDARDKALNALRQLIDEVHSGRFPGLYLVITGTPAFYDGQQGVQRLAPLAQRLATDFTTDPRFDNPRAVQIRLPGFTQESLVGVGVTIRDLYADAGASPDRVRTVVDDAYVADLARAVGGALGGKVGVAPRLFLKKLVGDVLDRVDQFDDFDPRQHYKLTVAGSELTDMERNLAASVTGGSASADDIDLEL

SEQ ID NO: 4482 - protein, 431 aa, Gordonia amicalis
MSTLSPVRRREVLTALRQGTVPAGNLDVLAVGIDRFAPTVDEEIETVAAGGSAFKAVRGEYGSGKTFFARWVQQRAMRRGMAVAEVQISELETPLHKLETVYRRTTESLHTAAFPPSAFRNVIDTWLFGIEEDAAAAAGVDEASTAQIEALLEQRLAAVASATPVYPMVLRAYRDALEREDVATADALIAWLGGQPHVGAAAKRAAGVRQDVDHFLAMGFLQGLLAVLKGARHPGLLLVIDEVETLQRMRSDSRAKALNALRQWIDELDSGRYPGLYLMITGTPAFFDGRMGIQSLPPLAQRLHTDFTTDARFDNPRAPQVRLAGFDLDRLVEVGIRVRDLFADGAQSPERIRTVVDDAYIRHLASAVAGKLGGQVGISPRLFLKKLVLDVLDRVDLHDEFDPRQHYSLTVDKKELTDIERAAMSADDIEL

SEQ ID NO: 4483 - protein, 426 aa, Mycobacterium intracellulare
MSGVVSARRRREVLDALRRGTVPHNGLDLLAVGLDRFEASLDSELDSVRSGGAVFKAVRGEYGSGKTFFSRWLGERAKRLGMAVAEVQISETETPLHKLETVYRRVCESLETAEFPPSAFRPVLDAWLFALESEGNSVDDLVERRLADVSRTTPAFASALRGYRNAQIAGDQATAEGLVAWLGGEPHVASSIRRSAGVRGDLDHFGAFGFLQGILTVLRDSGHPGLLLVLDEVETLQRVRTDVREKALNALRQLIDEIDGGRFPGLYLLITGTPAFFDGTQGIQRLPPLAQRMATDFTTEARFDNPRAVQIRLPGFSQELLEKVGSTVRNLYADGANSSDRVRQLVDDDYIAALATAVAGSLGGQVGVAPRVFLKKLVGDVLDRVDQFADFDPTQHYKLTVRLGELNDVERNAASSAPISVDDIKL

SEQ ID NO: 4484 - protein, 438 aa, Phaeospirillum molischianum
MLSPRRRTEIIDALRRGTVPKSGLDVLAVGMDRFERALDSELETVSLGGAAFKAIRGEYGSGKTFFGRWFQERARSKGFATSEVQISETETPLHRMETVYRRLIERLATADMASGALHSVIDGWFYRLEEDLLAAEPALGLDAESLHQRSVDLMEQRLSAVSRTAPAFSAVLRTYRDALLKGDAQLAEGLLAWLGGQPNVAASVKRAAGIKGEIDHFGAVNFLAGLLTILRDSGFAGLVLVLDEVETLQRMRADSREKGLNALRQFIDELDAGRFPGLYLVATGTPAFFDGPQGVQRLPPLAQRLHVDFTTDPRFDNPRAPQLRLKGFDLDLLAAVGGKVRDIFSDQSVKVSRVRSVVDDDYILDLGRAVAGGLGGKIGVAPRLFLKKLVGEVLDRVDQHDDFDPRQHYALTLADNEMTLAERASAGAMSVDDVELEM

SEQ ID NO: 4485 - protein, 435 aa, Nitrococcus mobilis
MTTLSPARADEILDALRRGTVPESALEAFAVGLDRYRETLHAELQQCTTGRGRFKAVRGEYGTGKTFFARWFQGLARSESFATSEVQISETETPLHRLETVYRRLTEHLTSAESQRGALRSTIDGWFYALEEEVVGRQGDCSEQALLDGTEALMRERLRTIERRAPAFGACLRGYRTATAEGNEELATGLIAWMSGQPNVAAAIKRAAGIKGEIDHFGALGFLQGLLLILRDNGFAGLVLVLDEVETLQRVRGDVREKSLNALRQFMDEIDAGRFPGLYLMITGTPAFFDGPQGVQRLPPLAQRLHVEFGRNARFDNPRAAQIRLQAFDFDRLVEVGQNVRRVFAARCADPERLLRTADDTLLGDLAATVTGKLGGKVGVAPRIFLKKLVAEVLDRIDQFPDFDPRRDYDLSIAATELTRDEQRVLSPNDIELDL

SEQ ID NO: 4486 - protein, 463 aa, Frankia sp.
MSADVSAARRRDVLDALRRGAVPAAGLDLLAVGLDRFERAAADDLAAVAAGGSVFKAIRGEYGSGKTFFTRWLAERAKKAGLATAEVQISENETPLHRLETVYRRLTERLTTATFPPSALRQVVDGWFYALEEDVLAADEATGDDPVAFDAAVGELVDRRLADVGRTAPAFAAALRGYRSALTGGDEASAAAVLAWLGGQPHVAASARRAAGVRGDLDHFGALGFLQGLLVVLRDSGFRGLLLVLDEVETLQRVRSDARDKALNALRQLIDEVHGGRFPGLFLVITGTPAFYEGAQGVPRLAPLAQRLATDFTANPRFDNPRAVQLRLAGFTEASLVELGGRVRDLYVAGSAGDAAGRERIERLVDDGYLGELAAAVAGRLGGKVGVAPRLFLKKLVGDVLDRVDQFDDFDPRRDYPLMIAAAELTDLERNAARADDIDLELDDDLELDDDLELDDDLDLDQP

SEQ ID NO: 4487 - protein, 439 aa, Pseudomonas stutzeri
MSISQQRRQDILDALRRGTVPQYGLDALAVGLLPFERAFDDELEKVSRGGAVFKAIRGEYGSGKTFASRWLREKAHRLGFACAEVQISETETPLHRLETVYRRLMERLTTPDMPSGAFQNIVEAWFYTLEEDVLAQHDIDPNDSEALIDATDLLMEKRLGEVVRSAPAFALTLRAYRRALLEGQEEIANGLLAWMAGQPNISAAVKRYAMIKGDIDHFGALSFLQGVLTILKDSGHPGLLLVLDEVETLQRMRGDVRDKSLNALRQLMDEVDSGRFPGLYLVITGTPAFYDGPMGVQRLSPLAQRLAVDFTTDARFDNPRAVQIRLRGFSQESLEEVGRKVRNLYADNSATADRILRLADDNYITELAKAVTGKLGGKVGIAPRIFLKKLVGEVLDRIDQFEDFNPRQHYALTISDTELTSVERATSAASSVDDIKLDL

SEQ ID NO: 4488 - protein, 434 aa, Dietzia cinnamea
MTVSPARRTAIIDALRRGTVPADGLDQLAVGLDRLAPVLGEELDKVAGGAAVFKAVRGEYGSGKTFFARWLQQQALDRGFAVSEVQISELETPLHRLETVYRRACEELRTPAVSRQAFRAVLDDWLLGVEDDAASSGADGAELLEERLRSVADAAPVFPLALRGYRDALLNGDTEVADGLAAWLGGQRNVAASAKRAAGVKGELDHFLAMGFFQGLLQVLAGSGHRGLLLVLDEVETLQRMRGDVREKALNALRQWIDELDSGRYPGMYLLITGTSAFFEGQQGIKRLPPLDQRIGVKFDADPRFDNPRQPQIRLQAFDFDRLVEVGSRVRDLYAAGLDPAVAQRITTLVDDAYLRVLAESVAGKLGGQVGIAPRQYLRMLVDVLDRVEMFPDFLPRQHFTPTLDASDLSQSERSAVASSSSSSLIDDPDAIEL

SEQ ID NO: 4489 - DNA, 765 bp, Halorubrum lacusprofundi
atggatttgaccatgtgcggtctgcttgtcgagcgagccgaggaactcgctcgactctatgccgaacacgggaactggaacgatgtcaaagagagatggttcgacgaacgactatcgaaccgaagcacacggggcagctcccagaagatctaccgtgtgctaacgtcacgtttcaaaaacgctcccacggacctcccgaacccaagcgttctgccaacgatattcgacgagtgccagacaacgcgcgataaagcacagatactttacctctatcttgtcgccgacgactcgcttgttcggtacgtcgttcacgaatatatggcccgcctcacagatggtaacacagattcactggacttctcgaacgagacgcttgtcgatatcctcactcacctcgagtattctgacggcggctccttcgactatgcggattcgacgactgagcggtggtgcgagggctttcgatcagtaatgcgtaaaatcggcgtactcgacgggcagcaatcagtcgttggcacatctccgtcagtgggtgatactccgttgctcgttgcgatggactattcgtacggaagcgacgacgaggactggctcacttcgccgcgggggctgctctaccttttccagcctgcgaaccgctggggggaactcttcgaccgggttgcaagcaccgacgcatgggagtacctcgaacttcacggcgacctcgacgtacgccccagcgatgagccgtactcgtgggtacacgatggaggtgaaaattaa

SEQ ID NO: 4490 - DNA, 843 bp, Halopiger xanaduensis
atgactctccgcaccgacggaaagggaacttccctgccgtcgctcgactcgacattctctcacgaagaggtgtcgatggcgctcactagatgcgggcttctcgtagaacgggcagagacgctcgctcggctgtacgcccaacatcgagattggacagtcgtcgaagagcaatgggtcgaagaacggttcgacgagcgcagtacgcgcggcagttcgaagggcatctatcgcgctctcagctcgcgattcaagacagcgggaagcgaactcccgtcaatcgtccaacttccgacggtcttcgatcaatgcgagacgaaacgcgataaggcgcaggtactgtacttctacctagtggaggacgatcctctcgtgaagtacatcgtccaccgatacgccaatcggcttcaggagtccggcgtcgacgggctggacttcgagcaggacacagtcgaacgccttctgaacgaattccattacgatgatgggagcgagtttgattacgcagaatcgacgacgcgtcggtggggcgaaggactccgctctgtgatgcgagagatcgacgttctcgacacacagcaggcgttagaggggcaaatccccaatattgggacgacaccgttgctcgtcgcgtcaggttactcgtgggagacccacagcgatgactggctctcccagccgaccggatggctctacctcttccaaccggaacagtactgggactccttggccgaacgcataagcgatcatccgaattgggaagcaagcggaattcacggtgaactgaggctccagccggtcgccgacacgtacgactgggccgaaccgtgggagggcgaagtatga

SEQ ID NO: 4491 - DNA, 603 bp, Salmonella enterica
atgaaaaacgacaaggcatggattggagacctgctaggcgggccgctgatgagcagggaaagtcgaatcatcgctgagctcatgcttaccgctcccaatgaacaaacctggcaagagcagatcgtgggtcataacattctccaggcttcctctgccaatacggcgaagcgctatgctacaacgataaaactacgcctgaatacgcttgataaagtggcgtggtcgcttattgctgaagggagcgagcgcgagcgtcagcaattgctgttcgtcgctctgatcctccattcaccggttgttaaagacttcctggctgaagtggtgaacgacctgtgcagacaatttaaagaaaagctccctatggatagctgggatgagtttgtggctaaccatcttcgtcagcagcccgtactcaccagttactcagattcatccatcaaaaaaatgggtaacaacttgatcaaagcactggctgaagctggttatctggatacacctcgtcggcgtaatctccagtcggtctttcttttaccagaaactcaggcgaccttgcagcgccttggacaacaagaattagtttctattctggagggacaacggtga

SEQ ID NO: 4492 - DNA, 705 bp, Photorhabdus asymbiotica
ttggatgacatcgacctaattaaggccagtacaactaccttctctaattttacgaaatacatcacaaaagcaggctatttcttaacactggttacaaacgatatgaagtatgacaaaacctggattggtgatctccttgggggttctttaatgagccgagaaagctgtttaatcgctgaggttatgttgcaatcaccaagcaaagagcaatggcagcggcatcttgtcactgaaaatatcctacagacatcttcggaaaggacagcgattcgttatgcacgtactcttcgtttgcgtctatccatgttggacagtcaaggattggagttggtcgtacatgggggtgaacgcgaacgtcaacagtgcttaatggtggcgttgatgttgcagtcacctgtcgtcgctgcttttatttcatcggtggttaatgatgcaaaacgccaattccgtgaatccttaccggccaacgtatgggcggtttttgttgaggatcaacgtcgggttcatcctgagttggcaagcttctctgaatcttcattaaggaaaatgggcaataacgcgataaaggcattaagtgaagcccgttatcttgatgctccttgccgtcgccatctacaaaccgtgtttctgctacctgaagtgcatgatctgttggtgcgtcttgaacgcagcgatttgattcctctcatggagggaaaacagtga

SEQ ID NO: 4493 - DNA, 597 bp, Clostridium sticklandii
atggaaaaatacagctcaggattagttgctgagtcgttttggtttaccgagctaaagcaaatcatcaagctcagatacaataatgtctcatgggatgagattaaaaaactttgcgtagaggaaaacctactaggcatagcaaaacagagcagatcgattagaatatatggctacctaaaaggtagggtagactgcatagacaaagagcttatggagatttttttgagctcggatttagaaacacaaaaactaataaacatcatctcagtagctagaaaaaacaaactatttctagaatttctctatgaagtatatagagaaaaagccatcatagggcatagtgagctgacacctagtgatatcaatatatttttcaaggacaaacagctccaagactccaatatagctacctggacagatgtgacatttcgcagattaagaagtacatatatgaactttctaacagatgcaggcatggtgagacttcataataaaaagagactcataaccttgcccattttagatatagtattagaaaattaccttgtagctcataatgaaataactctactaaaagctctgacaggaggtagatag

SEQ ID NO: 4494 - DNA, 786 bp, Acidiphilium multivorum
atgacgccggccgcgagatcccacgtcgtctcgtcgttcacactcatcaagggagcgatgattgccgaaacctatgccgtctttgctgcatgggactttggtgcatccaagaaagcgaaccttgatcgactcagaagtgataatttcattggagcgggctcaaccacttggcttcgcgatgttgcgaaagtgctgaatcggcgatttgatccagttaaccgcgatcgcgccctggtgcttctggcgaagaacgggtgccctatcgacgagtggaagccaatacttctgtggcacgtcacacgcgatgagtttttattgcgggattttttgatcaactggctcttcccaacttttgtgtcgggcacctaccgcgttcggactgaggacgtctacgagcatctccgcagcgttggacgccgtggcgggatcattgagcacgcctggagtgacacgactctcaatcgcgtctctgccgcgctccttaagatggcggtcgatttcggcttgcttcgcgggagctcgaccaaagaatttgccagttaccatctccccgaacggagcttcctttacattctgtacgctcttcgtgaagagacacgtaatcctcgaaaggttcttgaaactgcggaatggcggatgtttctgatgctgccctcagatgtagagcgtgaattacttcgtcttcatcagtatcagaaggtggactatcagatcgccggcagcctcgttcaactcagcttgccgtgcgccaatgcctgcgagtatgcgaaaaggatggtggcatga

SEQ ID NO: 4495 - DNA, 633 bp, Acidithiobacillus ferrivorans
atgcgcaagggacttgtgaccacgtctgaccgataccgtctctcctttaccaccggtggcctgtttctacaggaagcgccgctgatagctacgcgttatctggcactacgcgactgggcgcaaacgcgcgagcaagtgagggctgagaatctgctgcaggtgcgtactgcagcaacggccacccgcgtcagccaggagctcatcgcccggctggaattgctcgatatcgaggaactgcagtacctcaccgaaggtagctcacatgaacgagggtgcctgctgtggtcggcggcctgtcgtcgctacgccctcatccgcgactttgcccaggaagtactgcgcgagcattacctgagcctgcgcggtcggctcaccgcaagcgactacgacacgttctgcaacgccaaagccttgtggcatacagaactcgacgagatcgccccctccacccagagcaagctgcgccaaaatctctttcgcatgctgcgtgaggcggatctgatatccgcgcaattacggatacagcccgcgcttctcacgccaccactggcccgactgctggcgcgtcatggtcacgagccactgctggtttttccggcgaccgatcacgatatgcaaaggtggctccaatga

SEQ ID NO: 4496 - DNA, 639 bp, Acinetobacter baumannii
ttgatcaagcttcataggagattggctatgttagaacaattttattatgacagtgacctgattggcggttccctgatggtgcgtgaaagccggctgatcgcggatctgttattacgagaagcgactccagaacaatggcatcaggcaattcagattgacaatattctgcaaaaaagaacgcctgcttcagctcaacgcaatgccaccgctattcgtaagcgtctggagcgcttagagcctgatttctggaaagctttgcgggatggggatgatgagctggcgactcaggtggctttttgtggggcactggaacgcaacctgttgctgcttgagtttatggaaacggtgatgagagaggcctatatctcccaggctcaatacttggatagctatatttggtcagactttctggatgagcgttcacaacgcgatcttgatatctgtgattggaaagagtccagcaagaaaaaaatggggcaggtggtgtttcgcatcctggcagaagccggttacttaaaaaatacccgtaagctggagttgcagcgtgtgatcgtcagagcagagctgcgtagcctgttggaagaacattataaacaacgcattaaaagatctatggaagtgtcgctatggacgcggtag

SEQ ID NO: 4497 - DNA, 762 bp, Alteromonas macleodii
atgttcacacaagaacaacttaccaaactaggatttaagtttggaaaaaatggcgctcactctgcgcgcagtttgatgatagaggagctaaagcatcttcttttttctcgtgataaatctgcccagcttaaggattacgaagacgacgtcattaatttcaatttattacataaaccaactgagaaatcgcgtagattaaccttcaggcatttgaatgacctttatggcttggatccagcaattcccttatttaaagtttttcgtgactggtgggagttgcatgaagactcacaagaaatcttagctttacaactttcgctcgctagggatcccttactgagagcgtctgctgaaattatcattaagctagagccaggagagcaccttgcgcgagaaacaatggaagagtttttagctaaagatgatcctgaacgatttagcgcggcctctttaaagtccttctctcaaaatatcaatggaacatggactcaagctgggtttttaagtggtaaagcgaaaaagtatagagaaataccgaagtgcagctacgtcaatgtggcttatgcattgtttcttgcgcattgccacggtctaagtgggatgagactttttgacagcttctggtgccgcacactcgttcaagacaaagaaactttgtatgacctggctcacagagcttcaatgcgtggacttattaacttcaagcaagcgagcgaagtggtagaagtgacatttcctcatatcgaattaccagagatataa

SEQ ID NO: 4498 - DNA, 810 bp, Anaeromyxobacter dehalogenans
atgtccctcgcagagatcgcttccatcgaattctttccgcctggggggccgcccgcaggagcggcgaagctgggcttccgtttcggcgacaaggggacccactcgagccggacgctcatgctcgctgaactggaagccgtcctggcggccgctccggccatcgccgaccgcgcggcctactcggcggcgatcatcgacggcaactgcctcgagaaacccacggcctcgacgcgccggctgtcgagccagcgcctcggcgaactctacgcgctggacccgttcgtggccctgttccgcgtcttacgggggctctggagcctcgaccccaatgctcgcccgctcctcgccatgctcgccgccctcgcgcgcgatccgctcttcatggcctccgccgcgcctgtgctctcacaaccgccagatatcgagatccagcgagcgccgatccgcgaggccctccggagagtcgtcggcgagcgcatgaacgacgacacgctcgacaaggtggtgcgcaacgtctccagctcgtggacgcaggcaggccacctcaccggccgcacgttcaagcatcgacagcgcgtgagcgcgccgccgacagccgtcgcttttgcgatctggctcggcaatgcagccggcttccacggcgaagatctgctcacgaatggctggatcgcggcgctcgactgcacggcgtcctcagcccgcgcgctcgcaatagaggcgaagcggttagggctcatcgacctacgcacggcgggtgatgtcgtagagttcgagctcggacgactcgacccgggactcgggaggcagtga

SEQ ID NO: 4499 - DNA, 606 bp, Aromatoleum aromaticum
gtgacaaaatctcctgcgctctataacgccgaaatctcggctggctctctgatgctggtcgaaagtcgccgcattgcccgcctgctgctcactcatccggatcgcgttacctgggttgacaccctcaagcacgacaacatcctgcaaaaaaagtctccggccaccgcccgtcgccaggcgcgactcatccgcaatcggctggaaacgctggatgaattgggctggcagatggtggccgatggggaacaggaaatcgcgctgcagatcctgctcgctgcggcaatcaagcacagccggttgctcggggatttcatgcgcgatgtggtggccgagcacttgcgccgactggagcacaccttgtcgcccgccaactgggacgcctttctggctgattgcgcacagcgcgactccgtagtggggacgtggtcgcccggcacgcaggccaagcttctgcaggtcgtgctgcgcatgctggccgaagcgcgctatctcgaatccacccgcaacctgcaactgacgcccccgatgttgcaccccgaggtgctgcgctacttgcaggcgcgatcggaaaccgcagtgcttgccgccatggaactcaagcaatga

SEQ ID NO: 4500 - DNA, 720 bp, Arthrobacter sp.
gtgacgggatcaactgacgtccgagtgcccaagtgccagcattcgacagaacgccatttacttaccgtgacatctgagatgaggcctcctatggttgagcagcatgcggcgacgcagcgctatgcactctcatttaccagtggagccctcctcatgcgtgaggcagcgatcgttgcgcccatctatttgcgcgaacgccactgggcaaaagttcgatcggtgatcgctgaggagaacctactgcaagcccgcacggtctcctctgggtccaggctcgcgcgcgaggttgtgcagcggctcgcagtcctcaccggcgacgagatcgaactgctcattgaggcaacggcaaccgagcgcggacatttgctgtgggcggcggcgtgccgccggtacgaactaatcggcgactttgccgaggaggtcgtccgcgaacgcttcctcctgatgaccccaaccctggcctacgaggacttcgacagcttcgttcgcaaccaggcagtgtggcacggggaactcgccgagttgaagaagtcgacgttgcagaagttgcggcagaccgttttccgaatgctcgcggaggcgggactcctttctggctcgggtgacctggtcccagttgtgatgtcgcagcgagtcgcccaggccctcgcccggcgggagcctagcgaccttcgcttcttcccgctgtcgcccgtcggaattaggaaaggagtgcgatga

SEQ ID NO: 4501 - DNA, 693 bp, Azospirillum lipoferum
atgcttgcggagctgtcgaccctgctatcgattgagccgcaaccgtctgatcgcgccgagtatgccgagttgatcatccaggacaatcggcttggcaagcaaacggccgcaacacgccgactgagctacaccaggctcggagagctgtacgccctggaccccacggtcccgctgttccgaattctacgacggctgtggcgcttggacgagaccagccggcccctcctcgcccttctggcaggtctggcgcgggacccgctcttgctggcaacagcgcctgccgtactgcaactcaggccgggcgaagacttgcagcggggtgccgtacggtcggccttgctcaacacctccggtgatcggctcagcgcagcagtgctcgacaaagtgctgcgcaacacagccagttcttggacgcaatccggtcatctgatcggacgcactttcaagcggcgacagcaggtcatcgcgacaccgatcaccgtggcctttgcgctgtggatcgcctgccaagctgggttcagcgacacggaagccttccagagcggatgggtcaacacactcgacctggagcagccgcatgccctgcgcctggcaggcgaagcgcgccgcctgcgactgcttgatatggacatcgccgaacaggtcgtgacgctcgatttcgcgcgcctcgacgggaccttctgggagcgctga

SEQ ID NO: 4502 - DNA, 540 bp, Bifidobacterium animalis
ttgaccgttcagacgggcgcagcgattgtctctatccgcgatgagatcgtcgatatcaatgcgctggcaatccgtaccgcgtccgcgaacaaacgcatcacagctgaggtatgcaaacggctgagcacgttgtcctatgaggaacttggctttctggcttcggaccgatcctccccgcaggatcggcgttatctgctgtggatcgcgatgtgccggtattacctgttcgtcggcgagttcgcctccgaggtgctccgcgagcgcttcctgctcggcgagacgatctctcttgccgactatgaccgtttcgtgctcaacaaggcgttgtggcatccggagctcgagtcggtcagcacggcgacggcgtcgaagctgcgcggcaacgtgttcaaggcgatgcgcgaggcggagctcatcgagggcggtccccgtggcgcctgtgcgattgtccccgccgtgcccggccatacgttgtccgaaatggaggggccggacgccgcttcgctgctgttcctccctgtccgtggtctagtgaactga

SEQ ID NO: 4503 - DNA, 612 bp, Bordetella parapertussis
atgagtaacgataggtacagcatgtcatttacaacgggcagtctttttcaccgtgaatcggtggagctggccgcgctgtatcttgatcttggcgactggaacgctgttcgagacaaagtcatcgcagaaaacttacttcagaccagaacgctgaatacgctcaaacgtgtctgccgcgaggtcatctctcggcttagaacgctgagcccaggcgaacttgaattccttgttgagggcagccaccaagagcaggcctatctcctgtggctcgccgtttgccgccggtacagattcatcgctgattttgccgtcgaagtgcttcgagagcgctacatcacattgaaaagcgatctgacccacgaggattttgattccttcttcaaccggaaatccgagtggcatttggaactggatgagatcaccccggcgacacgaggcaaattgcggcaggtcctgttcaagatgcttcgcgaggccgatctcctaacggccaacaacatgatccacgctgccatgctcagtccaagactgttggaattgtttcatcaaggcagccgcagggatgttttgtacttccctgtatttgaatcagaactgaaggggatggcgtag

SEQ ID NO: 4504 - DNA, 1266 bp, Burkholderia sp.
atggccggggcgcgcgcttctgtcggggcgactgcggtagccgacgaaaccgaggtcgcaaggccgcccctgctttgcgctcgcggccccgaaactaccgggcggccgtgcgctcgcgacgctgggcggtgcgccgttccttctgctgcgcagggcgcttatttgggtcgaaaagcgggtccccgctgggcctcggaacgctctaacgctgtgtgcggtatgctagcattacgcaagcagaatgcgtacagggagtgcgtgtgtcgacaggcaaaaacgaagttgtcagtgtcagggtggagcggcatatcaagtcggcgttgcagacggccgccgaacgcgaaatgcggagcctcgcaaatatggttgaggtcatggtggttgcctattgtcgttcccaaggctatccgctggatggggttccaagcgacgcgttgcctaatacgatgcagaaagaacagcaacgtgactgaaccacgcgaagttcttctctcaaagcttggatttcgattcggcatgaatggccctcacgccgctcggacgatgatgctggatgacctgcgcctcttgatgtcgtgcgccccaccgcaagccacgcgcgcggagtatagggctgctgtggtcgacggcaatgtgctgggaaagcctacgcgcaaagcgcgcgagcttgcgtttcgccatctgtcgacgctgtatgcgttggacgtcagcaaccccatctttcgtgcgctgcgccggctttggccgttggacgaggctgcacagccactgcttgcccttgcagtcgcgctggcacgcgacccgttgcttgccgtcaccagaacattcgttttagggcaagccatcggcgcagtagtcgcccgcgagtctatcgaaagcttcatcgaatctagagaccctagccgcttcagtgcagaatcgctaaaggcctttgcgcagcgcattggcggtacttggactgctgctggttatctgcaaggtaaggtcagaaagacacgtgtcgctccaaaagctcaccccgaatccgtgacgctgctgttgttcctcagttatctcgagggccgaacaggcctgcgcctcttttcatcggagtggcttaatcttctaggtaaaacacctgatgagcttgaggcacttgctagctcggcatctcatcgtggactgctcgttttcatgaatgcgggtggcgttaaagaagtgcgcttccctgcttaccttacccccgaagaagaaaaaattcgacaggaggtctcgcatgtcgtctaa

SEQ ID NO: 4505 - DNA, 609 bp, Burkholderia gladioli
ttgctggggagggttgcggtgggggtttataacgccgagatctccgcagggtcgttgttgattccggaaagccgacggattgcgacccttttgctttcgcaccccagcgacgagcagtgggaagcggccctcaacgatgaaaacttgttgcaaaagaagcctgcgacggcccggcgccaggcgcggctcattcgcaagcggctcgagacgctggacgacgagggcctgcaactcgtggcgggcggcgacagcgagctttgccgccaggttttgctcgccgcggccatgcgccacagccggctgctcagcgactttatacgggacgtctacgcggcggacctgcggcgcttggagcacacgctgaatcatcgtcaatgggatggctttctggccgaatgcgagcaccgcgacgagacggtggcgcaatgggcggtctcgacccgcgaaaagctcttccaggtgatcgtccgcatcctcttcgaggccaaatatctggactccacccgtcagcgtggcctgacgcctccgttggcgcacccgcgcgccaaggcttacctcagacagctcggcgatctggaaacgctggagcgattggagctgttggcatga

SEQ ID NO: 4506 - DNA, 663 bp, Burkholderia vietnamiensis
gtgcagagcatgagcatgccgccgggccagggcgtcctgcgtcatccgaggggtgcattggggaggcagccggtggggatttataacgccgaaatctccgcggggtcgctgatgattccggagagccggcggatcgcgacccttttgctttcgcaacccagcgatgaacagtgggaatcggccctgaacgacgagaatttgttgcagaagaagccggccacggccaagcgtcaagcgcgcttgatccgccgtcgtctagagacattggacgaagagggcattcgactcgtggccgaaggcgacagcgagctttgccgacaggttctactgtcggcggcgatccgtcatagccagttgcttggcgactttatgcgcgatgtgtatgcggcggatttgcgacgcctagaaaaacatctgagccatcgccaatgggacgccttcctcgctgagtgcgaacatcgcgacgacgcggtcgcgcgatgggccgagtcaacccgcgagaagctctttcaggtcatcgtccgcatcctcttcgaagccaaatatctcgactccaccggccggagaggtttgacaccgcccttggtgcaccctcgcgccgagggctacctcaaacgcttcggcgacgtggaaacgctcgcccgattggagaaccttgcatga

SEQ ID NO: 4507 - DNA, 570 bp, Calditerrivibrio nitroreducens
atgccagtattagaaacattaaagcttatcgagcttaaaaagcaaggtttatcagacaaagatattgaaacggaagtgctgattaataattatcttcaaaaagtaagaccttctacgataaaaagggtatttggtgagtttaaaaaaagactatcttatatggacaaagattttattgatttaattacagaattaccatttgagagtaaaaaacatctattgtttgcaaatattttggaaacctatccaattatgctcgaatttatgactgaggtagtatccgtgaagttggaaaattatgattttatattatatgttagtgatttttttaaatttttgaatagtaaagagggggcatctattcaatcattatcagaaaatacacgcagaaaggtaaagcaggttacttttaaaatattggaacaagcaggtataatagatagtgtgaaaaatagaaaaataataaagcctttgctaaatgataatataattcgttactatagtaataagaaagaaatattaaaagggcttttgatgaatgaaaatgagatcttagcaaatattgggtga

SEQ ID NO: 4508 - DNA, 603 bp, Carboxydothermus hydrogenoformans
atgatagaagaaatggaatataagactactattaaaacattgccgttcctttttctggagatgaaaaaggctgcaaatcttgtcctccagggtttgaaagataacgaaataaaggaaaaagcgctttatgataacatttttcaggtaaacacagagactcgcagaaaagaaattgcgtctatggttttaaaaaggataaaagttctggatgaggttttgctccacaagttagttcatggggatatagaaacaggcaaactgatagtattatacagcattatgaaaaccgacaggcttttctttgaatttatggatgaagtgtttaaagaaaaattgatagtgaaggactatgttattgaagacaaagattttaacatcttttttgatagaaaaagggaacagagcaagaaagtagcttcttgggatgattacaccttttacaaactaaaacaagtttttatcaggatactctatgaagcagggcttatcagtaataaaagaaatagaaaaattattaagcctgttcttgatccttcaattatcgaacatttgaaagagaagggcgaaaaagcaattttgaatatattcctcgggcttaattaa

SEQ ID NO: 4509 - DNA, 615 bp, Chlorobium phaeobacteroides
atgagtaacgacagatacagcatgtcatttacaacgggcagtctctttcaccgcgaatcggtgaagctggccgcgctgtatcttgatcttggcgactggaactctgttcgagacaaggtcatcgcagaaaacttactacagacaagaacactgaatacgctcaaacgagtctgccgcgagatcatctctcggcttagaacgatgaacccaggtgaacttgatttccttgttgagggcagccaccaagagcaggcctatctcctgtggcttgccgtttgccgtcggtacagattcatcgctgattttgccgtcgaagtgcttcgagagcgctatatcacgctgaaagctgatctgacccacgaggattttgattccttcttcaaccgaaaatccgaatggcatttggaactggatgagatcaccccggcgacgcgaagcaaattgcggcaggtcttattcaagatacttcgagaggcggatctcttagcggccaacaacatgataaacgctgccatgctcagcccgagattgtcggatgtgatccatcgtggcagccgcagggatgtttcgtacttccctttatttgaatccgatctgaaggggatggcgaagtga

SEQ ID NO: 4510 - DNA, 606 bp, Clostridium clariflavum
atggttgaagagttagaatataaatccacaattaaatcaagaccattcctttttagagaaatgaaaaaggctgcagaacttataaataaagggtttaaagaatttgagataaaagaaaaggcaaaaaaagataatatatttcaggtaaacacagaaacgcgcagaagtgaaattgcgtcaatagtgctgcagagattaaaggctattgatgattttttgattgaaaaaatagtaaacggtgatatagaaacgagcaagcagatagttatctactctattatgaagactgacagattattctttgaatttatgtatgaggtttttagagaaaagatattgcttcgggattttacattgcaggataaggattttaatctattttttaatagaaagaaggagcaaagtgaacgagtggcctcatgggatgactacactttctataaattgaaacaggtatatattcgtatcctatttgaggctggttttataaaagaccaaaaaaaggatagggaaattgttaaaccaattcttgaagaagaagtggttcagcatcttaaggagattggagacataaaataccttaatgcactgatgggagagatataa

SEQ ID NO: 4511 - DNA, 606 bp, Clostridium clariflavum
atgtcatttaagtgggaatatatatctacattaaaatcaaaatcattcttgtacaaagagacgaaaaaagtcgcggggcttataaatcaaggatttaacgaatttgaaataaaaaataaggcaaaaaaggataatatttttcaggtaaatacagaagccagaagaagcgaaattgcgtcaaccgtgcttaaaaggttaaaggttcttgatgatttctttattgaaaagattgtaaacggagatatagaaaccggcaagcagatagttgtctattccatcatgaaaaccgacagattgttttttgaatttatgcatgaagtctttagggaaaagatgttgtttaaggattttattttgtatgacaaggattttaatatatttttcaacagaaaaaaagagcaaagtgaaaaagtggcttcatggagtgattctactttttgtaaattaaagcaggtatatatccgtatcctgtttgagtctggtcttcttaaaggtcaaagaaggaaacgagaagttgtcagaccaataattgaggaagaagttgttcagcatctgaaagagattggtgattcaaaataccttaatgcattgataggagaggtgtaa

SEQ ID NO: 4512 - DNA, 609 bp, Clostridium ljungdahlii
atgactaaacaattagaatataaatccacaataaaatcgatgccttacctttatatagaaacaaaaaaggctgcaagccttattttaaaaggatttaatgattatgaaataaaaaatatgtctattaaagaaaatattttccagatgaaatctgaagcacgaaaaaaagaaattgcgtcaataacattaaaaagattaaagagtttagatgaattcctacttgataaattagtgaatggagatttagaaacgagtaagcaaattgtgatttatatgattatgaaaactgataggctattttttgagtttatgagcgaagtttataggaacaaaaatatcttgagggaaaaatatattacagatagtgactttaatgtttacttccaaagaaaatgcgaacaaagtgatactgtagcatcatggaaggaatataccttttataaactcaaacaggtacttactagaattctttttgaagcaggattcattaaaaatcaaaagggtgataaggaaataactataccaatagtagattgtgacttagcacaacatttaaaagaaataggtgacggtatatacttagaagtgatgttaggacataagtcttaa

SEQ ID NO: 4513 - DNA, 597 bp, Clostridium saccharolyticum
atggagaagtacagttctggtcttgtgtcagaatccttttggtttatagagttcaggaaaattattaaactcaaacacgaaggaaagacatgggatgaaatcaaagacttatgtttaacagataatctgcttggtatttccaaagagtatcgagcaaaacggaattatggatatctcaaaaacagaatagatgcgcttgatacaggtttgattcaagttttcattcacgcagacttgaacacgcagaagatcatcaatctgattgccattgcaaaaaagaatagactgttttttgagttcctttatgaggtttatcgcgaaaaagttcagatgggagcacctgagcttacggagagtgatattaatatcttctacaaaaacaaacaaggtcaagatgacgatgtcagtacgtggacggatgttacactccgaaggctaagaagcacatatatgaatttcctaactgatgctggtcttctaactgttagtggcaaggagaaaaaaataacacctccaattctggatataacgcttgaaaattacctgaaagataacggtgataatcaaatgattaaagccattacgggggtgagctaa

SEQ ID NO: 4514 - DNA, 609 bp, Clostridium saccharolyticum
atggaaagaaaaccgtatagtgccggagcagtgaaattttcgttctggttcatggaatttcggaaaaccgtgcagcttttgagcgagggtaagagctttgcagacattaaaaagttgaatgaagagacaaacatctatggcgcaccgacaaaactacgagcgcagcagatttattctaccgtaacagcccgtatcaagacattagatgaaagcttttatccaatctttctgagcagtgatcttgctacacaaaaattatttgtgctgactgcggctcttttgcatgacacgctgttctttgattttgtgtatgaagtagtgcgggaaaaaatgattcttggttcggatgagttgaaggatgcggatatccgaatattcttcaaaaataagcaggaacagagtgagaaagtggcttcttttcaagactatacgctacaccgcctcggctcctgctataaaacgcagctttatgaagcaggacttttagaaagcaaccgggcaaacagcacaagaaaaatactgaagccaattcttgatattgcatttgagcattggctttatgaccatgaccttggcatcatggtaaaaacactgacgggggtaagatga

SEQ ID NO: 4515 - DNA, 603 bp, Clostridium sp.
atggagagaaaagaatacagcgccggtgctgtaaagcattctttctggtttatggaattccgcaaggttgtgtctcttcgtgcggagggaaagtcctgggatgaaataaagcagttaaataaagatgaaaatatattcggcgctccgactccgcttcgcgcgaatcagatctggagcacagtgtcgggaagaatgaaatgtctggatgatagtttttatccggtttttcaggcatgcgatattgctgcgcagaagctttttgcgctggtggcagccatggcttatgacacgctgtttgccgaatttgtatatgaggtcgttcgggagaaaatgatcattggcacgtctgaacttgccgacagtgatatacgcattttcttcaaaaacaaacaggagcaggacgacaaggttgccaagtggacggaagccacaacgaagcgacttggcgcctgctataagactatgctctttgaagcaggtgtgactgacaaggcaaaagacacaagaaagatcctgaaaccgattcttgatccggcaatggaaagatggctgatggatcacggcatggaatactgcgtaaaggcgctgacgggggttaggtga

SEQ ID NO: 4516 - DNA, 789 bp, Cupriavidus necator
gtggctaagaacaagccgtacacgacccagctgcaagcaggccttggactcgtcaatgagaccaaagccttgctcgacttgtggtcgccgggcatgtcggcgaatcagctgcatcaggttgcactgggatcgggtcgattcccgactgtcacggcgcgccgacttcgcaatatcgtcgttgaatgcttcgctccacgctatttggtggcgggcggcgcgtcggctgcccacctcaaacgcctgtccgcaacgatttcgacggctgacctgacgcagctcatgttcgtgcatacgagccgagccaatcccatccttggcgacttcgtgcgccaagtttactggactcgatacgctggcggatacacacagatcaccaatgatgacgctcgcgcctttgtcgagcgtggcatcgatgacagcaagactgtcaaacgctggtctgagaccaccgtccgacgtgtctccgcctatctgactggatgctgcgcggattacggtatgctcgaacgcggactgcgttccagccgacgcatcctgccgttgcgcatttcaccttccgtcgctgcttacctcgcctatgagctgcactttgccggcgttggtgataacgctctgctgacgcacgaagactggcagctgtttggcctggcccgcgaagacgtgctggaagagatcaagcggctttcgctgaaaggattgctcatcgtccaagcggcgggagatgtgatccggatcagctggaaacaacaagacatggaggcgctctgcgatgtcctcactcaaagctga

SEQ ID NO: 4517 - DNA, 801 bp, Dehalococcoides sp.
atgataatggagaataattttcagcgtaaatactcgaccgcaataagcaaaggagctggattgatcgaagagacacgacgtcttctcgatcactggcgacccgatgagccgcttgatgattttacgcatagggttcaggtggaaggactactcggcaactctacggcttatagaacacgcgacgtagtaagaagagttttcgccccacgtttattaaggccgaacgacaaacccgccagaatccttaaaagtgtaattgagtcgggtttaccagcgcggacttttactgaactactattcgtattcgcggcacggcaggatcccctagtatatgatttcacagtccgcgaatattggcccgctgcgcggcgaggaagatcgttcctggataccgaccctatgctctctttcctatcccaagcccattacgatggacgtttggataaccagtggtcggaaaatgtatctttgcgcatcgcacgttgtgttctcgggattcttcgggatgttggcttccttcgagagactgtgcgtggccgcagggaaatcgtcaattaccgcatgtctgacgaaggggccgccatactggctcgggagcttaacgagtccggtgttacggattcttccatctgcaatcatcctgactggtcattgttcggtatgacaccttcggacgttgtagagaggttggacgagatcggtgaacaacgcggattaatcgtgcaacatggtggctcggttgtgcatttcacttggggggtcaaatcgattcaggagctaataaatgtactcgctcgatag

SEQ ID NO: 4518 - DNA, 786 bp, Dehalogenimonas lykanthroporepellens
atgaaacaaaaacgatacacaagccagcttgggaccggcctgggcatgatagaagagaccaatgctcttctcaatgtttggaccccagggatgtcctcaacccaattatttgaagaggctttgaactccggtagctttcctggaatttcggcccgtcggctgcgtaatctcataagtgggtgtttcgctcctcggtttcttgtaaatgatgggaagccagctgaatatttgaaaaacttgcgaccagacctctcgagtcgagaggtagaacagttgctattcatatatacctgtcgtgccaatcaaatattggaagatttcgttcgcgaggtttactggcctgcctatgcagctggacatgagtccatttcgaacagtgaagcacagatttttgttaccaaagctgttcaagcgggtttgacaacaactccatggtcagaaaagacaattaaaaatgtggccggttatcttacaggtacatgcgctgatttcggcatgttagagcgcggacaaaaagtaaaccgtaagattattcctttccgaaccgaacccaacgtcgccattgttttggcctacgatctccatttttccggtctgggtgacaatacggttgtggctcattccgattgggcgcttttgggcatggatcgttccgacgtcgtcacggaattgagacgtttatctttgaagggtgtgtttcttgtgcagacagcgggtgaggtcatccgcatcggttggcaatgtaaaaatccagaggagctttccagtgccatatctcaaggctaa

SEQ ID NO: 4519 - DNA, 606 bp, Desulfitobacterium hafniense
atggatgtaactatgccgtacaacggcggactgactgccgagcagttccttttctacgaaatgaggattgtgtctaagcagtaccttgaaggaaaaacgattgacgaaataattgactatataaaacgggacaatttgtttcagtatccgaccgaacggaagatatcaaaactagcacgagcctgtcaaaggagaattgtcgcccttggcaacgagaaactggtctacgaattggcgaatgcacccgtcgaagtggcaaagcaaataaatctatatgcgatgatgagctacaatcgccttgtccgtgagtttatgaccgaccttatcggcgagaagtaccgccagcatgatttctcctataccaagaaagacatcaatatgttcttctcacggctgcgagagcagaacgatgacatcgccctttggagcgagcaaacgataacaaaactaaaacaggtgctgaccaaatgcctgatagaaacagagatgcttgacaacttccgtgctcacgaactgaaccccgtcttcatcagcactgaactggaaagcggcatccgtgaaaacaacgacttgaccgcccttccggcgtttaactgtttcaggtag

SEQ ID NO: 4520 - DNA, 636 bp, Desulfobacula toluolica
atggggttacataataaaaacggttcattaccaaaatatcgaatgtcttttaccgttggaggactgttttatcaagaatccgtctcagcagcagagctatatttgaaaattaaagactgggcaaaagtccgggaaaaaatattaaaaaccaacctattccaggcaaggacaagcaattctcttgaaaggatatgccgtgaagtactctcccgtctaaaaaatctttcttcggaacaattaaaaataattcacgacggttcaaggcaggagcaactccagattctttggatttcagtttgtaaacggtatgattttatccgtgattttgctgttgaagtaattcgggaaaagtttttactcatgaactattctataacagacgaagactatactattttttttgacaccaaagctgaatggcacaaaaatctgggaaagctcaaagactcaacaaaaaaaaaactcaaacaggttcttttcagaatactccggcaagcggagatcacatcagagaggaacataatactgcccgcaatattaaccaaacgagttgccagggctttgttcactgacaaatccgggatatatcttgtactgccggtctcagatacagatttcaaggagtttataaaatga

SEQ ID NO: 4521 - DNA, 801 bp, Desulfomicrobium baculatum
ttgacgaacaaagataagcattctaagggaatcagcccgttcggattcagttatgaacgagggggagcccatctggctcgaaccatcatgttcgaggaactccaggaagtcttgcggcaacctacggaatttacggtttccaaagatgacttccggaaggccattgtcgacgagaactgccttaacaagcgttcgggccgaacgaggttgctgacctaccggcacctcgtggatctttatagtctggacacagggaccaccttatttcgtaacctcctttacctctggcagcgggatccatccgccagggcatctctggccttcctttgcgcgtacgcccgcgacccccttttacgcagcgcaacaccattcctctttgatcaccccattggatcaacggtcatccggcagaacctcgaacactacattgattcgctggagactgaccgtttcagcgccgccacgcttaaatcgctggcgcagaatatcagttcgtcctggacgcaggcgggttatctgagtggccgtgtccgaaaaattcgctctcagccacccgtcacccctggcgcgacggcttatgctcttcttttggggtatcttaacgggttgcgtggaatgtcccttttccaatcagaatacatgaacctccttgactgtcccctggaatcggctcttgatgccgccgcagaggcttctcgccgtggctggatcgttttaaaaaggatcggcaccgtggtcgaagtcctttttccaaaccttctgactgataaggaaatggagttgctgcgtgagcaaagttaa

SEQ ID NO: 4522 - DNA, 594 bp, Desulfosporosinus meridiei
gtggaatatagtgccggaatggtgaaatgctcattttggtttccggagtttcgtaaagtaattcagcatttaaatgctggcaaaaagttaactgaaatcaaagagaagaacaagaatgagaatatctttgcagctcctacacaagcaagggcatcccaaatatttaatgccgtagccagacgtgcaaagagtctagatcagtcgttttatcttctatttgagcaaagtgatgtaaccatgcaaaagatcattacccttatagctatcatggcgacagatcgtctgttctttgatttcatctacgaagtgtatcgtgagaaattgatccttggcagcgatgaactgacagatcgggatcttcgcattttctttaaggacaagcaattgcaaagtaaaaaagttgccaaatggagggactataccctgaagcgtctcggaacctgctataagacattgctcatggaagcgggtataacggatcgttcgactggcaaccggaaactattgaagccgattttggacaaatctttggaagattgcctgcgagctaacggcatggagatcatgatccatgccctaacgggagtgagataa

SEQ ID NO: 4523 - DNA, 672 bp, Desulfovibrio magneticus
gtggtattgagatctgcagagttcagacaacctgaaaagtattattctcaacatcaccttcaagggacttccgtgccagaaccccgatttaatggcgagatcgttgcaggctctttaatggttaacgagagccgtaaaatcgccgaccttcttttgcaaggccttgacgaaaaggcgttttacgcggcgcttttaatggacaatgttctccagaagcgcagccccgccaccacgcggcgacaatcaaagctcatccgaaatagattactccccctacatgaagatttttggattatgattcgtgatggctctcatgaacaggctgtgcaaaccttgttggcggcagctattatgcatagtcgtattcttggagatttcataagaaacgtcgtaaatcttcagctaaagacatttcagagtcaagtgacatatcgtgaatgggatgcatattttgaggagtgcaagcaaatagatccgactgtcgtagaatggtcagattcaacaataaaaaagattcggcaggttgtatttagaatacttgccgaagccaaaattattgattctactcgaaacttaaagattattcatttctcgctactcccagaagttaaaaatcttcttgataatgatgcattgcgatatacacgcgaatgcctggaggccatccaatga

SEQ ID NO: 4524 - DNA, 612 bp, Desulfovibrio vulgaris
atggttagatttagatacattatgtcttttacaacaggcggcctctttcttcatgaatcggtgaaactggccacgctatatcttgaccttggagattggaattctgttcgaggcaaggtcatcgcagaaaatttactacaaaccagaacattgaatacgctcaaacgagtcttcagcgaggtactctctcgattgaggacgtttagcccagacgaacttgcattccttgttggtggaagccaccaagagcaggcgtatctcctttggctcgcagtttgtcgtcggtacagatttattgctgattttgccgtcgaagtgcttagagagcgttacatcacactgaaaactgatctgaccaacgaagattttgattccttcttcaaccggaaatccgaatggcacttggaattggacgagatcacacccgcaacgcgatgcaaactgcgacaagtcctattcaagatacttcgtgaggccgacctcctttcgcccaacaacttgatacaagcagctatgctcagcccgcgactattagaagcaattcatcaaggtagccgcagtgagctcttatacttccctatctttgaaccctacgtggaggggatggcgtag

SEQ ID NO: 4525 - DNA, 792 bp, Desulfurivibrio alkaliphilus
atgacccgaaaaaaagataacctggccagtttcggttttgctttcccggccggcagtccccatgtctcccggaccatgatgctggctgagctaacgctgctgctagattatgtccaggatcccgccgccagccgggccgactatatccaggccatcgtcgaggataattgcctgaacaagcggaccgaaaggaatcgcctgatcagcaagcgttatctgctggaactgtacgctctcgaccacgagctgctgctttttcgcgccctgcttttttactggcgccgcgatcccgccggccgacccttgctggcgctgctctgcgcttatgcccgggactcattgctgcgagccagttcccgctatattctgcccctccctgcgggagcggcggtcaccagagaaagcaccgaagaatttctggattccctggcgccaggccgctacagccccggcaagcttgcctccaacgccaaaaatatcaactcgacctggactcagtcaggccacctccggggccggaccaataaaaaacggtcccaccccaccaccacaagcggcccgctggcctatgccctgttgcttgcctatctgaccggggtccgcggcagcagcctgtttcacggtgaatacgtcaaactcctggactgctcctttgaccgggccgtggctttggcccaggaggcttcccagaggggttggctggtctgcaaaagggttggcgatgtcatcgaggtgcttttcccgaatctgatcaacgagcaggaaatggggtggttgcgtgagcagggttaa

SEQ ID NO: 4526 - DNA, 600 bp, Enterobacter cloacae
atgaccgccaaagaatatctgggtgacatcattggtggcagcctgatgttgcgtgagagcagagtcatcgccgagctgctgatatcctcaccaaatgatgatcaatggcataatgctattgtaaatgacaatgtgctgcagaagacctcagtgcatagtgttaaacgcatggcttcaaccctgcgtaaaagaattcaaccgatgggtgaggtattctggactgagctactaaaggcccctgatgatgcagccagacaaatgttgctaatggcgacaatgtgccaatccccagtgctgaccgatttcatggcaacgacactgtctgatgcccgacagatgtttcgtgaatcattgcgtagcgaagactggcaggaatttattctatcccgccagcgtgccattgtcggcttggatcaatattccgaaagctcaatccagaaaatgggcaacaatgtatttaaaatcctcgcagatagcgggtatctggaatcaggccgcagtaaaaagctgaaaaatgtcttcctactaccccagataagagagtgggcaaacagtctcgactgcaaaaaagtctacgatgtgatggagtcagtcagatga

SEQ ID NO: 4527 - DNA, 522 bp, Erwinia sp.
atgcttgccgacccagatgaacagacctggcaaaaacagatcgttggtcataacatgctacaagcctcctctgtcaatacggcaaagcgttacgcgacaacaataaaactacgcctgaatacacttgataaagccgcgtggatgctcattgcagaggggagcgagcgcgaacgtcagcaattgctgtttgtcgctctgatcctccattcaccggttgttaaggacttcctgtcagaagtagtgaatgacctgcgcagacagtttcaagaaaagctctcaagggatagctgggatgattttgtgaccagccaccttcggcagcagcctgtactcaccagttactcggagtcatccatcaagaaaatgggcaataacctgatcaaagcgctggctgaagcgggttatctggatacgccgcgtcggcgtaatctccagtcggtctttcttttaccagaaacccaggcaaccttgcagcgccttgggcaacaggaactggtttctattctggaggggcaacggtga

SEQ ID NO: 4528 - DNA, 603 bp, Erwinia pyrifoliae
atgaataacgacaaaacatggattggtgacctgctgggcgggccactaatgagcagggaaagtcgaatcatcgctgagctcatgcttgccgacccagatgaacagacctggcaagaacagatcgttggtcataacatgctacaagcctcctctgtcaatacggcaaagcgttacgcgacaacaataaaactacgcctgaatacacttgataaagccgcgtggatgctcattgcagaggggagcgagcgcgaacgtcagcaattgctgtttgtcgctctgatcctccattcaccggttgttaaggacttcctgtcagaagtagtgaatgacctgcgcagacagtttaaagaaaagctctcaagggatagctgggatgagtttgtgaccagccaccttcggcagcagcctgtactcaccagttactcggagtcatccatcaagaaaatgggcaataacctgatcaaagcgctggctgaagcgggttatctggatacgccgcgtcggcgtaatctccagtcggtctttctattaccagaaacccaggcaaccttgcagcgccttgggcaacaggaactggtttctattctggaggggcaacggtga

SEQ ID NO: 4529 - DNA, 603 bp, Erwinia pyrifoliae; identical to SEQ ID NO: 4528

SEQ ID NO: 4530 - DNA, 615 bp, Erythrobacter litoralis
atgagtgcttcgaccaaacaagattacaaaatgtcatttagcaccgggggtctcttccataacgaaagcttggaagtcgcgcgtttgcatctagacggagagccctgggaagacacgatcctcagggccatggaggaaggcgcaaccagcctgccgaagtcagcatcgaaccgccgatccttgcgcgaaatctcaaaccgcttgcttactctgacgagcgaagaacgagccttccttttggatgaggctgaccgctctgaacaacaagcgctcctctggatcgccacttgccgagcctaccgcttcatacgtgaatttgccgtcgaagtggtgcgggatcgataccttggttaccaactcgaactaccccttgaaagctttgacattctcttggatgcaaaggcggagtgggatgatggtttggccaatctgaaccaatcaacccgcctgaagcttcgtcagatcatgttccgaataatgcgtgaggccggaatagtctcagaagatcaccgcattcagacggctgtcatttcaacccgtgtgcggcacatgattgaagccaacaaccccggcgaactggctatatttcctagtgttccggtcgagggggcatga

SEQ ID NO: 4531 - DNA, 756 bp, Escherichia coli
atgactctcgccaaaaccgtttatgtgttgtacataacgcgatcatccctctcacaaattgccttttctcatggcatctcgcccggtcccccattacaatcactttttgtttttttgcgagctgcattccagtcttcagagggtttttcgatgattaaaaatgacaaggcatggataggagacttgctgggcgggccgctcatgagcagggaaagccgcgtcattgccgagctgttgctaaccgatcccgatgaacagacatggcaagagcaaattgttggccacaacattttacaagcctcttctcctaacaccgcaaaacgttacgcggcaacaatcaggcttcgcctgaacacgcttgataaaagcgcgtggacattgattgccgaaggtagcgagcgggaacgccagcaacttctgtttgtggctctgacgctacattcgccggtagttaaggattttctggctgaagtggtgaacgatctgcgcaggcagttcaaggaaaagttgcctggcaatagttggaacgaatttgttaatagccaggttcgccagcatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctggggcaacaggacttgatatctattctggagggaaaacggtga

SEQ ID NO: 4532 - DNA, 756 bp, Escherichia coli; identical to SEQ ID NO: 4531

SEQ ID NO: 4533 - DNA, 642 bp, Escherichia coli
ttgcgagctgcattccagtcttcagagggtttttcgatgattaaaaatgacaaggcatggataggagacttgctgggcggaccgctcatgagcagggaaagccgcgtcattgccgaactgttgctaaccgatcccgatgaacagacatggcaagagcaaattgttggccacaacattttacaagcctcttctcctaacaccgcaaaacgttacgcggcaacaatcaggcttcgcctgaacacgctggataaaagcgcgtggacattgattgccgaaggtagtgaacgggaacgccaacaacttctgtttgtggctctgatgctacattcgccggtagttaaggattttctggctgaagtggtgaacgatctgcgcaggcagttcaaggaaaagttgcctggcaatagctggaacgaatttgtgaatagccaggttcgcctacatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctgggacaacaggacttgatatctattctggagggaaaacggtga

SEQ ID NO: 4534 - DNA, 606 bp, Escherichia coli
atgattaaaaatgacaaggcatggataggagacttgctgggcgggccgctcatgagcagggaaagccgcgtcattgccgagctgttgctaaccgatcccgatgaacagacatggcaagagcaaattgttggccacaacattttacaagcctcttctcctaataccgcaaaacgttacgcggcaacaatcaggcttcgcctgaacacgcttgataaaagcgcgtggacattaattgccgaaggtagcgagcgggaacgccagcaacttctgtttgtggctctgacgctacattcgccggtagttaaggattttctggctgaagtggtgaacgatctgcgcaggcagttcaaggaaaagttgcctggcaatagttggaacgaatttgttaataaccaggttcgccaacatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctggggcaacaggacttgatatctattctggagggaaaacggtga

SEQ ID NO: 4535 - DNA, 600 bp, Escherichia fergusonii
atgaatataaaagaatatttaggcgatcttatcggaagcagtttattgataactgaatctagaataatcgcagaatcgctactgaaaaaacttccagaagatgagtggaagtcgctgatcgttgagcaaaatgttcttcagaaaaaatccggtcagacggctattcgttatgccagaacaatccgttggcgtattgaaggtctgggtgatgagtttatgactgatcttttagccgcgagtgaacgtgcctatatccaaatgctgatgatgtcattactcattcattctccggttgtcgctgattttatgcgacataccttagccgaggctcgtcgcacctataaacccgctttaaccgctgatgcatggtctgagttttatgacacgagagtgcgggcatatgccgaacttggcggtttttctgactcaactatcaaaaaaatgggtaacaacgcaattaaggcattggttgatagtggctacctgagtgatagcaggacaaagaaaatacaacctgtttacctaatgccagaagttaaagactggttagttcgtctgggccgggaagatttgattgaggtcatggagtgcacaatatga

SEQ ID NO: 4536 - DNA, 597 bp, Exiguobacterium sibiricum
atgacaatagaattagaatattcttcaagtatgaacggggcgtcgtacttactgtttgaactgaaacaagtagtcaaattgaaacaagaaggtttttctattgaagaaattcgaagcaaagtagtggatgaaaatttatttcagtttgaaaataaagggagaatcaagcgcacattaccatcagtgatgaaaagagctcatgtaattgactcggctctagcaattcttatgctagagggttctattgaaatgagtaaagtaattaatttgtatgcaattatgaagaccgatcttcttttttttgaatttatggatgaagtaattagtgaaaagttacgcaatggcgattatttgattgagaagaaggatatcaacctctttttcgaagcaaagttagagcagagtgaaaaaatatcgagttggagcgatattaatatcgaaaagttaaagcgagcgtttatgcaggtccttttcgaaagtggatttctcaaaagtcgacaaagcaaagaactaggacacatcatcatcgacgaacaaatcaaagaataccttaaccgtataggcgatgttcgatatgtacgagcgatgggtgaatga

SEQ ID NO: 4537 - DNA, 771 bp, Flavobacterium branchiophilum
ttgatatacaacaccgacataaacatcattggaagcattccggattaccatttgatatacaaggcactacctatgcttttgaatgatcaaacggaattagaagatattcttgtgaacaataatgaatttgattttagaacagaaaagtctcgaaaaagatttttatctgctctaaattctgcttttgtaaacgaaaacaatgatataaatgaatttgttggaaatttgataaattactttaaaaatgatgaaaactcacaatctgttttgttgttttggttattcagtataaataacaaattgttttatgaattaaatagagatgtatttctcaaatattattttcaaggtagagcagaattaccaaaagaatcaataatagcttacataaaagatttgattagccgtaatgaagaattaaaggggaaatggtctgagataactattgaaacgattgcttcaaaatacctgacaattttaaaaaaattaaatcttgttgaaggtaatcaaaagaaaaaatttaagctcaacagaataacagacgaacaactaacaatttttattaacctaattaataatcttaaagacattaaaatcaacttgctagaagaggaactaatgagttttacttttatatctaacgaaaatttattagacagattaaaaagaataggaaaaaaagattggattaaattaaattataacggtgcgatattacaagtcgaaccagtgtttactaataacaacattatagatggcatatatagatga

SEQ ID NO: 4538 - DNA, 594 bp, Gallionella capsiferriformans
atgccccgctataacgccgaaatatctgctggatcgcttatgcttgctgaaagcaggcggattgccgcgttgttgctcacccacccatctgatgccgaatgggatcacgccttaaggattgaaaatatcctgcaaaaaaacacgccggcaaccgcattcaggcaagcgaagctgattcggaaccgtttggttacgttagacgaggagggctggaagctgattgccgaaggggatatggaagtgtcgtctcagcttttattggcagctgcaatcaagcacagctacttgttgggggatttcttgcgagacgtgtacgctaggcaactcagtcggatggagctggctctgaatagtcacttgtgggatgcgttttgggtggagtgcgtgcatcgtgatggcgacattgagcaatggtctgcatccaccaggaaaaaactttttgaggtcatcgttcgaatattggtcgaggccaaatatctcgactcaagcagaaaaaagaatatgacgccgcccagtctgcatccgacggtcatttcttttctaaaacggcatggtgaatttgatgttatcgctgcaatgaaagtgtcccgatga

SEQ ID NO: 4539 - DNA, 786 bp, Gallionella capsiferriformans
atgcagcaagacaaactctcaaaagctcagacacaactcggattttccgctggtggcgcgattagctcgcgaaccgtgatgcaagacgaattttctatattgctggcatcggaatccatcaatgcctcatctgataattacaggcatgcgattcttgaacataacgtccttgaaaaatctactgcctcgaaccgcctaaagacttttaaatatctacgcagcctttacgcgcttgatcccgatgtatgcttgtttcgagaaatgcgccgactcaaacagtacgcgggaactgataaaaagctcctcatggggctattatcaatggctcgtgagtcaattttgcgagagtgtttgacgatggtattagcccagccagtgggaaaaagtctgggccgtcctgagttcgaggaatggatcagagcacatgtaccggggcgctattctgaatcaatgtatgtcagctttagccataacctttatgcatcattttatcaatttggatatcttggcgaatcaataggcaaagcacgaacgcgcgtgcggcctgtttctggtatagcatctgcgacttacgccgcttttcttgattggctggaaggccgcagcggaattgccttgctacagggtacgtactcaagggcgttgaacatttcaactgatgagcacctggcattgttgcagtcggccggacggcaaggattactgaaagtagcctattcaggcagcgtgctggatttagcttttcctggttttatgaaaaattcagaatcgagactagccctatga

SEQ ID NO: 4540 - DNA, 600 bp, Geobacillus sp.
gtgttgaaaaaatattccggtgggtttacagcggaacacctttatagaaatgaaatgaaaatcattgttcatttacaactgcaagggttatcgaaagaggaaataaagaaaaaagtttttgaagaaaatttacttcattgtcgcagcgaagcggcaataaaagacctatttcctcgcgtttatcggcgagccgaagtccttgatcagcagctaaagttttttctaatacatggagcacgttccgaccaaaacgcgctcctgctatatgcatttttaaaacgtttttcgtttcctcgtgattttgttttagaagtgattcattataatatgaaaaaatttaagtcaacggtaacagaaggaaatattcgcacgttttttgaagaaaaggaacagcaatatgaacaagtgagaaactggaccgataaaacaaaatataaactaaagcaagtgatgttaaaaataatagtagatgccgaattgcttaagaaaaatggaaacgaatacgaaatcaaaccgattccattaagcagagagttgcgtgattacgtcgaacgaaatccggtgtatcgcgacttactcatcttaacattaaacgaataa

SEQ ID NO: 4541 - DNA, 783 bp, Geobacter sulfurreducens
ttgatgctgaccaatgatgcaatatttacaactcgcctccaaaaaggaggagcattgctggacgacatgcggcagttggtttgtcagtggacagaggctgttgctaaaccggaaagtcaggctggcgagattttgcacaaggccactcgttcgcgagtcgcagacacctatagacgtgcattcttaccgagattcctgaaaggttcgccgcaggatgcgtggaaactcgccagagcacttgaggaagcacacccaagcatcgagataattcgaccattctattactggataaccgcgcgggcagaacctatcctctatgcatatgtgacggaagagcttgtagaaaaggcgaaaacttccgaccgggcagtacgaacggaagaaacagcatcctggatcaataacacgctccgttcatgcggtagagtctggtctcccacggtgcaactaaaagtagcaaggggaatcctggccgcactccgcgactttgcgattctcgaaggtgccgtgaacaagaggcttgtgcacggccatctgccaatcgagaccttctgtttgattgcctttctccttaacctgatggggatcggggcgcgcgagctggtggaacattcggactggaaattgttcttgttggctggcccggaagtggagcggctttttttcgaggcacaccagcatggctggttgcactatcaggcggctggtcgtgtccaccggatagagtttccgacaaacgacttcaaggactacatacgtgtcatctttggaacagaatcttga

SEQ ID NO: 4542 - DNA, 681 bp, Haliscomenobacter hydrossis
atgatgttcctggagttggcaaaagtcatggaccattccatcgataccagcgacttctcaggttccttggcgctcaatgtgaccggaaaaaaatccaattcaggggctgaaaaaaccgcgatgtacctgaaaagattgtacagctttgatcggcaacagccttcttttgctgcccttgcttttttttggaaaaccgctgaaactgctgaaaaacccatgctggcgctactttatgccatttgtgtcgacgatcttttggccgaaagtttggccgttttggaggcaagtgtacccggtgaaaagctctcggttgaattttttgagaacatcctccaaaaaaaccacccgaaccactattcacccaattcttgtaaatccatcgctcaaaacctggccagttcctggaaacaagccggatttatagcgggaaaagtgagcatcagtagaacacaacccaacatcagttaccgcattgcctgttttgcttttttgttggcttacattcagggtaaacggggtgatttcatttggagtagccttccagtgcaagccttgggactgcccgaaagccaactccgcaacctggccatcgaatgcagcaaacgggacttgatggaataccagcatgcgggcagtgtcactacgatttcgtttgctgcactgttgaataaaatcggatga

SEQ ID NO: 4543 - DNA, 603 bp, Halobacillus halophilus
atgcactattcagccggatttactaaagaaaaatggtcagaacatgagatgtatatcgttattgaactcatgaagcaaaataaaactaagaatgaaatattagaagaagtaactgagaagaatctattccagttgcgaagcccagtcagtataaagaatagatataatatggtgtatagacgagcggcagtcctaggtgatgaactacaacaacattttttaagtgccgttgattacgacaggaaggctttgacattgtattcttttttggatgtgtatcgcattcctttagagttttattgggaaagaatcgtctataaatatgaacttcaagagtcgttatatgcgaatgactttcattatttctttgaagaaaaggctaatacagacgacaaagttagtaactggagacctgaaacaattaagcgtcttataaggtcattaagcttgttctttaaagaagccaagatgattgaaaaggtggatcagacgaaatattcaataaatccgatacatatgactcaatccttaagaacatatgctgaaaagaatgatcctttattatattcttttacagtcttagaaaaggtgaatgaattatga

SEQ ID NO: 4544 - DNA, 603 bp, Halobacteroides halobius
atgaagaaatatagcactagaattaaatctacggattttatgtatatagagttcaaaaaggttgctagacttaagttagaaaatccaaatttaacttctaaagaaataaagactagagcagtagaagataatatatttcaagttgataccgtaaatagaagaaagactattgctaaagctatgattagaagacttaaagtagtagatgaatatttgcttgagcaattagcaaatggagttcttgataccagtaagcagataacattatataccattttaaaaaatgaccgattattttttgaatttatgagagaggtatatagagaaaagtatttaattaaagatccatatctaactgataaagactttaatatcttctttcataaaaaaagtgaacaaagtgaaaaagtagctgggtggaaagattatacatattataaattaaagcagacaattgttagaattttatttgaagctggatttattaatcatcaggatgaacgaagaatagttaagccaattatgaaccaagaactgattgaacatttaaatgaattaggagatcaagaatatgcaaaagtaatgttagctaaaatcagataa

SEQ ID NO: 4545 - DNA, 609 bp, Klebsiella oxytoca
atgacggtgaaaaacgacaaagcatggattggagacctgctaggcgggccgctgatgagcagggaaagtcgaatcatcgctgagctcatgcttaccaatcccgatgaacagacctggcaagagcagatcgtcggtcataacattctccaagcttcctctgccaatacagcaaagcgctatgccacaacgataagactacgcctgaatacgcttgataaagcggcgtggtcacttattgcggaagggagcgagcgcgagcgtcagcaattgctgtttgtcgctttgaccctccattcaccggttgttaaagacttcctggctgaagtggtaaacgacctgcgtagacagtttaaagaaaagctccctatggatagctgggatgagtttgtgaccagccatcttcgtcagcagcctgtactcaccagttactcagattcatccatcaagaaaatgggtaacaacctgatcaaggcactggctgaagcgggctatctggatacaccgcgtcgacgtaatctacagtcagtctttcttttaccagaaactcaggcaaccttgcagcgccttggacaacaagaactggtttctattctggaggggcaacggtga

SEQ ID NO: 4546 - DNA, 606 bp, Lactobacillus amylovorus
atgtcacgcagttataatggtggaattgcttcttatgcaatttggctgccagaacttacaaaatttattgagctttatcagtcaggttatagtattaatgatattaagcaaatgagtgatgaagaaaatatctttcaaatgccaacgaaagcacgtgctaaaagatgttccagaaaccttgccgtcagagtaaaagcattgcctgaatcagttttaaatatattctcgcaacttgatacttccaatcaaaaaatcatttctttattgtcagtaatgttaactagtcgtattttagatgagtttatctatgaggtgtatcgtcccaaagtgcaaatgcgagaggatattttacaagactatgaagttgaagcttttattaatcaaaaaaggatagaaagtcctacaattgctgcgtggtcgctaaatacttataagcgaattaagggagcactaaagacatatatgcgggatggaggattgatggagattgatcctcaaaataaaaaacaagataagtttctgtttccattacttgattgtcaattagttttagcaatgaaagttgcaaagttagattatgaattagctgctttaggagggatgtaa

SEQ ID NO: 4547 - DNA, 600 bp, Lactobacillus casei
ttgaagaaattttcggcaagctttatttctcgtagcttctggtttcctgaattttctgcagtgatctcaatgctgaacaatggtaaagattgggacgacatcacagaggccattattgacgacaacatatttaagatgtcttcaaaaaaccgagcgactgatctgaaaaaagaaatgttccttcgaatttcgtctttacccgtgagctttattgaactttttgagcaattgcctctcaacaaccaaaaaataatgaacttaattgctatcatgaacgcacgtcctttggtagaggactttgtgttagatgtcgttaaaaaagaacttttaacaggcgatctaaggcttgagccgtatgagattagtgcctatttacaggatctgccactccagcacccggaaacagcgaattggacagaacagacgctaaaaaggatccaggctaaatttcacgaaattttgacgcaaagtggttcaactgaagatgtcggaggcgctatgcaattaaaacgagctttactggaagcctcattgattgcatggcttaaacagaatgggaagtctgattatattttggcactaacggggagagcattatga

SEQ ID NO: 4548 - DNA, 606 bp, Lactobacillus helveticus
atgtcacgcagttataatggtggaattgcttcttatgcaatttggctgccagaacttacaaaatttattgagctttatcagtcaggttatagtattaatgatattaagcaaatgagtgatgaagaaaatatctttcaaatgccaacgaaagcacgtgctaaaagatgttccagaaaccttgccgtcagagtaaaagcattgcctgaatcagttttaaatatattctcgcaacttgatacttccaatcaaaaaatcatttctttattgtcagtaatgttaactagtcgtattttagatgagtttatctatgatgtgtatcgtcccaaagtgcaaatgcgagaggatattttgaaaagctatgaagtggaagcatttattaatcaaaaaaggatagagagtcctacaattgctgcgtggtcgctaaatacttataagcgaattaagggagcactaaagacatatatgcgggatggaggattgatggagattgatcctcaaaataaaaaacaagataagcttctgtttccattacttgattctcaattagttttagcaatgaaagttgcaaagttagattatgaattagctgctttaggagggatgtaa

SEQ ID NO: 4549 - DNA, 606 bp, Lactobacillus helveticus
atgtcacgcagttataatggtggaattgcttcttatgcaatttggctgccagaacttacaaaatttattgagctttatcagtcaggttatagtattaatgatattaagcaaatgagtgatgaagaaaatatctttcaaatgccaacgaaagcacgtgctaaaagatgttccagaaaccttgccgtcagagtaaaagcattgcctgaatcagttttaaatatattctcgcaacttgatacttccaatcaaaaaatcatttctttattgtcagtaatgttaactagtcgtattttagatgagtttatctatgaggtgtatcgtcccaaagtgcaaatgcgagaggatattttgaaaagctatgaagtggaagcatttattaatcaaaaaaggatagagagtcctacaattgctgcgtggtcgctaaatacttataagcgaattaagggagcactaaagacatatatgcgggatggaggattgatggagattgatcctcaaaataaaaaacaagataagcttctgtttccattacttgattctcaattagttttagcaatgaaagttgcaaagttagattatgaattagctgctttaggagggatgtaa

SEQ ID NO: 4550 - DNA, 606 bp, Lactobacillus johnsonii
atgtcacgcagttataatggtggaattgcttcttatgcaatttggctgccagaacttacaaaatttattgagctttatcagtcaggttatagtattaatgatattaagcaaatgagtgatgaagaaaatatttttcaaatgccaacgaaagcacgtgctaaaagatgttccagaaaccttgccgtcagagtaaaagcattgcctgaatcagttttaaatatattctcgcaacttgatacttccaatcaaaaaatcatttctttattgtcagtaatgttaactagtcgtattttagatgagtttatctatgaggtgtatcgtcccaaagtgcaaatgcgagaggatattttacaagactatgaagtagaggcatttattaatcaaaaaaggatagaaagtcctacaattgctgcgtggtcgctaaatacttataagcgaattaagggagcactaaagacatatatgcgggatggaggattgatggagattgatcctcaaaataaaaaacaagataagcttctgtttccattacttgattctcaattagttttagcaatgaaagttgcaaagttagattatgaattagctgctttaggagggatgtaa

SEQ ID NO: 4551 - DNA, 600 bp, Lactobacillus reuteri
atgatacaaaattacaatgctggaatcacttcatatgcgttgtggttcagtgaatttaaattatgtgtttctatgtatcaagaaggtaacatactcgatgatattaaacaggctagcgatagtaacaatgtctttgaaatgccatcacgtgatcgtgctaaacgagcatcacgaaatttaactaaacgtttaaaggccctacctgaaaatataattaatcagtttgaatttttggatgtcaacaatcaaaaactagtagctttgttatcgatgatgttaactaatcgattattaaatgaatttgtgtatgaggtttatcgcaatgaaattattttaggagacaaggttctggaagaacgtgaaatgattgagttcattactagaaaacaaatggaaagtgaacaaattgctaagtggacagatgaaacatccaaaagggttcgaggtagcttaaaaaccattttacgtgatgcggggttgttaaaacgtgaaaagaatattgatattgtccttcaaccatttattgatattcacctagctaaattgatgaagcaagaccacttaaataaggagttaaccgcattaggagggcaaaactga

SEQ ID NO: 4552 - DNA, 600 bp, Lactobacillus rhamnosus
ttgaagaaactttcagcaggatttatttccagaagcgtctggtttactgaattttctgcggtgatctcactgctaaatgagggtaaggattgggacgatatcacgaaagctattgttgaggagaacagttttcaaatgtcgtcacgcaaccgtgcacaagatctggcgcgggagatgaaattacgaatcagtacgttgccagtcggattcgttgacatctttgatcagttatctctcagtaaccaaaagtcggtgaatcttattgcactcatgcttgaaaggccattggtagaagattttgttctaacggtcgttcaaaaagagtttttaaaaggtgatatgaggctggagccatatgaaattagcgcttatttgcaagacttaccactacagcatccagaaacagccaagtggacggatgaaacgttgaagaaaattcaaacgaaatttcacgagatcttaacgtacagtggcttagcagaggatgttaagggagggatggctctgaaacgtgcattattggatccttccctaatagcattgttgaaacaaagtggcaaggctaattacattcaggcactgacagggagaaagttatga

SEQ ID NO: 4553 - DNA, 600 bp, Lactobacillus rhamnosus; identical to SEQ ID NO: 4552

SEQ ID NO: 4554 - DNA, 600 bp, Leuconostoc kimchii
atgaagaaaaaatactcagcgggacaagtgtcgcaatctttctggcaaaaagaatttggtataggtgttaatctattcttggcgggaaagtctcctattgaaatgcgtgagatgagcttgaatgaaaatatttatcttcaggcatcaaagggaagtcgtattcgagttgcgcaagctatgaatcaacgattgtcggtcattcctgatggtctgcttaatttatataatgatgttgattcacaaaatcaaaagcttataaacttaacagcgataatgaaacttaatcaattgattgaggactttatcattgaagattttcgaaatgagattatgttgggcgattctaaaatagaagattatgagtggaaagcttttatgcgacgcaaagaaggcgaaagcgaaattgtcgataactggacgaatgaaacgaaacgacgaatgctagtgctgttaaaaaatttcgtacgttcgtctggcctaagtgttgttgacgaacaaggcgtggatattattcagcgacatttgctagattcacaagttttaattgaattggaaaaagaaaatctagggatttacataaccgcatttacaggagtatag

SEQ ID NO: 4555 - DNA, 594 bp, Methanobrevibacter smithii
atgaagtatagtgctggaattatgagtcattcattttggtatcttgaaacaaaaaacactgctgaatatctagctgaagatatttcaaaaaaagagttaatggagttatctttaactgaaaatatttatcaggtagatagtgaacgtagagcacgtgaattgactaatgtatgttatcgtcgattaaatggattttctaatgatttattaatatatttatcaacttgtgatcaaaattcaggtaaattattagttttaatttcaattttaagaaatgataaattattttttgagtttatgcatgaagtcttcagagagcatattattttaggaaattacactataaaagattcagatttagatatttttttcatgaataaatctaaccaaagtgaagtaattgaaaattggaaagatacaactcttcgaaaggttaaaactaattataaaaattttttaattgaagcagaccttttagaaaaagaagaagggaattataaaattattttaccatttgtagattttaaattaaaagaattattaactcaaaataatttaacaccatttttaaatgctatatctggaggaatctga

SEQ ID NO: 4556 - DNA, 474 bp, Methanoculleus bourgensis
atgcttgctctccaatgcgccctcgcccgggatcccatcctccgtacatccgcaccgtgcatactctcgttacagaagggggaggaggctcgcaaagaaccgctgatggatctggtcgagaaagagttccctcagaggtacagtccgaagacggtcagggcgataagcgagaatctcctctcgtcctggacccaatccgggcacctggaggggaaagtcaggaaggtcaggagaaaggcagctgcaggcccggcgtcactgacgtatgccctgtttcttggttatctctgtggtgtgcggggaaacctgctcttccataccgtctgggcagatgtgctggatgcgacaaacacggaaatccgcgagtatgttgacgaatcgatgaggaaaggctggctgatctataaggatgcaggagggatcgttgaggtctccttctcctctgattttgctgatgggactcgatggttatga

SEQ ID NO: 4557 - DNA, 693 bp, Methanospirillum hungatei
atgctccaggagatggagttgctttttcaaaatatttcaccagatgctcctttcgataccataaaagatgcaatcattaatgaaaatattttaaataaaaagagtatttccggcagaaataaaaccttttcattcctgaaacgaatgtatggactggatgattccatcccgctgtaccgggtctttcgatacctttttactcactatgagaaagaacacccgacattaacactactctacgcattggctcgtgataagtcactcaggatttcagcggattatatattatctctcgattgtgggacacaagcaagaaaggatgatttgattcaaactttaacccagaatctggatggctcctttactgataaaactctcaaatcgatggcagagaaccttctttcttcctggacccaatcaggccatctcattggaaaagggaaaaaaaatcgtactaaatccacatctggtccggcttcattcacgtttgctctttatttaggaacattaatcggattcggaggagttatgcttatgagatctccttttataagtattctggatttgagtgataccgaacgggatgaactgttccattccgcttctgtgatggggcttatctcatataaatcagcgggaggggtgattgaaatcaccatttcagacttgattcgttctctggggggagtatga

SEQ ID NO: 4558 - DNA, 621 bp, Microlunatus phosphovorus
ttgagcactagcgcatgcggcgaccgccgctacgccatgtccttcagcaccggcacccttctgtcccgcgagtccgtgatcgccgcaccgctgtatctcgacacccaggactgggcagtagtccgaggcctgctgaacgcagagaacctgctccaggcgcggaccgcatcatcgagggatcggttggcttgggaggtcgttcagcgacttgcgactctcacggagaccgagcttcgcctgctgatcgaggccagcccgagcgagcggagccatctgatgtgggctgccgcatgccgccggtacgccttcattggcgatttcgccgaagaagtggtgcgcgaacggttcctgctgcttaccccggcactcggctatgccgagttcgacagcttcgtcaggggcaagtcgctgtggcacccggaactggccgagctaaagccatcgacattgcagaagctccgttccaatctgttccggatgctcgcagatgcggggctactcgccaatggcgagatcacccaagccatggtctcccaacgcgtactcgacgtgctcaacgcacgcgtaccgagtgacttgcggttcctgcccacgcgtgccggccaggaggtcacactgtga

SEQ ID NO: 4559 - DNA, 831 bp, Moorella thermoacetica
atgcaacatgacccgattttagcagacataaaacaggacgcagattcacgatcttacgccctttgggaacagatgggctttcgatttggtgataaaggaacccatacgagcaggaccattatgctggatgagctatcgctattactgcgtgaatgtgtcgaaaatgcaacgcgtgatgactatataacggcaattattgacaataattgtttgggcaaacgcacggctgcgacccgaaggcttaccagccagcgtatgcgggagttatatgctctcgatccatcgctgcttattttcagggttttacgttattgttggtatgccgatgagaatggtcgccccctcctcgccttgctcacggcattggcccgcgatcctctgctacgaattacttcccttcccattctccggatgcagccgggggaagaactggcccggcaacaaatgatagatgtactccgcgaaagtaccgggagccgcctgaacgacagcacccttgacaaggttgtgcgcaacgcttcttccacctggacccagtcaggacacttaaagggccgtgtacgtaagattcgccaaaaagtggatcctacacctgtcgtcaccgcatatgctcttctcataggatacttactcggtgcccggggtcatggtttatttaaaactttatgggccaaggtacttgatacaccctcggaggaacttgtttccctggcagtagatgccaagcgccttggtttcctggatataagctatgccggtggtatgatcgagatttcagttgatcgtatgttgaccggggctgaaaggaggttgatccgtgagcagaattga

SEQ ID NO: 4560 - DNA, 618 bp, Parvularcula bermudensis
atgaaaacggatgaccagtctccctacaaaatgtccttcgctgttggcggactattcatcaacgagagcgttgaggtcgcaaagctgcgggatccttcagagcgatgggcggagactatttctcgtgcaatccagtcgggcattatctcatcgccgaaaatagcatccagacggcgaacgcttcgcgagatcgccaataggctctgcacgctttgtccgcctgaaattgagcttctgtccgtcacgccagatcgaaatgagcagcaagcattgctgtggttggcgacctgccgggcgtatcggttcgttgaggagtttgcttgtgaggtcattcgagatcgatatctctcctaccgtctcgaactcccccttgagagctttgatgtattctttgatgcaaaagccgaatggcacgaggagctgacgaaaattagttcgtcaacccgcaaaaaattacgtcaggtgctgtttcgtattatgcgagacgcagggatcattaccgttgaaaatcggatacaaaaagcactcctctctgcgcgtctgaggtcgctaatcgctcaaaataagccacgtgaaatcgaactgtttccaggcctggaacaggaggcaagcgcatga

SEQ ID NO: 4561 - DNA, 609 bp, Pectobacterium carotovorum
atgacgatgaaaaacgacaaggcatggattggagacctgctaggcgggccgctgatgagcagggaaagtcgaatcatcgctgagctcatgcttaccaatcccgatgaacagacctggcaagagcagatcgtgggtcataacattctccaagcttcctctgccaatactgcaaagcgctatgccacaacgataaaactacgcctgaatacgcttgataaagccgcgtggtcacttattgcggaagggagcgagcgcgagcgtcagcaattgctatttgtcgctctggtactccattcaccggttgttaaagacttcctggctgaagtggtaaacgatctgcgccgacaatttaaagaaaagctccctatggatagctgggatgagttcgtgaccagccatcttcgtcagcagcccgtactcactagttactcagattcatccatcaaaaaaatgggtaacaacctggttaaagcgctggctgaggcgggttatctggatacgccacgccgacgtaatctccagtcagtctttcttttaccagaaactcaggcgaccttgcagcgcctcgggcaacaggaattggtttctattctggaggggcaacggtga

SEQ ID NO: 4562 - DNA, 615 bp, Pelobacter propionicus
ttgcatttgaatgtagcacagcaattatataatgccgagataaccgcgggctctctcctgctgaaggagagccgtgctatcgcgcaactacttttacagagcgcggatgaaacagcatggcggcaagccatcgcaattgataacattcttcaaaagacctcaccagccagtgccaaacggatgtcgtccttaatcaggaagcgcctggaattgatgccccgagagctatggagcatgatagcggatggcacaaccgaagtggcaattcagtcccttatggcagcagccatcaagcacagtcgtttgcttggagacttcatgctcaaggtcttgcagcgacattatcgagagttcaaccctaagatcctttcgagggaatgggattcatttctggccgaatgcgctcatatcgacccggcagttgcgtcctggagccaaagcaccaggaaaaaggtcggtcaggtcgcctaccggattctgtccgaagccggatatctcgataacacccgttccttgaagctccagccagtcctgattgctccggaagtcagcaagttcctgaatagccacgatgagaaatatatcctgaaatgcatggaaatcgcccatgaatga

SEQ ID NO: 4563 - DNA, 777 bp, Pelodictyon phaeoclathratiforme
atggaagtatataacgcagacatcaatgtcattggcagcattccggatttccggctgattgaggttgcgctggcagagtttgccaaaggaaaggggcgggttgatctcagggagttactggtgaccaacaacgccttcgattttcggacggaaagcacccgaaagcgctttcttgccgcagtggagcgtaccattctggtttttgccagtgaacggcaccggcagttaatggtggcactttttaatgcccccggtctggaaactctgaaacggtgggctatttttttgcagttacttgccgggaacgatcttttccggattcttaccaaagaggtttatctgaaggtctacttttccggtcggacaacaattgccggggatgaaatctttgcctacctgaaagatcgccagagtcactctctgccgttgaaaaaattctcggattcgactctggaaaaaattggttcaaagtatctcacgattctcaagaagctgggaatggttgagggtgcagtaaaaaaacggttgctcaatatcaggctttctgaggatgaacttcttttctttttgtatgttatcctcagtgtggatgatgctgccaccgatattctgaaatcgccatatcgggagttcttgtttcttgaacgagagcagttgattctgtcgctgaaaaacatcagcttcatgccatttatcaatatagcctctaccggtgaggccttgactgtgcagttaaaattgtcaccacaggagcttgttgatgccatttctcactga

SEQ ID NO: 4564 - DNA, 528 bp, Polaromonas sp.
ttgctgcttttggcatcgcccgatgaggcggcatggcggcacgccatcgaagttgacaatatcctgcagaaaaacacccccgcctccgcccgccggcaggcaacgctgatccgcaaaaggctcaccacgctcgatccccaagcgtggaccatgctcgccgagcgagagcacgaggtggtcatccagctgctgctggctgcaacggtcaagcacagccggctgctcggtgatttcatccgcaacgtgtataccaaccggcaacgccgccttgaacccacgttggctcccggcgactggcatgagtttctggttgagtgtgcacaccaggacccgcaggtagcgggttggtcggactccacccgggccaaactacttcaggtgattgttcgcatcctggtcgaggccaagtacttagagagtgcccgttcgatgaaactgacgcccaaatccctgcaccccgatgttaggcgctacctaagcgtccgccatgaaacctatgtactcgactgcctggagcgcgccaaatga

SEQ ID NO: 4565 - DNA, 783 bp, Pseudomonas brassicacearum
gtgagtcagcgctactacaccactcagctacaagccgggcttgggctcctagaagaaacaaggcagctgctccaggtttatcaatttggcatgagtgcgtcccagctttatgaggccgcgctagcatcgggtcgtttccctttggtaacggcaaggcgcctacgcaatattgttgccgagtgctttggcccacgctacatgcgcgacccctgcgttgccgcgcgcctcaagtccctggttgatcgtttcacgaccgccgagctcaatcaactgctctttatctatacagcgcgagccaatcttgtattggcagacttcgttcgagaagtttactgggcgcgctattcagcagggcgaaatgacctccagctggaagacgcacgcacctttgttgccaacagcgtgcgcgaaggaaaaacgcaaaagccatggtctgagaccacgatcaagcgcgtctcatcgtatttgatgggctgctgcgccgactatggactgctgataaccacaggccgtaatcagcgctcgattgctgcttatcgcatcttgccaaaggtcgccgcctacttggcctatgacttgaagttcagtggtcttggtgacaaccaaattgtttcaagctccgactgggatctctttggactggaacgtaccgatgtccgagaccaactgaaacgtttgtcattacaaggcctgctcatatttcaggccgcttccgatgtcgtgcatatcggttggacctataaaaacatggaggaactgatcgatgtcatcgctcaaagctga

SEQ ID NO: 4566 - DNA, 615 bp, Pseudomonas stutzeri
atgagtaacgacagatacagcatgtcatttacaacgggcagtctctttcaccgcgaatcggtgaagctggccgcgctgtatcttgatcttggcgactggaactctgttcgagacaaggtcatcgcagaaaatttactgcagacaagaacactgaatacgctcaagcgagtctgccgcgaagttgtctctcggcttagggcgctgactcaaggcgaacttgaattccttgttgaggccagccatcaagagcaggcctatctcctgtggctcgccgtttgccgtcggtacagattcatcgctgattttgccgtcgaagtgcttcgagagcgatacatcacactgaaaagtgatctgacccacgaggattttgattccttcttcaaccggaaatccgagtggcatttagaactggatgagatcaccccggcgacgcgaagcaaattgcgccaggtcttgttcaagatacttcgcgaggccgatctcctaacggccaacaacatgatacatgcggccatgcccagtccgagactgttggatctgatccatcaaggcagccgcagggatgttttgtacttccctgcatttgaatccgatgtgaaggggatgaagcggtga

SEQ ID NO: 4567 - DNA, 600 bp, Psychrobacter cryohalolentis
atgaatagccaaaaatacaatatgtcatttacagctggtgcgctgctacagccagagtcagtaacgatagccaagttatatcttgaattaggcgactgggatttagtgaaagataaagtgattgctgagaatttacttcaatctagagcattaagtacacttaaaaggctgagccatgaaattatagctcgcttgagaacacttaatattgatgagcttacgttacttatagagtctgagcgccaagaacaagcctatatactgtggattgcaatttgtcgttattatcacttcattgctgattttgctactgaagtgctacgagagcgttttatcactttcaaaccagatcttcaacactcagattttgatacgtttctgaatagaaagtgtgactggcatagtgagcttgatagtttaagtataagtacgagaaaaaagcttagacaggtgttatttaaaatgcttcgagatgccaatttcttagacagaaaaaataatattcaagccactatgttgagctcaaggctaatagaaacgataaagcgtaatggtagtagagatatcaaatacttcacgatttctgaaaatgcaatataa

SEQ ID NO: 4568 - DNA, 630 bp, Rhodococcus erythropolis
gtgagtgagaagtctgctccgacgacgcgttacgcgctctcattcactagcggtgccctcctcggccgcgaagcggtcattgtcgcgcctttgtatgtgcgcgaacgcgattggtcgatggtgcgcgcgatcatcgagcgggacaacctcctgcaagcccgcacatcggcgtcgagccgacgtttcgcgcgcgaaatagtccaacgactcggcatgctcaccgacgctgagatcgaattgctagtcaatgcgactgctactgagcgcggacacctcttgtgggcggctgcctgccgacgctacgaactgatcggcgagtttgccgaggaggttgtgcgcgagcggttcctcctgctggcatccatgctcacgtatgaggacttcgacagcttcctgcgaggtaagtcgctgtggcatcccgagttggctgagctcaaggattcaacactgcacagactccgctcgaatgtgtttcggatgttgaacgaggcgggcctgttgtccgatggcggtcagctactcccggtagtgctgtcgcagcaggtggccagcgccttgtccgaccgttgtccgagtgacctgcggttcttccctacccatgatgacgcgacgaggggattcgagcggtga

SEQ ID NO: 4569 - DNA, 771 bp, Rhodopseudomonas palustris
atgaaagtccatccggaatggtcgcaacggctcctgcgaaaaggagtgctcgtacaggaaacttacgagctcttcgccgcatgggacgatggcctgtccgtcgccgataacctgaagtcgacgctgtccggtcggcacaggaccgccggctgggaacgcgaggtgacctcgaccctcaagcgtcgcctgcgcggcgtcgagccggcgcggccgctcatcgccctcgccaaaggcggcatgccgctcgccgactggcgcgactgcctgcgcctctgggtgggtgccagcgaggagccgttccacgatttcgcgacgggatggttgttcgacgagcacgaaaagggtcgctaccagatccgctcggaggatgtccgtcccgtgctggcgaaagcgatcgcctcccgcggtccggaagcgaagccgctttcggagtacggcctgctgcgcggcgcccgcgacctcctgcggatggcggtcgatcttgcgatgctatcgggcgacggcccgactaagaccttcgcgtccatcgccatgagcgacgacgtcacaatgttctacgtccacatgatcagcgatctcgagagcaacaccaagaagatgctgaccagccgtctgtggcgccttgcctacatggcgccgaaggacgtccacgtcgcgctgctgcgcctccaccagtacaagcgactcaactacgaggtcgccggcaatatcgcgcaggtaggcctgccgttcggaagcgcgctcgaatgcgccgagaggatcgcggcatga

SEQ ID NO: 4570 - DNA, 717 bp, Saccharophagus degradans
atgatgttgccagaattaacgcagctttttgaatttttgcctgaagcaacagctactaaagctgcctatttcgaggcgatcgttgacgacaactgcctgtcaaagcgctcagcgcgcacccgtctattaaccgcccgccatctggcagacctttatggtctcgataatgccttcctactttttcgtgccctgaaattcttctggtatcgcgcagaagcagctcgcccacaactagcgcttctgcttgcctacgcacgtgaccccatcttgcgtatgagcgctaaacatattttatccgcaagccccggcgtgcaaattcaacggcagggaattgaagacatcatcagtaaccaatttcccgaccggtttagcgaggcaaccctcaaatcgaccgcccaaaatatcaacgcaacttggacacaagcaggttatttaacgggcaaggccaagaaaatgcgctgcacatcagaagcgagcgaagcagctgtatgcttcgcacttttaatggcctatcttcgcggtacacgcggcgaagagctcttcactagcgaatacgttcaattactcgattgtcgcccagacaaggcaatagaccttatcgaagcttccgctcgcaaaggttgggcagtatttaagcgtgttggctcggttgtcgaagtggcgtttccttcattgatcaatcaaaaagaaatggagtgggtgcgtgagcaagcttaa

SEQ ID NO: 4571 - DNA, 603 bp, Salmonella enterica; identical to SEQ ID NO: 4491

SEQ ID NO: 4572 - DNA, 609 bp, Salmonella enterica
atgacgatgaaaaacgacaaggcatggattggagacctgctaggcgggccgctgatgagcagggaaagtcgaatcatcgctgagctcatgcttaccgctcccaatgaacaaacctggcaagagcagatcgtgggtcataacattctccaggcttcctctgccaatacggcgaagcgctatgctacaacgataaaactacgcctgaatacgcttgataaagtggcgtggtcgcttattgctgaagggagcgagcgcgagcgtcagcaattgctgttcgtcgctctgatcctccattcaccggttgttaaagacttcctggctgaagtggtgaacgacctgtgcagacaatttaaagaaaagctccctatggatagctgggatgagtttgtggctaaccatcttcgtcagcagcccgtactcaccagttactcagattcatccatcaaaaaaatgggtaacaacttgatcaaagcactggctgaagctggttatctggatacacctcgtcggcgtaatctccagtcggtctttcttttaccagaaactcaggcgaccttgcagcgccttggacaacaagaattagtttctattctggagggacaacggtga

SEQ ID NO: 4573 - DNA, 603 bp, Salmonella enterica; identical to SEQ ID NO: 4491

SEQ ID NO: 4574 - DNA, 603 bp, Salmonella enterica; identical to SEQ ID NO: 4491

SEQ ID NO: 4575 - DNA, 609 bp, Salmonella enterica; identical to SEQ ID NO: 4572

SEQ ID NO: 4576 - DNA, 609 bp, Salmonella enterica; identical to SEQ ID NO: 4572

SEQ ID NO: 4577 - DNA, 603 bp, Salmonella enterica; identical to SEQ ID NO: 4491

SEQ ID NO: 4578 - DNA, 630 bp, Selenomonas sputigena
atgccgcaggaaatcgacggaaaaagaaaagcatccagtccatacagcgcggtcatgacacgagagcagttcttgtttcacgaaacgcgaatcacggcgaaactgctggatgaaggacttgaaaaggatgaaatcataaagaaggttttttccgaaaatctttttcagtatcccacagaaaaatctattcgccgtatggttcttacttgtctgcggcgcttggaggctttgtccgatcaaacattgatcactgccatagctgttgaatctggtgatgtggcaaagcaaatatgtctttatgccatgatgcgccaatatcgcttggtatgggattttatgctcacggtcattggcgagaaatatcgtaatttggatcattccttcagcaagatggatttgcatggatttttcctgcggctgcaggagcaggatgatggggtggctgcatggagcgatcagacgattgcaaaacttaggcaggtgctcacgaaaatcttggtggaaaacgggtatctggacagcatcaaagcggagagattgaatcccgtgctgctcagtccgattttggaacgtgcgatacgagagtctgggcaggaagcagccctgccggctttcaactgtctgggatag

SEQ ID NO: 4579 - DNA, 768 bp, Shewanella sp.
atggagcaactaccgcatttgactcaaattggcttcaagtttggtaaaaatggggcgcatgccgcccgaagcatgatgatccaagagctgacacaactgttgatgtcactgccagagcaggcatcgttggatgaataccgcgctaatattatcgatgccaatcttctgcataaatcgagtgagaacgcccgtaagcttacttttcgacatatggtcgatctttatggtttgtcgccacaagttccgctttttaaaatatttcgccagttgtgggatttatcagaggagtctcagccgctattggcattgcagttagccgttgccagagatccgctattaagaggttccgccgaggtcattttatctctagaacctggagagatgctccatagagaaaccatggaatcgcaccttgccaaagatgacccggacagatttagtcccgcttcgttaaagtccttctcgcaaaatttaaacggtacctggactcaggcgggttatctgactggcaaggctaaaaaataccgtagcgagcctaaagtcacctatgtaaacctggtatttgccttggttttggcccattaccaccagcttagtggtataaggcttttcaacagtttctggtgtaagttgctcttaaagagtcacgcagatttatacgaattagctcatcgtgcgacgcttagaggcttgatccactttaaacaggcaagcgaagtgatagaagtgtcatttgcaccattaaaacttcctgaattcaaggattga

SEQ ID NO: 4580 - DNA, 768 bp, Shewanella sp.
atggagcaactaccgcatttgactcaaattggcttcaagtttggtaaaaatggggcgcatgctgcccgaagcatgatgatccaagagctgacacaactgttgatgtcactgcccgagcaggcatcgttggatgaataccgcgcgaatattatcgatgccaatcttctgcataaatcgagtgagaacgcccgtaagcttacttttcgacatatggtcgatctttatggtttgtcgccacaagttccgctttttaaaatatttcgccagttgtgggatttatcagaggagtctcagccgctattggcattgcagttagccgttgccagagatccgctattaagaggttccgccgaggtcattttatctctagaacctggagagatgctccatagagaaaccatggaagcgcaccttgccaaagatgacccggacagatttagtcccgcttcgttaaagtccttctcgcaaaatttaaacggtacctggactcaggcgggttatctgactggcaaggctaaaaaataccgtagcgagcctaaagtcacctatgtaaacctggtatttgccttggttttggcccattaccacgagcttagtggtataaggcttttcaacagtttctggtgtaagttgctcttaaagagtcacgcagatttatacgaattagctcatcgtgcgacgcttagaggattgatccactttaaacaggcaagcgaagtgatagaagtgtcatttgcaccattaaaacttcctgaattcaaggattga

SEQ ID NO: 4581 - DNA, 591 bp, Slackia heliotrinireducens
atgtcgtcgaactacagcctgtcaatgagtggctcgaaggtgcgcatgcaggagagcatgctggccgtcgagatatacaacgagactaaggactggagcgaggtccgcaggagaatcattgacgagaaccttttccagctaaatgccgtgagctcgcgaaagcgggtcactggcgagatagtgaagcgactccgcacgctgacggacgccgaactcgaattcctgcaaggatcatacggagacgacagatgcgccatgttctgggtggccgtatgcaggacgtaccaattcgtgagggatctgtcggagcagatgatcgccggcaggtacaacaggacaattccagacttcaccatggaagcatacgatgcgttcttcgaagagcaggcagagattcaccctgagctgacagcgctgtcggacgagggtaggaagaaaatgcggaaccaagtattcctcatgctcgcggaatgcaagctgctctccgaagatgctcggatcacaccgctatatccaacgccaatgttcaaaaacgccctcgatccgtccaggaaagacgacctgcggctgttcccggggaggctgatctaa

SEQ ID NO: 4582 - DNA, 636 bp, Spirosoma linguale
atgctattacctacaattcactactcagcttccttcacgaccggtgctttactccaagaggaaacacgggctctacttaccttgatggagcaagtaccaatggaccaggtatatgaccgggcgaaaaaggactcggattatttaaaaatcaattcggaagtcgcccggcgaaaaatagcgggcgaggttttaaaacggtataaagctgttgatcagggtgtatggcagttctttcaatcacgggtgcgaaccaatgaacagtccatactcttattctatgtttgtctgaaaacctatactctactgtttgactttgttcaaggtgtagttgttcgtcgatggcaacaacgattactatcactggataagagcgatttcgagcgatttcttgacacgcttataccaacacatcctgaattacaaaaattgactgaagctacgcgccgaaaattggcccagataacgatgcttatgttaaagcaagcagggttgctggaacggggacaattagtcacaccttctctaggagctgaagtctggcagttttttattgatcaagacgacgactggatgttggacgcaggtatgttaactcgcgccgaccgggaacgccttggcttattactacacgaatga

SEQ ID NO: 4583 - DNA, 618 bp, Sulfuricurvum kujiense
atggattaccaactttcgatgacagcggcgacgctcagatatcacgaagcgaaaatcgtcgcggaactgtttatcgaaacacgtaattggagtgttgttgaaaaccgggtgctcggtgacaatctcctccaaaaatcgacctctgcaacggccaaaagagagtttggcgagttgaaacaccgcctctcgaccctttcggatgcaacccttcgtgcttttggtacggacgatttgaacgagctcaaatatctggcctttttgtcctgcgtcaagtattaccgcctcctcaacgactttatgatcgaagtggttcgtaacaagatccaaacgtttgattaccagatcctcgaaagcgactgggtcaacttcatcgaatcgaaaaaagcgcacgtcccgaaaatcggccaatcttccgaaacaaccctcaaaaaaatccgtcaagtgatcttcaaaatgctctccgatgcggggatcattgacgatatcaaacatcgcatcatccagccgccgctccttagccgtgaattccaaagtatcgtctgtcgcgagagcccacagttgctcgccgctttcttgctctccgacaccgatatcacaaaagcctgtgaggaggtttga

SEQ ID NO: 4584 - DNA, 798 bp, Synechococcus sp.
atgactttcaatcatcagtatcaacccaaggctcaatattcctcaagaattattaaagctggtgcattagtggcagacactaaaaaactcctttgtagttggaatttatctgtctcgacagccgagaatataaaacaattccatcgagagaacatatttggaaaatcctctcgctctcgggtggctgacatactagcaatttttaggcagcgatatctttcaaatgagtctgtcactaaagcattaatattatttgcaagaagtaagttttcaactagttcacttattcctttgttgtatttccattcatcacttgccgatagattactttttgatgttgcaacaaatattatatttccaatgtataaaagaggtttagtagatataaatcgacgagaatttcaatattccttaacgaaaatggttaaggaaggaaagatggcgagcctctggtctgaaaatacatttaaccgtctttcaagtgggttgctctcaacgctccgagattttggagtgcttcaaggatgcgttaacaagaaaatttctcctgcctacttgccaatagagtcctttgcatatattattttctacctaaagcagagtcaagcatctggagtaaaacttctagagctcgccgattggaggcttttcctattgttccaagatgatgtcgagagactcctctttgaatgtcaccagaggaaaatgctggagtatcatgttgctggaagtgtcacccggttaacattccctgcgaaaacacttgaagagtatgcggatgtcctcgctcaaagatag

SEQ ID NO: 4585 - DNA, 741 bp, Syntrophomonas wolfei
atgaatattaattcggatataaatgtcctgggtagcttgtcagatttcagcctgatatcggctttgttggttgaaggcaaaaataatacaaattaccaggcctattccaatataaagaccaatagatcctataagagatttgccagcgccataacgaacacccttatcaaatttaccgaccccaatatggaatatttaattcgggatgtatttgagcatgaggggctttccgctcactgcttgcttttaatattttggaatgcctgcgtaaataatgaactgctcgattatctaaatcaaaaagtttattttccggctttatacagcgggcgggcggcacttaagaaagatgaagttgtggcctgcttgcaggaattaaagcagagcgaaacagctatgcagaagtggactgattcaactattgaaactactgcctccaagtacctcacatttcttaaaaaatttaacctgatggaaggcagggttaataaaaccatagctcccccagttatgagtgataaagaattaatactttttatctattggctattaagcgttgaacccaaaactaatttactggaaagcgggtggctgccatactgctttttagaaaaagaattgtttattcagcagattatgcagaaaaggtatatgaagttttataaccttcaatattcggtaaataacctgaaaatcgaaccgaccttttcatacaaggagctgtatcatgaacttggttaa

SEQ ID NO: 4586 - DNA, 600 bp, Syntrophomonas wolfei
ttgacggaaattaaatatagtgctgcattgaccggtgagcccttcctgttttatgaaagcaggcaggtggccaggctcaaactgagtggccgtaaccagcagcaaatccgggaagagataaaaagccaaaatctcttccagtatgctacggaaaagagcttggccaaaagaattaatgccgtacaaaagcgtgtcgataccctggatgagacattgctcaggtttttggcggaaaaaccatcggcgacggctaaaatcatcaacctgtatgccataatgcaaactaataaactcatgctggattttataatcgaaataattggagataaatttgaacagggtaacctggttcttgaaaaaagagacctgaatgaattctttgttgccaaaagggagcagcaagagaatatagcacggtggagcgatgaaaccatcgccaaattaaaacgggtgttaccccgaatcatttttgaagccggtattctggctgatcgtaataccggaaccctacagcgactcaccctggacaaagatgttgaaaaatacttccgggagcatggagaaatagaatttttaaaagccgtgggaaccatagtttaa

SEQ ID NO: 4587 - DNA, 810 bp, Syntrophus aciditrophicus
atgaaaacaattcaacccatagattggctacagccaaaaacagaagcagaagaaatacgatttcgctctacgggttttcgatggggcaataagggcactcatacaagccgcacaatcatgctcgatgagcttcgagcgttattgaactattcgcggccagatgcaacgcgtgatgattatgtatcagtcattattgaggataattgcctcggcaaacgcacagcctcaacccggaaattgtccttacaacgtctctctgagttgtatgcacttgatccaaaggtactgttgttccagcttatgcgttacttttggtatgcagatcgttctggacaggcgatccttcctttgttgcttgcccttgctcgagacccattgctccgggcaactgctgccagtgtattatgtatgcatcctggcgaagagttcgcgcggcagccgatgacggacgcactgaaccaggcagcgggcggccgttttaatgaggggacgctcaataaaattgtacgtaatgccgcttcctcgtggacgcaaaccggacatctgaaggggagaagccataaggttcgccagagcattgctccaacggcaatcaccactgcatatgcccttctgctcggctatcttacgggaacacgcggagcgaaactctttgagacgccttgggcacaagcgctcgacacgccgccaagtacactcatgcaccttgccatggatgcccggagattgggcttcctggacatgagtcaatcgggcggcattgtcgagttaggattctcacggcttctgcccctcgacgaaaggcgataa

SEQ ID NO: 4588 - DNA, 330 bp, Tepidanaerobacter acetatoxydans
atgaaaactgataggctgttttttgaatttatgaatgaagtatataaagataaaatcatacttggggatagattcattttggacaaggactttaatatattttttgacagaaaaaaggagcaaagtgctaaggtggcatcctgggcggattataccttttataagcttaagcaggtaatttcaaggattctgaccgaatccggccttgttaaaaataaaggtaaaaaaatagaaatagtaagaccaattatagaacattctgtcgtagatcatttaaaagaaataggagatactgtatatcttgatatcttattaggtaaactggattaa

SEQ ID NO: 4589 - DNA, 609 bp, Tepidanaerobacter sp.
atggaaaataaatggaaatacaggacgacaattaaatcgcaatcatttttgtatgtagagataaaaaaagctgcaaagcttgttttacaagggcaggatgaatatcaaatccgaaataaatcactttatgacaatatattccaggtaaatactgatgccagaaaagcagaaattgcatcagctgttataactagactaaatgcactggatagattcttcatagaaaagttagtaaattctgacatacaaacaagtaagctcatagcaatatattctataatgaaaactgataggctgttttttgaatttatgaatgaagtatataaagataaaatcatacttggggatagattcattttggacaaggactttaatatattttttgacagaaaaaaggagcaaagtgctaaggtggcatcctgggcggattataccttttataagcttaagcaggtaatttcaaggattctgaccgaatccggccttgttaaaaataaaggtaaaaaaatagaaatagtaagaccaattatagaacattctgtcgtagatcatttaaaagaaataggagatactgtatatcttgatatcttattaggtaaactggattaa

SEQ ID NO: 4590 - DNA, 600 bp, Thauera sp.
gtgagcgcagccatctacaacgccgaaatctccgccggctcgctcatgttgcccgagagccggcgcgtcgcccgcttcatgctcacccagcccgaccgcgcgacctggtttgacacgctccgaaccgagaacatcctgcagaagaagtcgcctgcgaccgcacgtcggcaggcgcggctcatccgcaaccgcctcgaaacgctcgacgagcaagcgtggcagctggtggccgaaggcgaccaggaactcgcactgcagatcctcctcgccgcttcggtcaagcacagccgcctgctgggcgatttcatgcgcgacgtggtcgccggccacgttcgccgatttgaagagcacctggtcccgtcggactgggatgccttcctcgccgactgtatccagcgcgacccggccgtcgccggctggtccgacaccaccaaggccaagttgctgcaggtcatcctccgcatcctggccgaggcccgctacctcgaatccacccgcagcctgcgccttacgccgccgctgctgcatcccgaggtgcagcactacctcaagtctcgctccgaggccgccgtcttggccaccatggagctcacgcactga

SEQ ID NO: 4591 - DNA, 927 bp, Thermacetogenium phaeum
ttggcgcgagacttcataataattcagcttgccagcactaccagaataaggtatgataattttgccggcatatttgccggcaaaaggttggtgctaaaacacatgaagaatgacccaattttagccgatataaaacaggatgcaaactcattaccatacttcctctgggaagagatgggatttcgctttggggacaaaggaacccatacgagcagaaccatcatgctggaagagttatcgttattactccatgaatgttcagaagatgcttctcgtgatgactatataaaagcaattgttgactacaattgcctgggcaagcggacggccgcgacccgaagactttcctgccagcgtatgcgggagttatatgggcttgatccgtcgctgctaatatttagagttttgcgttattgctggtacgcagatgagaaaggccgcccgcttttggccttgcttaccgctatggccagagatcctcttttaagaattacttcacttactattctccggatgaagccgggtgatgaactggcccggcaagtgatgacagatgagctgcgccaaagcatcggaaaccggctaaatgacagaacgcttgataaggtcgttcgtaacgcttctgcatcctggaccaagtcgggacacttaaaaggccgcgttcgtaagtttcgccaaaaagtagtgcccacacctgtcgtcaccgcatatgctctccttttggggtacctgcttggagtgcggggccccggtttattcaaaacgttatggacaaaggtgcttgatacatctccggaagaattaatttctttggcaatagatgcgaagcgccttggtctattggatgtgtgttattccggaggcatggtcgaagtattagttgatcggatgttaaccgagaatgaaaggatgttgctgcgtgagtag

SEQ ID NO: 4592 - DNA, 606 bp, Thermoanaerobacterium thermosaccharolyticum
atggctgatgagttagaatataaatccacaattaaatcaagaccgtttcttttcagggaaacaaaaaaggctgcagaacttataaataaagggcttaaggaatttgagataaaaaataaagcgaaaaacgataacatatttcaggtgaatacagaaacaagaagaagtgaaattgcgtcaactgtgatgcgaaggttaaaggcactcgatgattttttgattgataaattggcaaatggagaaatcgatacgagtaaacaaatagttgtctatgccattatgaaaacagaccgattgttctttgaatttatgtatgaggtgtttagagagaagatactgcttcgggattttaccttgcaggacaaggattttaatatattttttgacagaaaaaaggaacaaagtgaaagggtggcctcatgggatgattataccttctataagttaaagcaggtatatattcgcatcttgtttgaggctggttttataaaaaatcaaaaaaatgatagagagattaccaggccaattgttgaagaggatgtagcatatcatcttaaagaaattggagatacaaaataccttaatgcactgacaggggagatgtaa

SEQ ID NO: 4593 - DNA, 786 bp, Thiocystis violascens
atgccgggtcttgctgaggcgacccagtcgcatgcacgtctgctcaaatgtacgctggcgatcgaggattcacgtgcctactggtcgcggaccgatggcactgggtccgttacctcgcgccaggcgttcgatgaatactggttcggcgcgcgcagtctagggcgcatcgaggtcttgctggcgagcctgcgtgcacgcttcgatgtctttcctccggccttggacgtcctgcaccgttggtctcggatgggacccgagacgcggcggatcatctgtcactggcatctgcaactggctgatccactttaccgtgccttcaccggcggcgatctggtcgcccgacgcgccgatccgcgtccagaggtgacgcgcgacggcgtgatccgttggctcgctcttcagggcaccgcgcactggacgctgtccacccggatcgagtatgccggcaagctgctgtcgaccgcccttgccgccggactcgtcgcgtcgaatcgtgacccacgtcagcttctgacgcctcggatcgaggatgaggcattggaatacctcctctatctcctgcggggcatccagatcaccgggacactgctcgacaacccctatcttgcttcggtcgggtttgcgggtagtgctttggaggagcgagtgcggcggttgcctggaatccgctttcgtcgccagggtgacttgatcgatttcggctggctctacccgagcctcgatgcctgggcagacgccaatcttggcgccgatcttccgctgcgggccgcagggggtattggatga

SEQ ID NO: 4594 - DNA, 798 bp, Thioflavicoccus mobilis
atgagtcaggacgcggcaagaccctactcgaccgagctgcgcaagggccgtggcgcggttgccgagaccctgaccctgttgggcgcctgggtgcccggtatgcccagtaccgagctgcaggccttggcggtcgaacagggcatcttcggctcgtccagcgcgaagcggacgcaggatctggtcagcgtggtgttcgcccgacgctacctggcggatgggggcaagcccgccagttatttgaagtacctggtggagcgcggcgcagaccgagccgttctgcggcagctcatgctcgtctatacggcccggcgcaaccccgtgctacgggacttcatctcagaggtgttttggaccgcctttgccgcaggcgctgctgcgctccgcatcggcgaggccgaagactttctcaagcgtgccgcagtcgatgggcgcatcgccaggccatggtcagaggtgatgcgcaaacgtattgccggtgatttgctgagcacactcgccgacttcggtctcctggaggacctcaaacgtccgaccaagccgatccgcagctaccggctcttgcccgataccgtcctgttcctcgcccacgagatccacttcaagcgtttcagcgacaacagcatcctagagtcaccggactggcggttgttcgggctcgccaaggaagacgtggttcagcagctcgacaaggtctcccgcgccgggcactacatccttcagtactcgggggatctgctgcggatctcctggcgctaccagaccatggaggaatgcctcgatgccatcgctggacgctag

SEQ ID NO: 4595 - DNA, 600 bp, Vibrio cholerae
atgaatataaaagaatatttaggcgatcttatcggaggcagtttattgataactgaatctagaataatcgcagaatcactactgaaaaaacttccagaagatgagtggaagtcgctgatcgttgagcaaaatgttcttcagaaaaaatccggtcagacggctattcgttatgccagaacaatccgttggcgtattgaaggcctgggtgatgagtttatgactgatcttttagccgcgagtgaacgcgcttatgtccaaatgctgatgatgtcattactcattcattctccggttgtcgctgattttatgagacttaccttagccgaggctcgtcgcacctataaaccctctttaaccgctgatgcatggtctgagttttatgacacgagagtgcgggcatatgccgaacttggcggtttttctgactcaactgtcaaaaaaatgggtaacaacgcaattaaggcattggttgatagtggctacttgagtgatagcaggacaaagaaaatacaacctgtttacctaatgccagaagttaaagattggttagttcgtctgggccgggaagatttgattgatgtaatggagtgcacaatatga

SEQ ID NO: 4596 - DNA, 801 bp, Vibrio cholerae
atgaaagatttaatagagaaaatgagtgtgcaagattataacactgcaattaaagatattgcgggcctgaaagactatacgcttgttttcaatataattagcgcctatttttgtgagcctaatttgactgactcgaagataactgatgaaaatgagtttgacattagaacttcaaaaactcgcaataaagtaagttgggcgattaataaggcgattctaaagtttataaatcaagatcatgagcttttaattaaaaaaatttatctttcagatgcgcctttaatagataagaagttttgctttttatggcacctatgtctaaataatcggttgttcagagaagtcacaacacaagtgttcagtaaagtgtatttcacaggaagagcacagatttcacaggacgacatcattgcctttctaaaagataaaatgtcttcagagggtcctgattttccgcaatggtcagaagatactttatatagagttgctacaaagtacctcagtttaatgaccaagtttgactttgtcacggtagggcgggggaagtctttcaatcatattcgcccaacacctgaggcattagtgcttttcgtatatttctctaatttattctcacctgagataaaaagcatttttgagcatgaattgctccctgcaagttttatagccaaagaagatattcaagaccgattcaaaaagctttcaatgaaaggcttctttgacatgagtttcaatggtgtagcgctcaatgtcgaattaactcatacctataaggatatatgcgatgccctttatagctga

SEQ ID NO: 4597 - DNA, 603 bp, Zymomonas mobilis
atgatgtctgccgtaccgaaataccggatgtcttttggtgtgggcgggctcatgctcaatgagagcctcgcgattgtgcaaagctatcaacccggtgagagctgggcgtctgctcgagagcgcttgctggcacagggcgcgtcatccttacccaaactggcctcgcaaacccgcacgcttcgtgaagtgtatgaccggataggccatctctcggatgccgagcgccagtacctgtcggcagaggctgaccgcgcagagcagcaagcaatggtgtggctggcggtctgccggacctatcgctttatatacgaattcgcagtcgaggtgatcagcgaacgctaccaatcatggcggcttgacctgggtcatgaggtttttgaccgctttctcgcggagaaggccgagagtgatcctggcctcgctgagctttcagcttcaacctgtgcgaaattgcgtcaggtcctgtttcggatattgcgtgaagctggcttgagaagtgtcgagggcagaattcagccgatttggttgtcggggcgcatgaagcggctgattgaggggagtaatccggcggacttgcgggtctttcccggaaatggggggtaa

SEQ ID NO: 4598 - DNA, 600 bp, Magnetospirillum magneticum
atggctgagcctcgatacaaggcagatatcggtggtggatcgctaaaactgccggaaagtcggatcattgcgggcttgcttctcgaaggggtcaccgaagatcagtggcgtcatgccatcgaagtcgagaacgtccttcaacgtcgcagccccggaactgcaaagcggcagtcgtcgctgatgcggaaccggctcgaaaccatggggccagaactctggcaaatggtacgggatggctcgacccaggttgcaatccaggcggtgtttgccgctgcgatcaagcattccacacttctgggcgacttccttgatctggtggtgcgggaccagttccgcatgttccgccccgacctgccaaggaagatgtgggatcaatatctggagcagtgccgaaaccgtgatccgctgatgcctgtgtggcaggacagtaccgccaacaaactggctgattgcgtctatcgcatcttggtggaggttggatacatcaccgattccaaaacctatcggttgaaatcagttcggatttcgggcgaggtgatgagctatcttcgcgagaataacgagcagtacgtaatccgctgcatccaggtgtccatatga

SEQ ID NO: 4599 - DNA, 615 bp, Marinobacter aquaeolei
atgacccaaggccggtatcgcatctccttcacgtccggcagcttgtatcaccgcgaatcggtgaagctggccgagctgtacctgtcgcttcatgactgggaagaggtgcgtgttcaggcgctacgagacaatctgctacagaccaggacagagagcacggcaaagcgaacttgtagagaggtgattgtacgtctgaagacgttgaccgaaagcgaactgactttcctggccgaggcaaaccaccaggaccaggcacatctcctgtgggtttccgtgtgtcgcctttatcgctttatcgcagactttgcggtggaagtgctccacgaacggtttgtcgcgatgaagctggatctcagttttgaggatttcgatgccttctataaccgtaaatcggaatggcatgacgaactggataatgccagcgcctcaacgcgcgataaattgcgacaggtcctgttcagaatgctgcgggaggcagggttgttagctaaggacaaaaccataaacgcagtactgctaagccccaggctgattgagttgctgcgtaagaacaatcctgacgagtttttctactttccagtctatgaatccgatatcagggggatgtcagcttga

SEQ ID NO: 4600 - DNA, 603 bp, Nostoc punctiforme
atgactgaaacggcttatgctgctcgtactaaccacgcttttgttttgactgaaacccttcgagttgctgaactgatgtatcaaggtgcaacccaggaagatattcggcaacgggtattggtggatgatttatttcaactacgctcccaagtttctcgtgagcgggcgctacaaactgttctcaaacgccttcaacaagtgccagaggaatatattcaattaattgccactagtaaccctgatacccgtcgattcaccatattgttcctgattttgcaagaacaccgccttctgcgcgaactcatcgctgaagtcctgctggacaaaattaaaggttttgattatgtcgtaacgactgctgacttgcgaaccttctttgaaggaaagcgagatcaaaattcaactgtggctgcatggtcaaactccacctataaaaaggctgctagcaacaccttactagtgctagtaaatgcgggtctattgcaacccacgtccccaagaggaaattatcaaattcgttctgttccggtgccatcagctttgcgtcaacaattactcgctgatgggctagctcattacctgactctcatgcttgatttttaa

SEQ ID NO: 4601 - DNA, 621 bp, Rhodobacter sphaeroides
atgactgttacagagcaccaaccctacaagatgtctttcgccacgggcgggctgcttctgaacgagagtgtcgaagttgcccgaatgcacgtgccatcagaggcttgggacaccacattgcggcgcgccttggaggacggtgtcacgtccctccccaaggccgcatcgcgccgcagaacgcttcgtgagatcgtgaaccggatttcaaccttggacgacgaggaactcgacttcttggtcgagggagccgatcgccaagaccagcaagctcttttgtggctcgctacatgcagagcgtatcgatttgtccgcgagttcgcgaccgaagtcattcacgagcgatttctttcgtttcagctcgacctgccgctggaaagctttgacatcctgttttccgccaaagccgaatgggatgaaggccttgccgggatcagtccgatgacccgcgcgaagctgcggcaggtgctgttccggatcatgcgccaagctagcgtgatctccgacgataaccggatcctgtctgcttatgtctcgcctcggctcaaggcgattttggcagagaaaaacccacgagacctctcggtgtttcctggattgagccgtgatggaggcattttgtga

SEQ ID NO: 4602 - DNA, 618 bp, Runella slithyformis
atgaagaaatatacattttcttttacgggagcatctgctttgatagccgaaacactggtgattgcggaagaattcgaacgattacaggattggaaggaggtacagaaatctttaatggaaagtaacctgttgaacaaggtgaaagaagttaccttcaaacgtgagttttccgaaatcaaaaaaagactgtcgctccttacagctccgcaattggcgctaatggtgcatggaagcttggatgatgccaaagccatgattttgctttcgctcgtaaaagcctatcctcttataaaagattttatcacggaagtccttttaagtaagcacctcgtgtttgaccgatcattgaccgaatcagattatatccggttctttaatgctaaaagtttttcgcacgatgaactgaataaaatcacggaaagcaccgcaaaaaaagtaaaacaggtagtctataaactattggaacaggtaggattgattacgaatgcaaaaaacggcaccatcatccgacccatattaagtacaaatgcattggacgtaatcattaccgacaatccatcgttcctcaccgcctttcttttttctaatgaagagataaaggcgtattacatgaaataa

SEQ ID NO: 4603 - DNA, 768 bp, Halobacterium salinarum
atggcgctcactagatgcggacttctcgtggatagggcggagacgctcgctcggctatacgctcgacatcgggactggacggtcgtcgaagagaaatggatcgaagaacgattcgacgaacgcagtacgcgtggaagttcgaagggaatctaccgcgcactgagttcccggttcaaaaccgttggtagcgaacttccgtccattgtccagctcccctctgtcctcgaccagtgtgaaacggtgcgcgacaaagcccaggtgctgtatttctacttgttggaggacgaccccctcgtgaagtacaccgttcatcggtacgtcgaccgacttcaggagtccggtgtcgataggctggacttcgagcaagagacgatcgagcgcctcttgaacgagtttcactacgacgacgggagcgagttcgactatgcggaatcgacgaggcgtcgatggggcgaggggctccggtcggtgatgcgagagatcggtgttctcgacacacagcaggcgctttatggacaaatcccaaatcttgggacgacgcctctgctcgtcgcgtccggatactcgtgggaaacacacggcgatgactggctctcccaaccgaccggctggctctatcacttccagccagaacagtactgggactctttggccgaacgtgtgagcgacgatccaaactgggaagcgagcgggattcacggtgagctaagactccaaccggtcgacgggacatacgactgggccgagtcgtgggagggcgaagtatga

SEQ ID NO: 4604 - DNA, 843 bp, Haloarcula hispanica
atgactctccgcaccgacgggaggggtgtttctctaccgtcgctcgactcgacgttttctgacgacgaagtgacgatggttcttactagatgcgggcttctcgttgacagagcggagacgctcgctcgactgtacgcccaccatcgggactggacggttgtcgaagagaagtggatcgaagagcgattcgacgagcgcagcacgcgtgggagttcgaagggcatctaccgcgcactcagttcgcggttcaagaccgctggcagcgaacttccctctattgtccagctcccctctgtactcgaccggtgtgagacggtgcgtgacaaagcgcaggtgttgtatttctatttgctggaagacgatcccctcgtgaggtacacggtacatcgatacgtcgaccgcctgcaggagtccggtgtcgacgggctgggattcgagcaggagacgatagagcgcctcctgagcgagttccattacgaggacgggagcgagtttgactatgctgaatcgacgacgcgacggtggggagaggggctccggtcggtgctgcgcgatatcggtgttctcgacacacaacagaccttgcagggacagatcccaaacctcgggtcgacgccgttactcgtcgcatcaggctactcgtgggagatccacggcgacgactggctctcccagccgaccggctggctctacctcttccagccggaccagtactgggacgccctggccgaacgcgtgagcgacgatccgaactgggaagcgagcgggattcacggtgagttgcgactccagccggtcgatgacacgtacggctgggctgaaccgtgggagggcgaagtgtga

SEQ ID NO: 4605 - DNA, 840 bp, Halophilic archaeon
atgaccctcgtcgccgacggaagtggtcctcccctcccgtcgctatctcgtcagctctctccaggagacgtgaatatggatttgaccatgtgcggtctgcttgtcgagcgagccgaggaactcgctcgactctatgccgaacacgggaactggaacgatgtcaaagagagatggttcgacgaacgactatcgaaccgaagcacacggggcagctcccagaagatctaccgtgtgctaacgtcacgtttcaaaaacgctcccacggacctcccgaacccaagcgttctgccaacgatattcgacgagtgccagacaacgcgcgataaagcacagatactttacctctatcttgtcgccgacgactcgcttgttcggtacgtcgttcacgaatatatggcccgcctcacagatggtaacacagattcactggacttctcgaacgagacgcttgtcgatatcctcactcacctcgagtattctgacggcggctccttcgactatgcggattcgacgactgagcggtggtgcgagggctttcgatcagtaatgcgtaaaatcggcgtactcgacgggcagcaatcagtcgttggcacatctccgtcagtgggtgatactccgttgctcgttgcgatggactattcgtacggaagcgacgacgaggactggctcacttcgccgcgggggctgctctaccttttccagcctgcgaaccgctggggggaactcttcgaccgggttgcaagcaccgacgcatgggagtacctcgaacttcacggcgacctcgacgtacgccccagcgatgagccgtactcgtgggtacacgatggaggtgaaaattaa

SEQ ID NO: 4606 - DNA, 834 bp, Natrinema pellirubrum
atgaacactctaccggacggcgataacggaccgccgtctctttcccgtacattctctcccgaagaggtcaacatggatttgaccatgtgcggcctcctacccgaccgagcagaagagatcgctcggttgtaccgtgaacacgggaactggaaccaggtcaaggagatctggtttgaggaacgacgtgcgaaccgcagtacgaaggggagttcccagaagatacaccgcgttctctcatcacgattcaaaaacgcacctgccaccctccctaatccgagtgatcttcccgccgtcttggatacctgttcgtcatcgcgagacaaagctcaagtgctctacctctatctagtcgccgatgacgcgctcgttcgatatgctgttcacgaatatgcccgacgccttgctgaggactttcccgaacctcttgacttctctaatgagacactcacctctgtcttgaatcagttcgaatacactgacgagacaccgttcgactatgcggactcaacgacagagagatggtgcgaaggactgcggtcagttatgcgcgagatcggcgtcctggagaatcagcaaacggtcgtcggtaatccaccatcactaggagagacgccactccttgtcgcaatgggctactcgtatgaggaaggcgacgaagagtggttcgaatcaccaactggactccagtacctattccagccgagtgcccgttgggaggaactctacaatcgggcagcagagactgaggcgtgggagtttgtcgatctccatggaagtctccaactgcggccgaccgacgagccgtactcatcgattacgagtggagggatctga

SEQ ID NO: 4607 - DNA, 783 bp, Planctomyces limnophilus
atgcctcggccttcggagaccacggcatttcacacgcgactcctcaagtgctcgcttgaggttgagcattgtcgcgcttactggcatcgtgttgccgaagccgccgatgacactatcacccaaatcgcatttaaagagtactggtttggggcgaggagtttgccacgtgtcactcggcttatcaatgatttccgacatcgatttgaccagttcccgcctgccatgtcgatcctgcatcgatgggggacaatggactcaagcactcgccgcttgatctgtcattggcacctgcagttggctgatcggctctaccgcgaattcaccggcggcttcctagtcgatcgctattctgccgggcgaaccgaaatgaccagagatgttgttgttcgctggatcgatcattccgctccccagcgctggactaccgccacacggatacagtttgcgagaaaactgctcttttcggcaggcgaagctggcatcctgaagggaacccgagatccacgtgaatggcaggcgccgcgagtgaccgacgaagcactaagctacattttgtatctgctgcgtgaaattcagtttcaaggcacgctgattgacaacccgtatctggcttcggttggcgtgaccggtccggaacttgagcgacgatcgagaacgttccccgactgccctctccgaagacagggagaactctttgagttctcatggcgatacaaggatctcgcggagtgggctgaggcgaggatcctccatggggaatctcaactgcgggagacagcatga

SEQ ID NO: 4608 - DNA, 795 bp, Anaeromyxobacter dehalogenans
gtgatcgagctcggtgaggtgcgggagcccgtcgcctcgagcgccacggctccgtccgaggagacagaggtacacacccgcatcctccgactcgcgctcggcatcgaagaggcccgcgcgtactgggcgcacatggatccagccgtcccgcccggcgcgcgtgctctccaggcattcgatcagcgctggttcggcgcgaagaccctcgagcgcgtcaagacgctcctgccctacctcgccgcgcggtacgacgcgttcccggaggcactcgacgtgctccgccgttggcggcacatggaccccgccgcgcgccaggtgatctgccactggcacgtccagctcagcgacccgatctaccggcgattcaccggcgagttcctcgtcgagcggcgcacgctgctggacccgaaggtgcatcgccccggcgtggcgcgctgggtgcgccaggcgttccccggccgctggaccgagtccacgatcgtccagttcgcgtcgaagctgctctccgcggcgtccgaggccggcctcgtctcgccgaagcgcgatccccggtcgctgctcttccccaaggtgccggacgacgcgatcgtctacctcctgcacctgctccgcggcatccgccacgagggctcgctcacggagaacccgtacgtcgcgtcggtcggtctcgcggacgggttcctcgaccagcgcctcaggacgatcccggcggtcacgctccgccgcatgggcgccctcgtcgagctcgactgggcgcacccgacccttaccgcgtgggcggaggcctcgctgtga

SEQ ID NO: 4609 - DNA, 789 bp, Haliangium ochraceum
gtgacccggccgggcgaagccacccacatccacacgcgcatgatgaaatgcgcgctcgaagtcgaagaatcgcgcgcctactggcagcacaccgacggcagcgaccgcgccgccccgcagcaagcatttgacgccttctggttcggcgcccgcagcatgccgcgcatcaaggtgctgctcatcaacctgcgcgcccgcttcgacgctttcccgcccgcgctcgcggtcctgcatcgctggcccgacatgtcgcccgacacccgcaagctcatctgccactggcacacgcagctcgccgatccgctctaccgcgccctcaccggcgatttcctggccgagcgccgcctcggcccgcgccccgagatcacgcgcgacctggtcacgcgctgggtgggcgagcagggggccgagcgctggactttgcccacgcgcatccagctcgccagcaagctcctgtccgcggcccgcgccgccggcctggtcgccagcaaccgcgacccgcgcccgctcaccgccccgcgcgtgcccgacgacgcgctcgagtacgcgctctaccttctccgcggaatcgaaaccgccggcccgcttctcgacagcgcctacttcgcctcgctcggcctcaccggcggcatcctcgaagaccgcctgcgcgcgctgcccggcctgcgctttcgccgccagggcgatctcgtcgatttcggctggcgctaccccgacctggccgcgtgggccgacgccaagctcggcgccgcgcccgtggcccagcgcgcccaggaggccgccccgtga

SEQ ID NO: 4610 - DNA, 789 bp, Haliangium ochraceum
gtgacccggccgggcgaagccacccacatccacacgcgcatgatgaaatgcgcgctcgaagtcgaagaatcgcgcgcctactggcagcacaccgacggcagcgaccgcgccgccccgcagcaagcctttgacgccttctggttcggcgcccgcagcatgccgcgcatcaaggtgctgctcatcaacctgcgcgcccgcttcgacgccttcccgcccgcgctcgcggtcctgcatcgctggcccgacatgtcgcccgacacccgcaagctcatctgccactggcacacgcagctcgccgatccgctctaccgcgccctcaccggcgatttcctggccgagcgccgcctcggcccgcgccccgagatcacgcgcgacctggtcacgcgctgggtgggcgagcagggggccgagcgctggactttgcccacgcgcatccagctcgccagcaagctcctgtccgcggcccgcgccgccggcctggtcgccagcaatcgcgacccgcgcccgctcaccgccccgcgcgtgcccgacgacgcgctcgagtacgcgctctaccttctccgcggaatcgaaaccgccggcccacttctcgatagcgcctacttcgcctcgctcggcctcaccggcggcatcctcgaagaccgcctgcgcgcgctgcccggcctgcgctttcgccgccagggcgatctcgtcgatttcggctggcgctaccccgacctggccgcctgggccgacgccaagctcggcgccgcgcccgtggcccagcgcgcccaggaggccgccccgtga

SEQ ID NO: 4611 - DNA, 711 bp, Acetohalobium arabaticum
atgaaaggattcgatagacctttaaagccagaatgggtatacgaaatgattcaaaggttagaagttggtgataagctttcagagcataaagaagaattggacgaagtattaaaagaattgactgggaagacagggaaacgtaaagtcagaaccgtaattggacgttattttttaaaggatttggataagccgcgacaacgttctgtgcaggatagtttgatttttagattaattaaagagcagcaattggatgaagtaaagcctgtcatgctttttaatttattagttaaagcccctatcttgcagtatttttctgaacaattatttaacttatatgaaagacagcaagaaataaatgctgcttttttacgtaaaaaagcatatcaacgaattggagaaagagatattgcacggcgatcattgaggaattttctcagtactttaactgattttggtattttacagcagcaagatagaaagatttttatctggaataaaagattaatagttaatgaagagaactttattaactttttgaagttatatagcaaattttatctaaagtctcctcaaatatccttaaatgatttacctgaatatttattattttattttgatttaccgaatgttagggaaatagcccaaaaatataataatgttcactgggattatactagaagattacaggcagcgattgttactttgtattga

SEQ ID NO: 4612 - DNA, 783 bp, Acidothermus cellulolyticus
atgatgaagcacccggtgcagatcggcttcagccaacgcgtgcgtctcgaatggtacgagagcacggcaaacctcgtactggctggaaatgatgaagtgtcgatctaccacattctcgatgagatgctcaaagagacgttgtcggtcgttggaaatgcgcgacgaggtactcgagagaaagtcatcaccattctcatgaagatctgggttcgacccccacgtcaccttgaagatatgaagcgggaaggactccagttccttcagcgcttgtcacgccgggatcgcatcacagtccactggggtatgaccatggcggtctatcccttctggggaaccgtggcaacttacgttgggcgactgctcagacttcagggtacggccactgctggccaggtgcagcggcgcgttcgggagcaatttggcgaacgcagcacggtcacgcgagcaacgcaacgggtgctgcggagctttattgattggggagtgctacaggagacgtcggagcgaggcagttatgcggctggatcggtgctggacgtgactcagcgggacgtcatcgcgtggctggtcgaagcagccttacacgcccatcaagtccgcgctgcaccgctcggaactgttcttgagtccacaagcctgtttccgttccgctttagttacctcccgccgatgcgcttagttgctgaatcggaccgtcttgatctgctgcggtacgatttaaatcaagaattaatcacgtcccgctcgaatgctccgtccgtggcgcgcagcggaggtatatga

SEQ ID NO: 4613 - DNA, 780 bp, Anaerobaculum mobile
gtgccacataacggccagctaacgtcacaaaaaagattttcacaaattggttttagtaggctgatacgcctagagtggctggaaagaacagctaatttagcccttgccggaaacgacgagtcatccatttatgatgcccttcaaagattgctagacaataagctctatggtggtaaaaacgttaaaggtggcagtagggaaaaaacaattgctattttaaggaaagtatgggttcgtcctcccatccatctgatttgtcttagagacgatggcctggaaattttatcgcatatcccacgtgaagagcatgtaataattcattggggtatgaccatggcagcatatcctttttggagtgctgtggcaatgcatataggaaggcagctgagacttcaaggtacaacgtcagtcggccaagtgcaacgtcgcattagcgagcaatatggagaacgaggtgcagtatctttggctgtacaaaagatatttcttagccttgccgattggggtctgcttagtagaactgcaaatagggggatttatgtcccagggctttcatttgccattaatgacataagggttattgcttggctggtcgaggcttttttgcatgtccaccaagggggtccgttgatgttggataccatacttaactcaccaagtttatttccctttcttattaacccagtgtcagctggtcaattggtcaaggcctcagggcgcctcgatgctttctcagttggaattggtcaagattttttggtaataggcaaggctaactag

SEQ ID NO: 4614 - DNA, 615 bp, Bacteroides vulgatus
atgggaaaaactgttggaatcaatcagcgaataagtataaatgtaattgagatggctatgaaagcagccttagaagggtgttattcatctgaatttgcagcagatttggcttcaggagaatatgaagggagcaacagaataaataaagcacgcagtatcataggtagattatctatacgtaatcctttattcccttttattgaagaacacaagaatgagtattatgtagcaatgaagcataaaagtgatagagcaattatctttacatctttaattaatgccgcatatagttttggatatgatgcaatggttgtccttggaaaattcttccatgttcaggatgaagtatcaacacagctcatactaaataaaatgtcttcaatatacgctagtaatcgttctttgcccaatgctctatattgtataatgccaatgtacattgaagccggtctgataaaccgtcctaaaacaggcatttatacaaaagtgtattacgaaggcgtttctacatttgcccgtaaactatatattaaatcatttttggttcataataatttaatacaagaagaggatattgactctttggaacatccttattttgagtttattctatag

SEQ ID NO: 4615 - DNA, 714 bp, Caldicellulosiruptor kristjanssonii
gtgaagacaataggatttttaaaaccagttcgagttgaatggttgaatataactgttgaagaactcatcaaaggaaaagagaagaatgaaatcagggatgtattaaagagaattgtgtcgaactattataaaagtgaggatacaataagaaaaatattaacaatattaatgaacacatgggtaaatgccgcagaaaaaaatatgtgtttaagagataggggagttgatttatttaaaatagcgaacccagacgaaaaaatagcgttgcattttggcatgctgatggttacttatccaatattcaatgatgttgtctttattattggaaaagctttttatctcgaaaataaatttaagctggaatatctaaagaagagaatatttgaaaagtggggagaaagggaaaccctaagattttcaattgatagaataattaaaactctcaaagattggggactgattgtcagtaaaaattctggtgtatatgaaccaaggacaaaagtgacaattactaataaagatataaaagcatttttgattgcttgttatttaaaagcaaatgaaagaagttatattgacatcaatgagattgaaaatttatattctttttttccgttcaacataagcgttaacttaaatgaactgatgaatgtagatggtttgaatgtaaataaaattgattctgtaataacggttgctgtaaataggttgtaa

SEQ ID NO: 4616 - DNA, 783 bp, Chloroflexus aggregans
atgaaccgtcgcctgaaccagatcggtttcagtcagcgggttcgtctggagtggctggagcgcacggcaaacctcgtgcttgccggtaatgatgaagccgccatgtaccatgacctccaagagctgctcaaagataaactatctgttggagggaacgcgaaacgcggtaatcgcgagaaggtcatcaccatcctgatgaagatttgggtgcgaccacctcacgagctgctccccctgcaccgagaaggtctcaaccttctcgcccggcttccacgcgaggagcatatcgcaatccactggggcatggcgatggcagtgtatccattctggggcaacgtcgcagcgcaggtcgggcgactgctcaggctccaaggatcggtcaccgccggccaggtacagcgccgcgtgcgcgagcaatacggggaacgtgataccgtatcgagagcggcccaacgggttctccgcagctttgtcgattggggagttctgaaggaaacatcggcggcaaaaggcatctataccgccgggctgacgcgcaccatcgatcaggtggaggttatcgcatggctggcggaggccttcttgcacgcccatcctggtggttcggtggcgctgagaagccttctcgatgccacgagtctgttcccgttccatctaagatatgttcccgcagctcatctggtcgcggtctgcgaccgcatcgacgtgctccgccacggtctcgatcaagacttggttatgctccgcccggaacggctgctggtggcgcagagaggtgaatga

SEQ ID NO: 4617 - DNA, 756 bp, Desulfovibrio aespoeensis
atgggcaaaagacacgaagccatcggcatcaagcaggcgattcgttttgagtggatgcagaaagcagccaatctgctgctggcgggactcgacgccaaaaccatccgccaggagctgcatgagttcctcgcggatcgaaaaggcaacggctccgaaggcgaacgaagcgatcagacccggacctttgtcgtcaacaatctgatgaagatctgggtctctcctgaccccgagttgattccattccgggatgcctcgctggcgttcctgagggaaaccccgtcaatggccctggcgatccactgggggatgatttcggcggtctatccgttctggttcaatgtggcccggcagaccggccgtctgctggccttgcaggatcaggtgacccagacgcagatcatcaaccgcctgaaggaacagtacggcgaccggcaaaccgtaagccgctatgcccggttcgtcatccgctcctttgtcgcctggggagccctgaaggattccgaggccaaaggctgctatgagaaagccgctccggtgagcattgccgaaccaaacctggccatcttgatgttcgaatccgcactcctggccaccccggaggccaagggcgcattggggctgctcctgaacaacccggcattcttcccattccagctccccgtgatgaccggtgattttgtatcccagcgcagcgcccggatcgatgtggttcgctatggactggacgatgagctgttgaaattgaagggcaactaa

SEQ ID NO: 4618 - DNA, 756 bp, Dichelobacter nodosus
atgggcaaaagacacgaagccattggcatcaagcaggcgattcgtttcgagtggatgcagaaagcagccaatctgctgctggcgggactcgacgccaaaaccatccgccaggagctgcatgagttcctcgcggatcgaaaaggcaacggctccgaaggcgaacgaagcgatcagacccggacctttgtcgtcaacaatctgatgaagatctgggtctctcctgaccccgagttgattccattccgggatgcctcgctggcgtttctgagggaaaacccgtccatggccctggcggtccactgggggatgatctcggcggtctatcccttctggttcaatgtggcccggcagaccggccgtctgctggccttgcaggaccaggtgacccagacgcagatcatcaatcgcctgaaggaacagtatggcgaccggcagaccgtgagccgctatgcgagatttgtcatccgctcctttgtcgcttggggagccctgaaagattccgaggctaaaggctgctatgagaaagccgcgcctgtgagcattgccgagccaaacctggccatcctgatgttcgagtccgcactcctggccaccccggaggccaagggtgctttggggctgctactgaacaacccggcattcttcccattccagctccctgtgatgacaggagattttgtttcccagcgcagcgaccggatcgacgtggttcgctatggactggacgatgagctgttgaaattgaagggcaactaa

SEQ ID NO: 4619 - DNA, 714 bp, Methanocaldococcus sp.
atgccaataaaagctcgatgggtgtatgacttattgaacatattagaacctggagataaaaatgatgaaataaatagaaaaatagatcaaatactttttgaaattgctggaaaagaaagtagaagaaaaattaaaacaatattacttagatattttgttgagactaaaaaaattgatgcaaggacaattgaagttcaaagttctccattactatactattcaaaaaattatgatttccaaatcatgaaacctctatatttagaagttttattaataagaagtaactcaattagaatcatattaaactcaatactaaaaaaatatgaaaatataaacttcaaacgaaaggatgttatggagattgttagcacaaaatttggacaaagaagatcaacagaaaaatttgtggataattttcttaaagtcatggttgaatttgatatattttcaaaaattgatactggcgtatatgcaataaaaccaaaaattaaactaaatgaaaaacaaaaggtattatttatactgttatattcatactatacaaaaacatctacaattgaattacaaacatttgatttaatacaagaatttaatgtatttgatttagattttgatgaaatcttacaaaaatataatggaaaattatggcagttaagttatagagcaggcggatatttagtatatatcacgcaaaaatttgatattattatataa

SEQ ID NO: 4620 - DNA, 750 bp, Methanosalsum zhilinae
atgagtaaaaggtatgattccattggaataaagcaggttattcgttatgaatggatggaaaaaacagctagtatgcttcttgcaggaatggatgagaaatcaatacgttcagagtttaatgagtatctaatgcattatagatgcggtggttctgaagatcaacgaagtaagaacacatgcaaatttgtcgttgccaatctaatgaaaacctgggtatctcctgaacctgagcttttaggtttacgggattctgccttagagcagctacgcaaatatccttctgaatctcttgcaatacactgggcaatgatttgtgcagcttatcctttttggtataacgtatctttgcaggtggggagacttttgaaccttcaagatcagattactctacatcagataaccaacagactcaaagagcaatatggtgatagacaaactattagcaggtatgccagatatgtgattcgttctctcgtagaatggggtattttaaaggattcagaatgtaaaggatgttatgtaaaagcaaatcaactaaacgtacacgatgatgaaattgttgttttgcttgtagagtcagtattgtatgcaataccagaaaataaaggatgttttaaaatgataacaagttcacctgcactttttccatttcagttatctatgatatcagttgattacatctcaaataagtcaaaccgaataaatgtaattacttatggtctggatgaaatttttttgcaattaaagtga

SEQ ID NO: 4621 - DNA, 795 bp, Methylacidiphilum infernorum
atgagtgcacggcccaaccgacgatacaaccaaatcggactcgatcgtcttgttcgcctcaagtggctggaacggactgcatatctctttttggcgggaaacgaggcacccgctgtgaagacagcactacaagaagatctccagaaaatgtttcgttccaataacacgaagatacgcggctcgcttgacaagacgatcaccatcctgatgaagatctgggtccgcccaccgcacgacctccatccccttcaccgggaaggcctcaagcttctctcacaccttccgcgcaaggaccatatcgcagttcactggggcatggccatggcggtttatcctttctggggaaatattgcggcccatgtggggcgactgctcaggctccagggaacggccgtagccagccaggtacagcgccgtgtgcgggagcaatatggggaacgcgacacggtatccagggcggcacaacgggtgctgcggagtttcatcgattgggaggtcctgaaagaaacatcgaaaaaaggcatctataccgcagggctttcactcgccatagctcaggtggaggttatcgcctggttggccgaggccttcttgcacgctcatcccaacggttcggtggctctgagaacggttctcgattccacgagcctgttcccgttccgtctcagcccaatatccgcagatcacctggtcgcggtatccggacggctcgatgtactgcgacacggccttgaccaggacttgatcatgctccgcacgaaaagccagccagcggcgaaaggaagcggatcatga

SEQ ID NO: 4622 - DNA, 741 bp, Moorella thermoacetica
ttgtcgagaaatattataattggctttgaccggccgctcaggccgcactggatttacgaaagcctgctcctggcaaggccagcccagcgattggcggaactatatgctccctttgagcagatagtgcgggagttaactggccgggaaggcaaacgcaaggtccgtaccgtcctctttcgctgctttttgcgcgatgaacaaaataaggccagggtaaggccgaacctggtattgaaggatttgagcctgcaatatggcctggacttcatgacacccatttaccttttttacctggtggcccggaccgaagtattaagaaggatatccgaccacattttccggctttacgattatggtagcgaaatcaagttgggatttctcaaagccaagatggtagaaagctttggagaacgagacgtggtgcttcgttctgccagggcctttatccagacccttgaacatttcggcgtggtagccaggcttgacggccggctgatcttgtataggaagttaccggttagcgaggaacaggccattattatgttgcagctctttgcagccgacatcctgcattccccgcagatttccctgcaccatctccccgccgccgtgttcaacttctttgatctgccggatctgaggacagtagcgcagaagtataacggtgaattgtgggattaccagtaccggatggtggatgcctatctggtgctgcattcaggtgatttcccagaaaggtaa

SEQ ID NO: 4623 - DNA, 768 bp, Nitrosococcus oceani
atggacaaacggcacgaggccattggtatcaaacaggccattcgctatgagtggatgcaaaaagccgcttacctccttcttgccgggctggatgctaaggctattcgacaggaactccatgactacttgagcgatcgcatgggcagcggtgtgcgtgcagaacgcagtacagaagcgaggtcattcgctgtcacgattttaatgaacatatgggttacccccgacccggtattggaaacattgagaaacgatgctctgccctatctggcacagggccgaagcgctgaacttgcggtccactggtcgatgatcggcgcggcgtaccccttttggttcaatgtggcgcgccaaacagggcgtttgctagcgctccaagatcaggtcacgatgaaacaggtctctaggcgtttgattgaggtctacggtgagcgccaaaccgtgagccgcaatgctcagtttgtcgttcgctctttcgctttctggggcgttctcaaagatactgcacagcaaggttgttatcaaaagatagtatcagcgcctatttccgatcttaacttagtatctttaatgctcgaggcagccctacatgccatccccgagggcaagggaactttagacctgctattaaataacccggcattctttccattccagctcccgctgatgacaggcgactttatcggacagcgtagggagcatattgagataatccgctatgggttggatgatgagctgttgatgctgaagaaaaaacaaggagagcgctaa

SEQ ID NO: 4624 - DNA, 768 bp, Nitrosococcus watsonii
atgggaaaacggcacgaggtcattggtatcaaacaggccattcgctatgaatggatgcaaaaagccgctcacctccttcttgccgggctggatgctaagactattcgacaggaactccatgactacttgagtgatcgcatgggcagcggtgtgcgtgcagaacgcagtacagaagcgaggtcattcgctgtcacgattttaatgaacatatgggttacccccgacccggtattggacacattgagaaatgatgctctgctctatctggcacagggccgaagcgctgaacttgcggtccactggtcgatgatcagcgcggcgtaccccttttggttcaatgtggcgcgccaaacaggacgtttgctagcgctccaaaatcaggtcacgatgaaacaggtctctaggcgtttgattgaggtctacggtgagcgccaaaccgtgagccgcaatgctcagtttgtcgttcgctctttcgctttctggggcgttctcaaagatattgcacagcaaggttgctatcaaaaaatagtatcaacgcctatttccgatcttaacttagtatctttaatgctcgaggcagccctacatgccatccccaagggcaagggaactttagacctgttattaaataacccggcattctttccattccagctcccgctgatgacaggcgactttatcggacagcgtagggagcatattgagataatccgctatgggttggatgatgagctgttgatgctgaagaaaaaacaaggagagcgctaa

SEQ ID NO: 4625 - DNA, 723 bp, Parvibaculum lavamentivorans
atgatgacgttggctccacgaataggctttgatcggttcatcgccctcgaatgggcaacgaccgcgctgaaagttcgcgccggtacagccaagctcgaagatctggagtcattgctggatgccgccggtttgggggccgccgcgcgaacgaagacacgcacggtgttgaaacgcctgtggctggacccgcgcgttgagttggtggactttgcggatcgcggtgcggcgatcttcaaggcgcacccggatgtgcccgtcacagcaatgcactggggcatggccgttgccacctatcccttcttcggcaaggttgccgaactgatcgggcgcttgtccgccctccagggtgattgcgcgtcagccgaaatccatcggcgcatgagcgaagcctacggggagcgcgaaggcacctaccgaatgaccaatatggtcatccaaagtcaggccggctggggtgccgtggagcggattgaaaagggcaaacgtgtcctccgtcttgcccccgccgttgtggagaacgacgaacttacggtatggctgatcgaagcggccgtgcggaatgcgggcaggccgttggcaattccaagtctgcaatcactacccgtgcttttcccgttcagcctgacacgtccgttggcctacctcgtgtccaacaacgactacatggctgtcagaagtgatgggccgaacagtcaatatgtcgccttgcccgacaggatttga

SEQ ID NO: 4626 - DNA, 723 bp, Parvibaculum lavamentivorans; identical to SEQ ID NO: 4625

SEQ ID NO: 4627 - DNA, 813 bp, Planctomyces brasiliensis
atgaccgctgttgttggtttcgatagaaaactcaagttggagtggctggatgacctagccgatcaggttgcgaaaggcgaggacgtttcgacgctgcgcacttttcttcacgagcgactcgaagaggaccatcccggagaaaccgctcgtggcaagagcatcaccgttttgatgcgaatctgggtcttcgtacccgacgaacaccacgagattcgagaacaggctttcgagcttctcaaacgcatcaatgcgaaggaccgcatctggcttcattggggcatgtgcattctggcctacccgctttttcgagacacggcaacggccatcggtcggctcttgaaactccaagacgaattcaccctcgctcaacttcaacggcgactcatcgacagttggggtgagcgatccacggtggttcgtgctttccaacgagtcgtgcgcagcatggtcgagtggcacaccttggaagatgcggacactcccggccacttccgagcgccgacgaaggtgaccaccaagtccaagtccttgcagatttggtttcttcgtgcgtgccacgctgcaaccggcaaggagatggtcgaggtcgatcagttgctcagtttgccatcctccttcccattcaagatcacggtggcgaagtctgaccttaggaactcgaaagatttttccatccatcgccaagggctggatatggacatggtgacgacgacggcgagcaacagtaagcccaagccggtcaagaagaagacagcaaagaagaaagtcaacaagtcgcaaagaagtctctttgatgacgaccaatccgagtaa

SEQ ID NO: 4628 - DNA, 723 bp, Syntrophothermus lipocalidus
atggccttaaatatcggttttgaccggagagttaagctggaatggctggatgccgccgcctggaaagccgcaacggaaacagacattgctgaggtacggaaataccttgatgatttcttgcagtcagaatgtcgaagtagagaggcacgcaggaagaccataaccgtattaactcggatttgggtcaggttaccgcagaagcaccggtcattacaggagcgggctttaagaattttaaccgaggacgaccccgatacaagactctggttgcactggggcatgacacttctagcctatccattttttcgcgatatagcggatattattggtcgtctgttgacattgcagaatgaagtttctctagagcagatttaccgccggctggcagaacggtggggagaaagatcaactgttcgccgggcgagccaacgagtggtgcgttcgatggtagactggggcgttctccaggatacggccctaaaaggcgtttatatccccaccgccaaaaaaggcccggccagcgctagtgttcagttatggtttttagaagccctgttgtgttcggaagcaacccaagcggtgatcctgcaacaattaccccagctgcccacagcttttccgtttcacctggatatttcggtggcgaatatacggcaatctaaacggtttgaaatacagcgtcagggtttggatttagacatggttacaatcgtacaccggtaa

SEQ ID NO: 4629 - DNA, 708 bp, Tepidanaerobacter acetatoxydans
atgcgaatagttggtcttgacagatttttaaaaggtgagtggctggataagacgatggagattgcaagtaatgaaagcgatattagtttaataagagagaccttggaagaatacttgaaacaagaaattcccggcgatattacaaggcgaaaagccagggataagctgatggctatatgggtaaatatcccggaagaattagaatgtataaaaagtgaggcaattatactttcaaataaagtctttaatcaagagcgattactgcttcattggacaatgatgtttgcggtttatcctatttttagggatatatctacaattataggcgctattactgattttcaagatgatgtcactttgtcgttggtggaaaagcgcatttatgaaatttggggagagcgcagcactgtaaaatatgcagtacagaaaatcatgagttcaatggttgattggcaggttttagagcgaaggggtaatggtaaatttaagaagaagacacctataaaaatagaaaatacctcgctaaaacttctttatttaaaagcgtatctttcggtaaataacaaagattatatagaatttttcaaagcaaataatataaagagtgtctttccctttgaaatccaatacaaaatggaagattttgcattatctgatgaatttgctttagttaaaatgggaagtgatgtggccatttccctagcatag

SEQ ID NO: 4630 - DNA, 708 bp, Tepidanaerobacter sp.; identical to SEQ ID NO: 4629

SEQ ID NO: 4631 - DNA, 753 bp, Thermanaerovibrio acidaminovorans
atgaacagtcgcctgacccagatcggtttcagccagcgggtccgtcttgaatggctggagagaacggccaacctggtgcttgccggaaacgacgaggcgtccatctacaacgccctccaagagcttctcgaagacaagctgtctgtcggcgggaatgccaaacgcggcaatcgggagaaggtgatcaccatcctgatgaagatctgggtccgccccccgcgcgacctccatccccttcagcgggaaggcctcaagcttctctcacacctgccgcgtgaggaccatatcgcggtccactggggcatggccatggcggtttatccgttctggggggccgtagcggcccatgtggggcgactgctcaggctccagggaacggccgcagccagccaggtacagcgccgcgtgcgggagcaatatggggaacgcggcacggtatccagagcggcacgacgggtgctgcggagcttcgtcgattgggaggtcctgaaggaaacatcggaaaaaggcatctataccgctgggctttcactcgccatagctcaggtggaggttatcgcctggttggccgaggccttcttgcacgctcatcccaacgcttcggtggctttgagaacggtcctcgattccacgagcctgttcccgttccgcctgagccctgtttccgcggctcatctggtcgcggtctccgggcggctcgatgtgctgcgacacggccttgaccaggacttgatcatgctccggagcagatga

SEQ ID NO: 4632 - DNA, 708 bp, Thermoanaerobacter brockii
atgaaaaaagtaggttttgctagaagaataaaacttgaatggcttgataaagttgtagaattttataaaaatgaaaaagatgttaaaaaaataaaggacgagttagatgcgtttttagtggatcaagtaaaaagtaaggtaaatagaggaaaaagtatagatgttttaataagtagttgggtagatgttccggaggaatttaaatatctgagagacaaagcagtggtattatttgataaggtgtctgaaggagaaaaaaagtttattcattggtttatgcttatatcagcttttcctttatttagtgatattagcactgttataggtaagttattgagtattcaagaagagtttaagttagatactgtaagacagagaatatttgaaatatggggagaaagaagtacagttaaatttagtacggataaaataatctcttcaatggtagaatggggagttttatcaaaagcacaaaaaccaggtatatataagaaagctaacacgattgaaataaagaataaagaattgaaacttttatttttggaagtatatcttaagtcaaataagaagtcattcataagttacgctgaaattgataaattgtatgtaatatttccatttgaattgtcttttgagttaggggatttttatgattcaccggttttaaatgtgaataaaatgggggataatacggtaattgttatttag

SEQ ID NO: 4633 - DNA, 708 bp, Thermoanaerobacter italicus
atgaaaaaagtaggttttgctagaagaataaaacttgaatggcttgataaagttgtagaattttataaaaatgaaaaagatgttaaaaaaataaaggacgagttagatgcgtttttagtggatcaagtaaaaagtaaggtaaatagaggaaaaagtatagatgttttaataagtagttgggtagatgttccggaggaatttaaatatctgagagacaaagcagtggtattatttgataaggtgtctgaaggagaaaaaaagtttattcattggtttatgcttatatcagcttttcctttatttagtgatattagcagtgttataggtaagttattgagtattcaagaagaatttaagttagatactgtaaggcagagaatatttgaaatatggggagaaagaagtacagttaaatttagtacggataaaataatctcttcaatggtagaatggggagttttatcaaaagcacaaaaaccaggtatatataagaaagctaacacgattgaaataaagaataaagaattgaaacttttatttttggaagtatatcttaagtcaaataagaagtcattcataagttacgctgaaattgataaattgtatgtaatatttccatttgaattgtcttttgagttaggggatttttatgattcaccggttttaaatgtgaataaaatgggagataatattgtgattattagataa

SEQ ID NO: 4634 - DNA, 708 bp, Thermoanaerobacter pseudethanolicus; identical to SEQ ID NO: 4632

SEQ ID NO: 4635 - DNA, 708 bp, Thermoanaerobacterium saccharolyticum
atgcaaaaagtgggctttgatagaatgatagaaattgagtggcttaataaaacggtagaaatttatagtaaagaatctgatataaagattattaaacaagaattaaatgattatttaaaagacaaagttatttctgatgataatagaagaaaatgtgtaaatatactgacaagtacgtgggtttcaatgcctgatgaattttctaacttgagagataaggcaataaagttatacaatgatgcaaatgaaaatgagagattattaattaattggtcaatgatgatgcttgcttttcctatattttgcgatattattgacacgataggtaaattattatatttgcaagatgattttgcaattaaaactgttttaaataggatatatgataaatggggggaaagaagcacagtaaaatatgctgttcctagaattatatattcaatggtacaatggaaagctcttgaaaagaaaaatcccggaatatgccaaaaggcaaacataattgccatagataatgttgacatagagttattttttctagaatgttatatgagatcatttaaaaaagattatttaaatttttatgaagtaaacaaattaaatccttcttttccatttagattatctatagggactatggatatacataattcggattcattaaatttatataaagtaaataacaatttacttatcacttttgcgtga

SEQ ID NO: 4636 - DNA, 708 bp, Thermoanaerobacterium thermosaccharolyticum
atgcaaaaagtgggctttgatagaatgatagaaattgagtggcttaataaaacggtagaaatttataataaagaatctgatataaagattattaaacaagaattaaatgattatttaaaggacaaagttatttctgatgataatagaaaaaaatgtgtaaatatactgacaagtacgtgggtttcaatgcctgatgaattttcaaacttgagagataaggctataaagttatacaatgatgcaaatgaaaatgagagattgttaattaattggtcaatgatgatgcttgcttttcctatattttgcgatattattgacacgataggtaaattgttatatttgcaagatgattttgcaattaaaactgttttaaataggatatacgataaatggggtgaaagaagcacagtaaaatatgccgttcctagaattatatattcaatggtacaatggaaagctattgaaaagaaaaagccaggaatatgccaaaaggcaaatttgattgcaatagacaatattgacatagagttattttttatagaatgttatatgagatcatttaaaaaagattatataaatttttatgaagtaaacaaattaaacccttcttttccatttagattatctataaggactatagatatacttaattcagattcattaaatttgtataaagcaaataacaatttacttatcacttttgcgtga

SEQ ID NO: 4637 - DNA, 708 bp, Thermoanaerobacterium xylanolyticum
atgcaaaaagtgggctttgatagaatgatagaaattgagtggcttaataaaacggtagaaatttataataaagaatttgatataaagattattaaacaagaattaaatgattatttaaaggacaaagttatttctgatgataatagaaaaaaatgtgtaaatatactgacaagtacgtgggtttcaatgcctgatgaattttccaacttgagagataaggcaataaagttatacaatgatgcaaatgaaaatgagagattattaattaattggtcaatgatgatgcttgcttttcctatattttgcgatattattgacacgataggtaaattattatatttgcaagatgattttgcaattaaaactgttttaaataggatatatgataaatggggtgagaggagcacagtaaaatatgctgttcctagaattatatattcaatggtacaatggaaagttcttgaaaagaaaaagccaggaatatgccaaaaggcaaacatgattgccatagacaatgttgacatagagttattttttatagaatgttatatgagatcatttaaaaaagattatgtaaatttttatgaagtaaataaattaaatccttcttttccatttagattatctatagagactatagatatacataattcggattcattaaatttatataaagtaaataacaatttacttatcacttttgcatga

SEQ ID NO: 4638 - DNA, 621 bp, Actinomyces sp.
gtgtcggatcgcagactggcctcgacaatcacggtgggcggcgcgacgaacgcgggaacgtttgaggcggctgagctgatggccgctggcatgagtgcgcgtgaggcgagcgacgtgttattcgagcagaacctggtggtcgcgggctcggagtcgacgcggcgacgcttggcgagcgcgacgacgaagcacctgtcgttcctggaggacgacgccctccgattcgtcgccagtcgcgagtacggatgggagcttgtcatgtggctggctctcgtgacggagtcctacgtgtttgcggcgtgtgcgcgcgaggttgcctggatccgtctggtcgtcgatgaggctccgctgacagcgtcggatatcgacaacttcgtggaacgccaacgcggggtggatcccgcgatgtcgacactgacagtaaagagtggccagaaggtgcgatccgtatttctgcgctgcatgcgagatgtgggtttcatcaacgagatcggtgttgctttgccggtcttggtcccggtgggggttgcccgcttggtgaacgcggctccgcagccgtggggttggccgatgcgggagtcgttcccggtcgcgcagttccagtttgatgtcctcggctga

SEQ ID NO: 4639 - DNA, 600 bp, Vibrio cholerae
atgaatagaaaagaatatttaggcgatcttatcggaggcagtttattgataactgaatctagaataatcgcagaatcgctactgaaaaaacttccagaagatgagtggaagtcgttgatcgttgagcaaaatgttcttcagaaaaaatccggtcagacggctattcgttatgccagaacaatccgttggcgtattgaaggcctgggtgatgagtttatgactgatcttttagccgcgagtgaacgcgcctatgtccaaatgctgatgatgtcattactcattcattctccggttgtcgctgattttatgagacttaccttagccgaggctcgtcgcacctataaaccctctttaaccgctgatgcatggtctgagttttatgacacgagagtgcgggcatatgccgaacttggcggtttttctgactcaactgtaaaaaaaatgggtaacaacgcaattaaggcattggttgatagtggctacctgagcgatagcaggacaaagaaaatacaacctgtttacctaatgccagaagttaaagactggttagttcgtctgagccgggaagatttgattgatgtaatggagtgcacaatatga

SEQ ID NO: 4640 - DNA, 597 bp, Vibrio harveyi
atgtctaaacacaaacgctacctaggcgatcttattggtggaagtctaatgctccgtgaaagccaaatcattgccgacctgctattaacagaaccaaccctagaggattggaacaaagcgattgtagaagagaacatcttgcaaaagccttcagctgcgtcagctaaacgcaatgccgcgacaatcaaaaagcgtctggagtcgttaaacaacgagtatcttcaaaaattagcttatagcggtacagaagaagcaacacagttaatgttcgcagcaacgttaatcaacgcccctatcctagcggatttcatgcgaatcgtagtaacagacgcaaagcgtatgtatagagaagcattgagtgtagatgactggcagcatttttggcaggagcgcggacgcttatacccaggtttacttgagatgtcagaggcatctacatataaaatatcccaagtcgcgttcaaagttttagcagatgcaggctatatagactccaccaaacacaaaaaactcatgaatatctttatctcacctgatgtacgcattctcctatcagagatggatagagatgatatcgtcagagcaatggagccataa

SEQ ID NO: 4641 - DNA, 606 bp, Lachnospiraceae bacterium
atggatcattcttatccgtatattgcatctttgactagagagccgttccttttttatgaaatgcgttccactgcaaagcttatgtcagaaggaatttccgatgatacgattgtaaaagaaattgtagagcagaatcttttccagtacccaacggaaaaatctatcacacgcatggcgaaagcctgtataaaacggcttcatgcactggaagatgattctctggtttctgcgattgcgtcacagccaacggatgtagcaaaacaagtttgtctgtatgcgttgatgaagcagagccgactggtttgggaatttatgctgacagtcattggtgagaagtacagattaagggacacgtcttttggtaagatagatttgaatacattttttatgcgtttacaggaacaaaatgataccgtagcttcttggagcgatagtacgataacaaagttaaaacagattattgccagagtgcttgtcgaaacagaatatctcgataatctcaaggcagatcatttgaatccagtatggctgcatcctgttttggaaaatgccatcagaagcaatggcgatacggcgatactgccggcgtttaattgctttgtgtag

SEQ ID NO: 4642 - DNA, 606 bp, Escherichia coli; identical to SEQ ID NO: 4534

SEQ ID NO: 4643 - DNA, 606 bp, Coprobacillus sp.
atggatcattcgtatccctatattgcatcgctaacaagagagccgtttcttttctatgaaatgcgctccactgccaagctgatgaatgaaggactttctgatgaagcgattgtaacagaaattgtagagcaaaatctttttcagtatccgactgaaaaatccatcacacgcatggcaaaagcctgtatcaaacggcttcacgcactggaagatgaatccctgatttctgcaatcgcatctcagccaacagaagtggcaaaacagatttgcctgtatgcgatgatgaagcagagccgactgatctgggaattcatgctgacagtgattggcgagaagtacagattaagggacacctcatttggtaagatagacttgaatacattttttatgcgtttgcaggaacagaacgatgcggtagcttcctggagcgacgccacaataacaaagttaaaacagattattgccagagtgcttgttgaaacggaatatctcgacagtatcaaggcagatcatttgaacccggtatggctgcatcctattttggagaatgccatcagaagcaacggcgatgcggcggtactgccggcatttaattgcttttcgtag

SEQ ID NO: 4644 - DNA, 801 bp, Vibrio cholerae; identical to SEQ ID NO: 4596

SEQ ID NO: 4645 - DNA, 606 bp, Escherichia coli
atgattaaaaatgacaaggcatggataggagacttgctgggcggaccgctcatgagcagggaaagccgcgtcattgccgaactgttgctaaccgatcccgatgaacagacatggcaagagcaaattgttggccacaacattttacaagcctcttctactaacaccgcaaaacgttacgcggcaacaatcaggcttcgcctgaacacgctggataaaagcgcgtggacattgattgccgaaggtagtgaacgggaacgccaacaacttctgtttgtggctctgatgctacattcgccggtagttaaggattttctggctgaagtggtgaacgatctgcgcaggcagttcaaggaaaagttgcctggcaatagctggaacgaatttgtgaatagccaggttcgcctacatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctgggacaacaggacttgatatctattctggagggaaaacggtga

SEQ ID NO: 4646 - DNA, 603 bp, Lachnospiraceae oral
atggaaagaaaagtgtacagtgcaggtgctgtaaagatgtctttttggtttatggaatttcgcaaagttatagggcttatggcagaaggaaaaactttgaaagaaataaaagaaatcaataaaaaagagaatatattcggtgcacctacaatacttcgctccgaacagatatttaatacggtttcaggaagaattaaaatgcttaataaaagctttattagtgtatttcaagacagtgatgttacaacacagaaattatttgcgcttatagcggcactaagctatgatacattgttttttgactttgtttatgaggttataagagagaagctgattatcgggagcaatacatttacggaaagcgatattagaatattctttaaggataagcagttacagagcgaaaaggtggcaaagtggactgatccgacaattatcaggctgggcagatcttataaaacaatgctttttgaggcgggacttatcgataaagggaaaacagagagaaaaattataaagccgatacttgatcctgctatggaatactggttaaaagatcatagtatggaggcatatattatggcactgacaggagttggatga

SEQ ID NO: 4647 - DNA, 609 bp, Salmonella enterica
atgacgatgaaaaacgacaaggcatggattggagacctgctaggcgggccgctgatgagcagggaaagtcgaatcatcgctgagctcatgcttaccaatcccgatgaacagacctggcaagagcagatcgtgggccataacattctccaggcttcctctgccaatacggcgaagcgctatgctacaacgataaaactacgcctgaatacgcttgataaagtggcgtggtcacttattgcggaagggagcgagcgcgagcgtcagcaattgctgtttgtcgctttggtcctccattcaccggttgttaaagacttcctggctgaagtagtgaacgacctgcgcagacaatttaaagaaaagctccctatggatagctgggatgagttcgtgaccagccatcttcgtcagcagcccgtactcaccagttactcagattcatccataaaaaaaatgggtaacaacttgatcaaagcactggctgaagcgggttatctggatacacctcgtcggcgtaatctccagtctgtctttcttttaccagaaactcaggcgaccttgcagcgcctcgggcaacaggaattgttttctattctggagggccaacggtga

SEQ ID NO: 4648 - DNA, 618 bp, Pectobacterium wasabiae
atgacaaacgctatgataaaaaatgacaaacgctggattggcgatctgctgggcggttcgttgatggtccgagagagccgaaccattgctgaactgttgctttctgaaccagatgaaacgacctggcaacagcaaataatcaatgaaaatattcttcaggcgtcctccaccagtaccgcaaatcgttatgcccgaaccttaaggctgcgattaatgaccctggatcgggagtgctggcaactgattgctggtggcagtgaaagcgagcgtctgcaaatgctgttggttgcgttgatgatccagtctccagttgttgcggagtttgttgctggtgccgtaaatccggctcgtcagcagtttaaagaaaagcttggtataaattgctggggtgagtttgtgaatgagaatctccgattgcacccggagctggctgctttctctgattcatctatccaaaagatgggtaacaatctgattaaggcactggcagaagctggttacctggataccccacgccgccgcaatttacaaaacgtttttcttctaccagatgttgcaacagccttgcatcgtttaaacaaagccgaactgctccctattctagagggtaacgcatga

SEQ ID NO: 4649 - DNA, 606 bp, Escherichia coli
atgattaaaaatgacaaggcatggataggagacttgctgggcgggccgctcatgagcagggaaagccgcgtcattgccgaactgttgctaaccgatcccgatgaacagacatggcaagagcaaattgttggccacaacattttacaagcctcttctcctaacaccgcaaaacgttacgcggcaacaatcaggcttcgcctgaacacgcttgataaaagcgcgtggacattgattgccgaaggtagcgagcgggaacgccagcaacttctgtttgtggctctgacgctacattcgccggtagttaaggattttctggctgaagtggtgaacgatctgcgcaggcagttcaaggaaaagttgcctggcaatagctggaacgaatttgttaatagccaggttcgccaacatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctggggcaacaggacttgatatctattctggagggaaaacggtga

SEQ ID NO: 4650 - DNA, 606 bp, Ruminococcaceae bacterium
atggatcagacgcacccttataacggcagcttaactgctgaacagtttctcttctacgagataagaattgctgcaaaatactatgtttctggcttgaaaattgatgaggcaatcgagcggattaagaagaataacctctttcaatatccaacagagagacaagtttcccgtttggcaagagcttgttataagcggctggacgcgctcggcaacgatcagcttgttcacgagcttgcctctgcaccaaatgagattgcaaagcagatcaatctatacgcggtgatgaggtataatcgtttggtctgggagtttatgattcaggtgataggcgaaaaataccgcaatcaggacatgaacttctcaaggaaagacatgaatgcgtttttttccagattgcaagcacaggatgattctgttgccgcttggagtgatgcgacaatcaccaaaatcaaaagtgttctcgttcggatgctgatagagacagggtatctggacgggctgaaagacaccacgctgaatcccgtttttctctgtgaagaacttgaacgaggtatcgaagcaaacaacgattatgatgcacttccggcatttaattactttagatag

SEQ ID NO: 4651 - DNA, 663 bp, Holophaga foetida
atggctcatgccctctcaggtcttgcaagtgctcgccttggacacatccccttaccgttctggggttgtgcagtgaggtattcggccaatctcaccgcaggcgccctcaagcccgccgaaagccgcgtcatcgcggatctcttgctgcgcggggtgtcaggggctgattggaaggccgccattgagcaggagaactgcctccaggccaagtccatcgccaccggcaagcggttggcccggctgatccgggatcgcctcgcccccttcgatccccccttctgggaattgattcgggattctgccagcccggtggtccagcaggccctgctggccgccgccgtgaagcacagccccctgttgggggatttcctggacctggtggtccgggagcaataccgccgcttcgccccgaacttgcccttcaccctctgggaggactacctcctggattgccgggggcgggactccgagatgccttggtggaacgactccactcgccgccgccttcggtcttcggtttacctctgcctcgcccaggcgggtttcctggagaacacccgtagcctcaaactccagcccgtcttcctggccacgcccgtgcttcggtacctggaatccagggacgagcgccttgtcctccgctgtcttcaggtgagcccatga

SEQ ID NO: 4652 - DNA, 606 bp, Escherichia coli; identical to SEQ ID NO: 4534

SEQ ID NO: 4653 - DNA, 603 bp, Oribacterium sp.
atgaatagaaaggattacagtgccggtgctgtaaaacatgctttttggtttatggaattccgtaaggtagtttctcttcgcctggagggaaagacctgggaagaaataaagcagttaaatgaaaatgagaacatctttggtgcgcccacaaaactgcgtgcaactcagatctttaatacagtatccgctagggtgaaaagcctagatgatagtttctatcctatttttgatgcatgcgatctggcatctcagaaattatttgccttggtcgctgccatgacttacgatgttctatttggggatctggtttatgagctggttcgtgagaagatgattattggtagtaacgaattggcagacagtgatttgcggattttctttaaggacaaacagcaacaagacgataaagttgccaaatggacagaggcaacaatcaagaagctgatggtaacatacaaatctatgctttttgaagctggtgtaacgaataaagcgaaggatatccgggaaatatataaaccattgcctgatcctgcaatggaaggctggatgaaagagcaggggatgatgtatcagctaaaggcaattatgggggtaagatga

SEQ ID NO: 4654 - DNA, 606 bp, Escherichia coli
atgattaaaaatgacaaggcatggataggagacttgctgggcgggccgctcatgagcagggaaagccgcgtcattgccgaactgttgctaaccgatcccgatgaacagacatggcaagagcaaattgttggccacaacattttacaagcctcttctcctaacaccgcaaaacgttacgcggcaacaatcaggcttcgcctgaacacgcttgataaaagcgcgtggacattgattgccgaaggtagcgagcgggaacgccagcaacttctgtttgtggctctgacgctacattcgccggtagttaaggattttctggctgaagtggttaacgatctgcgcaggcagttcaaggaaaagttgcctggcaatagttggaacgaatttgtgaatagccaggttcgccaacatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctggggcaacaggacttgatatctattctggagggaaaacggtga

SEQ ID NO: 4655 - DNA, 639 bp, Acinetobacter johnsonii
ttgatcaggcctcataggagattggccatgttagaacaatttcattatgacagtgacctgattggtggctccctgatggtgcgtgaaagccggctgatcgcggatctgttattacgagaagcgactccagaacaatggcatcaggcaattcagattgacaatattctgcaaaaaagaacgcctgcttcagcccaacgtaacgccactgccattcgtaagcgtcttgagcgcttagagcctgatttctggaaagctttgcgtgatggggatgatgagctggcgacccaggtggctttttgtggggcactggaacgcaacctgttgctgcttgagtttatggaaacggtgatgagggatgcctatatctcccaggcgcaatacttggacagttatatctggtcagactttctggatgagcgctcacaacgcgatccggatatctgcgaatggaaagagtccagcaagaaaaaaatggggcaggtggtgtttcgcatgctggcagaagccggttacttaaaaagtacccgtaagctggagttgcagcgcgtgatcgtcagagcagaactgcgtagcctgttggaagaacattataaacaacgcattaaaagatctatggaagtgtcggtatggacgcgttag

SEQ ID NO: 4656 - DNA, 630 bp, Selenomonas sputigena; identical to SEQ ID NO: 4578

SEQ ID NO: 4657 - DNA, 639 bp, Acinetobacter junii
ttgatcaggcctcataggagattggccatgttagaacaatttcattatgacagtgacctgattggtggctccctgatggtgcgtgaaagccggctgatcgcggatctgttattacgagaagcgactccagaacaatggcatcaggcaattcagattgacaatattctgcaaaaaagaacgcctgcttcagcccaacgtaacgccactgccattcgtaagcgtcttgagcgcttagagcctgatttctggaaagctttgcgtgatggggatgatgagctggcgacccaggtggctttttgtggcgcactggaacgcaacctgttgctgcttgagtttatggaaacggtgatgagggatgcctatatctcccaggcgcaacacttggacagttatatctggtcagattttttggatgaacgctcacaacgcgatccggatatctgtgattggaaagagtccagcaagaaaaaaatggggcaggtggtgtttcgcatgctggcagaagccagttacttaaaaagtacccgtaagctggagttacagcgcgtgatcgtcagagcagagctgcgtagcctgttggaagaacattataaacaacgcattaaaagatctatggaagtgtcgctatggacgcggtag

SEQ ID NO: 4658 - DNA, 603 bp, Shewanella baltica
atgataaatgtaaaacagtatttaggcgatctaattggaggcagtttgctgataactgaatccagaataatcgctgaatcgctactgaaaaaacttccagaagatgagtggaagttgctgatcgttgagcaaaatgttcttcagaaaaagtccggtcagacggctattcgttatgccagaaccatccgttggcgtattgaaggcctgggtgatgagtttatgactgaccttttagtcgcgagtgaacgcgcatacgtccaaatgctgatgatgtcattactcattcattctccggttgtagcagattttatgcgacttaccttggctgaggctcgtcgcacttataaaccttcattaactgctgatgcatggtctgatttttatgacacaagagtgcgggcatatgccgagcttggcggtttttctgattctaccatcaaaaagatgggtaacaacgcagttaaggcattggttgacagtggctatctgagtgatagcaggacaaagaaaatacaacctgtttacctaatgccagaagtcaatgattggttagtacgtctgggcagggaagatttgattgatgtaatggagtgcacaatatga

SEQ ID NO: 4659 - DNA, 801 bp, Vibrio cholerae; identical to SEQ ID NO: 4596

SEQ ID NO: 4660 - DNA, 606 bp, Escherichia coli; identical to SEQ ID NO: 4534

SEQ ID NO: 4661 - DNA, 555 bp, Halomonas sp.
atggtgcgtgaaagccgtgcagttgcagcgctattgctggatgaggtagacgaagcacactggcatcaagccatcatcgttgaaaaccggctacagaagaatcgcccagcgacagccaagcgtgcagcgcaggccatccgtaaacgcttagagaaactggaaccctctttttggaaagccctgcacgatggagacgatcagctagcgtcacaggtatcgttttgtgctgccatggcacgcaacctgctgatggtggagtttcttgaaagcgtggtggccgatgcgtttttaacgcggtctgaaaagcttcagtcctatcagtgggatgagtttcttgccgaacgtgctaaccgcgatgcagcgattgctacctgggcagaaagttcaaggcgcaaaatgggtcaggtagtgtttcggatgctgacagaggtcggcatattggattccagccgatcacgtcggcttcagtctttcttgccccgcccagagctgaagatgctgcttgaaacccaccgccatacccgtttacaaaattgtcttcaaaaattgcgctaa

SEQ ID NO: 4662 - DNA, 696 bp, Bifidobacterium angulatum
atggcgggctcgtacggtgcggaagcgacgcagggggagcggtaccggctttccttcactgtcggcggacttcttgcctcgcagggccgggcgcttgcggaaatgtatctgaatcatctgaatcatctgaatcatgcaggcggcggcgacgctgagtgttcttcccaaaccgaggtgggcaagtccattgccgcgattcgccaacaggccatcgaggaaaacgttcttgcgattcgcacggattccgcaaacaggcgcgttgtggcggaaactgctaggcggctcagtgcgctcacggttggggagcttgcatatttggcaggcccggattcctccacatccgaccgcgaggcacttatgtggatcgcgatatgccgttattacgcaatcgttggggaatttgctggtgaagtgctcaaaaaacattatcttgtagggaacctgcatcttgatttcgaggattatgctcgcttcattgcggacaaagctacatggcatcctgagctggaaaccataagcgagggaacggcgaagaaactccggtccaatctgttcaaggccatggttgaggcccatctgttcgataaaaattccgacacggtggtttccttcctacccagtccctctttggcggatatccttatgaagagaccagattcgttcgggtttttcccgatgcgtgaatcatccttgtga

SEQ ID NO: 4663 - DNA, 801 bp, Vibrio cholerae; identical to SEQ ID NO: 4596

SEQ ID NO: 4664 - DNA, 615 bp, Alcanivorax pacificus
atgacccaaggcaggtatcgcatctccttcacgtccggcagcctgtatcaccgcgaatcggtgaagctcgcagagctctacgtgtcactccgtgactgggaaaaggtgcgtgctcaagcgttgcgtgacaacttgcttcaggccagaacagaaagcacggcaatgcgcacttgtagagaggcaattgctcgcctgaagagattgaacgatgacgaactggctttcctggccgaggcaaactaccacgaccaggctcaccttctatgggttgcggtgtgccgtctttatcgctttattgcggattttgcgatggaagtagttcgcgaacggtttgttgcgatgaaattggatctcagttttgaggatttcgatgccttctataatcgtaaatcagaatggcatgacgagctcgataatgccagcgcttcaacacgcgataagttgaggcaggtcctgttcagaatgctgcgggaggctgggctgctggctaaggacaaaaccatcaacgccgcgctgcttagccctagcttgattgagttgcttcgacaaaaaaatcctgaggcgtttctttactttccagtctacgaatcagatatcaaggggatgtcaaagtga

SEQ ID NO: 4665 - DNA, 801 bp, Vibrio cholerae; identical to SEQ ID NO: 4596

SEQ ID NO: 4666 - DNA, 801 bp, Vibrio cholerae; identical to SEQ ID NO: 4596

SEQ ID NO: 4667 - DNA, 483 bp, Gamma proteobacterium
gtgcgtgaagaggtcatcaaagaaaatttgttgcagacacgcacagcgcgctcttcagaggttctatatggcgagatgcaaaaaagactaagtctgctgaatagcgagcaaatagagcttattgctgatgactatgaaggcgacgtccggcagctggtctggatgtcgatatgcaaacagtatccgtttgttggcgatttcgtgctcgaaatcgttgcgcctgcaatagcgtcggggcgacagagcatcgattacgatgattatgggtacttcttcaatgcgaaggcggagtggcaccaagaattggaaaaggtgtccgaaaaaacccgctctaacgcgcggggcgccgtttttcagatgatgcgccagtgtggtctgctcactgaatctaatgatttggttcctcagatgatctctgcggccctgcaaaactgctcatcagaatccgatctagccttaataccaggagcgattcgtttatga

SEQ ID NO: 4668 - DNA, 603 bp, Enterococcus faecalis
atgtcgaaaaaaatatatagtgcaggattagtctcacagcgattctggttttatgagactaaagaatatatagaaatgctcaatgaaggtaaaacacatcaagaaataaaaaaattaagtgaagaaatcaatatttttggcgctgctagtagcagtcgatcaaacgaaacatacaatgctgctaagcgacgtataaatgtattaggaaaagaaatgcaagaattatttcctaatttaaatatagataaccaaaagattgttgtactaatttcagttttattattgaatgatttgattctggaatttatgttagaagtttatcaagctcaaatacaaaaaggcatcttaaaattaacaacaacggattataaacagtttttctcggagaagcaaagaacgaatgaaatagttgctagttggcaaccttatacgtatagtcgtttaggtagtgcttataggaactatcttcttgaatcaggattaattcgtgaagataaagggatagaaattattacgccaaaaatggtggattcaagagtgttatcgtggttaaaagctatcaatcgattagatattgctaaagcgataacgggaggaatttga

SEQ ID NO: 4669 - DNA, 615 bp, Pseudomonas syringae
ttgatcatgcagactttcagctatgactccgatcttatcggcggctcactgcaagtacgggaatgccgagtcatcgcagatctactgctgcaacaggcttccccagagcagtgggcagaagaaatccagcaacacaatcgcctgcagaagcgctcaccagcctcggccagacgagttgctcaagcgctgcgtaaacgcctggagcgcctggatcaacctttctggcgagccctacgtgatggtgacgacgaactcgccacccaagtcgccttctgcgcggcgcttgagcgcaacctgctgctggtggaattcatcgaaaccgtcctgcgtgatgcctacctgaccaaggcagaacatctcgagccctggcattggcatgacttcctagaggagcgcagccatcgcgaccctgccatcgagacctggacggaatccagccgtaagaaaatgggccaagtcgtctatcgcatgctggccgaggccaagctgctcaaaagtacgcgcagcatgcagttgcagaccttgctggtccgccctgaggttcgcaccctgctggacgacagttaccgccatcgcatcaaagcctgcctggaagtgtccagcagcaccctctga

SEQ ID NO: 4670 - DNA, 606 bp, Escherichia coli; identical to SEQ ID NO: 4534

SEQ ID NO: 4671 - DNA, 792 bp, Pseudanabaena biceps
atggaaaatttttggctatctaccaatgatatttgcaaaaaacttagaattagacgtaacacagtatatagatggatttctaaacatggaatgcctgcacatcgtatagggcgcttttggaaatttcaaaaagatgagttggatttatggatagagctaaatagacccttatctcttcaacaaggaaagcaaacagcaaaaaaaaagacatatagtttgtcatttactgctggagatttgctgtttcgtgaatctttggttgtcgcaagtttattccttgatattcgagactggaatttggttcgagaaaaagttgttgcgaataatttattgcaagctaagacgttaagtacgactaaacgtatctgtggagaagtttgttctagattaaaaatgcttagtcaaaacgagttagagttacttaccgagacaactattcaggagcaaggttatttattgtggttagcaatctgtcgccgttataaatttgttgctgagtttgcagtagaggttttaagggaaagatatctgagtctcaagaatagtcttaattatgaagatttcaattttttcttttctaaaaaaatagaatgtcatcaagagttagctaaagtcagtcaaagaacaatcgataagtctcgtcaagttttattcagaatgatgcggcaagctgggttgttaacgactgaaaacgaaattaatgttgctctactaagtcctagacttctaaatgagcttgctgagaattcgcatccagatatttttgtgtttccatattttgaagttggttag

SEQ ID NO: 4672 - DNA, 801 bp, Vibrio cholerae; identical to SEQ ID NO: 4596

SEQ ID NO: 4673 - DNA, 801 bp, Vibrio cholerae; identical to SEQ ID NO: 4596

SEQ ID NO: 4674 - DNA, 606 bp, Escherichia coli; identical to SEQ ID NO: 4534

SEQ ID NO: 4675 - DNA, 669 bp, Actinomyces sp.
atgacgccgacgatgctgcccgcctactcctccgcgcaaaccgtgggcggcctggtcaatccggggaccgttgaggcggcggggctcctggcgggcgggatgtctgtgcgcgcggtcaacgaccgcctggtggccgacaacctcacgcgcactcagtcctcccagaaccgcaggcgcctggccaccacgacgacgcgccacctctcgcacctcggtccggacgcgctcgcgcatgtcgcccaggcgcggcccggtttcgagttgctgctgtggttggccatcgtcagcgaggcgcgcctgttcgccgactgcgcgcgcgacgcggtgtgggaggcgctggtgctggcggagcggccgttccgcgtagcggatttcgacgagttctggcggctcaaggccctcacagagccgagcctggcggccctgtcggcagcgaaccgtaaaaggcagcgcagcgtgttcctgcgttgtttgcgggaggcgggtttcatcgacggggcgggcgcccccctgcccctgcttgtccccccgtcggtggcgaggctggtgaacggggcgccggagccctgggggtggccgctgcgggaggccttcccggttccacaggcgcaattcgacgtgttggacggcgaggcattggagcagtacaggatgaggcgatcaggatga

SEQ ID NO: 4676 - DNA, 432 bp, Fusobacterium necrophorum
atgaaataccgagcgattacaggagaaaatttctatgtacaggaactaaaaaatgcttgtcaatttctattacaacatcctgagttggaaaataagagacaagcttttcaagaacgagatatcttaaattgtgtcagtgagagcaattttaataaaaaatttcaaacgattcaaaaaagattgcaagtatttactcctaaattgatggaattgtttttaaaagtagattatactacaacaaaatttatcaatctttacgccattctttcacaagaaaggttttttgcagagtttatggacgaagtgataaaagaaaaatattttctcttagattttgaattaacaaattatgacttttatgaatttatggagagaaaaaagagcagtcagaaattattcaacaatggtccgatgccgggtgtcataaaatga

SEQ ID NO: 4677 - DNA, 612 bp, Acinetobacter radioresistens
atgttagaacaatttcattatgacagtgacctgattggtggttccctgatggtgcgtgaaagccggctgatcgcggatctgttattacgagaagcgactccagaacaatggcatcaggccattcagattgacaatattctgcaaaaaagaacgcctgcttcagctcaacgcaatgccaccgctattcgtaagcgtctggagcgcttagagcctgatttctggaaagcactacgtgatggggatgatgagctggcgacccaggtggctttttgtagcgcactggaacgcaacctgttgctgcttgagtttatggaaacggtgatgagggatgcctatatctctcaggcgcaatacttggacagttatatctggtcagattttttggatgaacgctcacaacgcgatccggatatctgtgattggaaagagtccagcaagaaaaaaatggggcaggtggtgtttcgcatgctggcagaagccggttacttaaaaagtacccgtaagctggagttgcagcgcgtgatcgtcagagcagagctgcgtagcctgttggaagaacattataaacaacgcattaaaagatctatggaagtgtcggtatgggcgcgttag

SEQ ID NO: 4678 - DNA, 801 bp, Vibrio cholerae; identical to SEQ ID NO: 4596

SEQ ID NO: 4679 - DNA, 738 bp, Bifidobacterium bifidum
atggctggctcatacggcgcggagacgacgcagggggagagatacaggctttccttcaccgttggtggacttctcgccccgcagggccgtgcgcttgccgaaatgtacctgaatcgtatgggcgatggcagcactgagcgttcttcccaagccaaggtctctgaaaagatctctgaaaaggccaacgaaaagagcgacaagaatgctggcgaagaagttggcgaatccattgctgcgattcgccaacaggccatcgaggaaaacgttcttgcgattcgcacagattccgcgaacaggcgcgttgtggcggaaactactaggcggctcagtgcgctcacggtcggggagcttgcatatttggcaggcccatattcctccatatccgaccgcgaggcacttatgtggatcgcgatgtgccgttattacgcaatcgtcggggaattcgccggcgaagtacttaaaaagcattatcttaccggcaatacgcatttggactttgaggattatgatcggttcattacggacaaagccacatggcatcctgagctggaaaacataagcgagggaacggcgaagaaacttcggtccaatgtgttcaaggccatgagggaggcacatctgttcgataaaaattccgacacggtgctgtctttccttcccagtccctctttggcggatattcttagaaagagggcggattcgttcgggtatcttccgatgcgcgaatcgtcgttatga

SEQ ID NO: 4680 - DNA, 627 bp, Bacteroides ovatus
atgaataaaaaagatagtccatacacagcagccatcacgggtggcggtttcctttttgaggagaccaatatcctattacctctactccgtgcaaccaatagtgaggagttgcttcatgatgagaaggtgaataatcggttgcttcacattaatgcagaaagttctcgtaagaaagctattctggaaatcaaacgaagatatgagtctatgccatcatctttttgggatgactttcttggaatgaacgatacagacaagatagtagctatcttctatgttattttgaggacgtataagatctgtttcgattttcatgtaaatgttgcaataaaaaaatggaacagcatatccaaaagcatcgataaaaatgacattatgatggagttcaacgaaatagcatcaaaagatgagtttgttgattcatggagcgataataccaaagataaagtggcttctgcatatcttactatacttcgtaaagtgggtatgcttgacaatagcaaccatcttaatgcgatttcctgtagcaattttacttactacctgggaaaaggacaaccatggtttttggaagcttgtcttttgcaaccttacgaaattgagaacataaagaaaacaatgatatga

SEQ ID NO: 4681 - DNA, 801 bp, Vibrio cholerae; identical to SEQ ID NO: 4596

SEQ ID NO: 4682 - DNA, 627 bp, Parabacteroides sp.
atgaataaaaaaaatagtccatatacagcagccatcacgggtggaggtttcctttttgaggagaccaatatcctattacctctactccgtgcaaccaatagtgaggagttgcttcatgatgagaaggtgaataatcggttgcttcacattaatgcagaaagttctcgtaagaaagctattctggaaatcaaacgaagatatgagtctatgccatcttctttttgggatgactttcttgaaatgagcgatacagacaagatagtagctatcttctatgttattttgaggacttataagatctgtttcgattttcatgtaaatgttgcaataaaaaaatggaacagcatatccaaaagcatcgataaaaatgacattatgatggagttcaacgaaatagcatcaaaagatgagtttgttgactcatggagcgataataccaaagataaagtggcttctgcatatcttacaatacttcgtaaagtgggtatgcttgacaatagcaaccatcttaatgcgatttcctgtagcaatttctcttactatttgggaaaagggcaaccatggtttttggaagcctgtcttttgcaaccttatgaaatagagaacataaagaaaacaatgatatga

SEQ ID NO: 4683 - DNA, 618 bp, Escherichia coli
atgataaataccatgacaaaaaatgacaaacgctggattggcgatctgctgggtggttcgttgatggttcgtgagagccgaaccattgctgagctgttgctctctgaaccagatgaaacaacctggcagcagcaaataatcaatgaaaatattcttcaggcgtcctccacgagtacggcaaatcgttatgcccgaaccttaaggctgcgattgatgaccctggatcgggagtgctggcaactgattgctgatggcagtgaaagcgagcgtctgcaaatgttgttggttgcgttgatgatccagtctccagttgttgcgacgtttattgctgaagttgtaaatccagctcgtcagcagtttaaagaaaagcttggtataaattgttggagtgagtttgtggatgagaatctccgtttacacccggaactggcagctttttctgattcatcgatccaaaagatgggtaacaatcttattaaggctctcgcagaagctggttacctggatagcccacgccgccgcaatttacaaaacgttttcctgctaccagttgttgcagcggccttgcatcgtttaaacaaagccgaactgctccctattctggagggtaacgcatga

SEQ ID NO: 4684 - DNA, 606 bp, Lachnospiraceae bacterium; identical to SEQ ID NO: 4641

SEQ ID NO: 4685 - DNA, 801 bp, Vibrio cholerae; identical to SEQ ID NO: 4596

SEQ ID NO: 4686 - DNA, 630 bp, Bacteroides ovatus
atggcaatgaagataaatagcccttatacggctgcaattacgggtggaggttttttacttaatgagacgcttgctctgcttcctctcttgcaaagtgaagatcgagaagaacttctcaaagatgaacgattgaacaaccgtgtactgatgattaatgctgaaacatcaagaaagaaggcaatcctagagattagtcgtcgttatgatacgatgtcacctgctttctggcaggactttttagtgatgactgccgcagagcagcctattgctctcttttttgtgatgttgaagacgtacaaaatactttttgattttcatgtaaacgtgacgatacgtcgttggaacagcgttgctaagtctgtgaagagagaagatatcctcatggaatttaatgaaatatctgctcgtgatgcatttgttgactcgtggagtgaagctacgaaggacaaagtgattagtgcctatttatctattttgcgaaagataggaattctcgatagaactaaccaattgcaagtgcttgattgtaccaactatccatactatttgcaaattggcgaatcttggtttttggaggcttgtttgttacagccttatcaaatagaaaagattaaaaacagtttggcatga

SEQ ID NO: 4687 - DNA, 600 bp, Enterococcus faecium
ttgaataaaaaatattctgctggtctagtttctaaacgcttttggttttcagagttcaagttatatattcaattacgactagaaggatatacagatatagaaattaaagagaaaaatgaacatgaaaatattttttttgcagtgagcagtaaccgtcaaaaagaaatctatcagaacgtgaaaaggagagttagtcaactggatgaagctggattgcaacttttcaatcagttaaatatagataatcaaaagttagtgaatttgatttccatccttatgattgatgatctttttaatgaatttatgactgaggtatatgctgaaaatctacgtaaaggaaatttgcaattaacaccagttgattaccgttctttttttacagagaagcggagaagttcagaagatatttcaaaatggaaagattatacgattaaacggcttattgccgcttatcaaacgaatctaattgaaacaggattagtcagaggggaaaaagaatatggacgaatgactccgatattattagataaacgattgattcaatggttagttgacaagaatcgtaaagatattgtactagcactgggaggaattttataa

SEQ ID NO: 4688 - DNA, 774 bp, Yersinia ruckeri
gtgctgtattcgttggagccctatcgcaatatgccatggaaatttacgccacaaatgatgcacgtgactaattatgctgaccatagtcatagcttctcccgtgcatgccgactacaatcattacttgatttttgcgagcagcattccggatttttgatgacaaataccatgataaaaaatgataaacgctggattggcgatctgctgggcggtccgctgatggttagagagagccggactattgctgagttactgctttctgaaccagacgaaatgacctggcagcagcaaataatcgatgaaaatatccttcaggcatcctccataagtactgcgaatcgatacgccagaacaataaaacttcgactaatgacgctggatcgcgagtgctggcagctgatagttaatggtagtgaaagtgaacgtctgcaaatgctactagtggctctgatgattcagtcgccgattgtcgcggaatttgtagctgatgtcgtgaacccggcacgtcagcagtttaaagaaaaactcggcgtaaattgctggaatgaatttgtggatgagaatctgcgtttacacccagaacttacgactttctctgattcatctatcaaaaaaatgggcaacaacctgattaaggccctggcagaagccggatacctggacactccacgccgtcggaatcttcaaactattttcctgttacctgatgtcgctgcggcgttgcatcgtttaaacaaagccgaacttctgccaatcctggagggcaatgcatga

SEQ ID NO: 4689 - DNA, 606 bp, Pantoea sp.
atgatacataatgataaaagctggatcggtgatctgcttggcggttcacttatgagccgtgaaagcagggtcattgctgaattgttgctcaatgagcctgacgaagccatgtggcaagcacaaatcattgatgaaaatattttacaagcttcttccgccaaaacggcaagtcgctatgcccgaacgctaaaattgcgattaatgacccttgataaacaggccttagaacttatagccaatggcagtgagagtgagcgtttacaactcttactgacagccttgatgcttcaatcaccagtagttactgattttatcgctacagttctcaaccctgcacgtcaagagtttaaagacaggttaccagggaattgctgggatacctttgtagaagaaaatcaacgtcagcatccagagctaactcatttctctgattcatcaatacaaaaaatgggaagcaacctaatcaagtctctggctgaggctggttatctagatactccacgccgacgccacttacagaccatatttctactacccgaagtagctgcaacattacatcgtttgaaaaaggctgacttaataccagtgctggagggtagagcgtga

SEQ ID NO: 4690 - DNA, 606 bp, Escherichia coli
atgattaaaaatgacaaggcatggataggagacttgctgggcggaccgctcatgagcagggaaagccgcgtcattgccgaactgttgctaaccgatcccgatgaacagacatggcaagagcaaattgttggccacaacattttacaagcctcttctcctaacaccgcaaaacgttacgcggcaacaatcaggcttcgcctgaacacgctggataaaagcgcgtggacattgattgccgaaggtagtgaacgggaacgccaacaacttctgtttgtggctctgatgctacattcgccggtagttaaggattttctggctgaagtggtgaacgatctgcgcaggcagttcaaggaaaagttgcctggcaatagctggaacgaatttgtgaatagccaggttcgcctacatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctgggacaacaggacttgatatctattctggagggaaaacggtga

SEQ ID NO: 4691 - DNA, 801 bp, Vibrio cholerae; identical to SEQ ID NO: 4596

SEQ ID NO: 4692 - DNA, 606 bp, Escherichia coli; identical to SEQ ID NO: 4654

SEQ ID NO: 4693 - DNA, 648 bp, Collinsella intestinalis
atgcacgagcgggggccgtccatgagcgcccccaccacctatcgcggctccatcacgcgcgagcagtggctcgtcgacgagacccgcacggtcgcccgcctgcgcctcgaggatcgtgccttcctcgacacccgcgcccttgccgcgcacatcctcgaaaacaatctattccaataccccaccgagcgtgaggtcggctccatcgcgcgcgcctgcgcgcgcaggctcgacgcgctctcgagcgacccggatcggcgcgaccgtctgaccggcctcatcgcgcacggcaccaccgagcagctcaggcaggctaacctctacgccctcatgcgcgacaaccgcctggtttgggacttcatgacgtgcgtcgtggaaagtaaattctccctactcgacatgcacctgggcaaaaccgagatcgccacgttcctcgagggcctgcgcgcccaagacgagcgcgtggccacctggagccccgccaccctcaacaagatccgccaggtgctcgcccaatgcctcgaacaatgcgggatgtacgagcgcaagacggagcagctaagcacgctcttgctcgactacgacctggaaaacctcatacgcgagaacggcgacgccggcatcctgcccgcgttcggcctcgcgctatag

SEQ ID NO: 4694 - DNA, 609 bp, Salmonella enterica; identical to SEQ ID NO: 4572

SEQ ID NO: 4695 - DNA, 606 bp, Escherichia coli; identical to SEQ ID NO: 4690

SEQ ID NO: 4696 - DNA, 603 bp, Nitratireductor indicus
atgatggtggccgcagcgaaataccgcatgtccttcagtgtgggcgggctgatgctcaatgagagcatcgtgattgctcaagcttatcaacccggtgagaactgggcatctgctcgtgagcgtttgctggcccagggcgcgtcatccttacccaaactggcctcgcaaacccgcgcgcttcgtgaagtgtacgaccggataggccatctctccgatgccgaacgtcattacctgtcggtagaggctgaccgcgccgagcagcaggcgatgatgtggctggcggtctgccggacctatccttttgtccatgaattcgccgtcgaggtgatcggcgagcgttaccagtcctggcggcttgatctgggccatgaggtctttgaccgatttctcgcagacaaggcggaaagtgatccgagtcttgctgagctttcgtcatcgacatgcgcgaaattgcgtcaggtcttgtttcggattttgcgtgaagccggattgagaaacaccgagggcagaattcagccaatttggttgtcggggcgcatgaagcggctgattgaggagaataatccggcggatctacgggtctttcccggaaatggggggtaa

SEQ ID NO: 4697 - DNA, 606 bp, Escherichia coli; identical to SEQ ID NO: 4690

SEQ ID NO: 4698 - DNA, 612 bp, Acinetobacter baumannii
atgttagaacaatttcattatgacagtgacctgattggtggttcactgatggtgcgtgaaagtcggttaatcgcggatctgttattgcgtgaggcgactccagaacaatggcatcaggcgattcaggtggacaatattctgcaaaaaagaacgcctgcttcagctcaacgcaatgccaccgctattcgtaagcgtctggagcgcttggagcctgatttctggaaagcactacgtgatggggatgatgagctggcgacccaggtggctttttgtggcgcattggaacgcaacctgttgctgcttgagtttatggaaacagtgatgagagaggcctatatctcccaggctcaatacctggacagttatatctggtcagactttctggatgagcgttcacaacgcgatcttgatatctgtgattggaaagagtccagcaagaaaaaaatggggcaggtggtgtttcgcatgctggcagaagccggttacttaaaaagtacccgtaagctggagttgcagcgtgtgatcgtcagagcagagctgcgtagcctgttggaagaacattataaacaacgcattaaaagatctatggaagtgtcgctatggacgcggtag

SEQ ID NO: 4699 - DNA, 606 bp, Escherichia coli; identical to SEQ ID NO: 4690

SEQ ID NO: 4700 - DNA, 600 bp, Enterococcus faecium; identical to SEQ ID NO: 4687

SEQ ID NO: 4701 - DNA, 585 bp, Alcanivorax sp.
ttgctagccaattttaccaaggcatcgctgatcgttcctgaaacgcaggctatcgctcgtctgttgctggagcacccggatgtcgagcggtggcggcaggcaatcgaggcagagaatgtccttcaggcgaaaacggtcaataccgccaaaagctacgccactatagcccgcatgcgcctggaaaccatggatgagacgctctgggagattgttgccaatgcagaacgcccaacggcgacccaggcgattctggcctgcgccctgaaattttcgccgttgctggccgagttcatgcgcaccgcgttaagtgatgagtaccgccgaatgagccctggcctggaagaccgtatctggcgaagcttctttgcagacatgactctcgtgcacgccaacctggccgaggtctccgagggcacccaagccaagcttcgccagaatgcctaccgcatactgactgaggccggctatctggctaaaaataaaacgaaatccttgcagtatgtgcgtgtgctgcctgaagtccgtcattatttggccacacatggccataacgacattctgtcagccatggattgcgcgcattga

SEQ ID NO: 4702 - DNA, 801 bp, Vibrio cholerae; identical to SEQ ID NO: 4596

SEQ ID NO: 4703 - DNA, 780 bp, Vibrio cholerae
atgagtgtgcaagattataacactgcaattaaagatattgcgggcctgaaagactatacgcttgttttcaatataattagcgcctatttttgtgagcctaatttgactgactcgaagataactgatgaaaatgagtttgacattagaacttcaaaaactcgcaataaagtaagttgggcgattaataaggcgattctaaagtttataaatcaagatcatgagcttttaattaaaaaaatttatctttcagatgcgcctttaatagataagaagttttgctttttatggcacctatgtctaaataatcggttgttcagagaagtcacaacacaagtgttcagtaaagtgtatttcacaggaagagcacagatttcacaggacgacatcattgcctttctaaaagataaaatgtcttcagagggtcctgattttccgcaatggtcagaagatactttatatagagttgctacaaagtacctcagtttaatgaccaagtttgactttgtcacggtagggcgggggaagtctttcaatcatattcgcccaacacctgaggcattagtgcttttcgtatatttctctaatttattctcacctgagataaaaagcatttttgagcatgaattgctccctgcaagttttatagccaaagaagatattcaagaccgattcaaaaagctttcaatgaaaggcttctttgacatgagtttcaatggtgtagcgctcaatgtcgaattaactcatacctataaggatatatgcgatgccctttatagctga

SEQ ID NO: 4704 - DNA, 600 bp, Escherichia coli
atgaatataaaagaatatttaggcgatcttatcggaggcagtttattgataactgaatctagaataatcgcagaatcactactgaaaaaacttccagaagatgagtggaagtcgctgatcgttgagcaaaatgttcttcagaaaaaatccggtcagacggctattcgttatgccagaacaatccgttggcgtattgaaggcctgggtgatgagtttatgactgatcttttagccgcgagtgaacgtgcctatgtccaaatgctgatgatgtcattactcattcattctccggttgtcgcttattttatgcgacttaccttagccgaagctcgtcgcacctataaaccctctttaaccgctgatgcatggtctgagttttatgacacgagagtgcgggcatatgctgagcttggcggtttttctgactcaactgtcaaaaaaatgggtaacaacgcaattaaggcactggttgatagtggctacctgagtgatagcaggacaaagaaaatacaacctgtttacctaatgccagaagttaaagactggttagttcgtctgggccgggaagatttgattgaggtaatggagtgcacaatatga

SEQ ID NO: 4705 - DNA, 738 bp, Bifidobacterium bifidum
atggctggctcatacggcgcggagacgacgcagggggagagatacaggctttccttcaccgttggtggacttctcgccccgcagggccgtgcgcttgccgaaatgtacctgaatcgtatgggcgatggcagcactgagcgttcttcccaagccaaggtctctgaaaagatctctgaaaaggccaacgaaaagagcgacaagaatgctggcgaagaagtcggcgaatccattgctgcgattcgccaacaggccatcgaggaaaacgttcttgcgattcgcacggattccgcgaacaggcgcgttgtggcggaaactactaggcggctcagtgcgctcacggtcggggagcttgcatatttggcaggcccatattcctccatatccgaccgcgaggcacttatgtggatcgcgatgtgccgttattacgcaatcgtcggggaattcgccggcgaagtacttaaaaagcattatcttaccggcaatacgcatttggactttgaggattatgatcggttcattacggacaaagccacatggcatcctgagctggaaaacataagcgagggaacggcgaagaaacttcggtccaatctgttcaaggccatgagggaggcacatctgttcgataataattccgacacggtgctgtctttccttcccagtccctctttggcggatattcttagaaagagggcggattcgttcgggtatcttccgatgcgcgaatcgtcgttatga

SEQ ID NO: 4706 - DNA, 609 bp, Salmonella enterica; identical to SEQ ID NO: 4572

SEQ ID NO: 4707 - DNA, 600 bp, Vibrio cholerae; identical to SEQ ID NO: 4595

SEQ ID NO: 4708 - DNA, 615 bp, gamma proteobacterium
atgactgagaactttcgttacgacagtgatctcacgggcggctcgctaatggtaagagagagccgggtcattgctgacctgctgctcagccaggctgagcccgaaacatgggatcacgctatccgtgtcgaaaatcgcctccagaagccaaccgccgcctcagccaaacgcaacgcgcaggcgatcagaaagcgcctggagcgcctggaaccggaattctggcgcgctatacgtgatggcgacgaagaactggccacccaagcctcctattgcgcctccctggaacgcaacctcctcctcgtggaatttgttgagtcagtcgtaaaggatgcgtatgtcacccgtgccgacaagctggccttttacctttgggaggagtttctcgaccaccaggccaatcgagcgcctgaaatcctggattggaaggcctcaacgcggaaaaaaatggggcaggtcgctttccggattttggccgaggcgcattaccttaaaaacacccgagacaccgcgctccagcatgtcttggtgagacctgaaattcgcataatgctagaagactcctacaggcatcgcatattgcagtgcctggacgtgtccgctcgacgcgctcaataa

SEQ ID NO: 4709 - DNA, 786 bp, Pseudomonas psychrotolerans
gtgagcgcagtgcgtttttacaccacccagctccaggcggggttagggcttattgacgaaacacgcttgctgttgggactctacgagcaaggtatgagtacgagtgagttatcggataaggcactagcttccggccttttccctctggtttcggcccgtcgactgcacaatatcgtcagtgagtgttttgcgccgcgctttctgcgaacggcgggtactgctggcgcgcttaagagactggccgtcagtcttacgcgccaagaattcagccagctcctattcctacataccgcgcgcgccaatctgattctggaagatttcgtccgtgagcagtactggcagcactacagcgccgggcgtgacagcctgaccttggacgaagcgcgtgagtttgtgttgacaggtgtgcgcaagggtaaagctcagaagtcttggtctgataccacgatcaagcggatttcctcctacctgatgggctgctgcgctgactaccaattgctttcgtccaatagtcgggggcctcgccggattctgccatttcgaatcctgcccagggtggctgcctatctagcctacgacctcaagtttcagagcctgggggataaccaaattgttggccacagcgattggcaattgtttggccttgagcgagaagacgtgcgtgaagaactcaagcgcctctcactgcaaggttttctgatcatgcagtccgctgccgacgttactcatatcagttggacacacaagtacatggacgaggtgatcgatgtcctcagtcaaggctga

SEQ ID NO: 4710 - DNA, 597 bp, Acetivibrio cellulolyticus
gtggataataaaacctacagtgcgaatttaacgggtgcgtggtttttattttatgaaataaagcaaattgcaaagttaatagaggctggtttgcctgttgaggatataaaaaagaaagtgtttgaagaaaatctatttcaacacaaaactaaatcaagtattataagggcatatccatctgtgttgagaagagcaaaacttttaagcacagggttaagaaagcttttaattgaaagctctgttgaagatggtaaactgataaacctgtatgctatttctgaggatgacttattatttaatgagtttcttttggaaatattaaaagataagtatgaatcaaatcatctgcttttggaaaaaagggacgtcaatatgtatttcacgcacaaagcagagcagaatgaaaaggttgcagcatttactgatgcaacagtgaataagttaaggcaagtctatctaaggatattaactgaagttgggattttagcaaatcctaagagcggagaactgaatcggatatttgttgaagcaggtataagagatgcaattgttaaaaatggtggtagcagctttgtaaaaatatttgaatcaaagtag

SEQ ID NO: 4711 - DNA, 597 bp, Fusobacterium sp.
gtgcttatgaaataccgagcgattacgggagaaaatttttatgtacaggagctgaaaaatgcttgtcaatttttacttcaacatcctgaggtagaaaataggaaacaagcttttcaagaactggatatcttaaattgcatcagtgagagcaattttaataaaaaatttcaagcgattcaaaaaaggttgcaagtatttactcctaaattgatggaattatttttaaaagtagattatagtacagtaaaatttatcaatctttatgccattctttcaaaagagagattttttgcagagtttatggatgaagtactaaaagaaaaatattctcttttagattttgaattaacaaattatgacttttatgaatttatggagagaaaaagagagcaatcggaaattattcaacagtggtccaatgccgggtgtaataagatgatacataaattgaaaaatttccttatagaagccaactttttagagaaatctctttctggagagctatacttgataaaaagacctttggtagatatggctgttattgaggaaatagaaaagcatggaaatgtaaaaatattaagattgatgttatattaa

SEQ ID NO: 4712 - DNA, 801 bp, Vibrio cholerae; identical to SEQ ID NO: 4596

SEQ ID NO: 4713 - DNA, 609 bp, Salmonella enterica; identical to SEQ ID NO: 4572

SEQ ID NO: 4714 - DNA, 801 bp, Vibrio cholerae; identical to SEQ ID NO: 4596

SEQ ID NO: 4715 - DNA, 585 bp, Fusobacterium nucleatum
atggaatacagagctattacagcagaaaatttttatttgattgagatgagaaatacttgtaaatttattttagaaaataaggttgaagaagatttaaaaaaaatgttaaaagtaaataatattttagaaacagttagtgaaagtaatttttcaaaaaaatttaatactataaataaaagattaaaatttttaactgataatttaaaaaaacaaatagtaaatacagatttaacttctgctagatttattaatctttatagtatactatgtaatgaaagatttatattagaatttttagaagaagtggtcaaagagaaatatgataactatgattattctataaaagaaagtgattttttaagttatctagctactaagtctgagcaatcagagattattaataattggacagcagaaggtaaacgaaaaatgttagtaaagattaaaaactttttaacagagggtggatttttagaaaagaacaaagatagctataaaataataaaacctattgttgatttagctgttatagacgaaattaaagaaaatgggaataaaaaaattttaaaaataatgttctattaa

SEQ ID NO: 4716 - DNA, 585 bp, Fusobacterium sp.
atggaatacagagctattacagcagaaaatttttatttgattgagatgagaaatacttgtaaatttattttagaaaataaggttgaagaagatttaaaaaagatgttaaaagcaaataatattttagaagcagtcagtgaaagtaatttttcaaaaaaatttaatactataaataaaagattaaaatctttgactgataatttaaaaaaacaaatagtagacacagatttaacttctgctaaatttattaatctttatagtatattgtgtaatgaaagatttatattggaatttttagaagaagtggtcaaagagaaatatgataattttgattattctataaaagaaagcgatttttcaaactatatggaaactaagtctgaacaatcaaaagttattcaaaattggacagcagaaggtaaaagaaggatgttaataaaagttaaaaactttttaacagagggaggatatttagaaaaggacaaggatggctataaaataataaaacctattgttgatttagctgttatagatgaaattaaagaaaatggaaataaaaaaattttaaaaataatgttctattag

SEQ ID NO: 4717 - DNA, 639 bp, Acinetobacter lwoffii
ttgatcaggcctcataggagattggccatgttagaacaatttcattatgacagtgacctgattggtggctccctgatggtgcgtgaaagccggctgatcgcggatctgttattacgagaagcgattccagaacaatggcatcaggcaattcagattgacaatattctgcaaaaaagaacgcctgcttcagcccaacgtaacgccactgccattcgtaagcgtcttgagcgcttagagcctgatttctggaaagctttgcgggatggggacgatgagctggcgacccaggtggctttttgtggcgcactggaacgcaacctgttgctgcttgagtttatggaaacggtgatgagggatgcctatatctctcaggcgcaacacttggacagttatatctggtcagattttttggatgaacgctcacaacgcgatccggatatctgtgattggaaagagtccagcaagaaaaaaatggggcaggtggtgtttcgcatgctggcagaagccggttacttaaaaagtacccgtaagctggagttgcagcgcgtgatcgtcagagcagagctgcgtagcctgttggaagaacattataaacaacgcattaaaagatctatggaagtgtcggtatggacgcgttag

SEQ ID NO: 4718 - DNA, 600 bp, Lactobacillus casei
ttgaagaaattttcggcaacctttatttctcgtaccttctggtttcctgaattttctgcagtgatctcaatgctgaacaatggcaaggattgggatgacattgcagaagccatcattgacgacaacatcttcaagatgtcttcaacaaatcggtctactgagttaaaaagagaattgatgtttcgaatttcagctctaccagcaagtttttctgagctttttgagcagttacccctcaataatcagaagttaatgaatctaattgcgatcatgaatgcacatcctctggtagaagactttgttttagaagttgtgaaaaaagaatttttgactggtgatttgaaacttgaaccgtatgagattagtgcttacttgcaagatttaccactgcaacatccagaaacggctcattggacgcagcaaactttgaaaaaaattcagactagatttcacgaaatcctaacgcaaagtggcttggctgaagatgccggaggtgcaatgcaattaaaacgagctttactggaggcttcattggtcgcatggcttgaacagaatgggaagtctgattatattttggcactaacggggagagcattatga

SEQ ID NO: 4719 - DNA, 606 bp, Escherichia coli; identical to SEQ ID NO: 4690

SEQ ID NO: 4720 - DNA, 612 bp, Acinetobacter sp.
atgttagaacaattttattatgacagtgacctgattggcggttccctgatggtgcgtgaaagccggctgatcgcggatctgttattacgagaagcgactccagaacaatggcatcaggcaattcagattgacaatattctgcaaaaaagaacgcctgcttcagctcaacgcaatgccaccgctattcgtaagcgtctggagcgcttagagcctgatttctggaaagctttgcgggatggggatgatgagctggcgactcaggtggctttttgtggggcactggaacgcaacctgttgctgcttgagtttatggaaacggtgatgagagaggcctatatctcccaggctcaatacttggatagctatatttggtcagactttctggatgagcgttcacaacgcgatcttgatatctgtgattggaaagagtccagcaagaaaaaaatggggcaggtggtgtttcgcatcctggcagaagccggttacttaaaaaatacccgtaagctggagttgcagcgtgtgatcgtcagagcagagctgcgtagcctgttggaagaacattataaacaacgcattaaaagatctatggaagtgtcgctatggacgcggtag

SEQ ID NO: 4721 - DNA, 801 bp, Vibrio cholerae; identical to SEQ ID NO: 4596

SEQ ID NO: 4722 - DNA, 630 bp, Holdemania filiformis
atgacacaaaaatcgaaggcagcactgcagagcgcaagcccatacaatgctgccataaccagagaacaatatttattttatgaggtgcgtaccaccgccaagctgctcacagaaggcttgagcgcagatgaggtggcggagcgcatcgtttcagagaatctgtttcagtatcccacagagaagtctgtccgtaagatggcacttgcctgcctgcgcagactggatgctctgcaggacgagacgctggtacaagcgattgctacacagtcgtccgatgtggcaaagcagatatgcctgtatgccatgatgaaacagtatcgacttgtatgggactttatggttaccgtgattggagagaagtacagattaaaggacacctcttttggtaagatagacttgaacgtatttttcatgcgtttacaggagcaggatgactacgttgcaacttggagtgattccacggtcaccaaactaaaacaggtgctgcagaagacgctggtggacaacgagtacatcgacagcacaaaagcggagcatttgaatccggtgctgatttctcctgtgctggagaatgcaatacgaagcaataacgatgatgctgcactggtggcatttaactgcttcatgtaa

SEQ ID NO: 4723 - DNA, 600 bp, Enterococcus faecium
ttgaataaaaaatattctgctggtctagtttctaaacgcttttggttttcagagttcaagttatatattcaattacgactagaaggatatacagatatagaaattaaagagaaaaatgaacatgaaaatatttttttggcagtgagcagtaaccgtcaaaaagaaatctatcagaacgtgaaaaggagagttagtcaactggatgaagctggattgcaacttttcaatcagttaaatatagataatcaaaagttagtgaatttgatttccatccttatgattgatgatctttttagtgaatttatgactgaggtatatgctgaaaatctacgtaaaggaaatttgcaattaacaccagttgattaccgttctttttttacagagaagcggagaagttcagaagatatttcaaaatggaaagattatacgattaaacggcttattgccgcttatcaaacgaatctaattgaaacaggattagtcagaggggaaaaagaatacggacgaatgaccccgatattattagataaacgattgattcaatggttagttgacaagaatcgtaaagatattgtactagcattgggaggaattttataa

SEQ ID NO: 4724 - DNA, 585 bp, Fusobacterium sp.
atggaatacagagctatcacagcagaaaatttctatttaattgagatgagaaatacttgtaaatttattttagaaaataagactgaagaagatttaaaaaatttattaaaagcaaataatattttagaaactgttagtgaaagtaatttttcaaaaaaatttaatactataaataaaagactaaaatctttaactgataatttaaaaaaacagatagtagatactgatttagcttctgttagatttattaatctttatagtatactatgtaatgaaagatttatattggaattcttagaagaagtagtcaaagaaaaatatgataattatgattattatataaaagaaagtgatttttcaaactatatggaaactaagtctgaacaatcaaaagttattgaaagttggacagtagaaggcaaaaagaaaatgttagtaaaagttaaaaactttttaacagagggagggtacttagaaaaaaataaagctggctataaaataataaaacctattattgatttagctgttatagatgaaattaaagaaaatgggaataaaaaaattttaaaaataatgttctattag

SEQ ID NO: 4725 - DNA, 597 bp, Clostridium butyricum
atggaatacaaatctacaattaagtcgagaccgtatttatacaaagagactaaaaaggcttcaagccttataaataaagggttagatgttgattgcataaaagaaaaatcattggaagataatatttttcaattagaaagtgaagccagaaagaaggaagttgcatcaataattgttgctagattgaaagatttagataaaaatattatagataaaattgaaaatagtaatgtagaaacttcaaaggttttagttttatatgcaatagttaaaacagataggctgttttttgaatttataaatgaagtatataaggaaaaaatactattaaaagatttgtatataagagataaagattttggagtattctttcaaaataaaagagaacaaagcgaaaaagtagcatcttggacagagtatacatttaagaaattaaaacaagtatacataagaatactatttgaaagtggacttatctcaaatcaaaagggagataaggaaataaaagtacctatcatagataatgatgttaaagagtatctatataaaattggtgacagaatatatataaatgcaattttaggaattgtagagtaa

SEQ ID NO: 4726 - DNA, 612 bp, Acinetobacter baumannii
atgttagagcaatttcattatgacagtgacctgattggtggttcattgatggtgcgtgaaagtcggttaatcgcggatctgttattgcgtgaagccacaacagagcaatggcatcaggcgattcaggtggacaatattctgcaaaaaagaactgcggcttcggcgcaacgtaatgccaccgctattcgcaagcgtctggagcgtttagaacctgatttctggaaagctgtgcgtgatggcgatgatgagctggcgacccaggtggctttttgtggtgcattggaacgcaacctgttgctgcttgagtttatggaaacggtgatgagagaagcttatatctctcaggctcaatacttggacagttatatctggtccgactttttggaggaacgtacacaacgagatctggatatctgtgaatggaaagagtccagcaagaaaaaaatggggcaggtggtctttcgcatgctgacagaagctggttacttaaaaagtacccgtaagctggagttgcagcgtgtgatcgtcagagcagagctacgtagcctgttggaaaaacattataaacaacgcattaaaagatctatggaagtgtcggtatggacgcgttag

SEQ ID NO: 4727 - DNA, 609 bp, Cellvibrio sp.
atggctgatttttcttacaacagcgatttgaacggcggctcgctcatggttcgtgaaagccgcgtagtggctgatttgttgctcaataatgcgaccgcgagtgagtggcaccaagccattcaaattgacaacctacttcaaaaacgtagcccagcaactgccaagcgcaacgcacaagctattcgcaaacgcttggaattaattgcaccggaattttggcgtgccctgcgcgatggggatgatcagttagccactcaagtggcattttatgcggccttggagcgaaacctgttattggtagagtttattgaatcggtagtacgtgatgcctatatcacccaggccaatcaactggcttcgtatcaatggctagaatttttggaagatcgcacccacaaagatgaatccattagcacctggcaagatgccaccaaaaagaaaatggggcaggtggtttttcgcatgctcatcgaggcgggctatatgcagaataaccgcaacttgcagctacaaaaagtattgttacggccagaaatgaaagtcatgctcgaggatagctacaagcagcgaatcatcgactgcatggaagtatcactaagaaccggttaa

SEQ ID NO: 4728 - DNA, 558 bp, Faecalibacterium prausnitzii
atggaatttcggaaaaccgtgcagcttttgagcgagggtaagagctttgcggatattaaaaagttgaatgaagagacaaacatctatggtgcaccgacaaaactacgagcgcagcagatttattctaccgtaacagcccgtatcaagacattagatgaaagcttttatccaatctttttgagcagtgatcttgctacacaaaaactatttgtgctgactgcggctcttttgcatgacacgctgttctttgattttgtgtatgaagtagtgcgggaaaaaatgattcttggttccgatgagctgacggatgcagatatccggatatttttcaaaaataagcaggaacagagtgagaaagtggcttctcttcaagactatacgctgcgccgcctcggttcctgctataaaacgcagctttatgaagcggggcttttagaaagcaaccgggcaaacagcacaagaaaaatactgaagccaattcttgatattgcatttgagcattggctttatgaccatgatcttggcatcatggtaaaaacactgacgggggtaagatga

SEQ ID NO: 4729 - DNA, 630 bp, Fulvimarina pelagi
atgatcaatagcaggatccgtatggccggctccgtgaatgccccgatctacaaagcagacatcgccggcggcgccttgatgctcccggagagtcggcggatcgcacggctcctgattgatggtatcgatggggacgagtggcggcggaagatcgagcgggagaacatcctgcagaagcgctctccttcgacggcaaagcggcaggcaaacctcatccgcagccgattggacctggtcgatccgggtgtctggaatatcatcgcggatagccccgcgtcgatcgcaagtcaggcggttttcgcggccgccattcagcatagcgctctcttcgccgacttcctgcctatcgtgcgggatcgcttccgggttctacagggcgatctgcctcgacgtgcctggatcgattacgtcgatcgctgccacgacatcgatccccgaatgccgcactggaaggtgtcgacggttgacaagctcggagacgccgccttccgcatgctgcacgaagtgggcttcctgaccggtggtcgtctcaacatcctacgtcccgtcgagatcgacgcggcggtcatccgcgctctcaaggcggggcgccatcaccttgccctcgatcgcatccaggtgtctctatga

SEQ ID NO: 4730 - DNA, 606 bp, Escherichia coli; identical to SEQ ID NO: 4534

SEQ ID NO: 4731 - DNA, 777 bp, Delta proteobacterium
gtgatgtataaatccaaccagttgtataacacacgcatccagaaaggcggtgctcttctggaagacatgcgcatgattgtgcgctcatgggaggaatttgaggggataggcgctacgagcgatattcgccgtctgctcgggaaaaaaacccttgcacgttctagggacacgttggttcggacgtttgttcccagattcattcacggtgatcccccgaatgcgtggaagatcgtccgattactcgaaaacaggagcgtcgctcttgagattcttcggcccgtctattactggatcaccgctcgtagtgacaggctcctttatgaattcgtaacggaggaattgattcatgtggctcgttccggggatggttcggtgaggatcgaggaaacggccacgtggatcagttcccatataaagaaggcggggcaggagtggactcccaccgttactctcaaagtggggcgcggcatgctggcggcccttcgggacttcgggatcctggaaggcggatcaaagaaacggatcgctccggtacatttgcccatggaagctttctgttatattgcattttggctcgaaagacttgggtatggcggaggaagcctgataaatcattccgactggggcctgttcctcttaaacccgccgcttgttgaacggctgatgctcgaagcgcatcaactgagcctggtgggtttccactcggccggccgaatttacagggtggatttcccaacggatgatcccggagactatgctaatgtcctctttggctaa

SEQ ID NO: 4732 - DNA, 600 bp, Lactobacillus johnsonii
atgccgcgtacttataatggtggaattgcttcatatgcaatttggttgccggagtttgcacaatttattgagctttatcaatcaggaaaaagtattgatgaaataaaacatcttagcgataaagaaaatatatttaaaatgtctagcaaatctcgggctagacgttgttcaagaaatttatctgtcagaattgatgctttaccaaaaactattatagatatttttccatctttaaatcctaccaatcaaaagatagtgtcactaatatctatgatgttaacaagtaaaattcttaatgaatttgtttatgatgtatatcgacctaaagtgattatgcgcgaagatactttacaagattatgaaatagaatcatttcttaaccagaaaagaatcgaaagtcctgaggtcgcaaaatggtctcttaatacttttaaacgtttaaaaggagctttgaagactttcttgagggatgggggattgttagagaatgttaaatctaatgaggataagctactttttccattaatagattcacaactaatcactattatgaaagaagaaaaattagactatgaattggctgctctaggagaaatataa

SEQ ID NO: 4733 - DNA, 603 bp, Thiothrix nivea
atgataaatgccaaagaatacatgggcgacttgatcggcggcggcctgttgatggctgagagtcggattgtcgcggaaaccttgctgaaagacctgccagaagaagactggaagtgcttgtttgaggttgaaaacatcctgcaaaaaccctcccggcattcatccatccgttatgcgcgcgccatccggcggcgtttgacccctttgggcaaggaattcatccaggcattgctgaaagcccctgaagcagaatatgtgcagatgttgttgctggctgtcctgattcactctcccgtgctggccgatttcatgcgtctggtagtggcggaacataaacggctgtataaacttgtgcttcccacaggatcatgggatttttttattgcagaacggattcaattaatgccagacttggacagtttttctgtctcaacattgaacaaaattggtacaaatgccgtcagagtactggttgaaagcggctatctgaattccaaccgacaacgcgaattccagccggtctacctgcttcctgaagtgcgccagtggctgctgatacttaaccaccctgaacttgaagatgccatggaatgcacaacctga

SEQ ID NO: 4734 - DNA, 606 bp, Escherichia coli
atgattaaaaatgacaaggcatggataggagacttgctgggcgggccgctcatgagcagggaaagccgcgtcattgccgagctgttgctaaccgatcccgatgaacagacatggcaagagcaaattgttggccacaacattttacaagcctcttctcctaacaccgcaaaacgttacgcggcaacaatcaggcttcgcctgaacacgcttgataaaagcgcgtggacattgattgccgaaggtagcgagcgggaacgccagcaacttctgtttgtggctctgacgctacattcgccggtagttaaggattttctggctgaagtggtgaacgatctgcgcaggcagttcaaggaaaagttgcctggcaatagttggaacgaatttgttaatagccaggttcgtcagcatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctggggcaacaggacttgatatctattctggagggaaaacggtga

SEQ ID NO: 4735 - DNA, 621 bp, Brevibacterium mcbrellneri
atgagcatcagatctcagggacatgatcgatacgcgctgtccttcaccagcggtgccctcctggctcgggaggcggtgatcgtcgcgccgctcttcctggaagttcgtgactggggtctggttcgagaccagctccgttcagagaacttgctccaggcgcgaaccgcatcgtccggattccggctggcgcgcgaggtcgcgcagcgattggcagtgctcacggacccggagctggagttgctgcgagacgccagccccagtgaacgtgggcacctgatgtgggtcgcggcgtgccggcgctacgcgctcatcggcgacttcgcggaagaggtggtacgcgagcgcttcctcttgctcactcccaccctgggatacgacgacttcgacagcttcgttcgtgggaaggcactgtggcaccccgagctcgcagaggtgaaggactcgacgttgcagaagctccggtcgaccgtgttccgcatgctgaccgaggctggactgcttgcaggcggcgagatcgtcaacgcggcgctgtcagagcgtgtccgggaagcactcgacgctcagctaccaagtgacctccgctacctcccggcccgtgacagcaaggaggcctcgttgtga

SEQ ID NO: 4736 - DNA, 606 bp, Escherichia coli; identical to SEQ ID NO: 4534

SEQ ID NO: 4737 - DNA, 594 bp, Geobacillus thermoglucosidans
atgttgaattactctgctggatttacgagtgaaggatggtttcaaaatgagatgtttattgtccttcagatgaagctagacggtttaactcgtaaagaaatcattgaaaagattattgaaaacaatttatttcaaatgcgcagtgaggctggtattagaaaaagatttcaaatggtttatcgacgttcggaagcctttgatacgtctttagcgaagtactatgtagaagggaatcggttagatcaaaaagcacttctattgtatagctatctaaaaacctaccgctttccgtatgattttttcatggaagttattgtctataattaccaaaaaaataaaccaattattcaaactgtagaaattgattattttatggaacgaaaagaaagcgaatccgaaaaagtagcaaactggagacctgaaacaaaaaagcgcttacgtagctctattattatgtttttccgcgaaggagggctactacgggaaatggaacaagatacatatgagatcacacctttacatatgagtaccactttgaaagaatatgccaaacaacacgataaactgctatcacttttgagtaatttaaagtag

SEQ ID NO: 4738 - DNA, 801 bp, Vibrio cholerae; identical to SEQ ID NO: 4596

SEQ ID NO: 4739 - DNA, 600 bp, Enterococcus faecium; identical to SEQ ID NO: 4687

SEQ ID NO: 4740 - DNA, 600 bp, Enterococcus faecium; identical to SEQ ID NO: 4687

SEQ ID NO: 4741 - DNA, 600 bp, Vibrio cholerae; identical to SEQ ID NO: 4595

SEQ ID NO: 4742 - DNA, 597 bp, Sporosarcina newyorkensis
atgacaatagatttagaatattcttcaagtttgaatggtgcatcctatttattatttgaacttaaacaagttattaaattaaagcgaatgggtttaacatcatcagaaataagagctaaagtgattgaagaaaacctctttcaatttgaaaacaaaggtagaatcaatcgtgcattgccatccgttatgcggagagcagaagtgattgacaaaagtttagctgacctcttattagaaggttctattgagatggcgaaggttatcaatttatatgccattatgaaaacagatttgctgttttttgaattcatgaatgaagtgataggcgagaaactccataataacgacctattaattgaaaagaaagacataaacgtcttctttactacaaaagcggaacaaagtgaaaaggtcgccagttggagtgccgttaatacggaaaagctgaaacgagcattcatgcaagtgttattcgaaagcggattactaaagaaaagacgaggcgaggagttaagtcgtcttattgttgacgagcaaataaaggatcatttgatccgcattggtgatgcaaagtatgttcaggcgatgggagagtaa

SEQ ID NO: 4743 - DNA, 801 bp, Vibrio cholerae; identical to SEQ ID NO: 4596

SEQ ID NO: 4744 - DNA, 780 bp, Vibrio cholerae; identical to SEQ ID NO: 4703

SEQ ID NO: 4745 - DNA, 780 bp, Vibrio cholerae; identical to SEQ ID NO: 4703

SEQ ID NO: 4746 - DNA, 801 bp, Vibrio cholerae; identical to SEQ ID NO: 4596

SEQ ID NO: 4747 - DNA, 627 bp, Desulfotomaculum gibsoniae
atggaaaacattggtgaaggagacatgacgagaaaagaatacagcgcaggagcagtgaagcgatccttctggtttgccgagtttcgcaaggtggtcaacctgcttaacagcggcaaaacattaaatgaaatcaagactttgaatttagaagaaaatatcttctcagccccgacacaggcaagggcaattcaaatattcaatgcggtgtcttctcgtgtaaaaaacatagacaagtctttttatcaattatttgagcgatgtgatatcgcaaatcaaaaaataattgttctgacagctgtgatgcagagcgacagtttattttttgattttatatacgaagtctaccgtgaaaaattgattatcggtgacaatgaattgactgacagagactttagtatttttttcaaaaacaagcaattgcaaagtgagaaagtggccagctggacggactacactttaaaacgtttgagcacttgctataagacaatgcttatggaagccggtatcataaaccgggcaatcggaaatagaaaaatcttgaaaccaatcttggataaatcgttggaaaactgcctgctggcaaatcgtatggaaataacgctccatgcgttgacgggagtgagataa

SEQ ID NO: 4748 - DNA, 801 bp, Vibrio cholerae; identical to SEQ ID NO: 4596

SEQ ID NO: 4749 - DNA, 597 bp, Vibrio shilonii
atgtctgaacacaaacgctacttaggcgatcttattggtggaagtctaatgctccgtgaaagccaaatcattgccgacctgctattaacagaaccaaccctagaggattggaacaaagcgattgtagaagagaacatcttgcaaaagccttcagctgcgtcagctaaacgcaatgccgcgacaatcaaaaagcgtctggaatcgttaaacaacgagtaccttcaaaaattagcttatagcggtacagaagaagcaacacagttaatgttcgctgcaacattaatcaacgcccctatcctagcggattttatgcgaattgtggtaacagacgcaaagcgtatgtatagagaagcattgaacgtagatgactggcagcatttttggcaggagcgcggacgcttatacccaggtttactggagatgtcagaggcatctacatataaaatatcccaagtcgcgttcaaagttttagcagatgcaggctatatagactccaccaaacacaaaaaactcatgaatatctttgtctcacctgatgtacgcagtctcctatcagagatggatagagatgatatcgtcagagcaatggagccataa

SEQ ID NO: 4750 - DNA, 609 bp, Brachybacterium paraconglomeratum
gtgaacagtgactcagctgttgcgccgcgctacgcgctgtcgttcacgactggtggcctcctggagcgggagtccgccgttttggcgcccgtgtacatcgagcatcgcgactggcggaaggtgcgcgacatagccgtcgaggagaacctccttcagactcggacccgtagcacgggtgtccgtcgcgtccgagagaccgtcaagcggatgtcggcgctcttcgaccttgagattgagatcttcagcgatatcaccgcgactgaacgcggccacctcatgtgggttgccgcgtgtcgccgatacgaactcatcggcgagttcgcggaggaagtcctgcgtgagcgcttccttaccttggcgggtaccgtttcctacgcggactacgattccttctaccgcgccaaggccatgtggcacgacgaactgggcgcggtctcggacctctcgtacaagaagctccgccagatgctcttcaagatgatggtagaggcggggctgctgacggcccagggcgcgatcgagccggtgctcctgtccgcccgcgtcgccgattgtctcaaccagcgcacgccgagcgacatccgattctttccgacgagggtggtctga

SEQ ID NO: 4751 - DNA, 609 bp, Salmonella enterica; identical to SEQ ID NO: 4572

SEQ ID NO: 4752 - DNA, 591 bp, Eubacterium cellulosolvens
atggaatataacgcaagtgcgacgaaacaccttttctggtttgtagaaaccagagagacagcacgcctccttggaaatcattccatggacgaggtcaggcagattgtaatagacgtgaatttgtatcagcagaaatcgaattccagacttatagatgaatttgggtgtattcgaaaaagactggaagcgcttccggaagagcttcaacggatgatggttacagcggatattaacacaggtaaattgattgcatttgttggttgtatggcggctgataaattgttgtttgatctgatgtatgacgtatatagaagaaagctatatttcggcgaactaactttgacggatgctgatctaactgtcttttttaaagataagcaggatcaaaatgaacaggtagctgcgattacggatacatctgtcaaaaaactgaaacaggtttatagcaagtacatgtttgaggcaggattgcttacaggaaaaatttccgacaaacagttgagtaagccatatattgatccggatcttagattcgcacttcagaggaattcaatggataaatacctggcagcattaacgggggaaaagtaa

SEQ ID NO: 4753 - DNA, 636 bp, Pseudoalteromonas luteoviolacea
atgacttcaactaataacccgttaaacaaacacgccatcaaaacacacaaggactaccttggtgatttaattggtggcagtttaatgatcaaagaaagccaaatcgttgctgaattattacttaaaaaaccatctcaagaagaatggttagatgcaatcgttaaccgaaatatattacaaaaacgttccgatgcgtcagctaaacgtaacgctgcgactataaaaaaacgtatcgaagacttgccagatgaatatcttgagcaggtagcatttggtagcacggagctttcgactcagctgatgttcgcagcaacgttaataaatagcactttgttagctgactttatgcgaaatgtcgtgctcgacgcaaaacgtatgtttagagaaagcctagacgttggtgactgggaatcgtattgggaagaccgctgccgtctgtttcctgaactagccaatatgtctgacgcgtccacttataaaatatcgcaagttgcctttaaggtcattgctgatggtggatacatagaaacaactcgtagtaagaagttacagaatgtttatctgctacctgaagttagacaactgctcctgtcgatagacagagaggacattattgcagccatggaattaatctaa

SEQ ID NO: 4754 - DNA, 594 bp, Clostridium perfringens
atggaatataaatcaacaataaaatcaagaccatatttatataaagaaaccaaaaaggctgtaagccttataaataaagggttagatgttgatggtataaaagggaagtctttagaagataatatttttcaacttgagagtgaagcgagaaaaaaggaagttgcatcaataattacttctagaatcaaaggattagatccttatattttagataaaattgaaaatagcaacatagaaacatcaaaaattttggttttatatgctatagctaaaacagatagacttttctttgaatttttaaatgaagtttataaagaaaagatagttttaaaggatttttatatcagagacaaagattttagcgtatttttccaaagtaaaaaagaacaaagtgagaaggttgattcttggagtgaatacacatttaagaaattaaaacaggtttacataagaatcctttttgaaagtggacttattggtaatcaaaaaggtgatagagaaatagtagttcctataattgattcagatgttaaagaatatttatatgaaataggaagtaaaccttatgcggatgctatattgggaatagattaa

SEQ ID NO: 4755 - DNA, 600 bp, Vibrio cholerae; identical to SEQ ID NO: 4595

SEQ ID NO: 4756 - DNA, 606 bp, Escherichia coli; identical to SEQ ID NO: 4534

SEQ ID NO: 4757 - DNA, 801 bp, Vibrio cholerae; identical to SEQ ID NO: 4596

SEQ ID NO: 4758 - DNA, 294 bp, Vibrio cholerae
atgaccaagtttgactttgtcacggtagggcgggggaagtctttcaatcatattcgcccaacacctgaggcattagtgcttttcgtatatttctctaatttattctcacctgagataaaaagcatttttgagcatgaattgctccctgcaagttttatagccaaagaagatattcaagaccgattcaaaaagctttcaatgaaaggcttctttgacatgagtttcaatggtgtagcgctcaatgtcgaattaactcatacctataaggatatatgcgatgccctttatagctga

SEQ ID NO: 4759 - DNA, 588 bp, Fusobacterium ulcerans
atggaatatagagcaataactggagaaaatttttattttactgaaatgaaaaatgctggtaaatttttagtagaaaaccaaattacagaaaatttaaaggaaatatttaaggaaagggacatcttagattgtattagtaaaaataattttaatagaaagtttcaaactgttaataaaagattaaattctttgacatctattttaaaatattatttagtaaatagtgatactaatactactaaatttataatattttatagcattttatgcaatgaaagaattgtggcagaatttatggatgaagtaataagagaaaagtataataattatgattactatctaaaagatagtgaatttataaaatttttagagaataaagctgagcaatcagaaattattgaaaattggagtgatcctacaaaaaagaaaataattttaaaattaaaaaattttttaacagagagtggttttattaaaaaggagaaggagaaattatataaaatattaaaacctcttattatttctgaggtcatagatgaaattaaagaaaatgggagtaaatcaatactaaaaataatgctttattag

SEQ ID NO: 4760 - DNA, 642 bp, Roseobacter sp.
atgaccatggcggcgcggcaagcagagttcggggtgaagcagccctacaagatgtccttcacctctggggggcttttcttgaatgaatgcatcgatcttgcagcgagctatctggaaacccgcgactgggatgtcacgatctcccagttgcaagctgatggcctcacatcatcgcccaagcaaaagtcaaagcgtcgaatactccgggaactggtcaatcgcatcgaaacgctgaccgaggacgagttgcgtttcctggttgagcgtgccgatcgacaagatcaagcgctgctcatttggctttccttttgccgtgcctaccggctggtccgcgagttcacactcgaaatcgtgcaagaccggtatctcgcctatcagctggatttgtcgaccgacagtttcgatttgttcttcgagcataaagccgagtgggatgacactttggcctccacctctgcctccacacgcgttcgcctccggcaggtcgtgttcaagaccatgcgagaggttgggattatctcggaagaaaaccggatccagtcgagttacctctcgcctcagctgcgcgcgctgattgaggcgaccaatccggctgatctggccgtgttccctggagttgtgattgagggaggtctgtcgtga

SEQ ID NO: 4761 - DNA, 606 bp, Escherichia coli; identical to SEQ ID NO: 4534

SEQ ID NO: 4762 - DNA, 600 bp, Paenibacillus elgii
atgtctcaagaattagaatatagtgcgaacttaactggggcatccttcctgctttacgaatttaaacaggtcgtaagtcttaaagagcagggattagaggattcagacataaaggttagggttttgactgaaaacctgttccaataccaggtgaaagcgagtctgaagcggagcctaccaactgttttgcgtagagtaaaagttttggacgataccttgagaaaaatggtgttggaagaatcgctggatacgtgtaaaatcattaacctttatgccatcatgaaaacggacaggctcttttttgaattcatgaatgaggttatccgagaaaagcttgagacggataactacatgtttgaaaagaaggatctcaatgttttcattgcctctaaagcagaacaagatgcaggtgtggcgagttggatggaacagacagttaataagctgaagcaagtgttcgtcaaagtattgtatgaatcaggtctgctaaaagataaaaagacaggtgagctaagcaggcttcttatggacgagcaattagaacagcatttgattcaaatcggagacattgcttatttaagagcgatgggtgaggtatag

SEQ ID NO: 4763 - DNA, 606 bp, Escherichia coli; identical to SEQ ID NO: 4534

SEQ ID NO: 4764 - DNA, 612 bp, Pseudomonas mandelii
atggctgagcattatcgtctttctttcaccacgggtggcctgtttttgcgggaagcaccgctggttgtggagcgctatctaacgctgcgtgattggaagcaaactcgggagcaggtgcggggtgagaatctgttgcaagttcgtacagcagcagctgcgacacgtatcagtaaggagttgatcgcgcgtctggagcttttggatccagaggagctggagtttttggtggatggcagcctgcgtgagcaaggctaccttctgtgggctgcaacttgccggcgctatgccttcatccacgacttcgctcgcgaagttctgcgcgagcattacctgcttatgcgccgccaactcacgacaagcgattacgatgccttctgcaatgccaaagctttgtggcatgccgagctggatgaattggctgcgtccacgcaaagcaaattgcggcaaaacctgttccgcatgttgcgggatgccgacttgatcagcgcacagcaccagattcagcctgtgttgataactccagcgctggcccatttactggctcgccacgataacgagcaattgctgattttcccggcaactgaccatgaacttaaaaggtggctgcaatga

SEQ ID NO: 4765 - DNA, 600 bp, Vibrio cholerae; identical to SEQ ID NO: 4639

SEQ ID NO: 4766 - DNA, 801 bp, Vibrio cholerae; identical to SEQ ID NO: 4596

SEQ ID NO: 4767 - DNA, 801 bp, Vibrio cholerae; identical to SEQ ID NO: 4596

SEQ ID NO: 4768 - DNA, 597 bp, Geobacillus sp.
atgcttgactattcagctggttttacaagtgaaggctggtttcagaatgagatgtatatcgttctgcaactaaaaaaatccggtttaagcagaaaagaaattttgaacgatataattgaaaaaaattcctttcaaatgagaagtgaatcaggaattagaaaaagatttcagatggtatatcgccgctccgaaacctttaatgatgaattaattcaattttatttaatggggtctcgacatgatcaaaaggctttacttttatacagttatttaagatgttatcgaattccttatgaattttatcttgaagttattaaatataactaccttaataataagcctttgatccaaacggttgaaattgattattttattgaacggaaagaaacggaatcagaaagcgttgcaaattggcggcctgatacgaaaaaaagattacggagttccattctcctgttctttagagaaagtgggatgttgcagaaaaaggactcggttacatatgagatatcgccaatacatatgagtacaaagttaaaagaatatgccaaagaatatgataaattattgtattcctttagtgaattaagtaggtga

SEQ ID NO: 4769 - DNA, 618 bp, Escherichia coli
atgacaaataccatgacaaaaaatgacaaacgctggattggcgatctgctgggtggttcgttgatggttcgtgagagccgaaccattgctgagctgttgctctctgaaccagatgaaacaacctggcagcagcaaataatcaatgaaaatattcttcaggcgtcctccacgagtacggcaaatcgttatgcccgaaccttaaggctgcgattgatgaccctggatcgggagtgctggcaactgattgctgatggcagtgaaagcgagcgtctgcaaatgttgttggttgcgttgatgatccagtctccagttgttgcgacgtttattgctgaagttgtaaatccagctcgtcagcagtttaaagaaaagcttggtataaattgttggagtgagtttgtggatgagaatctccgtttacacccggaactggcagctttttctgattcatcgatccaaaagatgggtaacaatcttattaaggctctcgcagaagctggttacctggatagcccacgccgccgcaatttacaaaacgttttcctgctaccagttgttgcagcggccttgcatcgtttaaacaaagccgaactgctccctattctggagggtaacgcatga

SEQ ID NO: 4770 - DNA, 609 bp, Salmonella enterica; identical to SEQ ID NO: 4572

SEQ ID NO: 4771 - DNA, 648 bp, Collinsella stercoris
atgcacgagcgggggccgcccatgagtgcccccatcacctaccgcggctccatcacgcgcgagcagtggctcgtcgacgagacccgcacggtcgcgcgcctgcgcctcgaggaccctgcgctcctcgacacccgcgtcctcgccgcgcatatcctcgaaaacaacctgttccaataccccaccgagcgcgaggtcggctccatcgcgcgtgcctgcgcgcgcaggctcgacgcgctctcgagcgacccggatcggcgcgaccgcctgacccacctcatcgcgcgcggcaccaccgagcagctcaggcaggcgaacctctacgccctcatgtgcgacaaccgcctggtttgggacttcatgacctgcgccgtggcgggcaaattctccatgctcgacatgcgcctgggaaaggcggagatcgccgcgttcctcgagggcctgcgcgcccaagatgagcgcgtcgccacctggagccccgccaccctcaacaagatccggcaggtgctcgcgcaatgccttgagcaatgcgggatgtacgaccgcaagacggagcagctgagcacgcttctgctcgactacgacctggaaaacctcatacgcgagaacggcgacgccggcatcctgcccgcgttcggcctcacgcgatag

SEQ ID NO: 4772 - DNA, 546 bp, Glaciecola punicea
atgattcatgaaaacctaattattgcggaagaatacaataaatttaaagattggaccttggttcgtgatgaagttttaggtaacaatcttttacaagccagaacagaaagtaccttaaaaacgttttacggtgaagtatctaaacgactcaaaaatttgactgatgatgaattagctttaatgactgaatctgacgcagatgttaagcatttggtctggctagcaatttgtcgtcaatatttatttacttatcaatttgctgttgagattttatctgaatactttgataaaagtcgatttcagctctactcagaagattacgatgcttttttgaatgcgaaagctgagtggcacaaaaatttagatagtatcactacaaactctagatataagtcacaacaaaccatgtttaaaacgctggtcgagtgcggtttaataactaaaagtaaagagatattacatcagcacctttctccaaaacttcaagggcttattatgcagaccaatgctgatgatttgagaatatttccgagggtttttagttaa

SEQ ID NO: 4773 - DNA, 603 bp, Enterococcus faecalis; identical to SEQ ID NO: 4668

SEQ ID NO: 4774 - DNA, 582 bp, Pseudoalteromonas flavipulchra
atgagcgataagctatctctaacactgcgtcctgcaatgatccacgaaaacttaattattgccgaagagtacaataagtttaaagattggactcaagttcgtgatgaagtgattagcggcaacctgcttcagtcacgaaccgacagcaccttaaaaacaatttatggtgaagtttcaaagaggttaaagaaccttactgacgaagaattggcgttgatgattgagtctgatgctgatgttaagcatttagtgtggctcgccatttgccgacaatacctatttacttatcagttcgcggttgaagtattgtctgaatactacgacagaagccgttatcagctttattccgaagactatgatgcttttcttaatgcgaaggcagaatggcacagtaaccttgacaatataacgcaaaaatctcgttataaatcacaacaaatcatgttcaaaatgctggttgagtgtggattgatcacaaaagaaaaagaaatattaaatcagcagctatctccaaagttgagagagttgatctcaaaaaaaaatatcgatgatttaagactatttccgggagagtacgtttaa

SEQ ID NO: 4775 - DNA, 606 bp, Escherichia coli
atgattaaaaatgacaaggcatggataggagacttgctgggcgggccgctcatgagcagggaaagccgcgtcattgccgaactgttgctaaccgatcccgatgaacagacatggcaagagcaaattgttggtcacaacattttacaagcctcttctcctaacaccgcaaaacgttacgcggcaacaatcaggcttcgcctgaacacgcttgataaaagcgcgtggacattgattgccgaaggtagcgagcgggaacgccagcaacttctgtttgtggctctgacgctacattcgccggtagttaaggattttctggctgaagtggttaacgatctgcgcaggcagttcaaggaaaagttgcctggcaatagctggaacgaatttgtgaatagccaggttcgccaacgtccggtactcgccagctactcagattcatctatcgcaaaaatgggaaacaatctggtgaaggcgcttgctgaagcgggttatgtggatacaccccgcagacgtaacctgcaggcagtttaccttttaccggaaactcaggcagtgttacagcgcctggggcaacaggacttgatatctattctggagggaaaacggtga

SEQ ID NO: 4776 - DNA, 669 bp, Johnsonella ignava
atggtagagtcaaaagcggcaaatacattaaaacaaaatccggaaatggagagaacgaagatgaaaagaaaaccgtatagtgccggggctgtgaaatttttgttctggttcatggaatttcggaagactgtgcagcttttgagcgagagtaagagctttgcggacattaaaaagttgaatgaagagacaaacatctatggcgcgccgacaaaattacgagcgcggcagatttattctacagtaactgcccgtatcaagacattagatgaaagcttttacccaatctttttgagcagtgatcttgctacacaaaaattattcgtgctgactgcggctcttttgcatgacacgctgttctttgattttgtgtatgaagtagtgcgggaaaaaatgattcttggttccgatgagctgacagatgcggatattcggatattcttcaaaaataagcaggaacagagcgagaaggtggcttcttttcaagactatacgctgcgccgcctcggttcctgctataaaacacagctttatgaagcgggacttttagagagcaaccggacaaacggtacaagaaaaatactgaagccaattcttgatattgcatttgagcattggctttatgaccatgatcttggcatcatggtaaaaacactgacgggggtaagatga

SEQ ID NO: 4777 - DNA, 780 bp, Vibrio cholerae; identical to SEQ ID NO: 4703

SEQ ID NO: 4778 - DNA, 801 bp, Vibrio cholerae; identical to SEQ ID NO: 4596

SEQ ID NO: 4779 - DNA, 609 bp, Enterobacter sp.
atgacggtgaagaacgacaaggcatggattggagacctgttaggcgggccgctgatgagcagggaaagtcgaatcatcgctgaacttatgcttaccgcacccgatgaacagacctggcaagagcagatcgtcggtcataacattctgcaagcctcctcggccaatacagcgaaacgctatgccacaacgataaaactacgcctgaatacgcttgataaagccgcgtggtcacttattgcggaagggagcgagcgcgagcgtcagcaattgctatttgtcgctctggtactccattcaccggttgttaaagacttcctggctgaagtggtaaacgatctgcgccgacaatttaaagaaaagctccctatagatagctgggatgagttcgtgaccagccatcttcgtcagcagcccgtactcactagttactcagattcatccatcaaaaaaatgggtaacaacctgattaaagcactggctgaggcgggttatctggatacgccacgccgacgtaatctccagtcagtctttcttttaccagaaacccaggcaaccttgcagcgcctcgggcagcaggaattgggtcctattttggaggggcaacggtga

SEQ ID NO: 4780 - DNA, 600 bp, Enterococcus faecium; identical to SEQ ID NO: 4687

SEQ ID NO: 4781 - DNA, 780 bp, Vibrio cholerae; identical to SEQ ID NO: 4703

SEQ ID NO: 4782 - DNA, 603 bp, Bacillus cereus
atggtaaaagagcaagattataagtcaactattaagtcccgcccacttctgtttttagagacaaagaaggtttcttccttgttatatcaagggttgaaagaatttgaagtgaaagaaaaagcaattgtggaaaatatatttcaagttaatacagaatcaagaaaaaaggaaattgcatcaagtgttttggcccgtttaaaaatattggatgagtatttaattaggggaatcggacatggagatatagaatccagcaaggcgattgtattatacgctattatgaaaacggaccgtttgttttttgaatttatgaatgaagtgtttaaagagaagtttgtttttagagaagcttttctgacagatgctgattttaatatattttttgaacataaacagcagcaaagtgaaaaagttgcatcatggaatgattatacgctttataaattgaaacaagtttacattagaatattatttgaagcaggttatttaaagaaccaaaaaggaaatagagaaatcgaaagaccgctattaaatgttgatgtggtagagcatatacgcgcattaggtgacaatatatatatggatattttagtaggtgaataa

SEQ ID NO: 4783 - DNA, 609 bp, Salmonella enterica; identical to SEQ ID NO: 4572

SEQ ID NO: 4784 - DNA, 801 bp, Vibrio cholerae; identical to SEQ ID NO: 4596

SEQ ID NO: 4785 - DNA, 801 bp, Vibrio cholerae; identical to SEQ ID NO: 4596

SEQ ID NO: 4786 - DNA, 606 bp, Escherichia coli; identical to SEQ ID NO: 4654

SEQ ID NO: 4787 - DNA, 603 bp, Salmonella enterica; identical to SEQ ID NO: 4491

SEQ ID NO: 4788 - DNA, 603 bp, Bacillus cereus
atggaaatgaaagtatattctggtggttttacagccgaacatttatatcgtaatgaaatgaagatagtggcagacctacaattaaagggtatgtcaaagcaagctattaaagataaaatatttgaggaaaacctctttcattgtcgcagtgaagcggcaatgaaagatatttttccacgtgtgtatagaagagctgaaaaattgaatgatatattacgcaagatgttagtcaacggttctcgctctgacaataatgccattttgttatatgcgtttttaaaacactttaagtttccacgtgattttgtattagaagtgattcattataacttaaagcgttttaagaatacggtgacagaaggtaatgttatgacctattttgaagaaaaaggtcaacaatatgaagaagttcgaaaatggacggaccaaacaaagcataagctaaagcaagttatattaaagatcttagtggatggagagctccttgtgaaaaaagaaaatgaatatgaaatcaagtcgattccgctaagtaaagagttacgagaatacgtagagcataatcccgaatatagtgacttgcttattcttacattaaatgactga

SEQ ID NO: 4789 - DNA, 600 bp, Lactobacillus rhamnosus
ttgaagaaactttcagcaggatttatttccagaagcgtctggtttactgaattttctgcggtgatctcactgctaaatgagggtaaagattgggacgacatcacgaaagctattgttgaggagaacagttttcaaatgtcgtcacgcaaccgtgcacaagatctggcgcgggagatgaaattacgaatcagtacgttgccagtcggattcgttgacatctttgatcagttatctctcagtaaccaaaagttggtgaatcttattgcactcatgcttgaaaggccattggtagaagatttcgttctaacggtcgttcaaaaagagtttttaacaggtgatatgaggctggagccatatgaaattagcgcttatttgcaagacttaccactacagcatccagaaacagccaagtggacggatgaaacgttgaagaaaattcaaacgaaatttcacgagatcttaacgtacagtggcttagcagaggatgttaagggagggatggctctgaaacgtgcattattggatccttccctaatagcattgttgaagcaaagtggcaaggctaattacattcaggcactgacagggagaaagttatga

SEQ ID NO: 4790 - DNA, 813 bp, Haloarcula japonica
atgagcaacgagcacctggagcctgaagacgaagacaacgacgatcaagccacgagtcttgacccaaaaatcgcccatcacagtacctacatcgacgagaccaagcgaatccttcaggcgtataccgaatctgaatcgtacgatgaactggagcggatggtggtcgaagacaacatcctgaacaaaaacacggacgagtaccgaacgaacattctccgcgaagtaacccggagacacatcccgagtaaagaagactacaccgagaccccgctaatgcgggtactttcagctgacgttcggagtgatgtagccgattggtgtctctactacgagttcgcccaagacccattcatccgcctcatcacgatcgaattcctctatcccgagtttcagcgcggcactctctctatccaggccgaagacatcgtcacgttcatcaaatcaatcaaggacgactatgctgaccttcgtgaccgctccgactctacgatcaatgaggcagcaacgaagtatctcacttcactcagaaacttcggcctgttagaaggtagacagcgaaaggaattcgcagtcacctacatccctgacgaaacgatcgcgtacgtcgtgtatcgtctcttcgacgaagaagctacgtccgcatcggacgtgatcgaacacgatgactggaaactattcctgatggatgaatccgaagtccagcgccgaatccgcgacatttcgccacagtacataaactatgagaaacgaggatcgacagaacgattgagaatgaaacacgagacggtagacaagttgatcgatgctttctga

SEQ ID NO: 4791 - DNA, 630 bp, Lactobacillus rhamnosus
atgcttaagaaaaccagaaaggagatcaacttgaagaaactttcagcaggatttatttccagaagcgtctggtttactgaattttctgcggtgatctcactgctaaatgagggtaaagattgggacgacatcacgaaagctattgttgaggagaacagttttcaaatgtcgtcacgcaaccgtgcacaagatctggcgcgggagatgaaattacgaatcagtacgttgccagtcggattcgttgacatctttgatcagttatctctcagtaaccaaaagttggtgaatcttattgcactcatgcttgaaaggccattggtagaagatttcgttctaacggtcgttcaaaaagagtttttaacaggtgatatgaggctggagccatatgaaattagcgcttatttgcaagacttaccactacagcatccagaaacagccaagtggacggatgaaacgttgaagaaaattcaaacgaaatttcacgagatcttaacgtacagtggcttagcagaggatgttaagggagggatggctctgaaacgtgcattattggatccttccctaatagcattgttgaagcaaagtggcaaggctaattacattcaggcactgacagggagaaagttatga

SEQ ID NO: 4792 - DNA, 609 bp, Salmonella enterica; identical to SEQ ID NO: 4572

SEQ ID NO: 4793 - DNA, 612 bp, Vibrio tubiashii
ttgataaagcagttccattatgacagcgacatggcgggtggctccctcatggtgagagaaagccgtatcgttgctggtttgctaatggacggcgtaacacctgaacagtgggatgaagcaatccgtgtagagaacgtattgcaaaaacgcacgccagcgtcagcaaagcgaaatgcaacggcgatccgcaaacgacttgagcgcctagaaccagagttctggcgagcgttgagagatggtgatgacgagctggccacacaggtggccttttgtggcgcgttggagcggaatcttttgctggtggagtttatggagacggtacttcgtgatgcctacatgtcgagagctgagcacctcgatgcgtttgtttgggcggattttctcgaagaccggtcgcatagagatccggccattggtgactggaaggaatccaccaaaaagaaaatggggcaggttgtgtttcgtatgcttgccgaggtcgggtacctgaagagtacacgaaagcttgagctacagcatgttgtggtaaggcctgaagtcaaaaccatgctcgaagagcattacaaacagagaattaaaaagtgcatggaagtgtcggcatggacgcgataa

SEQ ID NO: 4794 - DNA, 801 bp, Vibrio cholerae; identical to SEQ ID NO: 4596

SEQ ID NO: 4795 - DNA, 801 bp, Vibrio cholerae; identical to SEQ ID NO: 4596

SEQ ID NO: 4796 - DNA, 603 bp, Salmonella enterica; identical to SEQ ID NO: 4491

SEQ ID NO: 4797 - DNA, 606 bp, Escherichia coli; identical to SEQ ID NO: 4534

SEQ ID NO: 4798 - DNA, 801 bp, Vibrio cholerae; identical to SEQ ID NO: 4596

SEQ ID NO: 4799 - DNA, 801 bp, Vibrio cholerae; identical to SEQ ID NO: 4596

SEQ ID NO: 4800 - DNA, 606 bp, Escherichia coli
atgattaaaaatgacaaggcatggataggagacttgctgggcgggccgctcatgagcagggaaagccgcgtcattgccgagctgttgctaaccgatcccgatgaacagacatggcaagagcaaattgttggccacaacattttacaagcctcttctcctaacaccgcaaaacgttacgcggcaacaatcaggcttcgcctgaacacgcttgataaaagcgcgtggacattgattgccgaaggtagcgagcgggaacgccagcaacttctgtttgtggctctgacgctacattcgccggtagttaaggattttctggctgaagtggtgaacgatctgcgcaggcagttcaaggaaaagttgcctggcaatagttggaacgaatttgttaatagccaggttcgccagcatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctggggcaacaggacttgatatctattctggagggaaaacggtga

SEQ ID NO: 4801 - DNA, 600 bp, Enterococcus faecium; identical to SEQ ID NO: 4687

SEQ ID NO: 4802 - DNA, 780 bp, Vibrio cholerae; identical to SEQ ID NO: 4703

SEQ ID NO: 4803 - DNA, 606 bp, Escherichia coli; identical to SEQ ID NO: 4534

SEQ ID NO: 4804 - DNA, 591 bp, Sphingobium indicum
atgtccttcggcaccggcggcctgttcttgaacgagagcgttgcgatcgcacgcctctatcaggagctaggagactggactgcggtcaagaaggctgcgggggcaaagggcgtcattccattccgcaaacagtcatcggtgacccgctcggtccgggagatcgccaatcgcctcgaagttctcaaggcggaggagatcgatctgctttgtcatggtgattatgcggatcagctttcggtcctctggctggcactgtgccggggctatcggttcatcggtgagttcgcggttgaactcctgtccgagcgctttctgagtttccgcacccatatcacctatgacgactttgatgctttctatgcggccaaggccgagtgggagccagagctcgaggcaatcagtacgtctacccgagaaaaactgcgccagatcctctttagactcatgagagaggcagggatccttaaccaggatgatcatatttgccgggctctgctttcgccgagtttcatggccctgatcacgcaatccaacccgcatgaactgcgatatttcccgggcgctgagctcggcaggcaaaggggtgcctga

SEQ ID NO: 4805 - DNA, 801 bp, Vibrio cholerae; identical to SEQ ID NO: 4596

SEQ ID NO: 4806 - DNA, 801 bp, Vibrio cholerae; identical to SEQ ID NO: 4596

SEQ ID NO: 4807 - DNA, 606 bp, Escherichia coli; identical to SEQ ID NO: 4649

SEQ ID NO: 4808 - DNA, 801 bp, Vibrio cholerae; identical to SEQ ID NO: 4596

SEQ ID NO: 4809 - DNA, 627 bp, Streptomyces sp.
gtggaacggaccgcccctgcgtcgcgctatgcgctctcgttcaccagtggtgccctcctcatgtgcgaggcttccatcgctgcgccgctgtacctgcgcgagcgtgactggtcgaaggtgtgcgcagtcatcgagcaggacaacctgctccaggctcgcacggtcgcgtcggggcgacgcctcgcccgtgaggtcacccagcggctcgctgcgctcactgacggcgagattgaactgctcgtcgacgcgacggccactgagcgcggacatttgttgtgggcggctgcgtgccgtcgctatgacctgatcggcgagttcgccgaggaagtggtgcgtgagcggttccttctgttgacatcgacgctcacgtacgaggactttgacagcttcgttcgtggaaaggctctgtggcataccgagctgattgaagtcaaggactcgacgctgcgcaagctgcgctcgaacgtgtttctgatgcttagcgaggccggcctgctctccgaccgcggacacctggtccaagctgtgctatcggagcgggtcgccagtgtcttgtccacgcggaccccgagcgatctgcggttcttccccgccagtgatcacgatacagggagggccgagcggtga

SEQ ID NO: 4810 - DNA, 609 bp, Salmonella enterica; identical to SEQ ID NO: 4572

SEQ ID NO: 4811 - DNA, 606 bp, Escherichia coli; identical to SEQ ID NO: 4534

SEQ ID NO: 4812 - DNA, 765 bp, Bacteroides xylanisolvens
atgagagagacaacatataatagtaatctggctaaaggttgtggtatgatagaggaaaccttgactttgttatccctttatgatgaagggatgacaaaagcgactttggttgattacgttcatcaaaacaactcgttgagcaaatgtacagaaaaacgaagtaaggatattgtcaacttggtattctatcctcgttttatgaaatgcgattcccgtattccgtcttggctgaaagcaatccgtaatcgtggtgtcatgcttcctcagttcaaacaattattgatgttgtactgtgcaagagacaatgcaatcatgtacgattatattgtctcacagttaaatgtactaagagcatctggaaacaatcatataaaaagggaagatatacggcaatatatagatagtgttgttgcagaaggaaaagcatcatggggtgaatccatctgccataaacaaaccagctatatcaaggctgtattaatggattttgatttagttgacaaaagaaataatattttaccatacgaaatcgcaaatactacagtcctctacctaatgcatgaattgcattttagaggattctctgacatggcaatctggcaccatgaagattgggttctatttggattggacaaatatcaagtacaagagaaaataatgaatttgaatcttaaaggaggctatattgcacaatgttctggagagttgttgacaatatcgtggaattatcaaactatggaggagtttatcaatggggcaatatga

SEQ ID NO: 4813 - DNA, 540 bp, Escherichia coli
atgattaaaaatgacaaggcatggataggagacttgctgggcgggccgctcatgagcagggaaagccgcgtcattgccgagctgttgctaaccgatcccgatgaacagacatggcaagagcaaattgttggccacaacattttacaagcctcttctcctaataccgcaaaacgttacgcggcaacaatcaggcttcgcctgaacacgcttgataaaagcgcgtggacattgattgccgaaggtagcgagcgggaacgccagcaacttctgtttgtggctctgacgctacattcgccggtagttaaggattttctggctgaagtggtgaacgatctgcgcaggcagttcaaggaaaagttgcctggcaatagttggaacgaatttgttaatagccaggttcgccagcatccggtactcgccagctactcagattcatctattgcaaaaatgggaaacaatctggtgaaggcgcttgctgatgtcaacgccaagattattggccgtttttcgccatttttaatgtccgctattggtcattaa

SEQ ID NO: 4814 - DNA, 720 bp, Bacteroides sp.
atgatagaggaaaccttgactttgttatccctttatgatgaagggatgacaaaagcgactttggttgattacgttcatcaaaacaactcgttgagcaaatgtacagaaaaacgaagtaaggatattgtcaacttggtattctatcctcgttttatgaaatgcgattcccgtattccgtcttggctgaaagcaatccgtaatcgtggtgtcatgcttcctcagttcaaacaattattgatgttgtactgtgcaagagacaatgcaatcatgtacgattatattgtctcacagttaaatgtactaagagcatctggaaacaatcatataaaaagggaagatatacggcaatatatagatagtgttgttgcagaaggaaaagcatcatggggtgaatccatctgccataaacaaaccagctatatcaaggctgtattaatggattttgatttagttgacaaaagaaataatattttaccatacgaaatcgcaaatactacagtcctctacctaatgcatgaattgcattttagaggattctctgacatggcaatctggcaccatgaagattgggttctatttggattggacaaatatcaagtacaagagaaaataatgaatttgaatcttaaaggaggctatattgcacaatgttctggagagttgttgacaatatcgtggaattatcaaactatggaggagtttatcaatggggcaatatga

SEQ ID NO: 4815 - DNA, 675 bp, Opitutaceae bacterium
atgttgatgcgatattcatcgaattttcggagatcggccatccgttcagccgtccttaacgagaacattcttgcccgctcttcctccagcgcacgagtcaagctctatcaagagctcaaggggcgctatatccttgacgaagagacaccgctgttcagcgcatttttggaagaatggcattcttttccagacgagcgcgatcgattgtttttaagctatattctctttgctctcaacgacctgacagtcatggttacctccatcggctggctattccctttcctccgccaagccccctcagagctcaagaccggagacctagtcgcgtacttcgaacacttggcgcagactagctatcccgaaatcaaagcttggtctccatccaccctatgccgtatggctcgccattatctcgccagcgtgcgtgacttcggcttggcgagtgggggcacgcgtaaggtcactgtccgacccgcgttgcaaccggccgcgctgcgtttgctcttgaaagctctcctcatggtcaaggttccttcggacgagatcatccgtcaccaagcgttcaaaattctcggtatcgccccgagtgaaatcgtagaaacactagctgaacttaatcgacagagagtcttgcgcttccgtatgcaagccgacgtgattgagctttttctctaa

SEQ ID NO: 4816 - DNA, 801 bp, Glaciecola polaris
atgaaagatttaatagagaaaatgagtgtgcaagattataacactgcaattaaagatattgcgggcctgaaagactatacgcttgttttcaatataattagcgcctatttttgtgagcctaatttgactgactcgaagataactgatgaaaatgagtttgacattagaacttcaaaaactcgcaataaagtaagttgggcgattaataaggcgattctaaagtttataaatcaagatcatgagcttttaattaaaaaaatttatctttcagatgcgcctttaatagataagaagttttgctttttatggcacctatgtctaaataatcggttgttcagagaagtcacaacacaagtgttcagtaaagtgtatttcacaggaagagcacagatttcacaggacgacatcattgcctttctaaaagataaaatgtcttcagagggtcctgattttccgcaatggtcagaagatactttatatagagttgctacaaagtacctcagtttaatgaccaagtttgactttgtcacggtagggcgggtgaagtctttcaatcatattcgcccaacacctgaggcattagtgcttttcgtatatttctctaatttattctcacctgagataaaaagcatttttgagcatgaattgctccctgcaagttttatagccaaagaagatattcaagaccgattcaaaaagctttcaatgaaaggcttctttgacatgagtttcaatggtgtagcgctcaatgtcgaattaactcatacctataaggatatatgcgatgccctttatagctga

SEQ ID NO: 4817 - DNA, 765 bp, Bacteroides coprophilus
atgaggaatcctaaatacacaactcagttaactcatggcaccggcatgattaatgaaacattgtctctgctctctatttaccaggaaggcatgagcaaggatgcgctcattaaatgtgtgaaagaaaatgattgcctgtcatgcaaaacggaaaacagactggttcatattatttatgatgtctttttccagagatttatgaaagtaaatcccaatgtgcctctttggcttaaacttattcgtgaacgcggattgtcattgaagcattttactcaacttctcatggtttattgtgcccgcgaaaacgccgtatttttcgatgccgtcacacaaatcttgaattcatgcaaaaatgaaaatcagcatatagttgaaagggatgccttcacaaaatatgttgaaaatctggtcaaagaaggtaaagcacaatggagcgagtccgtacaaaaacgtaacgcctcttatgtccgttcatgttttattgattatgaaatgattaatcgtaaaagcgaaatcctaccttacgaggtgaacgactttacgattctttattttatgcatgaacagcattttgcaggtctttctgatatggctatttgggaaatggaagaatggcatctctttaacctgactcgtcatcaagtattggatagaatcatgagccttagtctcaaaggtgcctatatggctcagacatctggtgaattgctcactatttcatggaattacaaatcaatggaggagtttatcaatgcaactttatga

SEQ ID NO: 4818 - DNA, 639 bp, Bacteroides sp.
atgaataataaatataatagtccatatagtgcatctgttacaggttgcggatatatgttggatgaaatgaataacatcctaccattattaatgtcatcagaacaagatgcattacttaaaaaggaaattatagaaaacaaatatctaatgataaatacagagaacacacggaaacgtgctgttgcagaattcaagcttagatacaattctgtttctcccgcattttgggcgcaataccagtccttctcccgggaagctcagaatgtgggcatgttctatgtcatgctcaaaagttataaactgttctttgattttcagctgaatgtcattctttccaaatggaactctatccaacgggaagttagtaaaaacgacattataatagcaattaatgaaatatcagccaatgatgattttgttgacagttggagtgatcagacgaaaaataaagtggctgtgacatttttatcaatgctcaagaagattggtatgttagacgaaaaaacatccgagcttcaccctctgcaaataaaagatactgactggaactattacttgcttcaaaaagaacaatggttccttgaagcctgtctgttacaaccttatgaaattgaacgtattaaacaatccatactataa

SEQ ID NO: 4819 - DNA, 606 bp, Escherichia coli
atgattaaaaatgacaaggcatggataggagacttgctgggcgggccgctcatgagcagggaaagccgcgtcattgccgagctgttgctaaccgatcccgatgaacagacatggcaagagcaaattgttggccacaacattttacaagcctcttctcctaataccgcaaaacgttacgcggcaacaatcaggcttcgcctgaacacgcttgataaaagcgcgtggacattgattgccgaaggtagcgagcgggaacgccagcaacttctgtttgtggctctgacgctacattcgccggtagttaaggattttctggctgaagtggtgaacgatctgcgcaggcagttcaaggaaaagttgcctggcaatagttggaacgaatttgttaatagccaggttcgccagcatccggtactcgccagctactcagattcatctattgcaaaaatgggaaacaatctggtgaaggcgcttgctgaagcgggttatgtggatacgccccgcagacgtaacctgcaggcagtttaccttttaccggaaactcaggcagtgttacagcgcctggggcaacaggacttgatatctattctggagggaaaacggtga

SEQ ID NO: 4820 - DNA, 606 bp, Escherichia coli; identical to SEQ ID NO: 4819

SEQ ID NO: 4821 - DNA, 606 bp, Escherichia coli; identical to SEQ ID NO: 4649

SEQ ID NO: 4822 - DNA, 801 bp, Thiorhodovibrio sp.
atgcccggggagccagtcttttataccactcaactccaggccggtctgggcatggtggaagagaccaagttattgctggggctgtaccagccaggcatgaacagtgcacaactctgcgaagcggcgctgcgttctggccaatttccgctggtgtcggccagacggttacgcaacatcgtggtcgaatgtttcggcccgaggtatctcaagcatgaggtcgcgatgtacctcaaaccgctggccgaggtgttaccaacccatcagctcgtgccattgttgctggtctttaccgcacaggccaatcggattctggccgactttattcgcgacatctattggccaagctacagtgcgggacgctctgacctcaacaaagccgacgcaacagactttgtccagaacgccgtcagggacggcaaaacccgaacgccctggtcagaatccaccattcgccgggtctcgggctacctgctcggctgttgcgcggactttggcctgctttcggcgggacgttcggccacccgaagcatccaaccggttcgtatccagtcgaccaccgtgctgtttttcgcctaccatctacgctttgccgggctgagcgacaacgcggtgctgaaccaccaactctggggattattcgggctggagcctggcgatgttcgagacgagttgaagcgtctggccagcaacggctggtggatcattcaatccgccgccggaaccactcgcatcacttggctgctgccgaacatggaggacgtgacccgtgtcatcgctgcccctgtcatcaatcaaggctga

SEQ ID NO: 4823 - DNA, 801 bp, Vibrio cholerae; identical to SEQ ID NO: 4596

SEQ ID NO: 4824 - DNA, 801 bp, Vibrio cholerae; identical to SEQ ID NO: 4596

SEQ ID NO: 4825 - DNA, 708 bp, Enterobacter hormaechei
atgaatggggtgaccatagtcatggcatctaccctgcatgccgattacaatcattacttgattttttgcgagcagcattccggatttttgatgacaactaccatgattaaaaatgataaacgctggattggcgatctgctgggcggcgcgctgatggttcgtgagagcaggattattgctaagctgctgctttctgaaccagacgaaacgacctggcaacagcaaataatcgatgaaaatatccttcaggcatcctccaccagcacggcgaatcgctatgccagaacagtaaaacttcgactaatgacgctggatcgcgagtgctggcaactgattgccgatgggagtgaaagtgaacgtctgcaaatgctgctagtggctctaatgattcagtcgccgattgtcgcggattttatggctgatgtcgtgaacccggcacgccagcagtttaaagaaaagcttggtataaattgctggagtgagtttgttgatgagaatcttcgtttgcaccccgaactgggggctttttctgattcctctattcaaaaaatgggcaataacctgattaaggccctcgcagaagccggatacctggacaccccacgccgtcgcaatcttcaaactgttttcctgttacctgatgtcgctgcggcgttgcatcgattaaacaaagcagaactgctaccaatcctggagggtaatgcatga

SEQ ID NO: 4826 - DNA, 618 bp, Marinobacter sp.
atggcaagtaacaacaggtatcgaatctcttttacctctggcagcctttatcatcgtgaatcggttcttctggccgggctttttcatgagcttggcgattgggagtctgtgcgggtagaaggtgtaaagcgtaaccttctccagacaagaacagaaagcaccgccaagcgggtatgccgtgaaaccgttgctcgtttgaaaacgcttagcgaagaagagttggatttcttgactgagggcagccctcatgaccaagcgcatattttatggctggcggtttgcaggctttaccagttcgtcgccgatttcgctatggaggttataagggagcgtttcctgtcgatgaaaatcgatctgacctatgaagactttgatgcttttttcaataaaaaatcagagtggcacgatgagcttgatcaagcgagcccgtctacaagggataagttacgccaggtaaccttcaggatgctccgggaggccgagctggtgaccaaagggaaaacgatcaatagagtcattctcagccccaggttggtagggctcattcgtcagaaccatcctgatgaatttctttactttcccgtttttgaatccgatatcaaagggatgtcactgtga

SEQ ID NO: 4827 - DNA, 606 bp, Escherichia coli; identical to SEQ ID NO: 4534

SEQ ID NO: 4828 - DNA, 603 bp, Salmonella enterica
atgaaaaacgacaaggcatgggttggagacctgctaggcgggccgctgatgagcagggaaagtcgaatcatcgctgaacttatgcttaccgatcccgatgaacagacctggcaagagcagatcgttggtcataacattctacaagcctcctctgccaatacggcgaagcgctatgccacaacgataagactacgtctgaatgcgcttgataaagccgcgtggtcacttattgcgcaagggagcgagcgcgagcgtcagcaattactgtttgtcgctctggtactccattcgccggttgttaaagacttcctggctgaagtagtaaacgacctgcgccgacagtttaaagaaaagctccctatggatagctgggatgaattcgtcgccagccatcttcgtcagcagcctgtactcaccagttactcagattcatctatcaaaaaaatgggtaacaacctgatcaaggcactggctgaagcgggctatctggatacaccgcgtcgacgtaatctccagtcagtctttcttttaccagaaactcaggcaaccttgcagcgccttggacaacaagaactggtttctattctggaggggcaacggtga

SEQ ID NO: 4829 - DNA, 600 bp, Lactobacillus casei
atgaaacgaatatcggccggagcggttaaattccagttttggttcacagaatttgttcaagcaatgggtatggctaacgataacgatgatttcacagtgttgcgccaacagatcctggcagagaatacgttccatgcctcctcccatgcccggctgatcaccacgaccagtgtggttttacggcgcgtgggctcactcacgccagcgatgcgggcactctttgatcagctcgatccagtcaatcagcgcattatgaatcttatcgccatcatgaatacggagcagttgatgtatgccttcatgtatgacgtcttccgtccggaactaatcctgggtgaccggcagattgaagcttacgaaatggcagctttttttaagaaactgccgttgacgcataaagaggctgcccattggaccgaggaaacattgaggagactgcagtccactgtggcgcagtatctgcgccgggcccaaatcgttaaggactacaaggacacactggtgattgaaaactatttgctcgatgagcgcttggcagaccggctgcgcgaagaaaaccacttggattacttagcaatcctgacggggaggacgtcgtaa

SEQ ID NO: 4830 - DNA, 600 bp, Enterococcus faecium; identical to SEQ ID NO: 4687

SEQ ID NO: 4831 - DNA, 801 bp, Glaciecola lipolytica
atgaaagatttaatagagaaaatgagtgttcaagattataacactgcaattaaagatattgcgggcctgaaagactatacgcttgttttcaatataattagcgcctatttttgtgagcctaatttgactgactcgaagataactgatgaaaatgagtttgacattagaacttcaaaaactcgcaataaagtaagttgggcgattaataaggcgattctaaagtttataaatcaagatcatgagcttttaattaaaaaaatttatctttcagatgcgcctttaatagataagaagttttgctttttatggcacctatgtctaaataatcggttgttcagagaagtcacaacacaagtgttcagtaaagtgtatttcacaggaagagcacagatttcacaggacgacatcattgcctttctaaaagataaaatgtcttcagagggtcctgattttccgcaatggtcagaagatactttatatagagttgctacaaagtacctcagtttaatgaccaagtttgactttgtaacggtagggcgggtgaagtctttcaatcatattcgcccaacacctgaggcattagtgcttttcgtatatttctctaatttattctcacctgagataaaaagcatttttgagcatgaattgctccctgcaagttttatagccaaagaagatattcaagaccgattcaaaaagctttcaatgaaaggcttctttgacatgagtttcaatggtgtagcgctcaatgtcgaattaactcatacctataaggatatatgcgatgccctttatagctga

SEQ ID NO: 4832 - DNA, 603 bp, Oribacterium sp.
gtggaaagaaaatcttacagcgcaggagccgtgaagatgtctttctggttcatggagtttcgcaaggtggtgagtctcctagcagaagggaaatctttagatgagattaaagaattaaacaaggaacagaatatatttggtgcaccgacaactcttcgaagtgaacagatttatagcacagtagcaggaagagttcgtacattggatgaaagcttttgctcggtatttttagagagcgatgtggcttcgcagaagttatttgctcttgttgcggcaatggcgtatgacacattgttctttgattttgtatatgaagttgttcgagaaaaaatgatcattggaagcaattcttttgctgatagtgatatccgcatttttttcaaagataaacagcttcaggacgaaaaagttgctaaatggacggatgcaacattgaatcgtttgggacgttgttataagacgatgcttttcgaagcaggtctaacggataagggcaaggacgaaagaaaaatattgaaaccaattcttgatccggtgatgcagcgctggcttgaagatcatgatatggaagcgtgcgtcagtgcactgataggagtgagataa

SEQ ID NO: 4833 - DNA, 801 bp, Vibrio cholerae; identical to SEQ ID NO: 4596

SEQ ID NO: 4834 - DNA, 606 bp, Escherichia coli; identical to SEQ ID NO: 4534

SEQ ID NO: 4835 - DNA, 606 bp, Escherichia coli; identical to SEQ ID NO: 4654

SEQ ID NO: 4836 - DNA, 801 bp, Vibrio cholerae
atgaaagatttaatagagaaaatgagtgttcaagattataacactgcaattaaagatattgcgggcctgaaagactatacgcttgttttcaatataattagcgcctatttttgtgagcctaatttgactgactcgaagataactgatgaaaatgagtttgacattagaacttcaaaaactcgcaataaagtaagttgggcgattaataaggcgattctaaagtttataaatcaagatcatgagcttttaattaaacaaatttatctttcagatgcgcctttaatagataagaagttttgctttttatggcacctatgtctaaataatcggttgttcagagaagtcacaacacaagtgttcagtaaagtgtatttcacaggaagagcacagatttcacaggacgacatcattgcctttctaaaagataaaatgtcttcagagggtcctgattttccgcaatggtcagaagatactttatatagagttgctacaaagtacctcagtttaatgaccaagtttgactttgtaacggtagggcgggtgaagtctttcaatcatattcgcccaacacctgaggcattagtgcttttcgtatatttctctaatttattctcacctgagataaaaagcatttttgagcatgaattgctccctgcaagttttatagccaaagaagatattcaagaccgattcaaaaagctttcaatgaaaggcttctttgacatgagtttcaatggtgtagcgctcaatgtcgaattaactcatacctataaggatatatgtgatgccctttatagctga

SEQ ID NO: 4837 - DNA, 822 bp, Methanoplanus limicola
atgaaattcataaatattatttgttataaagataacagatcaatagtggaacagtctgatttttttgttaaacaggattatcccgaaaactttggattttattcaaaaagttctcatacggggcgtacagtcatgctttctgaattcataactgtaatggataacgcacccggctttaatgataaagaaattcttaaaaaaatatttgttgaagacaacttacttaaaaaagagagtatttccgggaggaaaatatctttctattatttaaagcacctttatggtctggactctgaaaataaaaattttcagggacttttgaagtactggaaggagaaatcacctgataataaaataatggcactcctttgtgcattatcccgtgatgaagcattaagattatcatccgggtatatactgtcagttaaagccggagattctgctgataaatccggtttaaaagaaatagttgataattattatcagaacatttacagtgaaaaagtccgtgagtcgatggtcaggaacctgatgtcatcatggactcaggcagggtatcttgaaggcaggtccaataaaataaggattatacctgaaatatctgtatattcgtttgcatatgcctgctatctggcatatctttccggatttaggggaaagagaatatttcattctccctgggttttggtattatgcctgagtaacttagagattaaagaatttatcaaagagtcaaacagaaaaggtttgatgtcagtaaaaaaagccggaagtgtagttgagataacatttccggaagatttgattgggggtactcaatga

SEQ ID NO: 4838 - DNA, 801 bp, Vibrio cholerae; identical to SEQ ID NO: 4596

SEQ ID NO: 4839 - DNA, 606 bp, Escherichia coli; identical to SEQ ID NO: 4534

SEQ ID NO: 4840 - DNA, 801 bp, Vibrio cholerae; identical to SEQ ID NO: 4596

SEQ ID NO: 4841 - DNA, 801 bp, Vibrio cholerae; identical to SEQ ID NO: 4596

SEQ ID NO: 4842 - DNA, 603 bp, Bacillus cereus
atggtaaaagagcaagtttataagtcaactattaagtcccgtccacttctgtttttagagatgaagaaagtttcaatcctattaaataaagggtttaaagagttcgaagtgaaagaaaaggcgatttcagaaaatatttttcaagttaatacggaatcgagaaaaaaggaaattgcatcaagtgttttggcccgtttaaaaatattagatgattatttaattagggaaattggacatggagatatagaatccagcaaggctattgtattatattccattatgaaaacagaccgtttattttttgaatttatgaatgaagtgtttaaagagaagtttgtttttggtgaaacttttctgacagatgctgattttaatatattctttgaaaataaacagcagcaaagtgaaaaggttgcatcatggaatgattatacattttataaattgaaacaagtgtacattagaatattatttgaagctggttatttaaagaatcaaaaaggtaatcgagaaattgaaagaccgttattaaatattgatgtagtagaacatatacgcgcattaggtgacggtatatatatggatattttagtaggtgaatag

SEQ ID NO: 4843 - DNA, 309 bp, Salmonella enterica
gtgctgaccgatttcatggcaacgacactgtctgatgcccgacagatgtttcgtgaatcattgcgcagcgaagactggcaggaatttattctatcccgccagcgtgccattgtcggcttggatcaatattccgaaagctcaatccagaaaatgggcaacaatgtatttaaaatcctcgcagatagcgggtatctggaatcaggccgcagtaaaaagctgaaaaatgtcttcctactaccccagataagagagtgggcaaacagtctcgactgccaaaaagtctacgatgtgatggagtcagtcagatga

SEQ ID NO: 4844 - DNA, 801 bp, Vibrio cholerae; identical to SEQ ID NO: 4836

SEQ ID NO: 4845 - DNA, 618 bp, Collinsella aerofaciens
atgcgcatcgtcgctgcccttcgtatgcagggcgcaagcgacgagcaggtcattgtacgcgtaaagagcgagaacctctttcaatatcccacggagcgcatggtcgccaaccgcgcaaccgtgtgccttcgccgccttgacgccatggtgcccacggacgccgtatgcgccgcgcgcggcatcgaccccaaaaccgccgtcgaggctgcgtcatccctaaccaggctcatggcatccggcactcccacgcagacggaccaggccatcttctacagcatgatctgccgctacgatatcgtgcgcgagctcgtgctcgtcgaggtaggggagcgcctacaaaacttcgattatgcctttacggcggttgacctcaacgcctttatgacacgctttaccacggagtatccggacgcggcccgctggactgaggccacggtcaagtgcattaagggctcgctccgccagacgctccgccatgccggccttatcggcgagggccagggcccggagtccgagcgcctgtcaccactcttcctcgatttcgatgtcgagcgagtcttggttcagctgggcgagcagtcgcttatcgcggcccttaccggcagggcggtgatgtag

SEQ ID NO: 4846 - DNA, 600 bp, Enterococcus faecium; identical to SEQ ID NO: 4687

SEQ ID NO: 4847 - DNA, 801 bp, Vibrio cholerae; identical to SEQ ID NO: 4596

SEQ ID NO: 4848 - DNA, 627 bp, Bacteroides sp.; identical to SEQ ID NO: 4682

SEQ ID NO: 4849 - DNA, 600 bp, Vibrio cholerae
atgaatataaaagaatatttaggcgatcttatcggaggcagtttattgataactgaatctagaataatcgcagaatcgctactgaaaaaactcccagaagatgagtggaagtcactgatcgttgagcaaaatgttcttcagaaaaaatccggtcagacggctattcgttatgccagaacaatccgttggcgtgttgaaggcctgggtgatgagtttatgactgatcttttagccgcgagtgaacgtgcctatgtccaaatgctgatgatgtcattactcattcattctccggttgtcgctgattttatgcgacttaccttagccgaagctcgtcgcacctataaaccctctttaaccgctgatgcatggtctgagttttatgacacgagagtgcgggcatatgccgagcttggcggtttttctgactcaactgtcaaaaaaatgggtaataacgcaattaaggcactggttgatagtggctacctgagtgatagcaggacaaagaaaatacaacctgtttacctaatgccagaagttaaagactggttagttcgtctgggccgggaagatttgattgaggtaatggagtgcacaatatga

SEQ ID NO: 4850 - DNA, 600 bp, Vibrio cholerae; identical to SEQ ID NO: 4639

SEQ ID NO: 4851 - DNA, 780 bp, Vibrio cholerae; identical to SEQ ID NO: 4703

SEQ ID NO: 4852 - DNA, 600 bp, Enterococcus faecium; identical to SEQ ID NO: 4687
